United States Patent 9,328,346 (POLYCOMB-ASSOCIATED NON-CODING RNAS) - sequence listing, part 8

SEQ ID NO: 1039 - RNA, 39465 nt, Mus musculus
cucagucuguagaacacagugucuaugcagugagugguagucucgccucugaccuuucauagccucgagagaggcagccugccauugccugguguguuucuugugucuagaguccuaacagugcugcgauccgugccauuuccaacaucugacccagaaucuucaggucauuuucucccucaaggcuuagcccagaaaauaaggacagaaaaggcucccuucgauucgguuuccaaauaguuuucaauaguucaguaacaaacccccuuuacuggugacuaguguuuuucaucauuuccccaucauuacaaaaguuucuguuuucgucugguuuugccguauucugugucucuucuuuccucucagaauuauugaucucacuguagaaaagcagaucugccuagcauuauugaucagaggaaauacuuacugaauaguggacugcaucuuuaagcaguagaggauaaacuaccuacaaaugugaauuucuuaguuucacuuaaaaguauacaccuguuaaccuuucgugugccaaaucuaaguuacguuuuccuucaaagcaauguacucuuuucuacauauguaguauguaguuagcauaaaaucauuggugccaugaagauuauuuuuaaauccaauaaauauuuaaauaccguaagagaaugggucuuuuuuaaaaaaacaaaaacaaaauaaaaaaaacccuuguaacugguuucacuuuaucaaguuaacaguacacagcgagaaggauggcucaguacuuggaaaggacccagauucagaucccagcacccacaugguggcuugcaacuggcuaggacuuagcuccagaggauaggacacccucugacuuccugggcaacacacacaugcaguggacauacauagaauaaaaauaaaauaaacuaucagcuaugaaacagaacuaccauuuccuuacaaauaucaugauuauuaaagcuaagccucugacacacacuuuuuguuuuuagaugaggucucauuggcuggccuagaauucacuaaguagaccagacugcccaagugauaggaauaaaguccugugacaccacacuaaauucuuagauuuuuuuuuuuaaccuuuguguuaaucuuauguguuaugaguguucugcuugcauaccauguguaugcaauaccugcagagaucagaaggcggcacugcaucccugagaacuggaguugcacuggguucugagccaccaugcuggggauacaauuuggaucauuugaaaaaguaacuagcgcucuucacggcugagccucuagauuuuuaauuauaaagauuacucaaagacauuauuuaaggaaaauccacaucacuuuauuucucugacauauaauuaaguauuccuuuuuacaauccaaacauacugcuuaagcuauuuauuuauaaauccuucaguaguaauuuuggcaaauaacaauggaaaaauguugaauacacugugacaccaggcagauaugauccagcagaauauauauaaacauauaucguauauacauauaugcauaugaagauaaguuuuauuuuaaaguacucuaaaaaauaaaacuaccauaauuuuacuuugugugcucuauuaaucuggggagaagggaaggugagccacauuggccuugaauuuacuauuaccugagguuggccuugaacuccugauucuccugcuucuacuucucaagugcuaggguagaauaagaauucuagaauuuugguuucuuaaaaaaaaaaaaaaaaaaaacccacagaacuauaagaauguuguucuaaucccaggugugggauauguccacagcagcugacuaugauuugcauugugcucuagcagagccgugguuuugccagcuauagauaauuucuucaauugcaugucauuuggaacucugggaacuuuucagaggguaugcaaaugugggggccccaagaaggauuguuagcgguuauuggcugcuggggguggggggguuugguugguuacuguuuguuaauagucaugaucaaagaagaaacaaaaggaaaaagaauuagacuggauagaagugguacccaacacugggacucaauuuuuauuuuaaauuccaccuuagggcuguagcuggucuuuacuacuuuguggauuuuuucuugccacccuuuauccacgccgcccagcccccccccccgccccccacucuccccaacacuagauaacagagagaggaggauagagauagaagggaaagaaauagggggaagggagaucccugaaucuaauuucuuuccuuuugcugcuucuuugagcacaacuacuaacaaaucacagccaaucccccugaacaaccaacaaccaccccaccccgucuacugggggcucuagcauuuauauaaccucugaaaaguucccagaauuccaaaugucacgcauuugcagaaacugucugcagcuggcacaaccacaccccugcuacagcauggggcaaaucacagucaccugccgcggacaauaugaagcagcccuauauugugggauuaaaacaaaaagucuuauauuucuguguuuuuaaauaaaucaaaacuccaaaauuuucaugugaaaaacuacaaaccccucaucuggagcccagucuguacagcuagucacuagaaaacaagauaauggcgcaaggucaaacagugcuguccuggcccauuucaggagcugcccagaggcaggggacagagcgagcuccaagcagaccagagucaaagaagccaacuguucuccagugaauaucaugagauuucaaguaaaacugagcugagauacaaggauccccaaaaaaguucuuagcuuauaaaacuaaguucuggcugggcaugguaguacacaccuauauucccagcacuuggaaaagugaggcagaaggacuaaguucaaagcuaaccugggcuacauagcaagauccagucucaagaaugacgcaaaacaaacauuuaaguuucaaaggugggguaugagucaauuguagaauacuugucuagcaugugacagucucugggauucaauaauguuucauaauuagucuuagauggucuuucaggaccuaguccaguguugagaaauaauuauucaccccaagcuaaauaagucacagaucuauagauuacuauugcaucaaaauaguuucauucugucacaaaagauuaauaaugaccacugaaagcuuuauaauuuguuagaauuuugcaaaauacagccuaauuaaaaguguugaaagaugccaaguguacuggaacgugccugagacauuagcacucaggaggucggggcaggaggcucaguucuaggucauccuuggcuacagaaucugaggcuagccugugcuacacaagauccuaacucaaaacaaucaaaaaguacaugaaaacacccguuucugcuccaggucucucccucauccucuagaaauggccuucaaguuccucccuugcuaauauuacauucuguguggaggucucacugagaaagcaguguuauauuuacuaaauauaacacgugaccaaacagaugcacuaagcugagucucuagguucccuagcugcagaacaaguugaacaauuuguugaaccuauccaaugacucagguuucuugaugcauaaaaacauguaacuugccacuggaauuaccuccagccaggauauaucgcguaggaugcacagcacugagggaacacacagauacaagacauucuccccaaagagaaugcacauucuuucccgacucguggaagacuuccacccgucgugggugguccaugcuaccaacuaugaagcaaucuucuuguuuagggucccacacagccuggaaccucguuagccaccucccagugacaguguugugccuaguagggaaaaacaaacaaacaaacaaaaaaacaguguguuuacuuuuauguguuagagggcagugacucucagccuaugacaaugguacccuuuuuucugggccuggagagaugucucaguagccaaaaacacuuacugguuugguucccaggacccauaugauggcucacaaccgucccuaacuccagcuccaugggacccaaugcccucuucugaccucagcaggcaucaggcacacucaugguacacacacaggcaaaagacucauacauauaaauaagauucuuguaaacagauuccccaccccacccuuuuuuuuuuuuuuuuuuuuggauaccagggucuuauguaguccaagcugaccuugaacucacuaaguagcaaaaugaccucaaacuucugaucccccugccuccaccucccagguaacgauauuauaggcauauaccacacugggaaucaaaccaaaucaaagccagcggcuccugcuuaccaggcaagugcucuaccaacugagccgcaucaccaucccuaaaacaguaccuuuccuagucacugcucuaugcacacacagagaaucuaagaacaauuacauaaccaacaaacugaauaaccuagaagaagaggacaaacuccuaggaacacaacuugccaagacugacccuaaagaauuaaaauauauuaauucauugauaacuaguuaagaggacucaaacacauauacacuaagggaagagaggaagagagagagagagauuuaagaauaaguuuccauaaaauuaguuuuucuuuuucuguuugagacaggauuucacucuguagccuggaaauuggcauguagcucagucucacuccaacuguagcaaucuucccuccucaaccucccaaugcggaaacuaccuggguugcaccuccacacucagcuuucuuaaugaacacagacacaaguaucuucaaccuggggguguagcucacuugguagagugcuuauguaucauacacaguuuuuaaauguaggauauaaauaucaacaaacauaaacauauauauaaguaauauacauauaacuauuuuuaaaagcaguugcuacaacacucauaguuaacacauccaaaaacagaauuaaaaaaagaggccccaccaaccaggcauggugguaggcaccuaugcucccagcaucagggaagcugaguugauccagccugggcuacauugagacagggggauagaugauuuuaaaacguagaugccucagaaacaauccuaaccucggacaugaaaaacuuguauacaaaaagacacaaaacacuguuaaaagaaaugggggcugagcaaccacauaaaauaccagcgacugccuguaaccccagcccugggagggggaaacaggaaugacuccagggucuugcuggcccaccacucuagccagaacagcaugcuccaagucaaugagaagcccugucaaaauuaagaugggagcugcaugugggaccucagcacugaaaccaggggaaggcggagcucuuaucuacauagcaaguuccaagccagccugccucuaagauaaauggauggauggauggauggauggacggaaggacagacagacggauggauaggauggggaguaauauccagacccugccaaucaaccaaccaaccaaagaggaaaauagucagcaucaaacacacaaacacaguagcacacacugcacacacagaaaacaaagcagugauauaaagggacagacauccuguguuuauggcuuaaaacuuaauacuaaaguauucacacuacccaagggaaucgacaaauucaaugcaaucacaauguuaucuuuuauuugcagaaauagaaucaaaaaucuuaagacucauaccaaaauucaaaagacccuaaguagccaaaaauaauacugaagaaaauaacaagaaccugacacuucauggcuucagaugcuccagccugaccaucggaccucaguccccaggccccgcaacagcggaaaacccacuccugaacaucguucuaaccuacacacacguggcauguugugcaccaaccugucuguacacacacaauaauaaaaacuaaaauguagccaguuguuggcuguacaugccucuaauccaagcacucaagaggcagaggaaggcugaucucugaauucaaggccagccuggucuacagugagcucuaggacagccagugcuaugcagagaaacccugucucgaaaaaccaaaaaaaaaaaaaagaaaacccucagauuuuaaaugaaccaauuaugccuguuuucauuuaaaaggaggugcggugggauguucuaugccuuguuugugaucauuugcacucagaaaucaguauguaaagaaaucaugcaggaauuucaucaaacuuaaaauaaccucgggcuggcaagauggcucagcggguguacuucagcuacaguguacuuauguauaauaauaaauaaguauuugggcaggagcaagcagggacugagcaagcggaaucugacuggagcgagugggccaaccaaagcaagcagagguccuaaaaguucaauucccaacaaccacaugaaggcucacaaccaucuguaaagcuacauuguacucacauacauacaucuuuaaaaaaaaaaauaacaacaacaucaggaaaagccaguuauuuguguaaaauaacaauaacucauuuuuaguaaaaugauuuucacaauuauguuuuugcaacaagguuacaagccucugaacuccuguuagcccaauguuuucaugaaaguuggauguuagcaauagaaauuaaaaccaccuggcaaugaagagacacaaacaaauacgacaagugaccuagagaguuuucuccaaagauaaacauguaaucuuacugagucccaggccauccuccugccuccacccaacagugcuaagggcacauggguaccuaccuggcucuguuuuaagcauguuuguugggauuugaacucagauccucaugacuacgcaacacucuuaacuguugagccaauuuuuaaaaaagauuuauuucauuuaugaguacacuguagcuaucuucagacacuccagaagagggcauccgaucccauuacagaugguugugagccaccgugugguugcugggaauugaacucggggccucuagaagagcagucagugcucuuaaccucugagccaucuccccaaccccuguugagucaauuuuauggccucuuaaauuuguccuuuugagaacuccccauuauuagcccacuuauuacuggaaggauuguugugggcuuucugcuuuauucucuuguguacaguuuuuaugcuuauuuaguucuuauauucuagacauuaacccugccuggcagagcuuucucucuugcagguugugcuauuagggcuuuuuuuguuguuguuaauuucaaguaaucacaccuguuaauucuagagcugaggcaggugcuaucuagccacuauauagagagcuucagaucugugguuuuauucuagcacaugccuuuaaucgcagcacucaagauacagaugcagacagaucucuaugaauuuaaggccagccuggucuacauauagauuuucaaggcaccggcgcuagauaaauaucaacagguaaacagacuaaauguagaacacacacacagagacacacacaggaaaacuauuuagcuuuaaggaaucuugucaucuguaacaacacagaugagccugaaauaagcaggacauagaaaaacaggcaagacaugaccucacuuccuuguagaauauaaaggaaaggcuaagaaccuucccagaggcugguuccuaccagagugcuggggagacauuugugaaagacuaagcuuucagagagcagaaagauucaggacaucuauucuagaacaagaguuaauaauagguuuuauauuuaaacuuuguaaagacuuacuuuuaccuguguguguaugucaguguaaguuucccaugcugagccgggcguaguggcgcacgccuuuaauaucagcacuggggaggcagaggcaggcggauuucugagucugaggccagccuggucuacaaagugaguuccaggacagccagggcuacacagagaaacccugucucaaaaaaucaaaaaaaaaaaaaaaaaaguuuuccaugugugugcagggagcugaagucacagcagucaugagcuacccugacaaccaccaauaggaguggagggaguuccaggccagcacacuugccaaaccaguguuuccccaagucagugaguagauuuuaaaugaacucauucgagaaaaccaaggggaaggaaugagagguaauggacguuaaacagaauaguuuagccauucuauuucaaaacaugcuauauacgcguccuacacauuuuuauuuguuaguaaguuaaauaagggccgggcaugguggcacacaccuuuaaucucagcauucaggaggcagagacagaggaugucagugaguucaaggccagccuggucuacacagggaacuccugaagagcuagugagacgcugucucaaaucaaaaacaaaaacaaacagauaaacuaaaucauaauauaugaaaaauaaaaaaaaugggcaaaagcuaugaagaacgggaacaaaccugcuuaaaaugcagguccugaaaacugacacugacaaagccacgccacgcaggaaccaacuucaaaaaugauaaagcaauguggagagagacucguggcguguggacuaaagucccauaaaggaguggguucaagaagaaagaggcaaccagaccacagggcggaacggugcagaggccacggaagcccagaauaaacgggcccaucaagaagucgcagucuucuugaaguagaaacacaguguaacucaagggcaauacaguccuuagcguugacugaacagaaccucagagagcacgugccaaacaagagucgggccacugaggccuacaagcaagagcuccucuggacaggacuggaagucagcucacagcacaacacaaauccaggccuagagccuccccuggacagccacgugccuagcgugcaccuucuaugugcugugcugcucacagcguccaggaccaugggcguucugugcacggaggccuaccugaugguacugaggagaggaagcugggaagauauggagcugcugucaaagacccugcaaaauaaacguugaaaacaauuagucaugguacucagauucucaaaucuuucugaaauaguguguguuuaagauacccaugauucacaguaggaaauauaauuguuacuuuauaugggaucagacucuaaccucaggugccaucuuuaacaauaaguacacugacugcuaugaaauucagacuguaucauaagcauaucuaaacacuaucacuuaaaaucccagaacuugggagacgggacacuccgaucucugaauucaaggccagccuggucuacagagugacuuccaggacuacacagagaaacucugcccaaugcgacccuccuccccaaaagguaucucacuauguaugccuagaacugucgauuccuacauggccuccuaagagcugaaauuacagguagguacugccacaccagcuuaguauguacuugcagaaaaacuauauucagauucacaaauaagcaacauacaugagggcugugggagggaacagcacaaacacuuugcaugcauguacagaaagcaaucuuucucugacucagugauagccugguagugauggcagcaugcaagaggaggacccagacuccucuacuggguagggaacaugguagaaagaagccaacuucuguaucauaucccccuccaugcucgcccagcugacgcagagcaaucaaucucuuggcacaagagcuugccugguuugauuaauacuuaaugacuagagguuuauauaguaagauaaacuccggaguguaaaugaauaaaaagggauaaaccaugggaguagaagcagucugauaagcacucugacucaucuccugggagugcucacacacucugcuagacacuaacucugcacccaaagaccugcuugccacuccugagccacacccaugggauacauucaguaggcacuuguugaaggaaagaauuccaacucuuaagaaguugcaaaucuaaaacaagauuguguauucuugaagggaacagaauugcuucccuuauagcugcauuaacugucuucacaucuuuuuuccgggcugucgagaaauugggaauacaaaagccucuuuaacuugacauuauuuucuguaucuaaguucaacugauuuaaaucgguuuggggaagguugcuauagaaaaguaccaaagcaaaaacccuaaaacaacaucuacuacuaguuuaugcaaaagcaucauuuuuugcuguuuuccacaugccugaacggggcucucccacuuccauuuaacacacuauuaagguagacccagaacaccuguaaucccagugcucaggaagccaaagcaacagggucacaaguucaaagccaaccuagaauacaguaagacacuggaggugcaagggggaggggguaaugaggaagggagagacuauaauacugcaacacuagugauuccauagcaacaggguaaacauaacuucuagucuaagacaccauugcugcagucucuaaacuugagguuccucuagacacacuuucagucuucuucguuuaccugagcuuacagucagcacauguagucaccacucuguuaccaguaacgggggagaaauaugcagaggcaaugcuuuucgagugcucagucaaggaaaucagaggcuggcuuccccuggacuucaggaaccuggcaucguaaacaugaacgucccugggacaggaagagaaauuaucagcccauguagccagccuauaaagcaaagcuaagcccaaguuagacaugcagaagccuacuacauuaagagcauuuaagacaaaacccucuaaucuauaacuuugcaggcagugaacggcauagaaaaauaaauaaauaaauaaauaaauaaauaaauaaauaaauaaauaaauaaauaaauacaaagaaacaagagcgagguuauaggucacacacagcuuuucuguuuauuauaaguuuucuucucauaaaaguagacagaagcacauucagugccaaagagacagaugugaggggucagacgugaagggacaggugugaagagauagaugugaggggucagacgugaagggacaggugugaagagacagaugugucagacaugaagggacagguaugaagagacagaugugaggggucagacgugaagggacaggugugaaggcagagauguguguuucuccaacaguuucuguuuauuaaaccaaaagaauuccuguaaaaagcauuacacucaaaacauuucuaucagugugacuaagaaauuuacuuguauggcacaaaagucagauggggaucaaguggcaugcucuacaucccaacauucagaagguagagguuuauggauuucugauuuccaggccagccagggcuacauagugagaucuugucucaagagaaagaaaagaggccgggcagugauggcacacgccuuuaaucccagcacuugggaggcagaggcaggcggauuucugaguucgaggccagccuggucuacagagugaguuccagaacgaacgaacgaacgaacaaaagaaagaagaaaagagagacagagacagagacacagaaagcuggccaaggaucuaugaaacuaaaccacauaguuguaacaugaaaaggauuaaauccuaacauugucugcagagcacaucucaagccugaccuggucacagagcuauaaaccuugagaagcuaaggcaggagaaucagcagauuucaaagcagacugagacagaaagugggacccugucucaaaacacaaaaacggacaaaccuguaagaaaacaagcauaccucaauccugcugugacaaaauacugucuggauaguggguggacaugaacaguucuuauuuuuuccaaagaugaauuaaaaaacuucucauaagaaguuccagguguccgucuaucuaccagugacaaauguccaucccagugucccacuagcagacuggaggaaucguucaagaagucaaaggaggacgggcuguuucccucauuccuguacaccuacgggagaggcagcaguccuuaaaacacugacuagcaaggugguucgaugcaucaguacucaacacacaagcugacaaucugaguucaaucccuggaaccccagaaaaagaugaugagaggcacacaucuguacccccggcuuggcaccccuacuauggcagaggguggagaggaggcuccagcaggcagccuggcuugccagcacaccaacacaagcagaaagacuaccuggaaaguaggacagcaacgaccgacuccccaaugauguccucacaccucuauaaguagcuuaggcuggccuugaacuccugacccuccuacauucucuucccaggugcugguauuacagaaaacauucuuuuagagaaaaaccaaugcucggcuggggagguggcucagugauuaagagcacauagugcucuuucagaauuucagagguccugaauucaauucccagcaaccacaugguggcucacaaccaucuguaauggggucugaugcccucuccugguguaucugaagagugacagugugcucacauaauaaauaaaucuuuuuucuuucuuauuuuuuuaaaaaaagaaaaaagaaaaccaaugcucacaucccaagugagggaguuauggaacacuuuacuuccaagugaagucuaagaauaugacuagauguucaauucuaacuauuguugauagaggaauaagcugauuaaauuucuuuuguuguugugguuguuguuuuugaaaaauggucccucaguagccuaggcuggccucaaacccaagauacacaauugaggagaaccuugaacugcugagacacaagcauaugcuaccauaccaaucuauguggcacugaggauggaacucaaggccuugucccugcuccaccaacugagcuacaucccuaguguagauuaaaauucuucacaguucauaaagcuauaucaaaauguuucauuuucaaagcugggcacgguggcuuacaccucacuugggaggcaaaagcagauggaucucugagaguuugaggacaguauaguucuacauagugaguuccuggacaaccuggacuacauagugagaccgucucaaaaaugccaaaaaauuugucuuaauuaauauuuguuuuacucaauucugauuucacugaggcaaguuguuugcuacaauaauguuggugauggcuaacagguucagaaguacaagccugucacccuggcuucaaagacugagagaaaccacacguccaagccaacauacgcagcauggcaaggcugucucaaaaaccagugcaaacuuaaagagcuuuauucuuugauuaaaagcuuuauuaguuuucugcauacggguauuguucuuggauggacuuaugaagaccacaugcaagccugguacccaagcuugccagaagaugguacccgaucuccuagaaguggagguaagauguuugugagccaccauguagguacaacaaccuaaaccuggguccucuggaagggcagccaccgaccauugagccaucucuccagccucugcauaccaauuuuucauguggguccuagggauugaacucaggucuucaugguuauacagcaaacacuuuuacaaguaaacuaucuuuuaaaaauaguuaaugcaagguuugaauaccagcacucagggaggcagagacaggugacacaguaaauuccaggagagucaggacuacagagaaagaaccugucucaaaaagaagccuaaaagauuccuucaacucuucuuucuucuguuccuuuucugccauguuggaaaucaagcacaggaaugcaugcacauugagcaagcuccaaauagucucagacagcaucugcuucaucuucuuaguguggguaaucucuucaggauguguguuaaagcugugcugggagggcagaggugggagugucccucaguuggcagagcauuuaccaggaugcauaaaucccugaguuugauccucaggacagcauaagccagucaccauggugcauaccuauagauucagagcauuugggaaauggaggcaaggggcucaaaaguucaagguuauucgugacuauguaaggagguugaggccagcaagaauguaugagacuuuaaaaaaugagguuuggcucaacaguaguaugucucuuaucuaacauacucuucgcucuagaugcaaucucuagcacaaaaugaauaugcacaaagcuuaagccuagaaacacaacagcacucuuacaauaaaaugguuauguaacaaggauaugguggcacaugcccauacuauagucgcagacaucuggggcagagguuggaggaucaccaaucaguucaaggucagccuaggcuucuuggucagacccuaccucaaaaaaacaaaaauuaaaaauaauuaccuauucauacuaauuaaauuuaacuuucauaacacuguaaggaagauaacugaaaauaauacuucauagcuaaggaaacuaaggcacagaaguuaagagacuuaugaaggucacacacacaacugguaucagacagucugggacuugagucagucccucagcugaaccacacuucucucaacaugacacaggaaucacuguggcaugugauugauaauccagaaugucaucugaugucaggucgcaaauacauuugcauaauuaccuccucaaacacagcgcuggaaaaaucaccacaucgcagugugccgucauagcucagggacaguagaugggcuggguuggugggugagaaggagaggcagcuaacauaccgacugugagcauagaaaacguacaucgcaucuucacucugcugggucuggaacaaagucgggggugaggaaaagacacaacuagggaaaggagugaugguugcugucuugcuaucauugaaggauuuacaucggaauuacacucuguccguacuaacucucaauguguucacucucccagacaggcagcaccaguaacauuuuauaaucgugugcgugcguguguguugugucugugugugugugugugugugugugugugugugugugcaacaacaugcccucauagaugccaggaugcacauacguaagucagaagacaccuugagucuguucacuccuuccaccauguugaguucuggguucaagcaugugaguccacuagacaagcaucuuuaccucugagcaucucacaggacuagaaccaacaacuuuguacugaaauucuucccuucugaacauucaguuuaaaaaugccaaugcacagcugggcagugguggagcaugccuuuaaucccagcacuugggaggcagagacagguggauuucugaguuugaggccagccuggucuacagagugaguuccaggacagccagggcuacacagagaaacccugucucaaaaaaccaaaaaaaaaaaaaaaaaaaaaaaaaaaccaaaaaaacaaaacaaaacaaaagcuaaugcacagucauauuccacauguccagcuaguuauaacggagcaaaaaaaaaaauuaaaaaaaaaaaaaaaccuaugacuucuaccagcagacaacugagaaaagagggucacuuuagcuuauugguggcaagggggacugcuaaagcuagucaaagcaacauggcaacauaccaccucaagaccagucuggucuggucaacacagcaaguccagggacauccaagaacuauacauguuaggcaagcauccuacugagauucaucaccaaccccuccauuuacuuagauacauaauacauacauacauauauguguguguguguguauauauauauauauauauauauguauauguaaaaucaaaagaaauucuagacucaggaguugaaauuuaaaguuacuuggcauaaguaagugcugugacuguaguucaguugguagaguauuugccucgcaugcuggaagcucuggaaugaaaaagacucuuaagagccugcaugcauguugaugugaguaucugguacagggggaagccaggagguauuguauccucuggaacggcaguuacagauguugugagcugccaugugaaugcugggaauagaacccauguccucuggaagaacaguaagagcucuuaacagcugagggaguguccagaccuagaucaucaauucuuuugccaagcucuacacacacacacacacacacacacacacacacacacacacacacacacacacacacacacaucacacgcaagcguguguacgcacgcaugaacauuaaaaaauaaaacagucuagagagaugacucaguacccauguguccucucaaaacugucugacacucuaguuccagaagauccaacacgcucuucuggcuuuugugagcaccaguuauggaaaacaauucagacauacaugcaaggaaaaacacacauauauauaauguuuuuaauuaaaaaauaaaaauaagccaggcagugguggcacaugccuuuaauuuaaucccagcacuuaggaagcagaggcaggcagaauucugaguucaggccaaccuggucuacagagugaguuccaggacagccagggcuauacagagaaacccugucucaaaaaaaaaacagacagagacagagagacagagagagaagguuaguuaaaaaauaaaaucuuuuagcugggcaugucacacaccuuugaucucagcacuugggaagcagaggcaggcagaacucugugauuucauagccugcuuggucuacagaacugucucaaaaaaagaaaaaagaaaaaaaaaagaaaaggaaaaagaaaaagaaaaggaaaaccuuuaaaaauucaccacaaauauggaggaaaacuuaacauucagauccuaucagacacuauuuugaacauaauguuaaaacucagaguuuucaugugauuuucacauauacacuuaaugucucugccagauaauuauacccagauggcuaaagauauucaagcuaaaagugcuagaguucuauaaaacaauuuuaaacucuaccagauuucuaaaauuuaaaaucauaaagcacaaaacaacaaaucucaaguaacauuuauaaauaaauguucuaggcuauuucuuucacacauuuccgucaggcagacuucagauaacuuccaaaagguaguaguacaacaacuuaccaaaucccaaaguccaauuuguccagacuuggccccagcugcuaccaagguucucacuucugauggguggagggccacggaggagauugcuccuuuggucaccuuacgaacaguagccucacugaugaccaugccacuuaaauuggcuuuauagcuacaaaaauugguaaguuaaaaauuaaaacaaccagccgggcauaguggcgcacgccuuuaaucccagcacuagggaggcagaggcaggcggauuucugaguucgaggccagcccagucuacaaagugaguuccaggacagccagggcuacacagagaaacccugucuugaaaaaccaauaaauaaauaaauaaauaaaacaaccucaacaguccaagaaaguaaaaaauaacucuuugcuuaugauaaugaaaaaacguacaagguaaauacuggcaaauauccaacucccaggugacaacagaaaacaaagucaucaagguaauuauuuuucaauuauaaaauuaacuuugaucauuuuaaugaugacagcaagccuuaggaggcuacaguuaaaucugauaugcuuguccuggagacacagcuuggcagaggcagccacagaggauccgcacuccuggcccuuguccugcuaguagcauaaaagauuuuuagaaaaaguucagggaacugauucaaugguguauaguaaaagccauaaggauguccccaaugcauggcucaugagucccaugucuggaacucuaaccaacaggcuauuagcauauaugcacauacacacgcacacacaaacuaaacagaaacuaacuccaaacaccaaaagggcaagagaaagugcgauguaguaacugugcagacacgcacgacacaggcacaguguggaaguauauacacguuagaguuacacagaacgcacaccauguauuuaaauaaaaugugaauuccuguacucagcacugaguauauaccauaugccaagcugucauagggcugagauaaacucugccuucauaaagcuuccacccagugucaggccaggccuauugcugaagguuauaucuuagcaacuucagaagugaggacugcaaagccaaggccugacugcuuucaggugauaauacugauuuaaaccugacacaauuuagaaucacuugucaagaaucacuuggagaguccaguaggucugaggaaugucuguagagaauuaucuugacugaggugggaagaugcacccacuguaguuugaucuauucccuaagcagagaauccugaacuguguaagaggagagaaaaggcgggguaugaugaugcacaguacaauguggccuggacaacuucgugguacuucauagagagauggagagauggcucaggggcuaagggcaguugcuauucuucacccacaaggcagcuuacaaucaguucccagggaugcagcauacucuuccggccucugugggcaccagacacaugcagugugcccuuauguacaggugggcaaaacauucauacacauaaguauuucagauacauagagccagguguggugacaaacacauuuaaucucagaagacagagcagaggggagggaggcagagagagcucugugagguugaggcuagccagaauacacaaugagacugucucaaaaagguaaaaaaaugaauaaaauaugcauaaaauaaggcuagagacauaguuccgugguacagcacuugccuaguacacuguaggcuuuaguucaaucccugacacuacaaagaaaucaagcaagcaaaccauuguuagcauagaaauaguacggaugauuuuuuuucacuuuucaagguuuccuauaauaguauccauuacaccuuuuauauugcaagcaucucaaaguauaaaacaaaggucaaaaguaaaagccaaggaauuuuaacuuaccuuuuaauacuagacagccccuucuuggucuucucauuacuugucuacaacauuagaagagaccaaagggcuaagugaauaugcauacaugaaauuuccuuaguacaugauccuaaaagccguaaaccaucccaagugauaccuggcucaucucugcccaugucuucaaagaugcuuucaacaguucacugcugucaucuugguuuucaggaaucauuucuaaggguccaggagguaacaaaggcuaucaaaaagaaaaggcaaaccaugguuuguccuagaauguaaacugagaagggcuaggggcucaguccucauugucacuacuuccuuucagcaccagaaacugugguacaccagucauucaaaaugguugggugucacacagugcacuaugguacccaccuguaaucccagcauucaagaggaugaagcagggaucaugaguuucaggcuagccucaguuacauaguaauccccuagaaaaacaucuuccaaaauuaaugccaaggaaggccuaagaugaaucucauguggcagaaugcuugccuagugagccugacacaaaccggcuacuguggauuucaccucugaccccagcacugggaagguggaagcaggaucagaaacucaaggucacccugaacuauuuggacugcaagaguucacuuuuuuuuuuuucuuuaaaaaagcuaugucaagggauccucuuuuuucauuuuguguaugugugauguaugugcguguguguucgagugaauguggagggacaggcccaucacccauauagaaauauguagaaaucagacagccucugguguugguggucccaccuucuaucuugauuugaaacagggucucuacuguuugcuguccaccucacuauggaauuaaguacacggugccacacccagcuuucugugggugcuggguacucacauuuguacaggaagcacuuuacccggugagacagcuccucagcucaauccuuuaucaguuuggucauauauuacucaguauuaauucuuaugaagaccuuuauggauucuacuuaauuuccuuuuauaacauuuuggaacuucuguucuuuuauucuaggaauauucuuacucucuauucaggcuagccuggaacuaugaaacucaacucucuuuaaacuugugaccauccuccugcauuagccucccaaacaccaagauuacacaugggacccacauuuuuuaaaucugaaaacugaagcucacgaagagcaagugauuugcccaaaacuccacaauuccugcagagaaacaaacuauuacccagaacuaacaacucuaaagccuuauuaagccauacaauauucaaguauugaaucaauaaaauugaaacaaaacaaagauccacuaguauaauuucaaauacuuuacaccauucuucagauucugcuuaagcuaaaugcacuucauuuguauuucuucuuacauuuucuucuucuucuacuaauguuggcuguguuggagaugcugguaaugaaacucccaaagggucuacuuucaacaaccgcauggaccuucgacauccaauuucauuuucuuucuucuuaggccucuuucuaaaggaguggaggaaauacgcaugcuuuucucacugaauaguaaaaugcauuuagcaacuuuuaaaaaucuuucuaaauuuauuuuuauggcuaucuuggguguuccuguggaagcugauguauaccaugagugugccuggugcccaagaaagccaggggcauccagucauguggaauuggagcuacagaugcuagugagucacuucugugggcucugggaaccaaguccaggacacuggagaggaacaaugugugcuccugacaacuuagcccucucuccaguccuauacuuaguaauuuaaaggaaugaacaucuaagaauguguaccagagguacaaucacacauuuuauauauaaauauacaaagcugcacugucauacucgaguguguguguguaugugugugugugugugugcuuauuuguacgugaaccauauacauacacugcccaaagagaucagaagagguuguuaaauauccuggaacuggaauuacaaccaguaguuagccucccaauguaauugcagggaaucaaaccugaguauucuauaggagugucaaguacucuuaaccacugaucuaucucuugggcagcacugauuuuaauaaagucucaaaauaaccuaaacuaaaaagcuuagcacaaugaaguugagagccauuaaacaaaacauaccauauauaucuaauagaauaaugucagaugccaggcagugguggugcaugcaugccuuuaagcccagccagcacuuggaaggcagaggcaggcaggucucugagaguuccaggccagccuggucuacacagggaguucuagcagccaaggcuacacagagacaccuuaucucaaacaaugccaugcauaguggcucacacuuauaacccagcaaucauaaagacaggaagauuuccauuaguuagaaaccagccuguaagcuacauggugaguuccaaacacccugagauacauuguaggccccugcccuuuuuuccuugagacaggguuucucuguguaagccuugcuguccuagagcucccucuguagaccaggcuggucucaaacuuacagagccugccucucucuccugagugcuuccugggauuaaaggucuguuccaucuuuacaaagcugcgggagacccuuucucgaggaaaacacaaaacaaaacaacuagggccagagaaaauggcucaguggucaagagcauuuguucaugcaggaggccuggcucacaaccauccguaacuccagccucaggggacccacacccucuccuggucugcucagcaccaagcaugcaugugguacacagacauacaugcaggcaaaacauucauacacacaaguaacuaaaucuaagaaacuuugcaauuaaaacaagaaaagaaaaaccauaucuaauaaaauaauaugcgucuauaaaaaugaaauaugacuuaggguauaucucugagagagaaagccucuggccccuggccaucacacacacacacacacacacacacacacacacacacacacacacacacacacacacacagugaaccacuaaaaacaugcggugaaacaaauaaaaaaaccagagggagagaaagcugaggaaagagaugccucuuagaguacuuccaaaaacuaauggauaagguuggaaauguagcucaauggugaaguucuggauuugcucaccaacaauguuuuuuuuuuuuuaaaaaaaaaaaaagguaauagcauagguaaugauuuacacgcugcucauacaagcugcauaggaaucuauuuccagagacccccacucacccacaacugcucagacuucagaaugcucugaacaguggcuagagugcagcucagugguuaaaaaccacuugccuauugcgccguuccaacccccagggaucucccaugacacaauucuuuuuuuuuuuaaagauuuauuuauuuauuauauguaaguacacuguagcugucuucagacacaccagaagagggagucagaucucguuacagaugguugugagccaccaugugguugcugggauuugaacucaggacuuucagaagagcagucgggugcucuuaccugcugagccaucucaccagccccaugacacaauucuuacaggacauuuaauuacuguacagagaaaacuuaacuguuagcaaaauauaaaagcuuagauaggggggcuggagagaugguucugugguuaagagcacugacugcucuuccagagguccugaguuaaaaucucagcaaccacaugguggcucacaaccauccauaaugagaucugaugcccucuucuggugugucugaagacagcuacaguguacuuagauauaguaauaaauaaaucuuuaaaaaaaaaaaaaaaaaaagcuuagauagauaaugacuucuucagaagcaguuaggugcauccuggagacaguucaguuugggugugccucuaaaagccuccauagauacgaaugcuaaggaauggaaaguugccgccuacuaaggcgguaacccuaaccccaacccuaaccccaacccuaaccccaacccuaaccccaacccuaaacccuaaacccuaaccccaaccccaaccccaaccccaacccuaacccuaacccuaaccccaaccccaaccccaaccccaacccuaaccccaaccccaaccccaaccccaacccuaacccuaaacccuaaacccuaaaccccaacccuaaccccuaaccccaaccccaaccccaaccccaaccccaaccccaaccccaacccuaacccuaacccuaacccuaacccuaaccccaacccuaacccuaaacccuaaacccuaaaccccaacccuaacccuaacccuaaccccuaaccccaaccccaaccccaaccccaacccuaacccuaaccccaacccuaacccuaacccuaacccuaacccuaaccccaaccccaacccuaacccuaaacccuaaacccuaaccccaaccccaaccccaaccccaaccccaaccccaacccuaacccuaacccuaacccuaaccccaaccccaaccccaacccuaaacccuaaacccuaaccccaacccuaaccccaacccuaacccuaacccuaacccuaacccuaaacccuaaccccaacccucccuauuaagggaaguagcuucagagaggucuaugaccugaggcaaagacaauuggguggccuugagcuauccccaccuuaaagguaaaacaguucacuccuacagacuuggcuggcagcaccacccacaaugauaaugaggcgcagccugccaagacugugugggaggagcaagagacuuuuuauaagcaacaggaccuucgauauaucucucucccucucuccuuccucacaucccuaccuucucucuccucugacuucccuuuucucaguuaugaaaggagcucaagguaagagacaggaauugucucuucggacuuucaguaacagcagagaagcagugggcaggacacacuaaaacagucuucuaggaaagagagcuuagaagcccucuaaaucugaggacagauagagauuucuaaagagguagcaggaucaugcuucuaaauagauauucuguguauagcuaagaaaauaaaguuaccucccugagguagcagguuuuuaucucaguuuauaccuccaccucuuuacagguauaaauauuagauaauuaaagcagguacagagaagcacucuucauaaugauaaaaaucuggacauuaaccauagaauaaacugaggcagugggugcugcaaugaggcagugugcacugacaacacaaagccaagagaaccacaagucugaagccagucugagcuacacaguggaauagguacaggcaaacagggcugcacggggacccaucucagaaaacaaacugggaggggagacggcucagcagguggucaguugcuacaccguguaaaaagcuggauguagacaugcagaccuuuaaggccagcauuagaaggugaaaugaggaggaugcuaagagcuagcugacuagccucgcucaaaagagacagcuuccaguucagugaaaauaagauagagaauaagagagcgacuauguccaaugugugcaugcaugcacacaagcauucauagccacacacucaccugcacauaccacauacacagagcacaugcuacacaccugugcaugcauucacacagcccucaugcccacacucaccugcauacaccacauacacacagcacacacuacacaccugugcaugcauucacacagcccucaugcccacacucaccugcauacaccacauacacacagcacacacuacacaccugugcaugcauucacacagcccucaugcccacacucaccugcacauaccacauacacagagcacaugcuacacaccugugcaugcauucacacagcccucaugcccacacucaccugcauacaccacauacacacagcacacacuacacaccugugcaugcauucacacagcccucaugcccacacucaccugcauacaccacauacacacagcacacacuacacaccugugcaugcauucacacagcccucaugcccacacucaccugcauacaccacauacacacagcacacacuacacaccugugcaugcauucacacagcccucaugcccacacucaccugcacauaccacauacacagagcacaugcuacacaccugugcaugcauucacacagcccucaugcccacacucaccugcauacaccacauacacacagcacacacuacacaccugugcaugcauucacacagcccucaugcccacacucaccugcauacaccacauacacacagcacacacuacacaccugugcaugcauucacacagccuucgugcccacacucaccugcauacaccacauacacacacagcacacacuacacaccccacauggggggaugaaagaauaaaucugggucaccaagaugguucagugucaaagggaccuguagccaaggcugggacccacaugguggaaggaaaucaauucccacaaguugcuguaggauguacacacccauaaacacaaaauuuaaugaaacuuuaaaagauaauccccaaaaaauaugaaaauggcaucagauuauaagcaucacucgaugguucacaaguucaagacagcuuguguuacaaggugugucucaucugcaugagaugcaaaaaaauaaaaaaagggcugguggcacagaccuguaaucccaguacucaggaggcagaagcaggaggaucucucugaguucgaggcuacacuagucuacagaaagaguuccaggacagucagggcuacacagacaaacccugucuugaaaaacacgaaaauuaauucuuuaacaaauuuaaaccuggcuuuggucuaagagcaaguuccagaacggccacagaaacucuaccuuaaaaauuuuuuuuuaauuuuauuauuaauguauauuugugaguguaugugugagcuuauaaucucuacauugugcagaaguccccagagaccagaagaggggucaaauucccuggcaguaaguuuaagcagccaugagggugcuagguaccaaaccuaggucgacugaagagcuguuaaccacugaaccagcccagauuuguucacuuucaaaggcucuguccucuuuacuauccaacuacaacccccacgcuaccaaccugauaccucugccucuacaaacacuaaaugccagaaccuucagacucacaugacuuccaaggaaucaccaaucuuugugaacaauaaaugugugagcuaggcaacagggcacacgcccaugacccaaacacuugagaagacaguaagaagcuugaggccugagcccugucgcaaacuugaaacccucagcaacauuucucgguccaacuugaaacccucagcaacauuucucgguccagaggauguuaagcacauccucuucuguuuuaccucuuugacucaggugacucgcgcuucuuuaucaucccacggagccgugcagccgacugaaaagcacacaacauauauguacacauaaauaugcuaccauauagcuacacuguuuacccauuaagugucugcuacuauagcuacguuuauuuagaaaauauagagucuuaagaugugauacuuauuguuaguagauaaauauaccgccugucaauaacaaaagcgaguauauaucgccaucuaacauacuggcauucugguuccugaaccaaggugcuuaugaguuuacaggauuaaauacaguauuuaguaaacauacuaccacaggacgggcaguguggcucugaagcacagcaccugcucagcaugcauaggagugccuguauucacaacacugcaaaagagaacuguaaaaccuauuauguggagugagguggcucacacuuaucuauaacccaacauuuaggagucugaagacaaaugcaguacguucacggccggcuuggcuaccaaggcugucucaaaauaaaagagccagugagauggcucuguaaaaacaaaacugccaagccugacaaccuggauuugggcuccaggacccacgugggacaggaccacagcugaccucugaccuccacacaugugccauagaaugcacuugucuuucucaaaauaaauguagucaagaaauuggaagagucagccauggugaugcaagccuuuaauccuagcacucaggaggcagaggcaggcugaucuuugagcugcaggccagucuggucuacagagcaaguuccagggcagccagggcuacacagagaaacccugucucaaaaacccuaaguggaugacuccugaggcaaacaccugaaugacuuauccaugauugaccuuuggccuccaaauauacacacaccaaaaaaaaaaaaaaaaggaaaaaagaaaaaaaaaugccuagacucaauuaaacacgguaauuaaaaacauggaucgggcugccaucagacaucgcuuagaagaggagcccaguaaguaaauaucaagacccucugggaaccuacuggcuaauaaacuuucccaagugguuugcaguccucuuuugcugaucuugauuuuugagauaggguuucauguaacccaggcuggccucaaacuuacuauguagcuuagggaugaccuugaaauacuacaguccagccuccacuuacguucagggaggggcagcaugcaacacccaccagcaggcucacaagugucuaaaacaggacauacaaagaaaaacaagcagcuaagcacuguggcacacgcuuuaauccaagcacugugguagguagaggcagacaagccacuguaaauucaaaaccagccuggucucugcagugaguaccaaagcaggaggacaaugaccacaaaccaccuugcgucacacacugcuugaauuuugccuucccucauaggacacuauggaagauuagaaucuaauuagcucacucucaguuucuuuucuuuuuuuuuuuaagauuuauuuauuauuauacauaaguacacuguaguaagccaccauguggcugcugggauuugaacuuaggaccuucugaagagcagucaguguucuuaccugcugagccaucucuccagcccaucaccuucacuuucauuacaaacuucauacauaccucagcuaacugaagggaagcaaaaaaguuugcauuuucucugauguuccucagucucuuccuuucauaaggugacaauccugaaaaaucauccuauaaaauaagcgacagccacccaaaaaaaaagaucagucacuuccucauugauagcaagaacauguaaaaccagacacucacucucuacccagauacuuccuuucaaacugcacacagacacuaauuauuucauauuaucucaacaaacaguucacagucuuugcuggaugggauagugggagaauccuauccugggaugacuguaugguuuuccauuuaaaaaggaaguaaucugccugacaugguagcauacaccuuugaucccagcacuugggaggcagaagucaauggaucucggaaucuggucuacauugugaguucuaggacagccaggguccugugucucgaggaaaaaaaaaguaaugagauacugggaaccaaaugucaugcauuacagcaaacucuuuccagcaggugaaagauauuuuuaaucaucaucaaccaugaaacacaagcaaucaaugaauacaugcaugggugguucacacuugcaaaucccaccccuggaugacaaaggcaggauuccuggggcucauucuuuaaaucucacaucuuuauauuuauugugcaugccaaugugugugcauccacauaugaaggucagaggacagcucugaaaaccuggcucucucaccauguggguccuagagauucaaugcagcgucggccuaagcaaauggcaccuuuaccuacugagccauuucccugggccacaauuuaaaaaccaggggucaggggauuacaagcagcaaagugcugggugccuuauuuuugugaacaugugcuccaaaauagaauuauguguauguguacacauauaugugugggauuaucuuacuaagaacaugugcauuauuacuuugaccaaauaaauaaucuucuccaagggaaaguggaauguuugcauuuggcauugccuugguuuuguugaggcaggguuucuuuuuuuucuuuuuuuucuuuuuuuaaaaaaaacaauaguuacaucauacauguguauauauguacacauguucuuuuuuuuuuuagagauuuauuuauuuuauguauacgaguacacuguagcugucuucagacacaccagaagagggcaucagaucccauuacagaugguugugagccaccauguaguugcugggacuugaacucaagacaucuggaagagucuuuucucaauauauacuuuauugggcuagagagauggcucagaaguuaagagaacugacuguucuuccugaguucaaaucccagcaaccacaugguggcucacaaccauccauaaugagaucugacccccucuucuggugugucugaagacagauacaguauacuuacauauaacaauaaauaaaaucucugggcuggagcgagcgaggcucuggagcgagcagaggucuugaguucaauccccagcaaccauaugauggcucaccacaaucuguacagcuacaguguacucauucauaaaagaaauaaauaaaucauauauauauauauauauauauauauauauauauauauacacacacacacacacacacacacacacacacacacacacacacacauauugguauuuggccugcauguaugucugugugagggugucagaagucuugggacugcaaucacagacaagugugaacugccacuugggggcugggaauugaacccaggaccucuggaagagcagcaauuguucuucauuccuucgccaucucuccagcccaagagaggguuucagacaucccaggcuaggcuugaaccuauauauggccaagaaugacccuuuaacuuuggaucgaccugucucccaagugcuagcaccaucccaaguguauacacuaccucagcugcugaugggugcugguaaugaauccaagagcuucuacagggaggggccacucuaccaacucugcuugaucccuacucccuccaccauccacuuucauucucccguggggucaggaucuugcuacuuaggcuggccuggaacucacuaaguccaggcugaucacacacucuuagugcuccuuucagucucagcacacgccaacaagcccaacuuugucaccacugccuuauaacuguggcuuccuagcuugaugaccugaauuugaucccccauauccacaaggugggcaggaaagaaccaacucucaaaaguugugcuuugauuuccaacuacaugaacccacaaucaaucaaaucaaucaauaaacauaagaauaacuuuuuaugucguuucucaggagugucacaagcacuauccuugagccuacaguuucagucauagucaaccaggauucaaaagcauccacuggaacuuucagaaauaaacaauucauaaguuuuaagcucugugcuuuucagagaagcauguaaaaaaaaaaaaaagaaaaucucacaacucugaaauguuauacacugaacaaaacacauuaucaugucucccuacccccaagggacauauucuaagacuccuaaauggcugccugaaacuaugaacaccauaaacuuuacauauaauuuuucucauacauauauuaugccuauaguaugcucuaacauaaccuagguauaguaagacacucgaaacagaggcugacggugugguuuaacacuugcguaccacaguaaagaccauguguucaauuucugauagcacacacaucaaacaaguaaguaauaaaaucugagggcugaagagauggcucagcaguuaagaguacuuacugcuuuucuagaggaucagaauucaagucuuaauuccuacaucagacagccauaauccagcacucgcacacauaagugacacauacccccucagacacacaaucuaaagucauaaaaaaauccugaaaaaaaaaaaauaugaguuagcccaagcaugguggcacaugucuucaugcccagaacacaggaggcaggggaaggcagagcugagguccagguuagccuggucuacacagaaagcuccagggcaucagauuuaagauuccaucuuaaaagaagacuuaaaauaaagugcagggccggagagagaacucaggcaguaaaggcacuugccuacgaagccuaagagcagauucccagaaguagaaagaaaaccaacuccuauaagcuguccucugaccucaaugcucuugcagaagaccugaguuguguucucaguacccacaucaggaggcucacgagggucuauaacucaguuccaggaaaucagaaguccucuagucuaagggcacucaggccaccccuacaugcauccacucacacaaagauuauaaaauggagcuacagagaugacucacuggcuaagagcacuugcggcuaaugcagaggaccugaguucaguucucaguggcucucagccauguguaaaaugauucacuaggcccugagaacccucuucugaccuccacaagcaccaagcaugcaagcggugcacauucauacaugcaggcagaacacuuacacccauauacgccaaauaaagcuaaaagaaaauaaauuaguauggaauaaaaguaaagaacuuuuaagaaauucaagacagccaagugguaggagacccugucccaaauuuuaaaaauuauuuuuaaaaaaaaagucguuagaaauucuuuauauaccauugaugcuaaaagucgggcccuagaagaagcaucgccaauaucuacucacaguucacaguggagaaccucuguccagagcacggacgaagagguguucaccugcuaaccccacacaggaaagaccuuuacccagcuguuguuaugacccaugaauauuguauuuucuagcuauguaauauuguguccuugcuggauguguuggugcacaccaugaauuccagcauuuggagguucaaggccagccuggucuacaaagcaaguccaggaaaaccagggcucuguuacacagagaaacccugucugggggaaaaaaaaaaacaacaacaaaaacaaaacaagagagagggagagagggagagagagagaaaagaaagaaagagggagggaccaugcaaacauuagugcacaauagcuuggguuuucaauuguuacuuagggucagaagcaccagacuagaaggauguguaaauaucacuuccucaauugccuguaaaagaagggcaagcugccuuggggaaggugaccugccaagaggaaggugaccuucuccaaagcagcucccaaagccaacaaguaaaguaaggaaaauaucuuuuugaauaacaaagcgaccagagcuagagcagaagagcuugguggacucagaugcgggaggcuguggcagcacagaccugggaagcaggcacugaaaaccacauggagagucgcaauggcacaagucagcuuaaguuagagacuagcugagagacugccccagaagaaggccaacagccuucaacuagagaagccuucucacuagucuaccuagacucuagcugguccagacagcuuccugcacuuaggacaagguuucauuccgcaagugacaaggaguggcugcagaggggcugugacuaucuacauaacuaacaaggccagcugggacuaucucauagcugcugguaacuccaacuccaggagauuccacgcccucuucugggauccucacacauauaaaugagaagacauuuuaaaauaaguuucuaugccugguucucacaaaauaccaucccuuggaggaggcaguauaagaagaaaacucugucuuuaucccaggcuagcuucucauuccuccugugucacaccccuguaauguugugguuacaacuauaugcuacuacccccagguucucacaaaauauuuugcuguucgucuaagacaccuucuuauagaagagcuacaaacugaaaucucagaugaacaaaaaaugaauugcaagaaagacaaccuccaacagcacacccaaggccugacaccaucucaggaacacacuggggcucuugaaacaagagggggauuuacuuuauaacuuauuaaaauacauuucuaggugauucuacaaaauaaugaaaagcgggaaugucagguuugguauuucuguaauuccaagcacuuggaagcugaagcaggagaacugccaagagccugggccgacagaugaguucuaggccagccuaugcgucugugaaaucauaccaagcaccacaauaaaaaacaguaaugaugauguaaagagaacaaacuaaugaaccaucugauuaaguuaucuuagccagaccccggaguacagggcuacaaucccagauaaugaggaugacacaaaaggaucaaaagucccauggccaaccuagccaacaaaguaagacccuguuucaaaauagaacaugaaaagguggcuggaaaucugucuccuuagaacagugcuucucuagcaugugugaggcccuagcaccacagaaagauaaauaaaugcugcaauguuuauauauauauauauauauauauauauauauauauauuauuuuagggauaacaccacuuaaacaucuauacaguuguaauuucuauuuauuauaugcaaacaaaaaucagcucauacagccaacagucuuggcuuaagacauaaucuaauccaacaguucucaauguacaguuucagaccaauagcaucagugcuguaagauauuauagaaggugggcuaugguggucagcaucuuaauccuaccauuaggcaugaagaggcacagagaucucugugaguucaaggcuaguguggucuacagaguagacaagcaggacaaccagggcuacacagggagacccuguuuugaagaacaacaugaagaaauguuaaagauaauauuaaauauaaaguaaauuuagacuaaauuaaaagguuuacaagaugaaucaacagguaaagguguagagggauuguaauccaguagccaacauggcuacacgcguuggaaugcagaccuguccuaagcacacaccuuuauuuaaacccagacagugaagaaauaguuccguuucuagaaggaagcacccaguuugaaagugguaucugauugaguggcagacaaagugacaaaucagagaaagaucugacugaacaggauaugcccaacucucaagcaaacagaaaggaaggcgaaccuacucaaggggcagggcagagagagaacaggcagcuuuaccgacagacaccgucauagagacacaggcugcagaagagaacaagcuagacucaggugaagacagaaugagaaggagccagacgauuacggcauacugccaaguuagaaugaggccaagcagaacauuucagucagaggcugagaaagaagccagacugaagcagucagcugggagcagaguuugagccagaaaaguucagaaagaacuagaaagggugagcuuuuacagcaguaagucugacaggcuaagaacuuucuaggccuagacuagaugguaaggagaccggaagcuuccagguguaggccuagguuagcagauggagguaguaagucucugagaggacaauuacaucaggugaauaagugauuuuaacagaaaggggccugcugucaucccugagaaccugauucugauugcuauaaccuccacccaccccugugucaggcacauacaugcauucgcacugcuguuuggacacacgcaagcacacggauacacaaagucuuuucuguuuauauuagaugauaaaacagauuuugcuggagguccuucacuaccuuagcuuucagagcuucuaguuucaaaaugagaaguagaacagcuaaugaaggcucaccaggccuggugcacugucuucgucgcugcuuuccgcguccacacugagagucgcugaauccgagguccucuugggucccagccugguacuuucaguauaagcauccacggaugauuucagcagaagggaaucugccuuggaagauaaggccuucauuuuugaaguuaaaaccuuucuacgagucuucuuccgaucuuucuucuuauggaccacugauuugcuagaauuauuuacaaccggggauuuggacaacuuaaguaggccuagcuuggaauugcugagugaaaacggguaaagauaaaccuuagcuguuuuccuuaaaguuguaaucuguaucggucucagagaaguauaagcaauauguucauuuucuuuauauucauucaccuauucgggaaauaaaggaaaagaguauuaggaacgccggacuaugcucuuccauagcaaagcaugaaacaaaucugcuuaaacaagucuaacuccuauuccacagucacaugauucaaauugauggcuuguuaggaaauuuuuugcuccuccaaaauuuggauacaaaaaucucuaaccugaccagaaauucugaaggcaaauuucagugugaggugauuacaacaaaggucagauucagguuaguuguaauugcuuaaagcucacacuaacucuucaaaacaacugcaggggagccaggagaaagggccccaaguccuacaauccuacacuacagucuugggguuggccuagaacucacaauguagaccagugacaugguggccucuaacagauuuccaccuguuucugccuugugaguuacgggauuaaaggcaaaccuaccauaauuccuggaguuguuaguaaauuuuccucaaaauuuaaguaccuaauagucuguuuaaauuugaaaaaaaaaaaaaaaaagcagaaaucacagcuuuuccuuggcgccaggugacagugacuagcagaucccucccgggccgaaucaggucucaccugcacaaggggacacuguuuggagccugccuuuuccucagauucagccuuggacccagacauauuucugccacucagcugcugagcucuucccgcugcgaccaaggcgagauugggcggggcccgagggaugugggcgggcccgagggaggagccuccgcggucagcacggaagagcuguguggauucccugggccauuaaggcuucuggcgccuguuuuguuuuguguucuggauagcucaccccucugcaccuucuaggucugaaccugcaggucaccuuucgggcaggacuggcucacaagccagcuccaaggaugcgccuguguccauccccucaaugccggggcuuuuaccggugcugagaauuugaucucaagcuucaaauuugcgcggcuacagcucuuaccuaccuagugagccaucuacccggcuguguuuuguuuuguuuaaacccagcuacaucucucuaugucacccuagcuagccccguaauccuacugcucugcuuccggaaugagggggugcaggaucuaaaucagcacuuacacuggauccuguaauauugagccuuguacaccucgagaucuugcuuuuaaaaauacugcuguuuugcagcaugaccucuggaaaagauccauauccucauaaauaucauaaggauuggaagaaaaauaagcauaaaagucaauaggcagaacuugaaagaaauaacacaggugcuggcauuaggaccuguguuugauucccagcacccaaauucaagcacaggugaugcaagacaaguggacuucugcagcuccauggccaaacugacuaaccugaacacagagcccagguccaacagacgcugucucaaacacaagggagaugaugcacagguuaggaugcuugccacccaagccuagcaucuuuaucuuacucccagagccuccauaagggccauuucuccauuucucauuguuguccucugaucuucauaugugcaccagagcaccucaauaacaauaucaauaagaauuuuuaaaaguuagauagcuccugaggaaggacauucaagauugcccucugaaccucuaugugcauguauguacacaaaugaacucccaccaccaccaccaccaccgaggugugcacucaccccgagugcacaccaacaagaaacauucagccguuacuucugcccacuuucuugcaauacaacuaugagaaaauuacgccucaccacugcuauacaguuuucaaucauaauaaagggaacagcuaagcacggugaaucccgccugccugucaccccagacuugggagguggaggcaggugggcuagaaauucagucuucaucaucagcuauauagguaaaucaagggaaaccuguaguacaugaacuccagucgccaagagaaagggagcacugaaagaaaagaaggagggcgcuggagagauggcucagugguuaagagcacugacugcucuucaaaagguccugaguucaagucccagcaacuacaugguggcucacaaccaucuguaaugggauccgaugcccucuucugguaugugugacagcuacaguguauuuguauaaauaacauaaauaaaucuaagaagggaagaaaagaaaagaaaggaaaagagagagagagagagagagagagaaaggaaaguaagcaguucauguugcuuggguucuaagugcugaaaaagcugguuuaaguugcacaugacuaccuguccaccugcuucuaaauaaagaaaaucugcggauggauggccaguguuggccaaggccugugacccauccucuacacagguuuaacggaugauagacaacaacaaguagcaauucagucaaucugggcuacaacaccagaacugugucuggcagcaguggcagaagaggacuuuaauagcuaagccacagaccaggaacauaacucaguagaaaguuuaccuagaauacacaaagacccugaauucuauccccaguaccacacacauaaacuaaagcauggggacccacaccuguaaucucagcuuuaggcaaucaacacaggaagaucaaaacuuccagaucauccucuauuacucugaguuacaagccagauuacuuacaacacugucgcaagguuaaaaaaaaaaaacugaccgccucagaaaccggcguuaccaacugagauuuccccacaccgacuuucaucgagucaggaccuucuuaauccuuuuccaaacacucucuugacuugccaugaaucaaaacaauuaucuucccaaaacauuuacucuccauggaauucccugcuccauacuacacugagcucagaacaggcaagugcuccacugcugaauggcacccgaagcucagcaacauaacuucuuaggcugaugaguuuguaauauaaaauuucugugucaagugaagaggcacaccgggagauaauccuagcuacucagggaggaaauaagugaacaaccaccaaaguagagacaaaaacaaacuugccuguucaacacagcuccaaaauaaaaauaacagaaaaaaagauuucugucuacuuuagacuuuaaggcauuucugguuguaagcguccuccuucuuucguucauugaaaacccucgcuacuuaaaguuugucaauuuccugucuucacccagcaaggacccaagugaaauaauuuaauaauuauuaaccuucaaagaccuauguaauacuccuagaauuuucacuauguagaccgacuagccucaguuucugagaugcaccugccucggucaucccagugcuaaaauugagagcguguguguccaaaccaacaaaugaccccuaacggauuuccuccuuuaauucuuuaucuuucuuuuuuuuucuuuuucuuuucuuuucuuuuuuuuuuuuuaauuuuacaaaacacugcaauccucuuucaccuucccaaaugcuggaauuccaugcgugacccacguauccguauaaaacacuuuacacuucuaggcuuuaaacaauaugcaccaacagucucuccuaauauacucaguuucuucaaaacauaauaaaugaaaucuuuaauacgaaccuucuuggaccuuaccaaaaaccaaaagaaacaacugucagacaggaggaccuuccaguucuggaaaaugucgaaggcgggaaacuugcucgaaaggcgcgcaaaucucacccuagcccuuuaagcgauccgcgcucagccg

SEQ ID NO: 1040 - RNA, 69271 nt, Mus musculus
cagccuugaggcaucgggucgcgaguaccagcgccggcuucucccgcuucccugcggcgggagcccgcuggccuucgacucucggagggggcgcggcgggggcgcagagggggcggggaggacccgcgacgccccgccccccuccgcgcucuggcggcucggcccgucccuugggguccgggucccgaggccgcugagacagcaggccggcgcugcccgcaggugucggcggcagcggcggagccaccggccucaugguggguuucggggccaaccggcgggccggccgccugccguccuucgugcugguggugcuacugguagucaucgucguccuugccuucaacuacuggagcaucuccucccgccacguucugcuucaggaggagguggccgagcugcagggccagguccagcgcaccgagguggcccgcgggcgcuuggagaagcgcaauucggaccucuugcucuugguggacacgcauaagaagcagaucgaccagaaggaggccgauuacggucgccucagcagccggcugcaggccaaggaaggccuggggaagagaugcgaggaugacaagguaaggucgagcccuuuccucggcccuccuagacuuuuucuuuucacuucugggugggguauuaauauucgcccgccggcgauugcuguaugccgucagcgugguagcccuggaagcuccccagacccccagcaacccuguuuguugucagacuuucccggugucagcgccacauucucuguucgcuugcagagacuguaaguucugguucucuagaguggccuauguguggauaccaccuuuccuccaagcucagcugcugagcuggcagugguuaucaucuggccuguguggccgccuucguucccggcacacaggcugccagguauauguaugggcauugucucauccaccuccugugcagacugaucaauauuaauuuauuucagaaugcggccuucuucccuucuggugcucaacauguauuugucaacaguauggcuuuuuagaaaucucuauaaauugauguauuuugcuaaguagauuuuuaaaaaaugaauuuuguguugaaaguguuguuauagaugagucaggaacccguauaugagccacacuugugacuugagugcgguuaauccauuaucuucucaauuugaauuguuaaugaaauuagccgaaaugguagaaucuaaaaauaaguucuuaggaacagaaucuuaugucugucguuauaauucuugaaagaaaauaaaauugugugugcuuaaauagcucuuagggcugcugcuuaaugcagauagaaaauacaaaauuuuaaauuuaaaaaucuuaagucuggacuaugaucauguccuacuuaauaggaucuguuuucacuauuuuauugacaguuuauaacuuaggcaacuucaguugguauaucagaauucugaagacuucuagauagguacuauaguagaugacuucuuuucuacacucuuaaaucuuuuaagauuaaauuucuucuuucuuuaucuagugugugugugcaugugcauacacauguguggagauccgagaucuggagucaaguucuuuccauccauccuguggagcugacuucuguuuaucugucuuggcagcaagugcuuuuagcugcugagccgacccuuaaauugaauuucauuuguguguguauucacccuaaugcacauguggaugucagaggauagcagucagauuucuccuucuaccaagcagguccuggggauggaacucaaguucuaugagauuuuuaaugagcuuccaaccuuccuacccucauuggccucuacuuucuuacuuaucgaaaacugagccucucaguuguuuucuuguucccuuuucuucuuuauacaguaugcacauccucugagaaggcuagagaucagcagacagauguaccuucuauacacugaacuguaaaacauggauacaguagguagagacccguaagagcuuggaguauuaaaauaagaucuucaagauggaccguuuugaucuagcauucuuugucuugugguugugccucaaaaagugagcucucgacuguuucuuuucucugucaucugauggacuuugacccuguaaaacucuuuuuuuuuuaaaaaauuauuuauuauacauaagugcacuguagcugucuucagccuucagccaugccagaagaggugucagaucucauuauagaugguugugagccaccaugugguugcugggauuuggacucaggaccuggggaagagcagucagugagugcucuuaccugcugagccaucucgccagcccgacccuguaaaacucuuaaguauuuuaguuuucuguugccauggcggaacacccugaccaaggcaacuuacaaaagauagcauuuuauuuguggcuuacauuuuuauuauuuuauauguauggguguuuugucugcauguuuuuuuuaauuugugcaacagauaaguaucugguuccugaggaggccagaaguuuuggauuccccuggaacuggaguuacaggugguuuugagccaccauguggguccuggaaauugaagccaaguccuuugcaaaagucauagaagaacacugggaaugaaguaacuccuuugaaaccucaaagccugcccccagugacacaccuccuuuaacaaggucacaccuccuaaucuuucccaaacaguuccaccaacuggagaccaaguguucaaacaugagccuauuagggcuauuauucaagccaccacauagauagaggaaccccaguucuggaaccaaaaaggugauauuuccuucuuccaguucauugugccaguucugucauuuccaggaugagagcaagagacaguguucucaucacuguccaugaaagugagaaaucagacccauuucucuagauucucucaaacuuacuauauuuuauuccgucuguaaaggauuuuaacuuggagguguauauuaguuugcuagggcagguauaacagauccaagauaccacacacgagauauaaaacuuuauuucuccacagaccuggaggcuuggaguuccaggucaagguacaggaaaggguuggguuucucugagaccucuccccgugguugcagauggcugccuucuugcugcucuaucuugucaugguauucccugauggaugcaucccagugccucaucuccuuuuuggauuguggucccucuuauacaugacuuguuaugguaucuucaggaacucacuugugccugcugggcuugcugcacuguuuacuuccccugcuuuugugaugagcaaggucacagaaucuucuccuguguguucagccacagcauacgagcuaugcuaugcaagucugcacuaauuguucaggguugcagggagggacuagaguguagagacuggugaagggcuuugauucuguggcugugggaaagcuuuuauuccuucuagguagcccuuuaccuaugugcuauaaggaaauccaauaaacucauugguuucccagggguagauguuucuugggauuccccuggggaugcauuuuugcaacagccccacacuaauagccuuauuuaaucacugcuuuaaacuccaaauauaacuguauuuugagauccuugagguugaaaccucaacguaugaguuugaguaguacaguuuacuaucauauacacaauguaguccuuuuuuuucucuucuuucuaccaaaaagacuguuuguuacauaaacuguauuuuucuuuuucuuuaagauauauuuauuuucauauaugugaguucagcagacacaccagaggagggcuucuauuacagaucuuauuacagauggcugcugggaauugaacucaagaccucuggaagaacagccagugcucuuaacugcugagccaucucuccagcccuuccuuuucuuucuauaguagacaggagucucacuguguccaaggcugguuccaagugcugguauuugugugugugcccucaaccagcuugaacuuggaugccuguuacugugucucaugcacugcaggaaauggucuagcccagggaaaggaacuauuugaguguagacaguaucuuccucaaagcugcuauuucuguuauaaauacacauacacaaagguccaguuuugaagcuaggugugguggcauaggcuuguacucacagcauggggagauggaggccagcaugaguucaaggccaaucuggauuacauaaugaaacccugucuugaaaaaagaaaaaaaaucaauuuugauauuugaagcugaacaauaaaugacuuguuuuucuguuaacugacauaauccugacugagaguauauuaaaaaggauacauaaaauauguaaaaaauuauaaauaaauagcuuuaguugaaugaagaaaggagaauggggcauauuauauuuuuccuuccaaaguuaucuucacuguauguacaccacaauguauaaguauuuaacacauacacacacaaacacacauacacacacaaaguguguguauauaaaagcuuuagcacacaacagcuacucacuuagaagcaggucugggcaguaggugugcccuuugccacacuacgaugcaccuuugcugugcuacauggcgucaguacaagucagacaaaccacuccucugugccucagguguccucaucuagaaaaggaggaggaugacguuucuuccucucuggaaguugacauuaacaaauccgugaaaaucccuaaaagagggcuggagagacgguucaucgguuaaaagcacuggcugcuuuucuagaggguguggguuugauucacagaauccauguggugcucacagccaucuguaacuccaguuccacaggaucuaaaguguucugacuuccacaagcaugaggcacauacagggcacacaggcaugcaugcagacaaaacuuuuauauacauaaaauaaauaaaucuuaaaaagagaaucuuaaaugccaucuuagcuauuauuccuuuucugcucccuaugacagacugacugccuucuuuccaggacggagcucuguuuguguuccugcccaagauccgguucuagcuccaguguccuguuugacuuuuucuuuccuuccccacuuccugguccauugucaauuaacuuuaguugguuccgucuguaguugccuucccugacucugguguuugaugguuucucuguacuuuaggaaucagccuuucaucauucuaaaugcuuccacuugugccuuuccucugacucaccugccaaaaucuggcuacuguauaacugcaauuuaauugcuacuucauguaacucaaaaucaugaaaaauugguaccuucauucugaguuuccuauccuaugauauuaguccuguguaugauauguaacuauuaauaaagcagguuagaauuuugggcucucccuaaacaauucucccccauaaacaaacccaagcauccucagaccuuacuuucagaguggcuucaugaguuacuuuaugaagcagaguguuguuuaaucguguagagugucuccaacuaucugugucuuccguuagcuccugauucagacuguuccagucugguggucugcugaguucuagcuccguuuacaguucuaugucauuagaacugagugugugucauucuuccuccuugacucauccuuuugcuucuuuuuuugucuuucccucuaauccaucugcacucacucuguagcuccuaggacuucuuaccuagaucauguguuuccuuuuuuaaguguaauuuaccuuauuauuugagcuacacuaguuuauuuguuuagcuaauagcuuccugugugcuaaccucuucucaacauuguaaguucucugaggacagacugcuugaaauucccuguaguguuucugaagaaccuaaggagcugaagggguuugcagccccauaggaagaacaacaauaugaacuagccaguaccuacagagcucccagggacuaaaccaccaaccaaagagcacacauggugggacucauggcuccagcugcauaugccuggucaaacaucagugggagaagaggcccuuugucuuaugaagacucuaugccccaguguaagggaaugccagggccaggaggccgaagugggugaguugguaagcagggggaaggagggcgggauagggggaggguguuuuucagaggagaaaccaggaaagggaauaacauuugaaauguaaauaaagcaaauagccaauuaaaaaagcaagcaaacaaaacaaaaagucaauugguguaucucguauauaccucuuuuacaaauucuguuaaagauuuaaucccuguuacugcaaugucacuuuuggaaauggauguagcuuuugacauuccuaggauauacaaucucacagcaagcuccuuguuccucuagcucuuaaaauauuucuggucucucuucugcaaugaugucuuagucuuaggugcaaggagauguguuauggauguaucaguugggacugggcuccauagcuccacauuuugauugguuguaguuuuuugguuuuuuuuuuuuucuuuguaugauauccaucuguugcaaggagaaguuuccuuaugaaggcgaggacuucacuuaauuugugguuguaaggacaaauauuuaaaguauaguuggggauuaugaugguuuaguaaaguagugacuguagguucuccuucaaggaaugugacuucacuaguccuggguaguugacuggguuuccaguaccagacaucauuucucucgcauugaaugugauaagucaauuagagaacuauugguuacuggcaagguaugugugcucauaggguucugguggugguugugguucugggauuguagguuucuuuccuucuuuguaagcuuaacauuaugccuucuggcucucugaaagcuaguucucagggagggauuuucaggucaguucuaggccaggagccucgguucugugucugaaagguaggugucuucagcaauaggaacuuaccguccaccucuagggguuuagccaugggcaguaacaagagccuauagcauuuuggagucuguuggacaacuuuggccaacaacucaagacagggcuucuuguaacugguauugggguucuuguuaaauggucuuuggcucuuggauggagcauuguaaacagauaggaaaauuccauuaaacuauauguguauuuguacaccuacuuauguguguuacagguauuuuuagguggacauuuaauaaugugauuucuuacaacuuuuuucagacaucccuucuguacuuaucuaucccucccuaauuagagcuccccuguuuucccauuuccuccuucagaucaucugugcccugcuauccuuccucucuugugcccccucuaacaaccccccacugguccccuuuuacuuucuugguuucuuuagcuacuccaagauauguacucauggcugaauauuuggagcuaggcgccucagaugagagagaacaugcaacuguugucuuucugggccuggguuacuuaacucaauauggauuuuucucuuucuguccauuuaccuggcuagaucuuggaaaaggauaggauaaucguuuugauguguuuucaccccacuuuggcaugaaaaguaacuuuuaaaaaaguuuuagaauuuauuuuuuaauuuguucuguuuucauuuuauguguuugaguguuuugcuguacauaugucuguacaccacaugcgugucugaugucuaacccagccagauggcaguguugcauccccuggaauuggaguuccagaugguuguaagcugccaugcaggugcuaggaauagaaccugucuccucuggaagagcagucagugcucuuaaaaaaacuucguugagaauuuuugcacucuauaauuuucuuuuucuguuagaucuuugucuggcuuuuuuuuuaaagauuuauuuguuuauuuauuaauuaauuaauuauauaaguacacuguagcuaucuucagacauaccagaagagcgcaucagaucucauuaaaaaugguugugagccaccacaugguugcugggauuugaacucaggaccuccggaagagcagucagugcucuuaacugcugagccaucucucuagcccaugucuggcuuuguuauuagaguaaugcgacuuugcuaaaagaauauagcaauguuacuuucuuuuuuuuauggaacauuuugaggaaugucuaguagaguucguguguuguauucaucugguucuguuacauugcagaugugcaccauuccugguuuggacuacauuuuucuuuuuuccuaaauauauacuguauggggaggauguguagcagaaugccugccuagcaugcaggaaugcaagggcuguguguguguguguguguguguguguguguguguguguguguguguguuugaguuggaguuguaaggugugugugugugugaguuugaguuugaguuguaagggguccaacccagguucuuacacauguaggcaagcaugcuacuacugagaugcauccccagcagaagcccugaguuugguccuuagcacugcaaaaacaaaaccaacuccagucugguagggcgcaggcagcugggaaaggugagcagaagaugccauguuagcuaacaggaugaauaaauucugauguucucuugcacagucagcugacugcagggaacaggaaugcauuguacauuuuaagauaaaugguaaggauuuuaagugguuuuucagcaagaaaugaaaagcacuugaggcgauacaguuugcccugguuuuagaaccaaagcauguauaaauaugugcugggcuacccaacacagauuacccacuuaucugaauacacuaccucuggaagauaugaucagaauauucuaauguaaagccacucauugucuuccuagcauggggagaauauuguuuuuguuuucuucauguuuuuccccuacacauccuccuguauuaguuuugagauggagucuugcuaugauacccaggcuggucuuaaaaucuugcuuaaaaucuuagccucccauguagcugggaccuuagguucccagggcugguuuucauuucaaaacccuaaaauaucuuuguuucaguuuaauauuuaauaaagagaagaaaguuuagggguuaguucauggaguaucaugaaaacauuuucagucaucuuauauguugcugucagaaacaguuucuuaacuacuuuuuucuuuuagauuuauuuuuuuauuuuuauuuauuuauuuuaugucugugaguacacuauagcuguacagaugguugugagccaccauguaguugcugggauuugaacuuaggaccuucggaagaacagucagugcucuuaaccacugagccaucucuguagccucuuagauuuauuuuuaugugcaugaauauuuugccuguauguauauaugugugcuguguuugugccuggugccugcagaggucagaagaguguaauggauccccuggaguuggaguuacuaaugauugugagcuaccauguuggguucuggguucucuacaagaguagcuagugcucuuaaccacugagccaucucaucugucuugccucagggacuuguuuuauaaacaagaaauaaagucuuacauugauaagaugcuuuaugauguuuaaaugugucccagaaauccagaggcagaggcaggcagaucucuugaguuugaggcuagccuggucuacaaaaugaguuccagggcaucuagggcuacuguuguugggccaccagagaagacuacucugacacauguuuaagccgauagaaagucuuuauuagugggacagugacuaaacugagugguugggaucccaguguagccugagccuuucucagagagggcuuuuaaguacagaagccauguucuggguuaacauacuucaguuaacaagaacaguuagcuagaagcagaaccacaaaaacccaaaagcaaggcuucuacauuuagagacuuucccaugacuauguacuuuuuuuuuuagauuuauuuauuuauuuaugaauauuuuuuauuaaaauaagaccccauguucacuaacucacaagaaaaacacaauuuaaaaucuuacagccucaaaguacacaaagcauaaucuaaaaaauaaaaaauuccauuuacaguaauucuuauuccaauaauuaauagacaaaagguuaaaaaauuuacuaagggucuuaagauuuaggcagcaugugguaucuugaucacaauaucuagagaauaaguagguuucauuagcauagacuuaucaaacuugaugcauguauuagaccauuuucaaccuguggguugugaccccuuuggggauugaauagcccuuucaagaggaacuguauuaaaggguuacagcauuaggaagguugagaaucacuguauuuggcuaaccuacauacaaggucagauauuuggaaauggaauauaaugcuacuuaguaauucauauaacacaggagaaaucaggauggagguuugaauacauguaaaacuuaguaaauaaaauacucaucagaaaaugugggauacauuuaaaacaauaauuugagguauuuaugaccauacauacuuucuuuagaaaaaaaaaaaaugcuuaaagccaggcagugguggcgcacgucuuuaaucccagcacuugggaggcagaggcagguagguggauuucugaguucgaggccagccuggucuacagaguaaguuccaggacagccagagcuauacagagaaacccgaucucgaaagacaaaaaaaaaaaaagaaagaaagaaggaaaauuuuuucuugauuuuuagugagcuaauauucaucuugacaaguauaaaaaacaaauuuaaauaaaguaaaagaucauuuuaaaagcagaaauaaauuuagacccugguuagccauaauugucaacuugauaccgcuuagagugaucugagagaagggucacuagaggaauugccugcaucaggcugcucuagagacaugucugugagauaucuugauuuuuaauugauguacaagggcccagccugcuguguaugauaccuaauuccuuggagguaauacugaauuguauuuaaaaaaaaaaaaagccaagagguaacucacaguuacaguaguugcugcucucucagaugacccauuucaauucugagcacucuggcucagaaccaucuguuacuccaaauccaggaccucuggccccccugagcaccaggcacacaugugguacauagacacacauucagguaaaaugcucauauacagaaaauaaaaguaaguaaauuaaaaagaaaaaaaaagcuaagugugaauaaugcaaggcagccagagugugagccuguaagcagugugaauaaugcagccagagugugagccuguaagcaguaucucuccauggguucugcuuucagugccugccuaagguccugccuugauuucccucagugauggauuaugaauuagaaauguaaaccaaauaaacccuuucuucccaaguguuuuuggucaguguuggauuacagcaacagacugaagcuaauacaacccauggaugaugaccauggguaacagaggccuauaauucccgcauacucaagaaucugaagaagacuaagcuugagcugaaggccagaguaggaggccuaaaaacaaaacaaaaagaaaucaaaccaaacaacaacaacaaaccccaaaccaaaggaauaagucaaguacagcaagaaauuaaaacucuuauuagaaagaacuaaauugauaaagguaaacacacgaguaccuguuaaaagguagucaaaaugaggagcuaguucagucaguagagugcauucccacaaggccuuaggacuuaggugcaaucccuagaacccagugagaagauugguguggucuuacaaccuuguaaucucagcacugagaaaacaaaaauauauccuugggacuugucagccaaccagcagcgcacccaaccuacucugcaaauugcagaucccagugagcaaugcuaucucgaaaauaaagguggaugacucuggaguaaugacgcccaagguugaccucuaaccuaugcaucuacaccaugacugcccucaccaugggggaaggguugucuagggagaugguucagucaccaaaguaaguggagcaguacacucaagugaucccagcacugagaaacagagacagagagaucucuggggcuugcuaaucagccacucuuaacuuaauaaauuagcgaaauucaauggcaaacccugucucagaaauaacauggagagugauuaggaagacacccaaugcugaauucuagcaaggaccauuuuuuauaaccuuuucuuguuauguuuucuaaauaucucauuauacucacauauauauuucuuacuuacauacaugaauguauacacuauagagaaguagccuuaauggagauuucuugaaaggaagcauauaaaugcauauuaaccaaaauuaaagccagaagauaaaaauaguuuauacagaucuauuauaagcaaugaaucaaugauugaucuuuuuccuguucuaaaaguuagacaggucuacuuccagagccuuuggucugucugaguuaauuucucauaucauaugauauacccuugcuuugcaugugcuuuuacucaucugucccagcauguugaagaaccuugucauggcuaaucuugucaauuuggggugaccuaggggauuaguaaagcaugucuguaguugcauccagagaucuuaauaagggcuuuaaccuaaacaauagauucaguauuugaacagacuguugggggaggaggaagcgggccauuggaagccuuuagaagauaaaucuugacccugguccauuuauguacuguucuuugcuucccacuauaagauaaacaagcuccuguguuaaaauauuuugcucuuagcuaagcccagaagcauugaagcuaacuguauugaaacuaacccaaauaaguccuacuccuuaaauuuauaacagcuauguugucacuguagaaaacacaggucucuucauuuuccauuaacugucuuggcaucuauguagaaaucaguugauuguaugaauacauguugguuuguuuugggccucuuagggccagacacuuaacagucuuaaauguuauacuaaggauuuuuaguuuauccucaaagauaaggggaauacuauaauacaguuuuuauuuugaaaagauaagagcugggcaugguggcacauaccuguaaucccaggaaauggaagcauuuagaaauaauguuuagucagguggugauggugcacacaccugacuaauccccacauuugggaagcagaggcagaugaucuaucugaguuugaggucagucugaagugaguucuaggaaagccaggguuauacagagaaacuguguccugaaaaacaaauaaacaagaaagaaagaaaaggagaaaaaagaauguuccuauugagauaauuuucugauauucaguaaaguauuugccuugcaagcaugaggaccuaaguuuggucucagaaccacauaaaagaggggugggaagcacuagaguauguaggcugcuguagacuaagggagaagggcuccaucuauacaguugcacaucucuguuugguguggucuguugagggaggagcaccagcauucaccccuguccccauaaguaaccccuuaucuauauuuuauagagaagcccaauaaacucauugacucccuagaguugaugcagucaugucucugccuuuuguugggaccuuuggagaagguauaggcauuguuuauaucuccuucugggaagaaauucuacugacagaugugucucauaauguggugguuugaauagaaacggcccccauaggcucauguguuugaaugcuuggccaauagggagaaguagcacugaguaguagggagauguggccuuguaggaggaaguaagucauuguggagaugggcuuuggggucucauauauguucaagcuaugccugauguggcaagaagucuccuucugcugccuggggaucaagauguagaacucuugucuccuccaacaucaugucugccugcaugcugccaugcuucccaccaugacaauggguuaaaccucugaaacaauaagccaacaccaauuaaauguuuuccuguauaagaguugccuuggucauggugccucuucacagcaguagaacccuaacuuaagacauggugggguacauguagaaguuagagaacuacuuguaggagguaguccucuccuuccacuaugugauuuucugggaucaaauucagauugucaggcuggaggacaagugcccuuacccacuuagccaccucacugacucguaguuuguuuuguugauacagugucucuccguguaacucugaugacuuggaacuuacucuguagaacaggcuggccucaaacgcagagauucaucugccuccugaguguugggauuuaagguuugcacugccauuuccagcucauaguugauccucuugaaggagauaauaagccacaggaaaaucauuaacuauauauuuggagugaaggauugaaguaauuagaagauaauccaaaguacuucuuuguaguauaauuaauucagaacuacuaaaaaagaguugaaaauugguugaguguggcugcauaugccuuuaaucccagcacuugggagacagaggcaaauggauguuuguaagcuugagacuagccugggguguuuaaugaguuccaggccagccagagauaugcaguaagacccuaucucaaaacaaagaauugggaauaccccccccccaaaaaaacccuccaaaacaaaccaaacagaaaaaaaggguagagcuaacaaaucugguacagcucagguuacagaaccaggacacaaaaaccaguuacgcugcuguucacaggcaguggcuuguuagagcauaucauuaacaacucuguucucauuaacaaaacaaacaaaacacuugggauuuuacaaauccuccuacacugaaaauuaaaacacugaugaaggaaauggaagaguacaaaaauaaauggaaagaugucuccuguuuauugauuggaagaagggauacuauuaaaauauugguacgacccuggagcugacccugugccacagcucuccauacccaaauucauccuggagagaacuggucucccagguguacugacacaggcuugcaggaguaacaagccacagucagagacagcaaggccagcuaacaccagagauauccagaugguaagaggcaagggcaagaacauaagcaacagaaacuaaggcuacuuaacaucaucagaacccaguucucccaccacaaugagcccuggauaccccaauacaccagaaaagcaagacucugauuuaaagucacaucucaugaugaugauagaggacguuaggaagaucauaaauaacucccuuaaagaaauacaggagaacacagguaaacagaaguccuuaaagaggaaacacaaaaguuucuuaaagaauuacaggaaaacacaaacaaacaggugaaggaauugaacaaaaccauccaggaucuaaaaacgaaacuagaaucaauaaagaaaucacaaagcgagacaaccuuuggagauagaaaaccuaggaaagagauuaagagucauagaugacaguaucacaaacagaauauaagagauagaagagagaaucucaggugcagaagauaccauagaaaacauugacauaacagucaaagaaaaugcaaaacgcaaaaagcuccuaacucaaaacauccaggaaauccaggacacaaugagaaaaccaaacuuaaaaauaauagguauaaaagagagcaaagauuccaacuuaaagggccaguaaauaucuucaacaaaaauguagaagaagugggaggcuaugccagugccugacaaauacagaaguggaugcucauagucagcuauuggauagaaaacagggccccugauggaggagcuagagaaaguaccuaaggagcugaaggggucugcaacccuauagguggagcaacaauaugaacuaaccaguacccccagagcucgugucucuagcugcauauguagcagaugauggccuagucggccauuauugggaauagaagccccuuggucuugcaaacuuuauaugccccaguacagggaaaugcuggggccaagaagugggaguggguggguaggggaggaggguggggggaggguauaggggacuuucggggauagcauuugaaauguaaaugaagaaaauaccugauaaaaaauugaaaaaaaauuguagaagaaaacuucccuaaccuaaagauagagaugcccauaaacauauaagaagcuuauagaacuccagauagacuggaccagagaagaaauuccuccugucacauaauaaucaaaacaccaaaugcacaaaacaaaaaauauuaaaagcaguaagggaaggggcuggcaagauggcucagcagguaagagcacugacugcucuucugaagguccugaguucaaaucccagcaaccacaugguggcucacaaccacccauaaugauuucugacggucucuucuuguguaucugaagacagcuacaguauacuuaauuaauaauaaauaaaucuuugggccagagcaagcagggacugagagagugaaguugacuggagcaaacagagguccuaaaauucaauucccaacaaccacaugaaggcucacauccaucuaucuguacagcuacaguguacucaccauacacauaaaauaaauaaauaaauaaauaaauaaauaaaucuauaaaaaagcaguaagggaaaaaggucaaguaacauauagaggcagaccuaucagaauuacauaagacuucucaccagaggcuaugaaagcuagaauauccugggcaaaugucauacagacuuuaagagaacacaaaugccagcccagguuacuauaccuagcaaaacucucaauuacaauagauagagaaaccaagauauugaauaacaaaaccaaauuuacacaauauaguuccacaaauccagcccuacaauggauaauauaugaaaaacuccaacacaaggagggaaacuacacccuagacaaagaaagaaaccuaaaagaagauagccacacaaacauaauuccaccucuaacaacaaaaauaacaggaagcaacaaucacuauuucuuaauaucucuuaaccucaauggacucaauuccccaauaaaaagacauagacuaacagacuggauauguaaacaggacacaacauuucguuacauacaggaaaugcaccucaaugucaacuacagacacuaugucagguaaagggcuggaaaacaauuuuccaagcaaauggucccaagaaacaagcuggaguagccaucuaauaucaaauaaaaucaacuuucagccaaaaguuaucaaaaaagauaaggaaggacacuucauacucaucaaaggaaaaaucuaccaagaagaauucucaacucugaacaucugugcuccaaaugcaaggguacccaaauuuaaaaaagaaacuacuauagcucaaagcacacauugcaccacacacaauaauagugggagacuucaacaccccacucucaucaaugaacagaugauggaaacagaaacuaaacagaggcauaguaaaacuaacagaaguuaugaaccaaauggauuuaacagauaucuauagaacauuucauccaaaacaaaagaauauaccuucuucucagcaccucaagguaccuucuccaaaauuggccauauaaucagucacaaaacaggucucaacagauacaaaagacugaaauaaucccaugcauccuaucagaucaccauggacuaaggcuggucuucaauagcaacaaaaauaacagaaagcccaaauacacauggaagcugaacaacacccuacucaaugacaacauggucaaggaagaaauaaaggaauuaaagacuuuuuagaauuuaauguaaaugagggcacaacguacccaaacuuaugagacacaaugaaagcagugcuaagaggaaaacucagcucugagugccuccaaaaagaaacuggagagagcacaccuaaaagcucuagaacaaaaaaagcaaauacacccaagaagaguagacaaacucagagcugaaucaaccaaguagaaacaaaaagaacuguacaaagaaucaacaaaaccaggagcugguucuuugagaaaaucuuuccuuccuucuuuccuuccuuucccuuccuuccuuccuuccuuccuuccuuccuuccuuccuuccuuccuuccuuccuuccuuucucuucuuuuuuuguuccuucuuucuuuuguucuuuguuuuuuuaucauuauaguuuaacaggagucaaacugaaaaaggaaacuucaguuaaaaugccuccaucagauugucuaguaggcgaaagaucauugaguauuuucuugauuaaugauuuacuauugcaagcgccaucccugaacagcuggaauaagaaaucaaucugcacaagauacuaauucuauuccuucaugaccucuucuuuaguaccugccucccaguucauguuugauuuccuguccugacuaucauucauaauguacuguaagauaaaagaggaaauaaacuuuccucaaaaaaaaaaaaaaaaaaaaaaggcguuugggccagggaggaagagaaaauaacagcauuagcauuuugagcugaaggguuuuuaaggcuuggagucuacaaaguggacacuggcuuagguauuuuauagggccacuggguccuuuccccuacuggaccuuuuuggaaacuccccaccuucugugccuucuggacauuucuucuccaagugucuucuggaaacaagaagcuucucuguuacagagcccacuuuccuuaucuaacugucccuaacucuccuucaaccugauaaccuauucugacucauauguacauacccacuuacauucauauaaaugcacauaaugaaaaacugaaauaaacuuuaaaauauguaacaaacacacaaacaacaaagacuaaaaauaagccuaaccaaggaugugaaagacuuccauaauaaacuuuaaaauguggaagauacugaagaagacauucaaaaguagaaaucuugugguggugcacgccuuuaaucccagcacuugggaggcagaggcaggagaauuucugaguucaaggccagccuggacuacagagugaguuccaggacagccagggcuacacagagaaaccuuguuucgcaaaaaaccaaaccaaacaaccaaacaaaaaacaaaaccaaaaaaaaaaaguagaaaucucccauguucaugguuuuuggcagauuuuguauuguaaaguuuauauauugccaaacgugaccuacacaugcaauacaauccuaucaaaauuucagugacauguuucacaaaauuaggggaaauuguauaaaaauauaaaagaacagucaaaagucuuccuaccccuguccccccagaccccugccccucugccucccuucccaucucacucucuguccccuacccucuuccccucuaacucucucugcccuuugcccucugccccucugcccccuuccuccugccugucuucuccucugcuccccugcuccccugccucugaaaugcuggaauuauucaugugcaacacuacacuuggcuguacucuguuucaugugcuuauuucaagcauaguuggagaaagucauauaaccauacugaugaacagucacgcuuuaaguaaauuucucugggcaguaugcacuuuaggauacuuuucauaucucuuuccuguuccaacuaacucauccucuuuucuuacuuuucccacauuuaaauuccuuuguuaccugccuguuuuaagaauuauaugguaaggccaggagguggugucacaugccuuaaaucccagcacuugggaggcagaggcaggcacaucucugaguuugaggccagccuggucuacagagugaguuucaggacagccagggcuaugcagagagauacugucucagaaauguaugguaaaacuuacucuaccaaaucugcaagcguuuugacaucugcgcuguuuuacuuuuuaguuaaagcaaaguccuucuuucugucuuucaaucuuccuacuuguucuuuggaucuaauuccucuaccaucucagagaccuuuaacaaaucucucuauaaauuuguucccuagcauuugaaaaauacuugaauucccccuuugcagucaaauauucuugaagagaauuguuuuuucucaugccugcauuuucuuuuccuacuccccaugucucagcaucuuuucuccaguccucaugcucuuggcucccaugaugccagguuuuccuguuucuuacucuccuuugccggcuuucccgcucuguuuaccacuguuuuguacugcuccgaacuuuuaguuugaauccucuuuuuuuauucuuuuccuaaguaggcauauuuacucacaaaacuucacuugugcaugccuaugacuccaaaauuuguaucauuuaaucaaaacucccuucuguuucuuguauauuucuauaucucuaaucuuuacaguauccucuaccuauugggugcccaguauuuccuggcuaauggaaugaaugauuucagugauuuaacggaccaaccaaauacuuuguaucuccaguucuagaauauagugcacucagaaaguacuuuauaaauuauugauugaaugaauuaugaauguguaccacaauguaauacaacuuuaaaacacaauuaaugaguaagugaaaaaaaaaugugguucauuguagccaaccaugaccaaggacuuugcucauuuaaaauagguaacuaauagggccaaugagaugguccagcagguaaaugcaguugaugucaagccugaugacuugaguucaaucucuggaucccauaugguaaaggaaagaaccaacuccugcagguuuuccucugccuaucacacauggacauaaacaagcacacauguaaauaaauacuauaauaaaauuaguuuuaaaaguauguaacaagaccuguaugcugcaugcuuuuaaaccaagcacucaggaagcagggacaagaagauuguuguaaguucaagugcagccugguggugagcuccaggccacccagagcuguagaagaagacuuugacuuauacaccccacuccccauguaagaaggcaugaugucuacuacuauuucaagagaaacagaucagauacuacagguguaagugcaauguaaguugugagagaucaagguuaaucucuaucagauuuaauacaugugcagagguuacaggcacaucuuuggauugguauuguuuggaagaguccacaaucuguaccugugacuuagggaacaggguucucaucugugaaauggagaauauugcuaugucuacuuuguagggugguuguaagcauuaaauaagggaucugguguaaaacaagcauuuaauauguauucauuaugcuauagcuuagcucuuucuuuaugcguauaaguuuugucugaauguauguauguguaccaugugagugucuauuguccuuggaugccagaagagacugucagauccucuguaaguuggaguuugacaguugugagcugccaugugggugcuaggaacugaaaaagguccucuggaaaaucagccagugcucuugagugcugagcuaucucucuagcucguaauuagagcuugaacauuguggaaagguccauguguugaagguuuugucuccaguccacaggugauggaacuagggguaaagccugguggaagcaagugaagucauugggaacgugcccucaagggugauguugauaucccagcccauuugcuuccacuguuuuugcuucccagcaaagagacaaacagaccuuugcucuguguccccugucacauugugcugucuugccacgggcccaaaggacaaagggacccaguagcuaugaacugaaauuuuugaaaggaaagccuaaauaaaucuuaaauuuuuguaaguugauuaucagugacauuacaguuauuaaugaugcuuuguuuucauacagcuggcuuucaggccagaaacaguauagaugaguaauugcugaacuuauuuaucagaaucucuugaguuccuguaucaucccaaggaugcuaaaucauggugaguggugacagggaaagacucuggacuuuuuguuguugguuucuuugugaauuuugaagucuggaacuugcuuuauuuauaguguaagcuggcuugaacuuuugauucuccugccuuugccucuuggcuucaaaaaugcauuuuuauuacuuuuauuuauuuugugugcauaugugagccaaagcacauuauuaagggucagagguuaucuuggaauccuucucuccuucuauccaccaugaggguucuugggaaucagacuuggguuguuaaacuuaguggcaaguuccuuaacccacugaaccaucucaccagccaaauuaaaaaauuaaacaaccgggcuggugagauggcucaguggguaagagcacccgacugcucuuucgaagguccagaguucaaaucccagcaaccacaugguggcucacaaccauccguaacaagaucugacucccucuucuggugugucugaagauagcuacaguguacuuacuauaauaauaaauaaaaaaucuuuaaaaaaaaaaaauuaaacaaccagggcuggugagauggcucugcgguuaagagugccgacugcucuuccaaagguccugaguucaagucccagcaaccacaugguggcacacaaccaucuguaaugagaucugucgcccucuucuggagugucugaagacaacuacaguguacuuacauauaauaaauaaauaaauauuuuuuuuaaauuaaacaaccaaaaauacacacguacacacacauaaaacuacuaaauauauuaaauauauuaacuaaaaaauauauuaaagaagauagaauuuuguagaagucauuugagugugaaauuguuguggaaggcccuggugcuguuauauuuuuauguuaauucuguuuuucccaggagggguuguuuggaacaaagaaucaauuacugagugaguaggugggacuuccugguuggacagaggaagagaggaagcaggagaggguuagggccuuuuggacugggauagagagagggaaagauauagcuacuugugucucccagcuagugucuccuugagcuggaggauuuuguuuuguugguuuuuugagacaggguuucucuguguagcccuggcuguccuggaacucacuuuguagaccaggcuggccacaaacacagaaauccgccugccucugccucugccucucugccucucugccucucugccucucugccucucugccucucugccucucugccucucugccucugccucccaggcuaggauuaacuggauucuaguuguugugcccagcaauugaguuaccauuguuucugaacuaaguuugugagguguuuuccuucacgcaccuguucaacuggguucaagagagaaagguaugguggcuaaguguggguuugccagauguacaccacacaaaggcuuuuuuggggguuuugaaauauggggcuggcaugguaguaacccgccaguaggaacuuagugagcuggguggagagauuuuggagcucugggccagagagucuucugagaugagaacacccagcuggagccauguggcccccagugcccugcauaucgcgggaacuugcugcuauuuuuaauauuuucugaaacauuaaauaguuuuaaaauguguggugaguaugggaggcagacagaagacugucaucuuuuugguguuugagacaaaggagaaagaaauggcaauagcuuauuaaaagcuaagugcuaaguguauguaaccucuguaguagucggucauagcugugcuaauugcccaagagcaagccauaaugaaaaugaagcagacacagcugagccauuuucagggucccccagaugaaaaggaaagcagagcgacugagcugguacagcugccagaauuaaucuagacaaaccagaugcuggagaaagcauuaaaagaauuucagaaagggcugguaaggaaaauauaggcaaaguuuuagguaguagaggaagaaaaauuaaaguauaugaaauccuuggaauaagaaguaugcuggaaaauauaaggagauaauucuuccugagaagaagagacaggaaccuguacuucaaaaaagagggcauaagaagaacagcuuuacuguuuggucaugaaguguccucagaaaaggcucugugcuuagggcuuaguacccagguaugguguuacuuugggaggucuggaaacuugaggagauggagccugacugaaggaaguaggugucuggagggugcauccauagagauauuucaaagaggaagacaggaaggggucaaccuuggaauagcucuaucccuccacagagucccgcagccacgauguucugcucaaauacauaaagccagguaacuagacuacagucacauuaauccaugguccuuguaguuugcuucuccagcgaaaguacuaaguaggccccacuuuguuuaguguccaagaucagaugagauccugugcacucagggcuguauaacuauagauucccuuagguugauguuuugucacagcagugagaaaaguaaccaguggggggggaaaagacaucgacagggcagaggccagaaaguacagugaauuggccuaguuuuuagagagacuccaaauccuagggaucaguauucuggaaaaguagaggagaaauaaacuccuaagacaacgaaaguguugaugggaauuaugugaggaaguucaaaagucugugagggguaaguaguauagcuuaguauagugcuggacuaguuuguaggcuccagguucaauccuagcacugcauaaacugaguaugaaggauaaccuguaaucccagcacuugggagguggaggcaggaugguuaauaguuucaagguuaacuggcuggugguugugcagaccuuuaaucccaaccccugggaggcagaggcaggcagauccugugaauuugaggccauccuggucuacagagaaaguuccuugacagccagggcuacuugaaaaacaaacaaacaaaaaaauccucaaaaaaaaguuucaaggucauuccuaccuacaaugucuaguuugaagccagauaggauacuagacccuucuccccacugccccccugaaaaaaaaaucuggaaagcuaauuaaaaauauucaagcaugaaugaagauaauucaaguagggaagaguacaaaguacaaagagcauggggcauacaaaucuagagagucucagcaagcauacauucgguguucuacaagugccagauguugaacacuuggggauaagaauaaagauguaauuucuuuuaugucacaguccacuagcugagacauaauucuuauacucagaauucuugauucugauaaacauugagaguuuaaaaaaaaauucugaaguagcauuagcauuggaaacagacuagauaacuuuucaagaaaguuuuguuuuuaagaacugcuuaugaggauauuacuaguagaaucugagcccaggcaaguuguuuccaacacuguaaaaguuucuuucuuucuuccuuucuuucuccccucccuucccuucccuucccuucccuucccuucccuucccuucccuucccuucccuucccuucccuucccuucccuucccuucccuucccuucccuucccuucccuucccuucccuucccuucccuucccuucccuucccuucccuucccuuccuucuuuccuucuuccuuacuucauagugucuuacuauauuuuucacauuggccuugugcuccugagcucaagcagucuuucuauugucuguccaguagcuaggaguauauaacugaaggccaauauucccagccaccauuuuagauuuuugaaaucuggauuggugacucucuuaguuacuguucuguuacugggaagagauaccaugacuaaggcaacuguuacgaagcaucuaauuaggacuugcuuauaauuucagagguuuaguucuucaucaucaucaugucagggagcauggcagcaugcaggcaggugcuggagcaguagcagagagcuacaucauaaucuguagguagaaagagaaacuucugggcuuggcauggauuuuugaaaccucaaagcccacccccagugacacacuuccucccauagggcuacaccuccuaauccuucuaauccuuuaaauucuuucaagcaguucuacucccuggugacuacacauucaacuauuugggucauucuuauucaaaccaccacaguaucugauuguagaugugauugggcaagaggugugcuguuggugacuguuaacugucuggccacccuucaacaccacucacuugcaaagaaacauguacauuaucuuucuuguauacuuuuaaguaacaauaucuugccuauuuuaaguaaaaggccugaaaguaggaccagggauauagcuauaguuuagugguagaacacuucccugauuuguggcccuggauuuaauucccagugccagaaaaaaacaagaagaucacugcaaaagcugguaaguaaggagagagagaggugacacagaacccagagaaugagaaucccuuugugagauaagugguaaauaauacuuuugagguuuugugcuauauccugucuagaaaauauuuugaagaaaagcuaaguaauuuuagaacuuucuagagcauugccuauuuaacagugaguguggaaaugugaugaaccuaaauuauuuacuaauuaauuuauaauuaaucaguaguaagaaccaaaaccaggggcugagcagagggcucagugguuaagugcaccuuguucucuauuauaggaccggaguucaauucccagcacucauguugaguugcugaugacugccuguaacucuagcuccagugauuuucaguuagcuuuucauaucuuacuacaccgcagauuauugcuuggccagcuugucugugugccuuuuugcccucucccugcccauaccauuuguguguguaucucauuuauauuuauuuauugggaauggggaacaugcucgugucacuauacuuauauagaggucagaagacaaccuuuggagucauuucucuccuaccuuguggguucuagggaucagacuugguggcaaacaccuucaaccucuuaucuaucacaaggagcugccuuucuauucuuauucugauaguuuaggaguaaucggaccuuuuuuauagaaggccagagagcaaguucuugaggccauauaauuucugucacuauggccauagcuaucacacaagcauaaacacaggcauuauagcucauuucccacaaaacuauuuagagacauuggaaguugaguuuuaugauauauuauuccuuggaaaauuuccuccaaccaauaaaguguaaccaguaauccucagcuugucaucccuguacaaacaggccugguugagagagauuuuuuucucacauauaaaaugaucugauuucauuuuguauaauuuuguccuuucuggucugcccaucauacuguagccaaauuuacuucaaaauugcaaauuggauaucauaaucuuguuugcaagccuuguaaagaauccaugaaaaugccugucaucuuugguaagacccuugugcuauagaccuugauugguuuuuuguuguuuuuuuuuuuuuuuuuuuuggugggggcgguuugagacaggguuucucuguguagcccuggcuguccuggaacucacuuuguagaccaggcuggccuugaacucagaaaucugccugccucugccucccgagugcuaggauuaaaggcgugcgccaccacacccgcuaccuugauuguuuuuaaagagauauaucuuacuauuuccccuuaauucauuauuuuccugcuacucacacuccagugaagucugcuuggcaggccgagaggccuggaagcacucacgaggcagggaguuucaaggaaacucaaccuccuggaaccaggcauucucauaacccuauccccgcauuagucugguguauggauccaagugcucucuuucaguauuguuuuauuauaagugccuuuaaagauugaauugugacauagcuaagccuucgccaguguuccaacauccuagaaaauccuugaagcccacaaacuuguaauucaguaagaagguuaucuauucaacauucaaauuuacuucuaguacagacugugaaacuaauuaggcauuacaaagagcggagccagaauagcuuagggcuggucugcagaguguuuacuugggacauaggcagucuuacucagacaagggaauuuacaauggccuggcauauagguggguuuaccaugaaagaauuagagaaucccccugagacagguuucuucccuaggcccaaagaaacagcauaaucaggcauuuacuaaggaccccugguggugggcuuaacaauagacuagcuuuacaccuggcucccuucuuagugucaguggccucguccccaccuucuuuugauguauacauuccuuuucuauugugucacuguaacucucggauguaucucgccugguuucuuguugcucuucuguauaaaaaguugaugcucgacuugaaaaauuacauucagauucuacacaaucucuccugucgcuucuguuugucauuugccaacuccuugcccaccugcaacuagaaacccguucuacgcagacagggaccaaaaaggcucugcggcauuuuccagcuccuugggacuuuuggcagaugcuagaauguugagugaauuuucuuucuuucuuucuuucuuuuuuuuuuuuuacuuccaagauuuggugcaucguuaaaugucuucuuuccucuuuaucuacccuccuuccacaugggugagagucacucuucuguaggaguuagucagacauuacugucgucuccagaagccuccuguucucuccugaggcuggauuucuaggcuguuucuacuguguuugccuguauaaaacucuuaucauuugucuugccauucuauaauugccuguuuucuucagugucucuuuugacuaaugagguccucaagcacacaguguuuguuuauuguucugucuguauuugucugugugcuguccagagcacacucagcauucguaugguccuuuucuuugugcauugaaaaugguguaaaaaauguagauguaauugauauaaaauuaacucuucuaaaguauauaauucauuggguuuuuuuaaaaguaaauuuaucccaacacuugggaggcagaggcaggcagauuucugaguucaaggccagccuggucuacagagugaguuccaggauagccagggcuacacagagaaaucgugucucaaaaaaacaaaaacaaaaaaccaaacaaacaaaaaaguaaauuuauagugucauagagcuguuguuacugucuaauucuaaaacauuuucauugcucaaaaagaaauccuguacacauuaagaagucccucuuauggcuagggacuguuaagauguagaacaugaacuugugaaagacacuggguuuauccuuagagacuucaguaaccucugcuccccagaugguagccguugucuuucugugcauuucaugugggugggaucagaauuguuuggccuuuuugugagugucuucucgaacuugccuguguaguguucucgaagaguaccuguguuaugcuauguaccaguaguguuucaucccuuuucauaacuaugcauuggccuuauuuaaacuuccuucuucaaagcccccaagacuucagugagacugcuagauuccugcucuuggaacaguccugcuuucaucugcucuuuguuucuggauggacuuucaccuuacuaacuaagccaucaggacucagguaaaggguagacccugcuugauuccuugccuuuccugcccaagcuccuuuuccuauucgucuuucuugugaaucaccagauaguacuuuggacuguucuuacauaccucaggccuucuggacucuauacauuuucuugguuauucucucuuucugaaaggcucuuuucuacuuacuucaaguuuaaauucucaaccuuaaauuccuguuucagacagaauccuuccuguaacaucuuugaauuaucauaggaauuauacuuuuuagguacuacccuaucuauccuugacacuguucuuauguuuucucuguuguuucauauucuugccaauauguuggcacuagaugguaggagaaaggaaaugagucuugacuauaaagguaguguaagaucugguaggauggcuguaagccugaugggccugcguuucaccuccuggauucaugugguugaagaaaaaguucuuuuccuggaauuguccucugaccucuguguacuuuaugugaacacauacacacaugcacacacacacacacacacgcacaaauauuauaaaacaaaauaaaauguaguauaagagaagucuuuguggugauggaauaccuucugugucuugacuauuauugugguuucacagcccaagacacaugaugaaaugacauaaaauuauucauaguuguuauguuauugcccuaauuuugaaguugaacuaauaguuauacacacugggagaaauuaugugagaguuaaaugagauaucugugcaauagucuguacuuuuuaaaaauauuauuuagaaauuguauugguauuuaucauuugccucuuauaugauugcuuuggaucauugugaaucuggccuacuuugggguaaggauacccauuuguaguggcaaaauugucuacagcaagaacaucuuugugaaaaaaauaagaguauaaagggggaaaaugaaaaaaauuuaaaacauaacaaauauuauauuguucaaguacauguuuuuacuuuuacuuucagugguaagccuuagcuucagucagguuuuguacaucuaugcucuuagcauucuuguguacugacuuuuaaaggacagugaccuuggcuuugaaucuugagcacaugccugaacacagauacuguguugccauggaaaagccugauaagcaggaaucacuuuugauuugauaguaaauguuucaaagaguuaaucuuauucuaauauugaguuagugagagaucuucuguaagaucugggguagggaaguaauaaaugauguacaauucaaacucuaaaacauggaaaauuaacauuacauacagaaucagaauuuaccucuuaauuauuuuugauguauagaguuuuuguuuacauuuaugaucacguucaaagugaauaugaguaacuaugaaugaaaugacguauucuugguggguaaaauggugcacacauauaagcacuagagguggaagcauggaaaucagggguucaagguuguccuugacuuuacagaggagagcuagguggcggcggcagacgucuuuaguuccagcacugaaagcagaggcaggcagauauaugaguuuaaggccagccugcucuacauagcaguuccagacucaccaaggcuauauaaaaagaccuugucucaaaaagaaaaacacacaccaaacaaacagcaacaacaaaaauaacauagggaguucaaggauaguuugagcuacauaggacauuguguuaagaaaauauauauauaauuauuaaaaugaaaacaauuucuuuuuuagguuaagcuacaaaacaacauaucauaucagauggcagacauacaucauuuaaaggguaagaaauuuuucuuuuagauuuauuuacuauguacgcaguguucugccugcacauagacuugcaggccagaaaaggacaccagaucucauuauagauauuuaugagccaccaugugguugcugggaauugaacucaggaccucuggaagaacaguuagugcucuuaacuucugagccaucucucuagccuccaagagacuuuuaauuauagaguaaagguaaggacuacuuuaugucugaaaucuucaagaauuaaauaguaguuggcugagccagguggugguggcacaugccuuuagucccaccauucaggaggcagaagcaaguagaucucuguacuccgaaugcauauguauacauguguacaagcacauaaacacauauaaaaaauucucaaagaaaguugaacuguagauuauguggccauuacguuucuagggggauaaaaagaugggguucuuauucuguauuguguauucagauuggaggaugcuuuggugaaguucucuugagauagaaagaaaccuggaauguagagaaauaauaaauaaauuuaaagcucuaacuuuaaaaauauuaguuaguuuucuauuucugugauaaaacaccgugaccaaaagcagccuggggaggagaggguuuguuuccuguuguagauuauagucuguuauccagggacgucaaggcagggacugaugaagaggacaucaguuugcuugcuucccaugggucaggaccaccuuccauguuguuuuucaugaaggauuaagcuuuuacagaaaagaauaggcaaagagaguaagcuccucgcuuagauuacaucacuuccucugucagcuuuggggcauguaauggcuuaaucuuuauugucaucuugacuggauuuauaaucaccugagggaaacaacucuggucgugucuguaagaguguuuucagagaaaugauaauggaggagcuaaaacuuacccugaaugugagugucacuauuccauaggauuuuuaguuaaggucuuccuguguagccaaggcuaccuucagacuuacagugacucuuauaggagcgguuucauugaacauuaucuuugagcucauacuaagaaaauacaacacagaugggcaguggugacccauaccuuuagucuacagagccaguuccagaacagcuagggcuauacagagaaaucuuaccucaaaaaacaaaacaagaaagaaaaaaagaagauacaguguaaccaggcaucuuggugcaagucuacaguccagcacucagggcagaagcugguagaucucugugagugugaguuccaggccuccagaguuacauggagagaaccccgccucccgccccaaaccaagaaagaaaaaaagaaaagaaaggagguggggggggggggagaaagaaaagaaaaaaagugggagcgcaguaccauuguagugcaaugcaagaugcaucuaacccuaccuacauacucaaguguucuguuaacguggggcugccucagaacacgguuaguaaaggagaaggaaauacagacuucaaaacugaagccaagaaauaauguuaaaaaaaaaaugacaaaguuggaaaauaaaugauguuugagauuucuggugcuccagugaugaagcaguguagguauuucuagaaauugagaaguugaacagcagcuaaagcugugguagagccaaaugggagguauucugauagacaagcaguaaaaguguguuucuacaguguguaugaauacgggguccuagguuggcagaacaaguuugauuuugagaacuggagucaucucaguguuccuuacaugagccauagucugaacaacgcaaaagguguuaauaaucccuggagcuugcuggccagccagcugagccugcucaguaagcccagagcucagugaaagaccuuggcucaaaaccucaugagaaaaggcuggagagauggcguggcacuuacgaguacuuaaugcucuuguaaaggauccagguuugguucuaggacacacaugauggcuuacagccauauguaacuccagaugcaggagaccuaacgccucuucugaccucccaaggcuccuccacauguggggcacagauaaacauucaggcacacaaaaauaacaaaaacaaccaagguggaguauuuuaaggagcuacacucaagguugaccucugacuacacauguuaucuaacuuccugagaaucuuaguagaaaaauugaaaauguacauaauuaaaagaucauucuauagauucucaaaagaaagucaugcaguaaguaaauugauucuucuuuggcuccuucccuugucugccuagagcaacuggcugagcuucgucaggaguuucuucgacaggaagaucagcuucaagacuacaggaaaaauaauaccuaccuugucaagcggcuagaauacgagagguaaggugccacacgcagcagcucugugagccuccagcuguuguccaggcuuuguaacuaacgcacuucuucccaucugcccucuacucuugcucuucauuuucuucaucuuauuuuaucuuucaaagguuguuguaaaaguauaaucuuuuauuuuaauauuuuaaacacuaugaaaacaucucuuacaugaucuagauugucaaacagaaagaucuuauaacaacaaguuuuguugaaugggauacaguaagaacuaaaaccagacuuccuuucugagggacuuccagaagaugaaaacaacucugggcaugcccucagcauugcuaaggacuguguuccugcucuugaucugucccucccucacacuucuacagagggaggagguggggaacuucuuagggucuaaucagguuuaugguaaaggguugagucuuuuuagguuuguacaccagaaguuaggcucaacaguuuuucuguuucuuaguuaucuauguauaacuacuuacuauaugaguauuuuuaaccugccaguauucaguguuuuuucuagcauaucaauuuguuaaaacuuagauucuaccaacuugugggaccacuguagaaauuuucuuuucucaguauuauuuggaccaacaagauggcucaguggguaaaagacacuuucugugcaacucugauuaccugaggguggccucuggauccugccauggaaaacagaccuaacuucuaacaucuacacguaugccauggaacacugugccacucacauggcuacaaguagauacauaaaugcacacaucauauauacagcuaugucauaguaacaauaaugcuaaaguaaaauaaauaauuguagaugguaucauuuuuauuuuauguaauuuuuugagauuuuucccucuuaauauuucacuaguauauauucauaaacauacauuuacugaaaauguuuuaucaguuagcugccuguauaaugugaaucaaagauugcuuccuaaauaauuguguuuacuuauaacagagauguuuccucauagcccuaccacauuguuuuaguuuaacuuuaauuuggucucaagauguaggaauaagauaguacaaugauaucaagauaggaaguuuaauuugugauaauaaugugaacauuaagaugugucuauguauucauuaaguuuaauugcaauaauaaugugacauuagcauauguguauuaaguucuuguuucuauuuucaagaaugucuguuuguaucuuugacuacuuccccagcagaaagucaccauuuuuacauguuuugacuuuuuuuccugacacuauacuguuucuuucuuuccuuuauuccuugguauacacuuguauuaugguauuuaaaguucgguugaagacaugaauagcugucauucuuuauuggcuccuacuucuagcauuuuucaucuguuugaugagaaccuagagguuguuuguuauuuuuuccuuuuaucacagcauuuuucucugcugugauugaaauuggccuugacaauuguuucuuuauagguauaauuuguaaaacacuugaggaaggcuugcuugcaucuaccugcuuucuguuuuuucuguuaacuuuagcaguaucuccagcugcccccgauaaagagucaaacauuuaugauauugacugcauuucacuguuucccuacugaaugauguugugucuuccuagauacaugugcugcuucuggacagacuuggagcacucagucuaauagcaucuaaagaaugacuuucuaauuuaguuuucaguguggacagcagaucaaggaguuaagagcacaacaugaagaaaauauuaaaaaauuagcagaucaguuuuugcaggaacaaaagguaaauuaaaacuaaguauuuaaauaauguaugcuuugguuauaauucauuuaauuuagaaguagaugguugucauaacacauuaagaauucuagucugccugauuuaaaagaggauguguauuuguugaguaaaauggauguguguaaaaauauaucaacuuacuguuucuuaugguuaagaaucaaaccuagggcuuugcacaggcuaggcaaauuguuauuauggugguuauugcugucaaugucagauucuaagguggacgacuuucuaccgaaaagccuuccuuuuucccuccuccuuccuuuucuguaucccauucucuuaguauauagcucaaauaccauugaauuuccaacccccuugccugagcuuuucaagugcugguguuaacaggugaauaauauccacacccagcuucauuuuuuuauuuuagucuguugagaaaacagaauugucaagcuuuuucuuauuagucucuaguagucugaugaccugucuuaaaacagaaauaacaugucuagauacuaaauaaguaauuuugauucauacuuucuuaaaguacugugggucagaucuguggcuucauaugugcaguuauauguucuguugagcuagaugaccaacucugccugauacaucuugggucagcaaaugauuuauuuauuuugaguugaguuaucauaaaggccauuguagaaauagaauuuuuuuuaaagcucacuaaccauuauggacaggaguuauuuuuuauacucuuuaaucuuaguuugguuaaaugugauuuguauaaaauuuguaauuaaaaguaaagagugacucaguaauaaagagcauuucuuuuguucuuugguaacauucuaaggacuagaagucaaggcugucugguuuuuguccuuagcucuuccuuagcuuuacagcaggauauugaggguguuauaucucuccaguuuucagucuacaguuugaaacagcugcaguuuaucugggucugcuuugaagagugugagaauggacuaguggaaagcuugaaugaucagccacugugaagguacugaguguaguuagagguaguauuaagacaccgaaaguucagaggaguacaauaguguggaaaaggaaggagagaggcuugcuguagugcuguguuauucacugaaagccuuuauuauuuuucaugguuuugacaaaaauagcugacaaaacaauuuauagcagaaaacucaaaauaauaugauauuaugacauggagauauuauuaaaaauucacaggcuaguauccauaaauaacauuuuguauuguuuuugugauacaaggacagaaagacuacagaucagaggagaauaagaaaacuugaagaccaaaacuccuuauacuagguuauauacuuauauacuagguuaaaucuuggaacagaaaaaagauauaguagaaaaacugguuuaaaagaucuacaugaggucugaaaguuuaguuaauaauuauauuuuuuuccuuucuuuuccuuuugagacaaggucuuguguagcucagacuggacuuaaauuuccuauguagccaaggguggccuuagacuuuggauuuuucugccuuugucuccugugugcucuuauuagagauguauggcaccugcccagcuuaugugcuucugggaagccagccgggccuuuauggaugguagggaagcaauccuccaucugagccagcgcuccaguccaguaacaacuguugucuuuguuuuauaagucuaucauaguaguaucaguucuaacauuaggggaaccuggguacacagagcuaauuuucuccaaaucuaaaauuauuucaugcugggcaguggugguacaagcuuuuaaucccugcacgcaggaggaagaggcagaggcaggcaggucucugaguucaaugccagucugauuuacagagugaguuccaggauagccagggcugcacagagagacuacaucuugaaaaucaagaugggcuggugagauggcucaguggguaagagcacacgacugcucuuucgaagguccagaguucaaaucccagcaaccacaugguggcucacaaccaccuguaacaagaucugacucccucuucuggugugucugaagacagcuacaguguacuuacauauaauaauaaauaaaucuuaaaaaaaaaaaaaagaaaaucaagauagauagauagauagauagauagauuuuuuucauaauaaaaacucuccuuaagcacaacaagaaguccccucacuaaauuacagaaauauuguuuuaagaaagaugcuuuauauuuaagauuacauggugucuuauuccuauaauuccagcacuugggaagcagaggcaggaaaaucaccacacauuugaagcuaaccuggucuauuuuaucuaggaaguucuaggcagcauaaaaacucugaccuuguuucuuaagagaagaaagaggugguguuacccauucgcacaaaggugauagcauuaaaaggaaaacaucuuuguuaacuuguuuguuuuguguuguuuuuacuguauuuuuuuagcccuuagaugguucaguaaguaagggcacuugucaguaagcaugaugaccugaguuugauccucacuccccacaugguagaaggaaagaaacuuguggauaacuguacuugcuugcgcccaugaacacacauauagacacacagacacacacacauuaauuguuuuaucaguggcuuaaugauucaaaacugaaaaauacuuauuguuaccaaaucuuuauccaacaacaggagacucauaagauucaaucaaaugauggaaaagaauuggguagaaacgaucauggagcaccuaaaaauauuccaaaugugccugaaaaugaugcaaauaagaaugaagaccccucaagcaaucaucuuccccaugggaaagguaaguuuuguguuuauaugagauucaccauuuuuuccuguuuugaaauauauucaaaucauuaaaaacuuguuugauacuaguucugagaugauuugauuuaaugucuguauuguuuaaauuuuugguccugugacaaaagagaaaaaaguauuuuaguuaaaaaucagggccaggaaguaggcucagaugguaaagucacuugcugugcaccaaugacaaccagaguucagguccucacaucuacauucacaaguuaauguaguggcacauauccgcaaccccagaacuacagugagguaggagauggaaacauauuuuucuggaggugaucaggccagcuagccuugucugugaagcaaagcacacacaacagaggccccuaccucagcaguggaaggaaagagcugacucccuugacugccacguuaugcacacgugcaggcacauacacgcugaagaaaguacguuuuuuaaaauauuaaaagaaaaaaacaaaacuaaguuucaagcaagguguucacuuacaaucugugacauuagaaacugauuuuuacuuuccuucaaaucuuuuuugauuuauauuugcauaaacauaguuguaccuuauuuuguuccuugggcagaacaacucaaacgaguuggugaugcagggaugccuggaguagaagagaaugaccuagcaaaaguagacgagcuuccugcugguaagugaggcuuacuggagaacugagcuaagguuaaugacacuguuuuuauguggccacauucucuuugauguuguuguuuugagagagaccucagcuguguauagcccgagcuggccuucgacuuuuccugcucagcuuucuaagugacaggagcaccaccauucucuguucuccauuaguuuaguuuuguuuuguuuuaguuuuuguagaaucuagaaaaccuauagauguauguguguuuggugcagcucauuaauugccagaauuuaaaacaaaccuuuuauugcuuuuauuuggggugucugugugugugugugcguggagauuaagugcaugccauggcauaugugugaaggucagaggacaacuuguggggauugggagaagaaucacacucagguuguuagucuuuguggcugcugccuuaacccacuggaccacuucucuggucaaugccagcauuuccuuuuuucuuuuuuaagauuuauuuuuauuuauuuaauguauaugagugcucuaucugcauguauaccugcaugcccgaagaggguaucagcccuuauuauagaugguugugagccaccaugugguugcugggaauugaacucaauaccucuggaaagaagucagugcucuuaacggcugcacuaucccuccagggccccaggauuucuuuuucaauggaguuuuuaugaaguuuuugcuaaguauacaaucaggagagagagagagagagagagagagagagagagagagagagagagagagagagagagagagagagcucuaugagcauaccuugcuccucuguuguuauauuuccaacuuucucugggaauuuuuuaaagguuuguuuguuuaacccaaccuuguuuuaccuaucuaaaccacugguucugaaccuuccuagugcugugacucuaauacaguuccuccuguuguggugaccccccccccgccccggaacuuuaaaauuauucuugcuacuucauaacuuuaauuuugcuacuguuaugaauuauaaauaucuguguuuucugaugaucuuaggugaccccuuugaaauggucauucaacccucaaaggggccacaacccacagauugagaaacacugaucuaagccaaauuuauuuuuaaagucaccuuguucuuaagcaagagacauuauaauauaaaucuuaacaugacugauuauuauuuaguaauggagauacucuugucuucugcacuugaucuuagucaaaaggugaagaagcacucucccuccaucuuaugacuugugcuaaggacagcacugaccagcagagcuauagacuaagcugcccccguccauuaacaagucacaguuaagcuguugauucuagugaagugcuauucauugaaggcuuuguguguaguuguguguguuggcuauugcagauggcaguggagacaagauguaauggugacaaagucugcggagaacagcucugugugcuugaguguuuuucucagaguaaaugccagacuucuuguauacuuaacacuauguaauaagugacauaaaaucauuuaaguaaacuguaaaagugacccaaguaaaaugugcuaguuaggauagacuaggaaguaauuccuacuagacaucuucaaauuacaacauccagcagugacgaaaguuucuuuauuuccaucuuaagccugaugauccuuuugcagaucugaagaguggcuucugucaugacuccacguguucauauuagcuuccuauguucauauuccacauguucauauuagcuuccuauguuguuguacaagaagggaaagagguuauguaugauuggaauguauuugaugacccaaauaagaugugacuuauucaagccaggcauggaggcccaugccuuuaacccuagcacucaggaggcagaggcaggcagaucucuggaguuugaggccagcuugauauacaaagcaaguuccaggacagccagagcuacagagaaacccugucucaaaaacaaacaaacaaacaaacaaacaaacaaacaaagugacauacucaguuucaucuauaucuucaaugucagaauuaaaggcccuuguccccuaaccacaagggaaagcugguuguguauccagcaaaaauaaauaggaucauauuccaucaaguuuaccacaccaaucuuuaggaaguaaaaugugcccauauuuguauguaggagcuucugguuuuuuucuuccccucuugguuuccuuuucucuuaguuuuccugugagcugucugcuuuccugccauagucuccuucugugcagggaucuauuggggugagugcugauguguaaaauguaaucuuuccuguugaucuuuguuucuuaagagagaagaaacuucuaacucuaaccuucuuguugguaaugcucuuuguacaaauaacauuucccauuuuaaaaaauaaaaauuccaggagcuggagaaaugguucagugguuaagaauacuuacuuacuacucuugcaaaggacccagguucagauuccaacauccacauggcagcucacaaccaucugcaagcucaguuccagaaaacugaccccucuucugaacuacacaggcugcacacguaaacauguacacccaaaacuaaauaaauguuuaagacauagaaaguaaauguuccagagccaaacggagugguucaugccuguaaucucagcaugaggaguguagguauagccauguuugagaacuguagguauagccauguuuugggcugaauacugaauuucaagcccacacaagcuacugaauaaaacugguauguaguuguucuaaacauacaauaaaacauacguagcuggccuuugcuacuuuguggguucuuuaucccuuuauccuucuaguuucacccaccaucacuagauaggagagaaaggaugauagaggagagaaagugagagauaccugaaucuuuuucuuuccuuuugucucuucuuugagaaugacuacuaacaaacugcaaccaacccuccugaacaaccaccacccacaccugccaggcucuagcauuuauauacccucugaaaaguacccagaauuccaaacaucacacagucucaggaacuaucugcaguuggcaaaaccaugcgucugcuagugcaugaggcaaaucauagucagcugcugugggccgucugaagcagcccauaucccacaccugagguuaaaacaaaaacauauucuuaugauguuucuguguuuuuuuaaagaaaucaaaauuccagaauugucacaauaguugugauuuguuuuguuauuuuaaauugaggguucagcaauggacucaguggguaaaagcaccugccaccaaaccuuaugauuguaguuauguccccaugagccaccuugugguagccuggcucaccugcuuccaacacacucauuacacaaaauuaguaagucccaaugccauaaaagacggcauugagcagccuagagcucuguucuuaaucgccucgccagcaaguacucauuuuugcuugcaguuauuuauagaaaagaaucucaugguuguaagucauauuugaagagacuaccuuguuuauucauaaauucuuugcuuaagugccuguuuugugccaggaacuguuugauuaugauagccagcaagacagaauagauaguacaauguauaacuuaauaaucauacaagaauuuuuaauaugccaaggauaaagauuaaaaaauuaggauacacauaguauuucugcaguauaaacugauucauaguguuuuuuagaaaucacaguauuuucuuuaaaaaaaaaaagauuuauuuauuuauuacauguaaguacacuguagcugucuucagacacaccaaaagagggggucagaucucauuaugagugguugcugggauuugaacucaggaccuucagaagagcagucauugcucuuacucacugagccaucucaccagcccagaaucacaguauuuucaauggcaauaaugugaaucuauuuuuuucuuauagcuuuaaagaagcccccuguguuagcuucucaacaugaaagucaucagacaaucucccaucuuccaacuggacagccucucucaccaaacauggcuccagguauaaagucucacuuagcauuccauuugagaaccaacuuauuguucagguguuacuauagaguaaguagaacaugccauuuagcaguguggugaaauagcauuuguucuggaaaugaauauauuuuuuaaaugauuggcauauaacacaugcacacauaaaaaauguggagauggcuggcugaggaacuuucugguuuccaaauguuuagccauuuagaguccagugggcucaggauguagcguaguaauagagcgguccuuuagcuuguauuaaaaguguaguuucucuucucaacuggaaaaaauaaagccaagauauugaugagauaaagacacagugaugaaaaaguuagaaaauaacagcugugaaucauugcauagcugaagaugacauagauauuaaacgugucaaacccugguagagcuuagagaucucuagcagcuguuuggaguuuggaaggagaagugagugucaguucuccuuguagacaccuaagacaagggaaguuggacaagcuuguagucagugguggagauaguuagcuacagauggagugucuuucauaaaacaguaaagcuuaguaacaagccagcucugugaccucugaugucagauggccaugagcuuuugcuuuuguuaagcagguuauaugcaauuguucuguuaaagaauuccgugcuugggcuggagaucuaguucaguggggugcuugcucagcaagugucaggcccuggauuugguacuugacuacaagaagggugggaaguuacauucuuagccagguggugguggcagcacaggccuugaauuuuagugcucaggaggaagaggcagguggaucucugcguuugaggccagcauggccuauagucaguuuuaggauagccaggacuacacauagaacccugucucaaaaauaaaaaaaauuuaaaaaaaauuacguucuucuuauuucgauuuuaugccacagguucacaucuaaaccagaaugaaaaucccaguacuucaaaacagaacccuucaaauccucuucagcacauaauuccaggcccaaacuuggaucgggaacccagaauucaaacagacacguuaaagcaggccaccagggacagagccaaugauuuccacaaguugaagcaaaguaaggaccgguugaugaaugcuaugaaugcuaugcuaacaggaaugcuaugcuaacagggguucuuuacauauauuucugugcgaggcugaauugugacuucauuguuaugcucuaacagauguguaagagaaaguauaguucuguuacaauuuaaaagaaaaucauuuuuaaauggacagaaaauggucuaaagaaacuguaaaagguuauuauggucaccuuguuaauucauuucaggugaguugauuucuaaaaaaaugcuuaguucuuaggcauugaaacuuuuuggagaaacaguagauacaguuugcgagucuaaugacagagacuuugauuaggagggugaaaagucguuuugaaaagugggugggugagggagagcaagcgccuggugaggcugcuguagugggagggagggaggcccagugugcuuccuccuccucccucccuuccaguugucucugccccaugugggugugaacacucagagcacuguggaaggaaguuuguuguuuaguuacuucagagacacugauucugguaaguuagcucucugaaucuguguaaugggauaaccuguaaggaaaaccugugguagcagagagaauuugcuguuggcacuuucccuuaagucagcuccuuaaacugcuuuccauuccauuuucuccucauggcuucuucucuccuucaguucuaagcagacaauguucaaaagcuccagguagggcagcaacuuucccagagacaugguacuguuugcacacagguugauuauagguugagaauuggacagcauauuucauuuauucaaagauuucuauuguuuucuagcaguuacuuauauauauauuuauaucuguauauauaauuuggacauuaauugucuuuccuuccaugauauuuuaaaguguauuugugcaccuugauuaaaaugcuacauaauguuuuauuuguaagaauguagcucacuuuuuaaaauguugggaaauuuuuuuuuucuaaagucccacuguggaauuggcuugcgugcuaguuaccuguuucauugcuguaacaaagcaccugaggaaaacaaguuaaggaaggguguguuuguuuuggaucacaguacagcccaucuaguaggggaagguuugucagcaggaguuugaggcagcugacacaguccuccucagguaagacacucuccuuuguauucagucugggaucucagcccacccacaguuagaguggaucucaaaacuuaaauuagccuaaccuggauaucuuucaccuacacgccagaggcuagugucuucaaugagucgaggucuuuucaaguugacaguaaccaucacagacugagaacuuuucucucaacaaggacuggggacauuaaacaagagguuuaaaugaauugguccuaguggcucacaccuauaguccuuggcacuuugaagucugagacagggggaucacaaauuugaagccaaccaggguuagugaguucaagaccagccuggacuguauagugaaaccuugucucacacaaaaaaguggggggggggguguccugaggaugcaucucaguugauagaguguuugccuaccaugaaugaagcccuggauugaagggauagugcacacuuguaaucccagccuuuaggagguagaagcaggaguaugaguucaaggucauccuugguacauguuguguuugggguauaugcaauucuuuaaaaaaauaaaacaggaaagaaaaaggaaaaaaauauuaauauagggcugguaggauggcucagcgaggcaaggcacuugcugacagugauguuccaaguucgauccccaggaccaacagaguggaagaaaaagagacaaauggcuuuugcaaacuuuccuuugcccuccacaugcaugugcaacaucacacaugcacucaggcacauguguacacacaaacaaauguuuaaaaagcaguuuaaaauuauaauaaagcucuuaguuugucaccuagauucucauagcauugauuuuacagaauuuuuugcuaguguugauuuauauuuuaguauacauagauuaauuuguugguacagaaugucuguaaauaaugcugggaaauuacucucuauaaguuauuuuggaaggaccccuucugagccuuaaauuauguuccauguauuaucauuagugaacauaaagaacugaaacaucggugcauguaugcuuuuguauguauuuugccuacauauauguauauguaccguguacaugcaguaccuuuggaagccaggagacaguguugggccuccuagaacuggaguuacaggcagucaugagucacuauuuggguacugagagcugaaucuuguucucugcaagaauagcaagugcucuaaaccacugaaugucucuccagcccccaaaguacuguuuuuaaauucauuucaauugacauuauuuguuagaugcccuuuguaggcugaugggagcaagaucuugcucuauagcccaggaucaccuagaacuuguggucuucgcccacucagcuucuuaagcguugauguuacaggcauauacuacuacaccagcucucuuauauaccuuuugauuuuauuuuuaauuuuauuuuauguguauggguguuuugucugcauguaugucuuuguacuaccuaugugccugguguuuguggaaaccagaagagggugucagauucauggaauaggaguuauaggcaguugugaaccaccauguugguacuaggaauugaacccagguccucuggaaaagugaccauuguaaggcugagccaucucuccaauaauuuuguauuugucguuaaaauacacacacaugcacacaaaauacauacauuguuuguaugugugcaucugugugugagugugggcccugugccacagugcuuacauggucagaggacagcuucaggacagccucacuuucacuguggcucuugccuuugccuugguaaggacaggugcucauugguuguucucuacaguguucgccaggccagcuguuccugucucugccucccaucuacccauaggaauauagucuagggucuggcaguuacaggaauccugguuuugagcuugggccuucauauuugagcauacauuuacccacugagccaucugcccagcucacauauuuuuaauaucuauauuccauugugcuuuuuacucuuacuauuuagaucauuucauuuuucuccuuuuaauugucaugcuuuuuuccagauuauuuauuccuucuacuuuaaauucaaguguagaucaaagaaguuacugagucaaaugcucaaucagccuugcagcucaugcauccuuagaguagcucucagggccacugcccugcgaucugcccgcauucauuuuuaaucucuuauaggauauuuaggauauaagaguuccuucgggguauauuagucgcuguggaugugaagcucagugguaguacacuucuaacauguacaggguccuggguucagagcuagccuugcugauagccuugguuuuuaaaaauaguauuuuauuguuugugaggcaagaucucacuauguugcccaggcugaccugaacaggaguucaguucacugggcucaagagauccuccucuuuagccuaaccacuuauauuguuuuauaugaggaauuuuauuuuaaugauuuccugguauguaaucuguauauugguuuuuuaaauaaauuacccugaauuuuuuuuuaaguuuuuguuuguuuguuuguuuuuuuagguuuuuuuuuuuuaguuuuucgagacaggguuucucuguauagcccuggcuguccugaaacucacuuuguagaccaggcuggccuugaacucagaaauccgccugccucugccucccaagugcugggaucaaaggcauacguacgccaccgccaccgccuggcuaacccugaaauuuuuauaaauuguuuguauauacuuagaucuuuuagaaaaguucagauauuagucuuuaauaaaugacuuuuaaaauguuuauccuacucuagugucuuuccugguagagggcuuuauuuauuuauuuuuguauuuucuuuaaauuuuuaaauuuauguguauuuugggaaugaagcaugugcagguccccacagaagauaagaaguggacucuggguucccugaaacuagaguuacagacaguugugagcccacgugggugcugggaguugaagucucauccccuggaagaacccggaacccauuaaauugucauuucucuguucucuucuuagagcccuggcaaccaucagucugcucuuccaguuguuucauaaaauauguggccuuagaccaaaugugguuguacacuccgaugagcucagcaucugaggguaaaggcaggagggugcaagguucaagcugcccuguaguuccaggcgucuuaaaggcuuuagcucugagagugguauagaguguauuacugguuugguuuuuuuguuuguuuguuuuuuguguauuacuguuuuauuccuuuauaaucaguguauggaugcauuuguuuauucaacuauuggugggcacuugacuucuccuuuuugaguauuuuaaggaguacugccaugaagauucaugcacagauuucuugcuaacaccugucuaaagcuuuuugaauauguaccuagauguggaauugcugagucacauaauaauucuauguuuagcuuuuugaggaacugccaggcuguuuuccauaacagcugcaccauuuuauuaauacauuccuucccaaaauauggaagaguuccaaggcaggggauaugacucaguugguagaaugcuugccuagcaugcaggaaucccuguccugucuuugaguaccagcacuacauaaaaacagacauauuuguaaucucagcuuccauagugaguuugaggccagccucggcuacauugaguuccugucuuguuuuguuuuguuuuguuuguuuguuuguuuguuuguuuuuuaauguugcagcuucuccgcccugccugcaaugcuuacuuuuuuccauccacuggcuuuaucccuuugugcugccaaccuacuggauguaaugggguauuucauuucucauucucuguguuuuucaguccugggggucagacccaggccuugcacuggcauccuaggcuucuucaguccuuuugguuuugauuugugucucuaaagacuaagcuccuuuugguguucuauuuggauauacucugggagaaauguccauuuaaaaaguccuuagcccaguuuuaaaauuggauuuguuguuguaagaguuuuuauauuggggauacuauaucuauuauuuuucuguguuuauuggaugcaagagccacuguguaugugugugucucugugucuguguguuuugagacaggguuucuuuauauaguccucacuguccugcuggaacuuauucugcagaucaggcuggccuugaacucagagauucacuuuugucugccuucugagugcugggauuaaaggcaugggcuaccaccauauagcauuuuucugauuucuaugggcugcuuucuuacuaucccuccaguuucaaacccuagcaucacaaaaggggguggggggagagacuccauugaauguucuuagcauucuuaccaaaaaucaauugaccgcuaauguauagguuuaauucuggauuaugaauuauguucuguaguaugcaugucuguccuuaaugucaagaucagacuguuaugauuaucauaauccaucaaaguaguuuagagacugugacuugagaaucauucagcaguguuuuuguuccuuagaacaaaaacaaaaaaacaaaauaaaacaaaccucccaaacaaacaguaacagcaacaaaaugaagaaguguacuucuccaaacaaaagcauaaaauccuuuugcuguuauuucagcuauucacaauccauugcaguucugugagguuguuuuuaaaggaucuguucugcucuaaaggcaguugguuaucucaguguguguguguguguguguguguguguguguguguguguguguguguguguguguguguuagggaguauauguauauacauguuuguuugugcacacguguguagaggucagagauuaaugucuucuguaauuguucucccuuauuuucugagaccaggucucucacugaaccuggagcacuccuguggcacaacuggaugaccaguuaacucaccccaggcccuauccccacuccucggcauggucuaggaaugugucuccuugcccaguuuuucuguuucuuuuuaauuugaguucuagggaucacuuuggguucuugugguuaugcaacaagcaucuuuccuggugaacuguauuccuagccccagcagugaauugcauugacuguugacccuaucugagaauauugccaucuucacaguaaucaugccuuuucauuuauuuacaucaucuuuaauuucuuucagcaguguuuguauacaaauuuugugcuaccucuguuuaaauuaucccuaucuuauucugcauauguuaguauuaauuuucauauucuucagugcuugcacuuagaaccagugcgguuuuaugugucuauuuugucucuugcugcuuugcugaauuugauacaaaagguuuuuauguuuuuguuuggagaaauucacuucuucauuuuguuguuauuguuuguuugggagguuuguuuuguuuuucaguuuugucuucuaguuuuuuuauuucuuaaagauucauuuacuuuauguguguauaugugaauguauguauauguaccauauaaauguagcuguccauggacugcagaagaggguguuagagccccugaaacuggaguuacaggcauuuguaaguugccugcuuagaugcuggauacagaaccucucaaguagauagauugcagaacagguccucuccaagaguaucaagugcucuuaaccacugagacauuucagcuccucauuguugauguuggagauguuguugcuguguagcuuuaacuugacuacaaagcagucccuaagccuccugcacauuagaaucagaagcaucagccacaauaugcaacacuugaacacauuuuuacauuuuuuuaaucuaguguguauauguguacauaugugccacaguuuguauaugagggucggaagcugacuuugcaaagccaguucucuucuuccaaggauugaauugucaaauucggugggaaguuccuuuacccauugaaccaucuucuuauugcccuaaaauaguuuuuuguuuguguuuguuuuguuuugagacaaaaucucuuccccaagcuggauuagaacuccucacuagcugaaagacccuugaacuucagauucuccuucuccccgccuucuuccucagugcuggguuguauuacagcugugcauugucauacuuagaugauuuuccuuuuuucuccccuuaaguuuaccaugauucucuuugucucuaacccuauauuuguuuauuucuccauucuuaauaaauuucauuuugccuuggaaauuguuaguaacaguuacuuuauuuugaugaaauaugguuguauuuagaguaaggagagggcuuauuccaccuaacagcuuacaaguccuucugaagggaagucagaacagaacuagaacaaaggccauggaggugugcugcuuacuggcuuauucucucuagcuugcucagccuguuuucucagacaccccaggaccacuugcccacaauuggcacuauucacagugggcugggucuuuccaagaaaaucguuuuuaucuaauggagacauuuuagcaguuguguuucaccuuuccuagcuaacugucaaguuggcaaagagcagccaggaaggggauagugcuuguggucuaauagucaaauuaaauuaucacauaaagcuuuuuauuuuuuuauuuuuuacuuuuuuugaaccagggguaguggcacauaccuuuaaucccagcauuuuagagacagggauagaaugaucuugugguuucaaagccagccuaguuuucaaagugaguucuaggccugccaaggcuacacuguaagacccuguuccaaucaaucgaucaaccaaucaauaaacaaauaaauaaggcuaaacaaugagaccuuguuuaaauaaauacauaaguaaaaaaaaacaaauuucaauauuuuugagaauuucauacaauguguuuggaucauugaccccugcccuaaaucuucagauucaugccacuuccugaccacccaguuuugucuuucauguugccuauguauucuuuguguggccuuccacuuuagugugguuuacuugguagagaacuacacucuuaaaacuuugacuucuccugccaggcaguggugguacaugccuuuggguagaagcagguggaucucagaguuugaggccagccuggucuacaaagggaguuccaggacagccagggcuauacagagaaacccuaaaccauaaaaggaaaaaaacaaaacaaaacaaacaaacaaacaaacaaacaacaccugacuucucccuuccccagcaguucucaguugccaguaguuccuuagcuguggaugugacuuggugccugucucagcucuccuuguugggauuuguuucugcugucaacaacuguuugaguucauagguuuauauauagcugcccuguuaguucauaagacacuguguccuuacagucauccuccaccuccucuuacauccuuuuuuccccauuuuccacaaugauuccagagcugugagaggaugaggaggucugauauacauugccucauuuaggguuagacauucugcagucuuacucuuugugccuugaccaaucgugaguaucugcauucaucauaaucucguaggauuuaguacuucacugaugagggcugagagacagaucaucugccuauauaaugauaagccacugggaguugguccagcacuaugucuguuuuggagaauaaugguuuuuccugucgggccuaugaccugugcagccacagguucuugucuccaguaauagugcaagguauggguuucauuuuguggaacaggccuuacaucugaucagaaaauaguuacuucuaugauguugaugucacugcuccuucugugggcuugucuugccagaccauuccuuaugguagcucucgggguucacggcuggauaagacugaugaucacaggguucacagcuggaugagaccagugaugacuugucugcuccaguagugugcauagcaccuuccugcucugugcaagcuagccaguagcgauaaagcuuccacaucagacugcuaugaggauugcaggucuugacuuacaccucauuuccguacauguuaaaccuuggacugcugcucaggugcugggaacagaguccagggcaugcacauaguaggcaugugcucuaccacccaguucauaagcccaagacugucauuuggaaguggaaauacucuuuaauagugcuuauuauguuuuuagcaagccuuuaccauauuuugaacugccacucuaugaucacgaauuugguacagcccuaacucaugucuacauuaucuguccaugucaguuucucuucucauacuacuucaagccauagagcauacuuaauuaguauauacagcuugucacguuguucuguaagucucuguuuacuuugucuucucacuacaauagugacucugauagcauuagugccucacuucuuguuuucccagccuagcaagcauuuaagcacucauaaagauguccuaucaguauuuuaacuuuauuucuuuagauaaacaaugaaauuauuaacauaaucauacuuaauguauaguuaaugucuucauuuuauauguuuuauaaagauucuuaauccugaacuuuuuguauucucuuauacuuaaaaauuauaaggcccacacuccuuuaaucuugaaacuccugaggcccagacaguucccgaacagucugauuuacaagugagcucuagaccagucagagcuacaaagugauagauagauaaccugucucaagaaaauaaaugaguguguguguguguguguguguguguguguguguguguguuuuaaucaguaggguagaggggcucacuaguggacuagccuaacugaaaugaagaacuccagaugcaguuaggggauucuuuuaucuuaaggugggagggguuuggggacagcuagggaugagcucugagguuaagagugccuacacuuuugcagaagaccugaguugguuuuccagcaccuauguuucacagccaccuauaucuccagcuccaaagaauccaacaucuucugaccuacacaggcauccuguacacaucacacucaccacacacacauacagacacacacaucacaaacacaacaaacacaauaaauaaacaaacaaaucuaaaaggggcaggggagagaugucucagcauuuaagaguacauauccccuuugaagagaaucugaauuugguuuacaguccccacaucaguaacuuacaacugccuauauggaacucugccuauauagaacccacaucaguaacuuacaacugccuauauggaacucuggcuucagaggauucccacuccuaugugcucugugaguaccaagacacaccugcacaaacauucacacacauacuacacagagagagacagagacagaaacagaaaaaagauuguuauaauucccaaguagaaaugaauuagaaauagaaaugaaauaggcgaauuuauugaggaccugaauuccaucccuaaaaggcacaugguagggguagagagggccaagcuguacuuugaccaacacguacacacugaagcaggugugugaacacacacacuaaauaaauguaaugaauauaggggauuguuggauggugguggcauacuccuuuaaucccagcacuugaaaagcagagacaguugaucucugugagguuugagacuagccugaucuacacaguucaaguauagccaggacugcacaaagaaaccuguuuugaaaaaacacaaccuccuucucccaaaaaauauugggaaucauuuccaauuuuaaaaaaaaucauguagauccacaacuccauguuaggugaauauggccacuggucauaagcuuucuaucucugcaagagauuugacaaaauuuuaugaacauauagauagagugcaauaaaacauaaauugcaaaauuuaauucaagucugguauuccuauaaauuauaaucucuaaguaaacagguaggcuuaacuuucaacuucaaucccaaauauaccuucaccuauuuggaauauaguuagaagaaaauaauuaacaaaaucauagcuggauguaguagugcacaccuuuaaucccagcacucaaagagaguuugaggccagucugguuuacacaaagaguuccaggacagacagggcucuacagagaaacccuguccagugcuguggugagaaucagagaucagaggguaacugugggaguggugcuucuccuuucacauuuuguuuuuguuuuguuuuguuuguuuuuucgagacagggcuucucuguguagcccuggcuguccuggaacucacucuguagaccaggcuggccucaaacucagaaauccaccugccucugccucccaagugcugggauuaaaggcaugcgucaccacugcccggcuccuuucaccuuuacuguggguucccagauugacucaggucaucagacuuucgcagcaagcacuuuuaccagcugaauaucucucccguccuuaacguuaauuaugguuaaauuuaauguuaaaguaguuguguggcauuuuuauugcucuguuugucauaguuguaggaguugagcacauagcauauagucacauucuagacaugugaucuaccacugagcuuaguucccggcuaaugagagcuaggaguguuuguuuugugcauuagaucuuagugcaccuaagaugcacauauauuucaguuuggaauaugugugucagagagacauacucaccauuaccugcugagccaccucacuggcccuauuuuugcuuuuaaaugugcagguauugaacaccuuuuuauguuagguauuaguuuuauuacccuucuugauuguuauaaaaaguauauaaugguuugacauagagcaacuucuuuaagcuuccauuaacauuuaaaaaccaugaacuaggagacaggaaggauaaguuaggauuuuuuucaaggcaaacacuaguagggauucuaguuugugcuaucugcuaaagccucuauagaaacucaugacuauggcgagucaguauuacuaaagaaaugugaaguagccuucagauggugguaguuugucugcauagaacuaacucuugauuacuuuaaaaauaauuuucaaauuauucaugaaugguauuucauauagccguaaaugacuauauauauaaguguauauucuauauaauacaauaauuuaucucuuuaaaguguuacuuccuuuuuuuuaaaaaaaagcuugcuuguucuuuuuuuuuccccccaaagaauaauuaacauauuuuauuuauaugaguacaguguagcugucuucagacacaccagaaaagggcaucagaucucauuacagaugguugugagccaccaugugguugcugggaauugaucucaggacuucuggaagagcagucaguguuuuguuuuguuuugguuugguuuuugguuuuucaagacaggguuucucuguguaguccuggcuguccuguaacucacucuguagaccaggcuggccucaaacuagaaauucgccugccucugacuccuaaguucugcgauuaaaggcgugugccaccacaccuggcucagucaguguucuuaacuacugagccaucucuccagcccaaagugucacuaucaaccaguacuuacauuaaagaaauuguaggucaguagaaaagggauucuaaacaagaaaccauuucuuuaagaacgccuucaaaucucgagcacuggggaaaccagccuuagcuacauaguuguaagacuuuguuugaacaaaaagacagacagcaguaacuuuuuuuuuuuuuugacuuaacucacucuguagaccaggcuggccucgaacucaaauaucuaccugccucuuccucccaagugcugggauuaacguguauuaccauggcuggcagaaaacauuagaucucaauaggaaauacuaaacacaaaagagaaaauuuagaauaaauuuuauuuugggguauaagcagagauggaguugcugcucaggccacuacucuuuuguaguaugaugaauaagcuuuuuuuaaagguauuuugauucuucauucuuaauuacuuuugucuuauguaacuuucauaaaauguguucuuuugugaccaguacccugaaaguugcuggguuucuguugccugcuuucucaucugucuucaguuuaggucccuucuuuucugcucuuuacuugaauuaauccucugccuacuucacaggccgguucuuugaugagaaugaauccccuguugauccgcagcauggcucuaaacuggcggauuauaauggggaugaugguaacguaggugaguaugaggcagacaagcaggcugagcuggcuuacaaugaggaagaagauggugaugguggagaggaagacguccaaggugagccuggccuggcuuccaugcugugaccgugaaacucaccucuuagguuuugguugaauuuguguagaauuuuccccacuuguaaucauaguaguaucuuaaucuuaacucaagagguucugugucauuuuuuagcuuugagaacuauuuuaugauaaguacaaguuaaguuuuuuccauuuuuagauuaucuuacauauauuaucgaugugauaauaugaaaugccaaguccucaaaauuuuuagaauuaaauuguuugaaaugaacguaggugucacuugaggcaaacaccuucagggaacauccuuuuuaaucucaauggaaaacauuuacuaucacaaguauguauagauauuggcuugacaggcuuguuguuaaagugaagccacaauugaaauauggccuccauaaugaacagaaaugugcucugcugcugguggaacacuagaaggccaaauguucugagaaccuaaacauuuauauuucgugaaggguuuauaagauuugucuucauguuuaauacacagauucaacacauuuuuuaacuguugcuucugaacuuuuaacuugguagaaguucagacucuuaacuguguacacaccucagaccacacugcugugcuauaguggggcuucggguuucuuuuuugccuccuuguuuucaguaguauuuuuggaaucuuuaaaaguuacuuaaggucuuagggaaaaauguaagauuuuuauauuaguacaugaguuuucugcuauaaccaguuugauuucuuauuacuuuuuauaguuauuaaaaauuuacuuagguucaggacaagaguuauauauuuuuuaacuuagagaauaauaaaacugcccuuaaauacuauagagucaggauaaaagggaaaaccagcagucgcacuucuuaggcaucaccuugugguccacccuaguuuaaggauaaauauaguuauugaugaaaagauuaauaaauacugggaguucucuaaggacaucaucuuuucucaucaauuuuccuuuccucauugcuuuuaugauuuuauugagcuacguuuguucgccacuaucugcacuacuuuauggcccucucauucauggcugucacaucaccaguuagauuguaagcucuugaagagcaggaauuuucauuuauuuuaccuuguauuuaauucguguucuuuuuuuuguccacucucccauaguauuuggacucaggacccaaacaaugcuauuagcuauuaauaccaugcuuuuuccuuggcucuauccucacaacugagcauggugaaugcucuguaacucugucacagcuugcuugcuugcacuuugaagagucuccccucccugcacuaaggaucauuagauaauuuugagguuuuuauuagaguaguuuauuucaaguauuuuuugaggggggcaugggguuucaagacaggguuucucuguguagcccuggauguccuggaacucacuuuguagaccaggcuggucucaaacucagaucgccugccucugccucucuagugcugggauuaaaggcgugugccaccacgcacugcucuuauuucaaguguuaauaauccuuacauuuugccuguguuaagccugaauuuuuaauuuuuauuuaaagaauuucauuuaauauuuguaugaguuuaugcacagugagugguuuaucuucagugacuugucuccuuuucuuguauccuccccacagccauuucucauuaccacuuugcuuuuccuuuugcaaaacaaauaauaaauucauugguuauaaggaauauaagagccuuaggaucuauuauagcccagucuauccucacauuugauacauagcugaaggcaaccuugaacucuugauccucuugccuucaccucccacgugcuggaauuaaaaacacgccaccacauccaguuuuauguggugcuggggaagaaacccagaccucacaugugaugggugagcaugcucauaaauaagguacauccccaggucuaaauuuuuacuucaguauuugcaaguaaaucuugcuuggguugagaguuguucuuuaguguuuaucuuauuuugguauccauuaguaauaguuucaggaaguacaccacuacaacgauacucacacagaacagaaagaaacaaggacagcagacccaguaaaguggaauagauuggauauacugacuuuaacaggaguauuuaaagaccuaaaauaauuucaaacauacuuguaagauuuuuuaagauccauuauuaacuguccaaagaguggggagauagaccuagcccuaaauuaauaaguuagauucagguguuauugcagggucagaauucagaguugagaucauuuugucauugugcccacauaauuacaaugcucucacaacccaagcaggccuuagaacugacaaauaggggcgggaaugacaacaaagccacauauuggaguuagaguuaaaagaaagucugugugcacuuuuucaucgagaaauuucaguggaauugcuguguauaacuuaaauacuauaggaaaauacaauuuuuauuucaaaaugccugaggcacaucuacccucaggaaagaaaaaaugauuuuuuuuccugguugggaccuuuugaccaauaauaaaaacaaacaaacacacauacaaacaacccugaaguguggcuaggcauaauagccuccacaugucaucccagcacucaggaagcugagguaggugacagagggagcacuaggcuauucugaacuacagagccacaccuuuucuuuccuuuacaauucuucccuauuauuuugugugucuuuuggaugcaugugugucugaugccggaagacagaaguaguguuauaucuccugaaacugggaguuaacauguaggugcaaggaauugaacuuggguccucuagaagagcagccaguacugucccugcuaaaccaucuugcagcagcaaaaccuugagagaaagaaaaggggaaggaaggaccucaaagcauuaauaaagcuguaagcacaggcucugcucugcugauuguggaagcaauuuuuugagauguggaauauacaggauuagagacuccagcuaaaggcuaagauucuguuaguuaaauacacucuaucaggacugugaaguggcagcucuggccauuaggccguauucugcucccugugacuuuggacucaacacuguuaccuccaguguuugcuuauaaaauuaaauaagacuucuuuuuccuguguuuauaaugacuuaguuuuauuucaaacucauagaguauucuaaaggaaauaauuuguguugauauaaaaauuugaaaagaauaaaucugaaagcaugauagacauguucuuuacuguuauaagaagguaaaaacuuggagcuggagagauggcucagcuguucuugaggaucucgauuugaugcccgcuauauacaugguaguccauaacggucuguaacucuaguuccugggaagucaauacccucuuuuugccuccagcccauguggaugguacacagacaaaacacucauaugcauaaaaucuuuaaaacuuuuuagagauuuguuauuuuuaauuuucugucugucugccugucugucucugccaccccgugugugugugugugugugugugugugugugugugugugugucgguaucagaucccuggaacuaaaguuacagauaauugugggugcugggaacugaccacucagguccucuggaagagcagcgaauguucuuaccuggugagccaucuccccagucccaaauuaacagucucuuuaaaaagaugguagaaauguguaaguuuccuuuacucuuuaaaaucaaagaaauuccccauuuauuugcuaaauauuaauaaacauuaggcacugucugcaaauggaaguucagccugcaacccagugcuaaaagccuggauuugaauugucucuccuucacuugcugacacugugagcuuguaaauacuaugguuuguaccauaauucccacaacuauaaggcagacauauauguacuuaccuaacagaaguuauauggacuacaugauuugguaucaguccacgcuuaaaacagaccaugucauucuauaaagcacuguuuaaguguuugcucaauaauuuuuuuaaguaaagaaaacuuuagaauuuucucuuuggauugccuccuuugaaggauaaugccuuguguccugaggguaauuugugacucugggaaccuuucuguauuaggagcucuuuaguugcuaguccuuucuuacauuaacaguaagcuuagcacugaugucacaaauuaugcuuauuucucugguuguauuucuuuggcuguuuccucauggcuagcuacuuacagguucugcuacuuucuguagaaauuaaacacucaguuucuguauuuauugucagagugucaguuguauucugucagguaauuguauaggcuuauaguuaaguauaaagaaguuguugauagaaacuagaaaucuggguaaaaucacuacacugaaaacagacuauaguuaguuaaaaaggugcucacugccccgggcgugguggugcacgccuuuaaucccagcacuugggaggcagaggcaggcggauuucuguguucgaagccagccuggucuacaaagugaguuccaggacagccagggcuauacaaagaaauccugucuccaaauuccaaaaaccaaaauaaauaaauagauagauagauagauagauagauagauagauagauagauagauagauagauagauaaaugaaugaugcucacugcaguauuccaaaaguccucuggaauguuugaaaacaguauaucagcauuguauuaaaauugugcuaaagaaagaagacuggggcuggauagcucagugguagagugcuuguccagcacgugccgcuccugagaucagucuuuagcugcaugcucacacaagcacacauguaugugcacaguaaagaacguagacagaaguugccaaaccucccuucuauuuauagaggacuuugcaaccagagacugcaguuccaucguuucacuuugagguaagacaguuguucuggacugagaaggcgcagggcagguccaagggguggaacuagcuccugcaguagcguuugauccagggacagaucccaguguucccuaucccuagaaccuucguuuuuuaucucagccugucuuuguauuuauucauguaaaaauucacaaaaguaauaacauuuuuccugcacuaaauuuuguguugaauuucucagaauguuccauugcuuuauagugauugucuuaaaagugauuguuuuaaaagauguacucaugggcauaaauugaagcuucguaacucagguucuccagagagcauucuacaaaagugcucccuuuaaaaucaaaauuuuuuuuucuuuuaagugugauuuuuggugagguguuugguuuuuuguuuuagugagaugcuaucucaaaauaaaaaauaaaagcaggggcuggagagauggcucagcaggugagagcacugacugcucuuuuagagaucccaaguucaauucccagcaacuacaugguggcucacaaccacccguagugagauaugacgcccucuucuggugugucugaagacagcuacaguguacucauacaaauaaaauaaauaaaucuuaaaaaaauaaaauaaaagcaaucuacggauguggcucaguaagcagguagucagagcccacagcaccacauaaaacagaugaaacagcaagugagcuaacaaguauaaacuggcugaggauggagcccugugggacaacacuugacaaguaugcagacagaguucagacccuagcacccccugugacaaaagaagugaucaauauucagauuguauuacaaaauggugguuugaauucacaauucuaugauuuuaacagggaaguuguugaaaggaaaaagaaaguuggguuguuuggucauuuuagaaagcccaaaauagcauguggaggguugaaauaggauugugaguucaagccugagcuacauaaugaaguugucucaaaaacuuacuguuauagggcaccuuggaucucaggggaggagucagagucaauaugguucauccacuguaugaaauucuccaggaauuaaugaaaaauguuaauucaauaugauuccaauucaaagauggucccuaauuuauaauaguccaguaguacauacaaaagcauauccauagagccacccugcuuuucauuuucagaugguagucaguaaauuaugagugauacuaagaaauaaguaacaaaaggaagcaaugcacaaagccaucuccuaauuaaacuuccguucauuuuuuuaaaaaaaauuuuacuaauuuuuuguuucauguauauugauugauguuuugccuacaugugugucucuguaaggguguccaaucaucuggaacuggaguuacagacaguugugagcugccaugugggugcugagaagcaaacccaguccucugaauucuccagaagaguaguggugcucuuaacugcugagccagcucucuaacacccccuccccuucauucuuauucuaacauaaucuuaauuauuuugaacaguuguauaucaaaauuuggggggcagggagagggcuauugagaaauaaacagaacuugcaaaauggcagcugacagaugagacuguaggcagagcagacugcaaggcacucacuagagucacucacuacagcugcucaaaaggcucuuggggucucgcagcuauaauuucuuuuuuggugaagaaagcucuaacuuuugguacaugugcucugauuagaaaguuaugaguaagcuauuuguagagaacuuccuggaaaugcauauugagauuggggagaauuuauauucucucuuauuuucuaauuuuuuucaugaugaguguagauuaccuuuauaguuugaaaagaugauggugguuuuuaagagugucaccuguagcuuaggcuguuuugaaacuauggagauaggaaugaccuuaaacuaggaccucacaggcacauaaaaccccauaagaccagcuaagaugaggguuuuugucuuuguuuuuauaagacuuauuuauuuuuauuuauaugaguacacuguagcugucuuuagacacacacuagaagagugcauuggaucccauuacauaugauugugagccaccaugugguugcugggaauugaacucaggaccucuggaagagcagucagugcucuuaacugcugagccaucucuccaguccauaagauaaugcacagcacuagcucuucagugcugugaguuccuaacauuuugcuagcucugucugucuauuuccccgguaccugucagaagugacucuguucuguuugaaaguuggagaugauugguguuucuuugagaugggguuucauguagcccagguagaccucaaguuuucuaugugguccaggcuggucuugaacuucuaauccuuuugccucaggcucccuagagcugggauuacaggugugagccacuauguccagcuaagaauauuuguuaaaauuaaaucuuacaaaguaaugauagacuauuuacacuucagccauguggcuaaggaacagagcacuguuuaagauaacaagcacauaugggauaaugagaaaagauugcugaaaaacuggagacacuuugaagcuggcucuuugcagcaacuuuggaacucuauucuugauacauauuauuuugcuugcagaugaugaagaacgagagcuucagauggauccugcagacuauggcaaacagcgcuucagugauguccuuuaagucuaagggauucccgaaacccaaagugcugugcaacagaucaucucuacuugucaauuuugacuuuugcuguaaagaucaguuguaucaguuguaaagauacauugagauagauuuaaggaaauuuuaaugaaggaauguaccaauguacauaugugaacuuuuucauauuauauuaucaaagcagauacuuuuuuugguuacuacacagcugggccaaaaacaguuaaucuuugcauuuuaaagcaaacuaauguaaauuucacauuuuauugagccuaauuuuuuuuucacaaagagacaaacaggaacaaaugguuguacagguuauaugcugcacauaguauaaccacaaugagaacuuauucggcugaaaaguccacauuacuacauuuuuguucccccauagguguccucuacuaccccucaguuaacacucuugaagaaguucugaauaguuacacagaaguggggaggcuggaugccagacagugggcaaauguacagaauggccuucuacuccuuuaucuuacaugggcccugaugugagugugcugaggccugaugaaaagccuaggucaccguuacauccuuaccauaucuaucaguaguuccuuacuugguucuugaaguuguggaaugcaugguugacaguguauuuuuauuuuucaaguaauaccagaacuguuuaacucuggucagcacuggcuaaaauucuuucuauuuucagagcucaagcuggugaauacauucaccaguuaagagucagacccugagagagacugaauccacuuugaaaugagucugcaaucaguacagcaaagcuuugcugguaguuuuaaugaucguauuugauuagacuuuuccagaacuacuaaguaagggauuuuaacagguuuuuauuaaugaacagaugaguagaaguaccgugaagucugcagcuauuuuauugaaauagcugaaaacuuuguaauaaaaaaugaguauuuguaauuaauguuaguuaagaacccaccaagcucauuugcuagacuuacagaauuauuuucagugcauugugucuuuuggcauuauucauuaggauauauaagcuagcuaauccuuguuuacugauuucaagcacuuuuaauuuuuuuguguucccuaaaaauuaaagguguugaucauaaggcuguuaaucccaaggcuauuauuccuuuuuuuuuuuuuaagaagggcugcuauuaauuacacauaagcaugaacuacuagagagugacuguagcucagaugugcagaggccuggguuugauucaaacacuaaaaacagcagacaaguaaguagacaugaaaaguccccacacuaaggcucuaauccaaauacuaacagaaguauuguucaccugcugacaucugaaguccuuauaguucaguccaaaguuauuuaauggccaggaaaagauggaauaauuuauuaaaauuuguuuuuucugcuaucucagauuauauaccacugggcauguaucacaacugcaauccuaguguugaggaaacagaaacaggugugucccugaggcucacugaauagccauccuggccuaauuagcaaguuccaggucccuguaagggacaguuguuccugaggaacaucuacacacacacacacacacacacacacacacacacacacacacacgcauauauaaacaaguugacccucuggcuuccacauacacucauaaacaccuguaccuacaugugcacacauguaacugcacacgcacauacccacacaccaagaaacuaaacaguucaugauuuuguuaucaguaaagcuaggccucuguaguaaaaaguaugguucacauuaaaauacagucaaaggggagugacauacaaccaugggcauuagaaaggggagcugaaccuacaaaugccuagugauacuccauacuugauacuguagaacuguacagacaaaaucauaaagaugccuguugguuccucuguuauaaaagcagucacuugauuuuaugguaccuaucuaucuuuauauggaaaaaaacuucaauuagcagccuagacauuuuauaaacugaggaaucuuggaccaauugauaauauuucugacuguauuaacauuuuagugcuauaaaauacuaugugaaucucuuuaaauugugacauucuacagucuguauuagacaugcuauuuuguucuguuuacaguguuuuacuucugccuuaagauuuaggguuuuuuuuuuauuuuguuauauuuuaauauauuuugcccugaauuaaguguuaauuugaugggaacucugcuuuuaaaaaaaucaucacuuucuggguucuaauaaauuaaaaguuaaacuuguuucacaguuuugauuauauauauauaauuacaugaauauaaacauuuacaucuugacauuaaaacuugaauaaauguuaucauuuauuuuaagguaaauuggacuaaaagacuaggguugggcuggugagauggcucaguggguaagagcacccgacugcucuuccaaagguccagaguucaaaucccagcaaccacaugguggcucacaaccauccguaaugagaucugaugcccucuucuggugugucugaagacagcuacaguguacuuacauauaauaaauaaauaaaucuuuaaaaaaaaaaaaaaag

SEQ ID NO: 1041 - RNA, 62617 nt, Mus musculus
cgcgcucuccuugucgcccggcucuaggcgguuccguuagcggcgggagggaaaaccgcccccggcguccccgccuccgcugcuaacgcuuuccucccuacucccccugcgaccaccccgcagcccgcuacggaggcccccgaaguacaaacgucccccacgcuccgagccccaucggaggcugaguccagucuaacuccucgggcccuaagcucauuuuuuuuucauuguuuuuuguuguuguuguuucuuguuuuucuuuuggucaggaauucgcucuggugaguucccuaaggcggcagaaacuucagccucuucacgguaguaaaaguugguuuccccucccccgcugccgcccaggccucccgcauuccuucccucccgccucuccggaucggggcgggcgggggaggagggagccagagcgccugcgcagggaggccgcuuuccauccgggucccuguccgugcggugcagcaggucgguaggcgggaaauggcgacuggcugaaggagcugguucuguugcugcugagggauaagcgggaaagacaccaccuauugcgcagucgggaccaucgccggagcccgaagacacuuuucugucgucacagugaagguaauucccuugguccagacgcugccguugcuccgaagcucaguccucucucagggccgucugccgggaucuccuccccuucucuagccgagcccucagcgguuccagcaacguccguaggcaugcacuguuggcgccuuguacguccacugucguggaagcugcucuggcuuggacuuuccccagggaacggccagggagcucacuucccgccagcuucagcucuuaggcugcggccuguguugugauuucugggguuagauuucacuuugcuacccacccccaaccccaucucacguucccagucucugaccccguggacccgauagcuaauuaaguuagauugccuuuucgaaccuucuugugggcccacguaauguuuuugguauuucauucuuguagggugcauuaggggggcguugcucucucuacuugagcucuuacagacauccuuugagaaucuggaaagagguucuuggagcuucugucguuuucuguacugcuaaaauguugaguugacauuacuacuuuuuaaagucaagugugguaguaaaaaccagcguguguaggaggccucugauuuccguagugguuaguuaagggugaaucuuaauucuauuuagcauguuguuuacguuggguaaguccguaugaguuuaccuuugcguucuugaccaggauucugugauaaauaauugcauaaauaaauaguguuuauuuacuucucgcccuagugguagcuggaugugugaaugacguuaggcacucucagaguaccucggagaaaccuacugagauacugccaggaaacuacccuaagcuccugacaugaguauucuuagaugcuacuccaaggcaaggcagggaguguuaucuuucucaugcuacuaagacaauaccaagauuacgguuacauccauauacaaauuagugccuugaaaugauaggcuuaucuacauguuuuagauuguagauugccuguuacuuugauucaugaaaugccaagcuacacauuuguguuugugguccagcaauuaucucuauaaaagcagugacauggcauguggaagcuaguuuuuacuggcuuuuguuuugauuuuucuuuuuuuaauagaguuucucaauuuuuuuucaaugguuuggucaugucgaguuuggggcauuauagguguuuucuccccuggaauaaaacggaagauuaaaacauggcuuauauuacauauuaguuaauguuucucacucaguagccuucugcuucauaggugcagccuaaaguacuucacuugcuguucacauguuaggauuaaauuucaguaauaagcaggcacaugcaaacauuauaguuuuuauuugaaagacuuagcccaaggucauaaagaaagucaagguaaacauagcucuuauaugaaguagauuuaggagugaccugggccucacugcucuuuccucacugcugcuugauuucgggguuuggggagugaaaguuuagacagccugaguccuuguugagucauuucauuuuaaaaugggaccaauuauguuacucagaagaauugggauaaauuaugucuggugcaggcuuucucuguguuuuaacaauguuuuagggguagguuuuuugauaaaauuuaguuuauagguagcagaaucaguauuguacuacauucaacuagacccuauauucuuuuuuuguuuaauuuuuguuuugugagacaugauuuugugugugugugugugucacagcucuguacuggaacucacuuuguagaucaagguggccuugaacucacagaaauccaaccugccucuaucuccagaggccugggauuaaaggcaagcgccaccacagccaggccagucccuauauuccuaauagucuccuaugcaugauuugaaaggaugugaaaacugccaagugcuaucuagucuuuuucucaugugugcuauaguuguauugcaauaauaggauuguguaggaauacuaaauaggauagguauauuuuagaacauucaguugugcauagugcuggugccuuacagacauuucauuugaacuaguggugcuauuuuuccccugcuguuagaaaauugaugauugggggcuggugagauggcucaguggguaagagcacccgacugcucuuccgaagguccagaguucaaaucccagcaaccacaugguggcucacaaccauccguaacaagaucugacucccucuucuggugugucugaagauagcuacaguguacuuacuuuaauaauaaauaaaaucuuuaaaaaaaaaaaagaaaauugaugauugauaaaguuuuaucuuuuccagauuaaucuagccuauuccaagguuguauuugaucagaugguuucuuuguaggaugauuugagcaaaaucugucuggauauguagugcagugguaaagugcuugccuggcauucaggaaacccuggguugcuaaauccccaucgccagaugagcugguucuggugguuccugcuguaacuuaccucagggagguggaagcagagaaucagaaguucauccacaucccagcuauaguacacauucgaggccagcuugggcuacaggaggcccugccucuacaagaaacuugaacuugcucagaaaggauauacuggacaggcuuguaacuaacugcagaaucaauugcugauugauaaaguaguauuaugcuaacuuaauaauaauaauucgcuaugcuuuugauugauaaaucaaaaauauauaaagaauauagugguuugccagaauuugaaaaggggcagcaucucauuuuuuuguauuuguaauuuaucaaguuuuuaugaaaauauaagggaagaagaaagguacuuuaagucauguaucaagugugugaagaggaccucauacauggugcacucgcucuuaaguuguuuuuacuaguuagauuaaaguugccaaaccauuuuacacuggauuggcuacaggaagucauuugugcuacauugaaaaugaaguugcuuauuuauauacuuguuuguuuuuuagugagacagggucuggcuauauagcccaagcuuacucaaacuccagauccuucugccucagccaggagugcugggauaaaaggugagugccacuacaucccagaauuaggcuauuuaacaggcauggaacuugcuagaaggagcaauuuugacuucaguucuuguucacuuuucugacaucuuuaugcccuaaccuaagcuagauguauccacuaauguuuguaugaguauauaugcuuuuucuuccuuaagaaaaagugcugcugcuauauagcccuugccagccugaaacuugcuauauacacuaagcuggccuugaacucacagagauccucuugucucugccuucuaaguccugggauuaaaggaguaaguacaucacgacagcuauucaauacauccauuuuaaauuuaaacuguauuaaaauuauuauugaaccuacccauagguagaccuaggugguugagauuuucuugagaaaugucuuguucgacuucauuuauauauaccaagucuuguggaauucucucugaaaugcagugcuuaaaauuauaaauucagcugggcagugauggcacacgccuuuaaucucagcacucgggaggcagaggcagguggauuucugaguucgaggccagccuggucuacagagugaguuccaggacagccagggcuauacagagaaacccugucucaaaaacaaagagaaagaaaagaaaaauuucaaauucagcuggguguggugacaagcaucuucaguugcaguucuugggaggaagaggcagguggauugaugugaguuuaaggccagccuagacuauauagcagguucuaggacagccagggauauauaaagagacccuauguaaaaacaaauuacaaauucuuagauaaaacaucguuguauuuuauucauaaguguagauuagcuuguuaaacuacacauaagugagggugagaguucagagacaguggaauugaggaaacguaaauuuccuucuguuuuuuuguuuuuuguuuucuuuugcuuuuguuuuuuuuccagacaggguuucuauggcuguccuggaacuugcucuguagacuaggcuggccucaaacucagagauccaucuguuucugcuccccaagugccgagauuaaagguguguacuacugcauuuuaaggaaaguuaaauuuuuauauguugguugugaucaggagauagaugggauauaggaguguuggcuagguaagacaaacgugaugaaaguaaaauuuauauagugagaaucuuaggccuccaggggcccuuugauaaggaauggugagauuuaaggguggcuuccaagguaagacuuuauggacaaauacuuuuuuauuuuguuuggugacagggcaggcaggcuuugaaucuuccauguagcaggggcugaccuugaggcccccccccaucccucugccuccaccucaaaagugcuuggaucacaggcauaagucaccauguccaucaacaaaauuuugacauaaaaucauaguagaauaguagucuaggaucccacauuucaugauaugcauagcuuuucuauaauagauugaaaaagagagagauugaacauuacuaacaugaguaauagugcuuugagcuggaguuccaacaaguuaggcuuucauaauagcugcaauaauuguaggacaagcacuuuuuaaaacaaacaaacaugaaacaguauaguagaaaguggcacuugaauacuuuagaaauaauuaggguuaaacuuuaauaauagccauuucuauaggaucucacuguaucucaggcuggcuuuaaacuauauagaugugcccauuuauuuuuuuauuuuuauuagguaguagagacgccuuuuuauuugaauuucuuuagugacuuggauaaguaggggagagaaaaugggcaaacucaacaguagagcauccguuucaguuuagguguacuagaguguagauuacuuuuagcuuuuucuuucaugguuguguuaacgauuuuuaagauaagguaugaguuaguuaaucauagaaucuagacuuaguggauaacaauuuuuuuuguuuuuccaaaauucaguucauuguuuuaaaacagauuuuuuaaaaaauuaaaacaguuuuacauucauuuacuguguguguugugugaacaccaaagcuauaauuauuuuaaauacugugugugacugaguguauguaugaguugcuacaugccacuguguaccuguggggaucagaagacaacuuucaggagcgcauucucuccuuucaccauguugguucacaggcucaaacucaggugguaaguacacacccuuacucucaccgacccaagcaauucuugaggcagacaguugcaauuguaaauugucuuugauuaccagauuaauaguccaaguauaggacuggcuuuaucuaggggguuccuuacaauacagcaauucacaauaaugguacaaauauaaacuuaguuggaaauuugucacagaggucuucagugcacuaauuucuaccaaacacaagaaagaaaugaugccgggagugguggugcacaccuuuaaucccagcacuuggggggaggcagaggcaggcggauuucugaguuugaggccagccuggucuacaaagugaguuccaggacagccauacagagaaaccuugucuugaaaaaccaaaagaaaaagaaaaagaaaaaagaaagaaaugauaaacugcacaugaagguuucucagaaaguuaucaagacuauauaauuuguccucuuucaaacaaauauguuugcugaaaaaaucagcauuacaguggcaaauuauacauugaagaaaagaagggcagccaauaaagcuguaaaaagauuucaaaucaagcuuuaaaggcaaaaaaagucaaagccagcccagauugucuauuauaaagaauauuuggggaaauaaaagggcuagagguguagauucauggcaaaguaguucuucguguacagggcccugucuagagagcauccuggagaaaaugcugugccaguaagauggcucgaacagguagaccugacaaccucagcgcaguccccaaguccacauggcacagcauuauugcauuuuacuacacauaaauuuuaccuuuugguaaagugcugagccaggcaagaagaucauguguagcucagcacugaaagggagaucucaccaaguuugagaucagcuugggcuacgcagagugagauuuugucucaaaauacacauauacacauacauacuaaauuauugugaauugcugcauuguaaggaacccccuagauaaagucaguccuauauuuggacccuuauuguaaucugguaauccaagaugauuuacaauuuauaauugccucaaaaauugcuugggucagugagagggugugugcucuccaccugaguuugagccuaugaacccacaugguggagggagagaaggcacuccugaaaauuguuugcaguggccugaaggcacucauacgcacacucaguuacacacaaaaugauaaagaaaaucuuaaaauaauuauagcuuugguaguaauuggaaauggcugugauaaagaaaggaaaggaacuuuuuuuuugcccguuuuguaagcaaacauucuuacuguacugaugauuguucagagagagaauuuucucuuaucugaucuguuugaaauaaaugaaaaacaaauugguuaaguucaguaaagagcaaagacugaguuguagaguaucagguucuuaaagugauggauuagaucacugccuucaaggguuuuuaguucuuugcaguacuucugcaugcuuagcaagggcucaacuucugagcugcaucucuuaguccuugccaugaggacuuacucuugucaagugugauugaaucuauugaagcagauuauuuaguguuaauuugguaagagcuaagugagagaggaccucaggguuuacaaaaguuuauggguguggagguggauuuuauugguuauaugauacuugggcugaguuuuaaacagugaggauaacuagguaauuaguugaaauaauaguugugguaaaagccgggcgugguggcacacgccuuuaaucccagcacuugggaggcagaggcaggcggauuucugaguucaaggccagccuggucuacagagugaguuccaggacagccagggcuauacagagaaacccugucucaaaaaaaccaaaccaaaacaaaacaaaaaaaaaguugugguaaagaggacagaaacauagguagagagcgcagugugucagagcuaugauuacugcaguacagaggaugacagcaaauaacagugaagaaagacugcaccuggaaacccucucuggggaauuaaugcagguggauuguuggugcugaccgugagcuccagguucuguaagacccagucucagccaggcagagaaagacugaggaacauaacugguguccaccuuuguccuccucacaagcucaucagcacacacgaacaccuacuccauguauuugcaacacacucucucuccuucucucuccauauuauagggugauguauuugccagugauuuuugaguuuaguuuuuauuggaaagaaguugauaagaaaccugguaagaggaguagacaagugugcagaucagaggaugguuuuaaaaggaaagacugaaaaauuaauacuagagguuaaaaaccggaguuucauaguugauuauagggggauaaggccagugucacaacuagguggucgauggaguuuaggguuuuuugguuaguugauuacguugaugaauauaggagaaacaauaaaacaggaagaagauauuuugggauggagugagaaaaauuaauucaguuuuggguaaguugaguuugagguggugagcuuuaagucugcaauuuuagauaguagucuagaaaaucaagcauuauuaaugucgcaguuuauggucaaccuuugaaaggcuccugcagcaacaacaccuguaaccuauuuaccuguaaccuauuuaccugggcagcagguaacuacaaaacaaauuuaaguugaaaaaaauaaauaaauguuuuuuuuuuuuguuuuuuuuuuguuuuuuuuuuccauuuuuuauuagguauuuaacucauuuacauuuccaaugcuauaccaaaaguccuccauauccacccacccccacuccccugcccacccacucccccuuuuuggcccugguguuccccuguacuggggcauauaaaguuugcaaguccaaugggccucucuuuccagugauggccgacuaggccaucuuuugauauauaugcagcuagagucaagagcuccgggguacugguuaguucauaauguuguuccaccuauaggguugcagaucccuuuagcuccuuggcuacuuucucuagcuccuccauugggagcauaaauaaauguuuuaugcugucuuuaugucucaaguucuuggacuuaaaaguacuauuuucuuauuuuaucauuuucguuagcugguacuagauuuauuuuacuaagcaugaucauuucccacucuucuguuaagggguguguguguguguguuuuaaguguuauaaagagaaauuguauagcgggcuguagagaugguucaggguuuagguuguuacugcucuucuagaauaccucuguuccguuccaagcacccucauuaggcagcucacaaggugccuguaacucaagccccagaggcucugacaucaucguuucauacacaugaaggcaggcaaaauacauacacacauuuaauaaaaagaucuuaaaaauaucuuguguugauugguuucuauagugaagugaacugggccuuguauuuuacauaggguuuuaacuacauacucaauuuuaaauaugagguuaaccagccuauuuaucauuguaagguuuuguaauuuuuauuucuuuugagacaaauuuugcuaugucucaaacuggcccggaaguucuaaucuuccuaucuugaccuucugagggcugagauuacagguauuuguacacuaucccuugguugugacuaaucuuuugaggaauuuggccauuucaucugaauugguuaauguaaagauguuugaaauucuucauaauucuuucuaagucuacacaggcucuguuguaauuuucaaguuuucauucccaauauugguauuguaccccuccccuuauucuugcaguagcuugucaauuuacugagcuuuucuuuaaaaaaaaaaaaaaaaaaaagucagcuucauugauuuccccuccauuuuacaguucuaggaccuuauacuugagacaaauuuugcuaugucucaggcuggccuccuacucuugaccuccugagugcugggauuacagcuguuuaccacacugucagcuagcuguuuaccugagcugaaaccccacccccgucugaguuuuuccaucuuuguggaauuuccugacaguugcuuguauuuguuacuggugguggugguggugaugguggugguguguacaccucuauauugggggagcaugacacaguguauguggaggccagaggacaacuuuauggagucauuucuuuccuucuacuuauaugugggcucgggcuugaacuuagguugccagacuuguguggaaagugcuuuuacccaccgaguuuugcuaacucuuggaguauuuuacugaaugcugaauauuaugaacagaaaguaaacacugguauaaucuacuuggaaaauuggauuuuuggagcugugaaugaagguguuuggguuaaucaguuuugcugcagaggguaccuucuucaugcaucacugacuuaaauaaguuuucuuguugcuuuugcucagaauccuaguuggaauguggggaaguuucugcuuucugaucuguucuugacuuuaguuuauucucucugccucaguguaagcaccuggugugcaaagcugauggcaguucagagcaucuucuauccuucccuguuuaaugguuuggacucuuguuucccacaacugagguugcuccagcaccacagaucuauaauguaugcucaugcuagcccaugugcauccaguuuauuaauaauuuuaaggacuggagagauggcuuaguggucaagagcauuuguugcucuugcaaaggacuuggguuugguuccuuuacacccauagagcgacucauaaucacccauaacuccaguucugggggacccagacuucucuucugaccaggcaugcacuugguacauauacaguacauaaaggcaaaacacuuguacacauaaaauaaauaaaucuaaagaaaaauuaaaacccuaaauaauuuuauauauuucuaauuaaaaaaacaguuuaaauuuauuuaaaaacuugcaaauaaaagauuaauucugaugucugaauaaaacaauuuuagauuuuucucauguuuuuguuuuuuguuuuuuuguuuuuuuguuuuuuuucgagacaggguucucuguauagcccuggcuguccuggaacucacuuuguagaccaggcuggccucaaagucagaaauccgccugccucugccucccgagugcugggauuaaaggcgugcgccaccauacccucacuuuuuuucucacuuuuuuauggcauaauuauuucuucauuuguucuagagaagaacccuuacuuguuuccugucucuccuaagaagggcuuaucuuuuguuggauuugagauugauuagguacuucagguucuuaguguucuguuguuuucaggaaggucuuaauucuuuggugauucacccaaguuuuuuauuguugguuuugggcuagagcagcuuaauuauuaucagcuuucuguaagugaggcagaacucaguaauagcagaauuggccauuucccuuucuggaacuacagcuuuaaguccgacuuuuuuccccuugccuucaaguugucuucugauuuagaucaaggaaaggguucagguuggccagauuuauaguaaagaaagaaaacaaugccucuuuugggcuugcaugcauuuucuucuuaaggaccuuaaaguugugugguucuguagaacagucuggccucagagcugccucugucuccagaguguugggguuaagagauuggccacuuugucugcugcugacauuucuuuuugaauucagucaauuguugaucucggaugagggccauucuauauucuggauaucauuugcuuuaggcgaauaauuuguacacauuuucuucauacgugugcaugacaugauaugcauauggagcucagaggacaauuuaggagacucaucucccaccauguggguccugaagauugaacucagacuguguuuuuacuaauuggcgcaccuuacuggcccuuguacauaggguucuugguauacagauacuuuuaauuuugaugucugauuuauucucuuuugagacaagcuuucauguaucccaggcuggccuucugcucacagaguugucuuccucugccuccugaguaaugagauuaaagguguuagaguacaguuaggucauuaggcuuuggggggaggggcaaggguuuguuuguuuguuuuuuguguuuggauuuuucuguguaguuauuuuaugggcuaacuagucucauaaguguguuaauuuacaacguuguuuucuuuuuuuuucuaaaaauuuuuuuugaauguauguuuuguuuacaugugucucagcaccauguuugugcuaauacuuaggccugaagaggccgucacaucccuuagauggaguuccagaugguuaugagccuccaugugagugaugggaauuaaaacucgguucucuggaagagcaauaagugcuuuuagcucugagccagcucucuggccauccuuaaaauuucuuuuuaaauauuuguauuuguguauguguuacuggaagaaaguggggccucucauaugaccuagcagagauccacaucucagcccauaaauccaguuuuauuauguguggugagacugaacucuuaucaaagugaucaacccucucuuguuacucucacaugguuauugguuuuuagaauuguguuugugaaauucaucaagugauggguuuuccucuuaaggucaaaaggacaaaacccuuaccccagggcuuaccuagcuuguggucucagaugugauuaacugcucaauaaauauuuguacaguaaaugaaugacuaagugugauuuugacauagguagagguagcacaguuuuagaaagaucaugcacuguguuuggcauuauucaguuuucuaggaggcaauaucucacauguugaaguuauuugguagauaacauauauaaaauagaaugccuuucacuuacaaauauuaguuuuuuauuuuaguucucuuagagaucuggacucuuuuaaaggaauagauuaauaacuuguguucauuucuccugcagguuuacauguggcacccguaaaagaugaagcugagaacacggaaggcuucucagcaguccaguccaauccagacacagcgcacugccagagcaaagaggaaauacucagagguugaugauagcuugccuucaggaggagaaaaaccaucaaagaaugaaaccggcuuauugucuucaauuaaaaaguucauuaaaggaagcacacccaaggugauacuuuaaccucacaccuauguaaaacacaucaugcuuagguuguuauauuaauagagcccauuuuaaaggauaauacacauuuugguuuuauuuucagggguauaacaugugagguauuuaaugaaaguccaaaacaaacauaacauugaacuaaaaucauuuagcuuucugccgugguuguuguuuugguuuuguuucuugagacaggaucucucuguguguugucuuggccguccuggaacuagcucuguagaccagcuggcauugaacucucagagauccaccugccucugcuucuaagugcguuaggguuaaagguguaugcuuccaccuccugguaguuguuuuguguuuuugagacagguucuugcuauauagcccaggcuggucaaguauuugcuaacaaguuagcacaggcuaacuuccagucuuccuggcuuaacuucuugacaauugggguuacaggugcaugccauuguaccaguagucuucucugguuuucagcaugguguuauggaaaucagaagaggauuuuuucauuguuaauuuuuuucauugaguuauugaagaaagcauuuauuuaguaguguagugcagugagcaguggguauaguauagcaacaauagaauaacuacaugcagcugaaacaauauuaaaagaaagaauguuuacauugguguuauggauugucauaagugauuuaggaagucaguuacucuucugaccuucagggaaauuggaauuggugccaagugcuuggucucaagacuuuucagacuacuacaaaguggaaaaguaguuuuagaaauuuucauguauucuguaaaugugcguuguuauuucugauguugacuuuuggguuuuuuuuuuuuuuuaaauuuauuuauuuauuauauguaaguacauuguagcugucuucaggcauuccagaagagggugucagaucucguuacggaugguugugagccaccaugugguugcugggauuugaacucuggaccuucggaagagcagucgggugcucuaacccacugagccaccucaccagcccaacuuuugguuuuucaagacaggguuucucugcauagcccuggcuguccuggaacucacucuguagaccaggcuggccuugaacucagaaauccgccugccucugccucccaagugcugggauuaaaggcaugugccaccacugccaggcaacaaaucuuuuuuaauuuaauuguuuuuugagauuuguauuuuauguguaugggugcuuugccuguguguauguguguguguguauauauguauauguacauacauacauacacacacacacauacacacacacacacacacacacauacacacacacacaccccacaguauaccuauggaggucagaagaggcauuggaugcccuggaauuggaguuauaguuuucagcuacuaugugggugcugaaaauugacccagcucuucuuuggaagagcauucacuguucuuaaacauagcaugucuuugaaagccccuuucuccaguuaugaucuuauuuuagaauaaagcuucagcauauaaguacuagcucccuuccucauuuuuguuuuuagagguuuuuuugaguuacggucucaguauguagcucugacugccuggagcucagcuguagaguaagcugcacucuacagagacccaccugccucugcauccugagcucugggucucacuauauaaccguggcuggcauucacaagacaucuuccagucuugggugcugggacuaaagguuuaugcugccacucugagcucuccuccuccauuguuuaccuguaacaaaguacaugaaauucucaaucuguuucaaauccauauuuugguccaaagauucaauacuucucugauuucaaaauuuuaaaacuuagcaagaacacucagaaauuauuuucauauagccuuucugcuuuuaguucaaagagauuucuaauacuauauuagaaguaaaagcuucaguuuugaaaugaaauguugaaauauuuauaucacauugaaagcauauuugucaaucuccuaauuaugaucuauagaaagaaaauuuuuuauauuauauaugcaaaauaaaccugacuauagauaagacacacauuacugaacauugagcccagggcaucaugcagucuagguaagcacuguaacacaguuauucccucagcccccauuucuccuuuuauuuuuuuaaagacaaguucucaugucauagcccaagcucaucugauacucaaagcaauccuccugcuccaaccuccagacugcugugauuguaaagaacuaccauacccaauuuuuaacucugaauauuguaauggacugauucuuuucuuuuguguguguguaauuuuuaaaagaugaucauaaaacuuuaaauugauuuuaugauggauuuaugucuccuaaucuagaaaagcauuacuagauuaauuuuguuuguuuugcuuugaaacaaucuccaaaaguucuagcuggacuggaacuuuauauaaaccaggcugaccuuaaacucagagagauccaccuguuucugccuuccaaguguugaaauucaaggcaugcacuaccaugcauggcauuggauaguaauacuguaauccuuagaaugaaauaacccaugauaccauaauaaauauuuuauuacacuuuauuuguuuauuaauuguaugcauauguauauguguggauguauaugugcuauaauacaugugugaaagucauaggauaacugugagagucaguucucuucuaucaugagucccaaggauccaaggcagguuggcugcaggaaccuuuaccugcugagguaucuuacugguccaggaguaauaagcagauaaucuucucuuuuuuucuuucuguaacagagccucauguagcuuaguuucaacccggccucuguguaucagaggcugaccaugaacuccugauucuccagccucuaccuucagcugcugggauuaucaccugccuuaugggacacuggggaucaaagccagggccuuguucaugcuagauaaauacugagcccccagucacuuguugguuuuuuugagaccaugcuuuagcuuggcugaauuagacuauacuauguaagccaggcuagucuugaacucuuaagcagucuuuuugauucagucuccagaagugugggauuacagguauagcucaccacgccaagcugagucaacaaauuaguuaaguagagauggaagaguucucucuccucaucuccaaccacacaugguuacuucauguuacagagauaccucccuuugcaucagcuuuuguuuugauuaugcccuaaguucagauucauuacaaaauauuuauuuaucuuuaugccuaaauuauguuuucuuuuauacuguucuuuuuuguuuuugucuuuuuugguuuuuagagacaggguuucucuguauagcccuggcuguccuagaacucacucuguagaccagccuggccucgaacucagaaauccaccugccucugccucccgagugcugggauuaaaggcgugcgccaccucgcccggccuuuuuugcuuaauguguauaucaggcugaccucaaacagacagucuucugcuuuagccccucaagugcuggugguuacaggccugucuaccaagucagccuuucuguuaacuguguugugugagggaucuugggggaaacagaaguacugaacuuuguuuuauuucaaaacuuauuuuaugauuguuuuugaguuuuuuuuuuuuuuugguaauucaguauauauuuuagaauuaguuuagauuauuaaaaagcuaccacugcuauuuuaauaaauuuuguacaucauucacuucauugaauguguagauuauuuaccaaggauggacaucuuaguauggagucuaucaauucauaaugaugauaauuugagccaggaacaguguugaguaccuguagucccacugcuuauaaggcugagguuggaggauggccugggaaauauggugagacuuguguguuuucaggaaauaaaaaaaaaaacggaagcauggugcugcauucuaauauuaucuaaccugggcuacauagcaaggccuuaucuuaauaaagaacaacacagaaaagacuugggugaugaagcuagccucagauacauagcaagccagcuugggcuacaugagccuguugucuucaggaggaaaaauagaaguauguauagugggugauguguaaguuuguguaauccaugauacaggaggauugucacgaguucuagacccauacuuggcuacaaaguaaguaccacgcuagguagaguucagugggaaaacucaccaacuaaccaacugcacaauuauaagcagaauuaaaagugcucuguuacugaguuacagucuagcccaguggaguuaaucuuauuuuuucugaauaauaaggaagucuugcucuauuucuaccaauucuuuuacuagguauuugauguuucauaaugcuuuuuuuuuuuuuuuuuuuuuuuuuuuuggguuuuucgagacaggguuucucuguauagcccuggcuauccuggaacucacuuuguagaccaggcuggccucgaacucagagauucaccugccucugccucccgagugcugggauuaaaggugugugccaccacgcccgguuuuuauaaugcuuuuaacuuuauuuuuaguacuaacuuugagauagggucucacuguauagcucugacuggccagggacuugccauguagacuuggguggucuugaacucagagauucaccugcuucuguuuuuuugaguaaugugaguaaagauguacaucaugcugcccagcaaauucuuuuuauguuuuuaagauagucauguaguuacagaauucaaaauguagucagggacgaccuuaaacucccgauccucuugccucccagcucccaagucugaaauuacagguguguguuaauacuauguccaaugccuuuuaguauucuagaacgaauguuuuauucuuuauuuguaugaauguuuuaucugcauguuuuucuguacuacuuucaugcagugccugcuaaaucucaucucccuggaacuggaguuagugaugguugugaaucaccguguagguacuuggaauuggaugcuggaccucuggagagcaaccagugcucuuaaccacugagccaucugucuagccacuuauaauuaauacaaauacuuuuaaaaacucaacgguguaguuguuuguugcuaauacaaaauucaguuuauagggacuggaaagacagcugaauaguugagagcacaucauuuaccuuuauuggguacugggaauugaacucuggucaucaggcuuagcagcaaguauguuuacucucugagcuaccuugucagccuguuuucuuuuucuguuuugaugcaaaaaggaaauuauaauuauugccaucuacaauacuagguuuugucuuuaaaauauaacaggguuggagaugguuagcaguaagagcacuugcugguuuugguuccuaccauccacauggcaacucacaacugucuuuaacuguuguuaaagauaguuuuuggguuuuuuguuuguuuguuuuuucugccugcauggauacuaggcauacauguccagacacaccuguuaugugcaugaaauaaaaaucaguuugggggauggagagaugcucagugguuaagagcacuuauugcucuugcagagaaccucggcuugguuccuaguauccaaaacucuuaucuauauauccaagggaucugacacccucuugugaccuccuuaggcuccugcaugcauaugaugcauuaaaacucaugaaggcccacacacuuuuuauuuauuuauuguuuguuuguuuguuuuuauguuuguuuguuuguuuguuuuucccgagacaggguuucucuguguagcccuggcuguccuggaacucacuuuguagacuaggcuggccucgaacucagaaauccgccugccucugccucccgagugcugggauuaaaggcgugcgccaccacgccuggcuccuuuuauuuuaaaaguuaaaauauuuauagucagccuuuaggaaauucauagugguauauauuguauuauauuuuguguauguaugccuauguggugagugaguaccaccaaccuacucccauaccaguguucaguggacaguuaguuuucucuuuccaucauauggacugugggguugaacucuagaacaucagauuggcuuguuuccgacuuuacccgccaugucaucauagucaucaucauuacuguuguuuuauuuugacuuucuguguauggguacuuuaccugcaaguaugucugugugccacuuguguaccuagugcccgugcaggccagaagagggucucagauccucuggaacuggaguugcagaugguugugagcugucaugugggugccugguccucuuuaaaagcagccaguucucuuaaccaauaagccccuaauuaccguagguuuuuaaagaguuacuuguauuaauuuccuuuauguauaugcgugugagugugcguguuuguuauagguauauggcaugccuccagaggauagaggaggugucagaucuuucucgaguuggauuuuucaaguggucaugagcugucugauauaugggugcugggaaccacaaucagguucuuugaaagagcagcauaugcucuuaacugcuuagucaucucuucagccccuuugcuacuguauuuuaaaaguaccucaaacuagcugaugaaauggcucaguguguagaggugcuugccaccaagagucacucccagugcugaccuuugaccuccaaccauacacauacuaccuacaugcacacauacacaaucauaaauuuuuuuaaaguacccaaaagaagaacaaagugaagcagugaaccaagguagaugagaauauuguguauauaaauuagguaucacuuguaauuuaaaaaaucuaaucuuuauccaaugacuuuaguuugucuuaacuaaacuagaaacuauaauguagagcauuauauaguauugcaggagaugacucaugcaguaaugacccuggaaauuuacagaugagaaaaguaagucagaguaaugcuuggaaguaucuuuuauuauguauaugaguguuuuacacacacacacacacacacacagauauguguguguguguguaugugucugguuccuaugaaggucagaagguguuggauccacuggaaauggagcuauauauuauauggcugugagccaacaugugggugcugggaauagaaacuggguccucuccaagagcaaaaacugcuccucacuacugaguuauucaucuuuccagcucccuugguaguauauuuucaucagucauacuuaaggaguaguauaaacaggccaugugcccauaccucaaguaacacaaugaauagagugcuagguauggauuuggguguugcaguuuuggcaaucugaauaccagcagauucugugggguuuucauucuagagaucacagaaaggagcuuuguuguuuagaauaguuuuuaaaauaaaguuggcugagccgguugugguggcacacgccuuuaauccuggcacuugggaggcagaggcaggcagauuucugaauuugaggccagccuggucuacaaaguggguuccaggacagccagggcuauacagagaaacccugucucgaaaaaccaaauaaauaaauaaauaaauaaauaaauaaauaaauaaauaaauaaauaaaauaaaguuggcugaaaagucagagcauauuguaaauuucaguuauuucaggagcaugggaaauuuaggagucuugagaaaucuuggauuaucauguagaguaacuauauaaacacuuuaaaaacauugucaaucacucuucaauguuaauugcauuuuguuucuucaguauaugaaaaacaggagaaaguauguauuauuucauuuaaaaugagaagcagaacaauuauacucaaugaauuuuuuuccuauuauaucuuaaggaagagagagaaaauccuucgaagcggaguagaauugaacgugauauagauaauaauuuaaucacaucaacaccaagaaccggagaaaagccugacaaacaguugucucgaguaagacggaaaaguccagucaauggagguuuguuuauguuuugaugcuaucuguccuuugacugcaagcagaaggccuccucaccuacuguggccuuugggggauacugagggggccccuaccaccucagaagagaaaggaggggaggaugggggaauggggcaaggauugugggaaggagugaccagaauguaaagugaauaaguaaaaaagguaaaaaaaaaauuuuuaaaaccugcuuuaagguuggucauggcaggucagugccugcauucaagaggcaaaggacagagaguucaaggccaggcaacaaaucaagauccuaucucaaaaaacuacaacaaaacauuuggagcuacuuuucucuuguuuuuauaaucuuugauacuuuaaauuaauauuuuuugugcuaaauauuaauuuaaaguaucaaguaaaauuaaaaauuaucuuccuaaaauuuuuuacuucuaugaauuaaaaugagucaaggcagaauacuagauauacauuauuuaucauccaguguaaauggacugggcuaggacuaugccucagugguaguguaccugcauagccugcucaguuuccuauaccaagaaacgggaaaugggucaacauuaugacaauuuauuugaaauuauguauacaacuuuguggaucagauauauucauuuacuugacauucauuagagauagauaucaggaaaagucugaaauagccaauguccuaaaaauguagacagcuggaagcuuguaucuauguauuggaauuaguaacuuguuugcuuacaugcaucuucuuuuuugggggggagggggucccagacaggguuuacugacuguccuggaacucacacuguacaccaggcuggccucgaacucagaaauucaccugccuuuuaccuccuaagugcugggaucauaggugugcuccaccacugcccggcugcauuuucuuuauuuucuguuguucugugcugauuugaaaccucuccagcuuuuuaacuuuagguguaaaucaauguugaaaaaaacucagugaauguuagcauuuauaaacguuguaaauacauuaaaaucauuugauguauaagaaauuggccucaggcagggcaugguggcgcacacguuuaagaccuuuaaucccagugcgggggaggcagaggcaggcggauuucugaguucagggccagccuggucuacaaagugaguuccaggacagcaagggaaacacagagaaacccugucucgaaacugccccccgcccccuccccccaaaacaagaaauugaccucaggauuccuuugcuaagcacucaugaauauuaauuauuguaagucuacaugaaauaguuugagaagaaagaauuuuaaaacagauuauaguacacaccugaaaugcaguguuuucuggacauuacuuuuuuuuucccucuuucauucuuagaagcugguaguuaugaaaugacaaaucaacauauaaagcaaaauggaaaauuagaagauaacccuugcucugguaguccuccgaggacuacauuguuggggaccauauuuucgccugucuucaacuuuuuuucaccagcaaauaaaaaugguaaguaaaacccauuuuuuagacagucaaacauuaacuacaauuacaguuuucuaguuuuuaaagaucuuuuugagcugggcauaguggcacauuucuugacuuugaagccagccuaucuuuaaaaaaaguaacccuaucuuaggaaaagaaaaagaccuuuugguuuuacuggcauauuuugucagagaggagacagagacgagcguuaaaaagaccugacugagcauauaacucuugaauuuggacgcucaauaccauugaguuagaagaauaaaauguauaguuugaaaggugacaacaaguguagaggucuaugaagacuuuaaugugaaagaaaaaccaaagaagucacauagccuuguaucucugagaccaagcauauucuuauguuuaagaacaagaaaggucuccaggcgugguggcgcauuccuuuaaucccaacauuugggaggcagaggcaggcggauuucugaguuccaggacagccuggucuacagagugaguuccaggacagccagggcuauacagagaaacccugucucgaaaaaacaaaacaaacaaaacaaaaacaaaaacaaaagaacaagaaaggucuggcaguaagagauugaagagagacacgaaaacuaagggaggcuauugacugagcuggagucagaagagcaggugagguggggaacucccacagaagcaccauagagacauuuuuuacugaggcuggaaggaagaagcucaaacggaaagugaguacagauguuggcaaagcauuguauuccacugcauggcaaacuaagagcuauguguuagacuauguaauuaagaggauguuggcaauaguauauauuagauggaugcaaagaacuacagucaaaaaacauuaagcuccaaagaagcuguguuuuugccuuuauucuuuguuuugucuauuagugaaaaaucaguuaacugguggcagugaauuuuagauuguguauuagaguugggagaauaaaaauguugggauugaguuucagguuaagacauacucucuuagcggagggguuaauauuaaaacaccaagggaagaggaguguuguauaaggaaauugagauacuggaaguugauuuuguuauuuucguuuaaaauuauacuugaaggaagaaagcaauagcauuucauaguaugagaagacuuggguaauucuuuauucucuguuacuuaaaaggaaucucacugagaaauuaaucaugucuuuaaaaauuaauauuaugucuuuuaaaaaugauuuaguaagaggauucugaugguuaguaaaccauuuaaccuguucuuggacaacauuucucugguugaaaauugugguugccaucauggcuuaauguauuuaaacuggaagauggagagcuaauguuuaucaaaugacucauacaugguacuugaauggaaaguucugaauuguaguuauuugacauaggagguguuugcaaacuauuugagaacuuaacaaaaacuuuguucauaacuauuauguagcuaggccuggugacacagaccugucaucuguaaucccaagcuacuggggaggcgcaggcaggaggauugaaugaauuuucaagcccugacugaacuacuuaaugauaaccuugcuuuaaaaauugaguuggaggggcuggagagauggcucagcgguuaagagcacugacugcucuuccagagguccugaguucaauugccaacaaccacaugguggcucacaaccauccguaacaagaucugacgcccucuucuggugugucugaagacagcuacaguguacuuucauauaauaauaaauaaaucuuuaaaaaaaauugaguggagacugaggguacagaucaguggcagugggcuugccuaguauauguuagucucuuuaaguucaaugccuucuauugaaagauaaaaaaauucuuauuccccauugauuacugagguuuuuuauagauaauuucaaacaaugguacccucaguuuaaccuuuguaugaguaaucuaaaaauuaaauaaaucauaaugguguuuguguuuagcuuuuuuuuuaauauuugugcuuugaagugauucaugguuuguugauaaacaauuccaggaacgucaggcucagauuccccaggacaggcuguggaagcugaggagauagugaaacaacuugacauggaacagguggaugaaauuacuaccagcaccacgucagcuaauggagcggcuuacucaaaucaagcaguucaagugaggccaucacuaaauaaugguuuagaagaagcagaagaaacaguuacccgggauaucccaccccuuacaggugaagaaaauacucccuuaacacaucuuaugaaugguuauaaaaacacaauauuuaauauauuuuuuaauuagguauuuuccucauuuacauuuccaauccuauccaaaaaguccccaauacacuccccccccccacuccccuacccacccacucccacuuuuugucccuggcguuccccuguacuggggcauauaaaguuugcaaguccaaugggccucucuuuccagugauggcugauuaggccaucuuuugauauauaugcagcuagagucaagagcuccgggguacugguuaguucauaauguuguuccaccuauaggguugcagaucccuuuagcuccuuggguacuuucucuagcuccuccauugggggcccugugcuccauccaauagcugacugugagcauccacuucuguguuugcuaggccccuaauauuuuuuaaaauggcuagauugauaguuuuucauacuugaaguuaaaaagaagacugaauaagauuugucccugaauccugucaucauaugcaauagcuuagaccuuuaagacuaaagugacagaggcagauggauuucugaguuugaggccagccuggccuacacagugaauuccaggacagccagggcuauacagagaaacccugucuugaaaaacaaacaaacaaacaaaauaaaaacaggagaaaaaaaaaagaaaagaaaaaaaaaaaaacgacuaacgugacuguaaagagagguagucuuauaccuuuagaauaguuugauuuuuaaguggagacccccuuguccagaagagauucuucuacuaucccaagcuuugcagcuuacuuuguuuguuuguuuguuuuuugagacaggguuucucuguauagcccuggcuguccuggaacucacuuuguagaccaggcuggacucaaacucagaaaucugccugcuucugucuccugagugcugagauuaaaggcaugcaccaccacgcccgccugcagcuuacucuuaggucuuuaugagguucuaacuuaacuguuacauuccugcaguaguugacauugaaauguggaugcaagauccgaauuuauuacuuuuaauuacugugguacaugaucauaaaaaauauaagaucugauuguguuuguccuauucauuauguagaucaagcuguuuucaaacucagaagauccacuuaccucugccuccuggguguuggaauuaaaggggugugcuaccaugucuuucuguguucagauguuuaaaaagaagugugggacugagcacuuggcuuguuagagggccugguuaauuaacaugugaugaugccauguguuccagccccauuacuaaguuucaaauaaaauaaguauaauuaugaaaguuuuguaaaguauaaccuaguaguacuaguaugaaauaaaaaaaaaacagaaaauagaggaaagauaugcuuuaaauuaauuaacuaaaaguaacaugucccaaauuuuaauuaagauuauugagauuauuaagauuguuuuuaauuauugagauuaacaaaugaaucacuaauauugggaacagaagcaagauaaggagacagaaccuuugaaucugaagcuagccuguucugcauagccagcuucaugccagccagggcuacauagagacacccuuucaaaagaguaaaauuaaaaauuguggguaguucuuuaugguaauaugugagaaugacuuguuuguggcuuucuuucuuucuuucuuucuuucuuucuuucuuucuuucuuucuuucuuucuuucuuucuuucuuaaaugcugguuacuuuuuucuuuccauuuuuuaaaaaagaguuauuuauuuauuuauuauauguaaguacacugcagcugucuucagacacaccagaagagggagucagauauccuuauggaugauugugagccaccaugugguugcugggacuugaacucaggaccucuggaagagcaaucagugcucuuaacugcugagccaucucaccaguccucuuuccauuuuuugaauuuuuuuuuuuuaaugucauguuuuugagacaugguuucuuuguguaguccuggcuauucuggaacuguuucuauggaccaggcuggccucugacuuugucucuugagugcugggaucaaaugcaugaaccuucaugcuuagccuaaggcuaggcuuaaaacauuaaauccuccugccucagcuuccugcugcuuguuacuaccccuagcuacagugauuuuugugaugugaauauuugacacagaugauuaaaauaggcuccuugacuaugaacuuucuaugauugaauuaaagagccauuaugagcuguuuuuauacagaaaaauuaugauaauguagcaaaugcacauuguggguauuuuggaacgauaugaaaagacugacagaaggugacauucaucucuuauaggaggcugaggcagauggaucuccauuguggguucaaggucagucugaucuacauaagugaguuccagaaccacagagagacuucauuucaaaaucaaaauaaauaaaguacauaaauaagcagauaagucaguaauguuaauaaaaagauaauuaggaaugauaaaaaugcugcuuuuuaucacuuauugugaaguuuuuuggagguugugguuucaagacaggguuucucuguguagcccugauauccuggaacucgcucuguaaaccaggcuggccucaaacuuacagaaaucuauguacuacuguuucugaagugucaggacuugagccugaggacuauagaauugcuucuggauuacuuugaaguggcaaaguuuguuuaaagcaaugauugcuacacgcaucuuauaaaucauuuucauuauuuuuguuguuuuauguauauuuguguuucaccugcaugugucuuugcacugguuccuucaaaggccagaagggcaucaaacccuuuggagcugguauuacagacagucauaaaccaccacauggaagcugcaaauugacuccagguccuuugcaggaguagcaaguuaacugcugagccaucucuuagcuuccaagccugucaacuuuuuacaaucacuuaaaaaaaaaaaaaaaacuugaaauucuggacaaauguacauguguuuuccgggcuuguucuugugcuuagguuuccuuuccuguguguucuguucuaucucaugcuuugcuuccuucucccucuccaguuacuuuucuucuuucagauuuaggugagaucagaaauauuacaaguguugccaacacuugaaagaucaaaaguuugaggccaaccugauuuaauagugaagacccuugucuucccccucccaaccuccuccccccaggacuugucugccuuuauuuuaugcuuaaaauacauauauaaagagggaauagggggagaucaggugaaaaguagacuaugccaaaaugaauacuugaaauccuaacccgagcuaagaccaacaggaagacacuugucuuacacacuaagagcuauuagggcucaaagagaugacucaguaauuguuauuagggacacuugcuucucuuguagaggacccuggguucagguuuacaacauuuauagcuccaguucuaggggaucaaacaccauuugccccagucauucacacggugcacauacauacaugcagacaaaacuaucauacauauaauauaaaacauuuaagcaagaaagaaaagccgggaaugguggagcauuccuauaauuggagcacuugggaagcugaagcaagaaaaugagcaauuggaggccaccccaggcuacacacugucucuaagcugaucuggucuaccuauugagacaucucuaaacaaaaacaagauaguaacuuucugucuauauacugacaggaauagggaggggagguaugugcuaugugauguuuuauugacauguacauuuuaaaauauuuaaauuaagcuaaaaagagauagauaucuccuuuuuuuuuuccuggcucuuugauacauaaaguacauuuuuguaucuacuguccugguacaaaagcacgugagaacuucuugcuugaaacugccuggugaccagccucucuccuaacagccacagagugagcuuaugagcucuuuuuauccggcucauuugacuuaacgcucaaguugcaucucuguucaggauuaguggacuacuuaaggaauacucaugagucuuagauuuuauaacuguauuugguuugucaucagcaucuacuuauugacuacauguaagcacugucaaauuagaaauugauugcucuggcuugcuuuuuuuuuuuuuuuuuuuuuuuuuuuucuugagacaggguuucuccuguagcgcuggcuguccugaaacuuacucuguagaucaggcuguccucgaacucuuugucucaaagauuuacuauuauacaaaauaaacuguagcugucuucagaaacaccauaagagggcaucagaucucauuacggaugguugugagccaccaugugguugcugggauuugaacucaggaccuuugaaagagcagucaagugcucuuaccugcugagccaucucgucaacccccccaauuuuuuuuuuuuuaguuuuucuagacaggguuucucuguguagcccuggcuguccugaaacacacucuguagaccaggcuggccuacaaacucagaaauccgccuaccucugccucccaagugcugggauuaaaggcauucaccaccacugcccagcgaccacuuucucaagaguggcaccacccauugugggauagacacuuguacacuaacaguuaaucaagaaaguccccacagagcugggcggugguggcgcgcgccuuuaaucccagcacuugggaggcagaggcaggcagauuucugaguucaaggccagccuggucuacagagugaguuccaggacagccagggcuacacagagaaacccugucucggaaaaaaaagaaaguccccacagacuugccugugggccagucugauagucauuuucuugauugagguucccucuucuaaaaggacuuuaggucuuguuaauaaaaaacuaacaaguacacuauuuggguuuuuuuguuuuguuuuguuuuuuguuuuauugcugaacauuaucuucaaauaauaauagauuuccucucaguucauagacagacaucuuaauucuacuuuuuuuuuuuuuuuuaaagauuuauuuauuuauuauauguaaguacauuguagcugucuucagacacuccagaagagggagucagaucucuuuacggaugguugugagccaccaugugguugcugggauuugaacucuggaccuucggaagagcagucgggugcucuaacccacugagccaucucaccagcccaucuuaauucuacuuagccauguaguuuggcauguugauagcaguaauuuucuuuggauguagaguuguuuauuuucuuaaauuugcuuuuaagugaucuuuaugaauuauuuaugugguuaaucuaaaauacaggaagcuccuuguaggaauaauaaaaauguguuuuuugugacagaugagugaaaguaaucuuuucuuuucuucuuacuaaauagcaccaguaacuccagagaguggguacucgucagcccaugcagaggccaccuaugaagaagacugggaaguauuugacccgugaguuguuuccugguuaucaaauuuucuuucuugaacaauuuuuaguuucaugauaaaacuggaaauguuauuuguuuaguagaaaaucuuacuuuggauauugaguuucaacuuuuucucaagucagcagcacauaacaagauacucucucaugauguuggacauugaacuccaccucucauucaucuggcacuccuaaggccuaaccaguacucugcauuguuuaacuugggcuuuauaguuucuuaauacuauguuugcuagccuagguauauuagaugcauuuuuaauaggauauuucaacauaaaagcgauaaucucaugaauagaggcaucuguuuuacaaagagcuugugaucuugagcuguggguaucaguacuuggugaguuuuuguagacacuaaucuguguacuuucuuacauguuuucuaaauuaguuuacuggguuaaguguugaauuauucauggcuucauugcugugaccaaauaccuuagggaggguaacucaguauguuauaagcagucaguuaagaauagaaauaaaucagaaaggugaaaagacuucguaagugggugccuugugagcuaauggcaaagaaaaacaauaugucauuuuggacuuccuuauucuaagcaucaaggaacuuaauugugacaugcaaagaaauauaaauaccaaccacgguguagaggaucaauccgugaucuugagaagacgcuccagagaauguuuuacucuucuuagagccaaacaugcacugaaaaaaaagucacgugguugguguuugguggucugcugccaggaugauccacacagaugucugucuagagcaacgcauuaugucugucuguguucugcagucuaggagauggguugaaacaguauaguacuucaaaugggggcuuuuuuucagacccaugcagaggccacuuuuuuuuuuuuuuuuuuaaagauuaacuauauaaaaguauguagcugucuucagacacuccagaagagggagucaaaucuuguuaugggugguugugagccaccaugugguugcugggauuugaacucaggaccucuggaagagcagucagugcucuuaaccggugagccaucucuccagcccagggaaaacuuuuauacuaccaucagcaugcaaaaaaggcugucuaagaauuugcugaguccugagcagugguuuucaaccuuccuaaugaugugacccuuaauacaguuccucaagguguagugaccccaacuauaaauuuaucuucauuuuacuacuucauaacuguaauuuugcaaucauaacgauuccuguuaugaaucguaauguaaauaucugacauguagaauaucugauuuguaaccccugugauuuuacucuuaaaggguuaugacccacagguugagaacagcuacacuacaggaauaaacaaacuuuacuucuuguagguuaaaaugugucaguucuuccuacuggggagauguauguguuugagucuaguuauggcuuaaaauucagucuggcauagcaguuccuuuugugccaauguaauaaaucuagugggauagacaaugaaaacuagccaccucgagucugcuuuuauuuuauuuuguacuuggaagauugaacccaaggccuuguacauucuaggaaagugcuuuauagcuaaucauaugacaagcuaauuaaaauuuagaauuuaauacuaucuucuauguauaaaacauagaaauguugaaauuuucuuaaaauuugauuuauagcuauuauuucaucaaacauguuccgccucugacagaagaacagcuaaauaggaaaccugcucuuccuuugaaaacaagaagcacaccagaguucucccuggucuuagaucuggugagugugaucuuuacagguauaaagaauaagagcuaaaauccagaauacaaaugaacaagcagucauaauauuuacuguaaauauguucugaguauuuugaaugguuuuauuuaggcacccuagcauuagaccaguuuguuugggaccggcacauuuugaaaauauguaagacuuuuacuuuugcauuuaaauaaaauuuuuuuucucuacauuuuugagacccugugauuuguuuuuguuuauuugauuuuguuuuugagguguuggguauuauuccagggucugguuaugcaagacaaguguuauuauuacuacauuauauccuaagccuaaagcaguuguauuuauuauauuuugccuggauagaaacagcucccuggaaccggcguuacugaguaguuguaacuaaacccagaucaucuguaagagcaccaaauuuucuuagucacugaaucucuccacuuaauauaucucccuguaaauuggaaugccuagcauuaagauuuccucuuauuuuuagaaucuuguuuuccugaaauacaauuugacuucaguuaacuagccugggcuggccucaaacucuccuuguagcuuaggaugauuuugaacuucugaaccugcuacuuugaccgaaggugggccauguggcacuaugccugugucuggcguuagggaguaaaccucgggcuuuuacauacugaacccuugccagcugagcuuuaucccugaucaccaagcaacuuucaaaauagacuugauuuuuuuuucuuugaugugauuuaaaaauuuuugcauaccuggaauggggcuuuauaugcuuuuagccugaauuguggaagaggccgagacacacacaguagcuugugaggguuugggcccaggcuaggcaauuuagaaagacuuuugucugaaaaaacuuacauuuauacuauuggguagaaaagaacuuugaauuaaauauuuuauguuuugcuaacccauuuuauuauuugugugaauaccacauuuacuguuugcuuuuaguuuuccaauaucaucaaaagauauaucuaaugaauugugcuggaaaacauuuuauuguuuaacacuuaucacugauaucucauuaauagaaaugugauuuaauucucaaaaauaucuuaaagaaaagccaguucuuuaacuuuuuauuguuuguuuguuuguuucuuugguugguuggguuuuugagacugaguuucucugugugucccuggcuguccuggaacucucuguguaaaccaggcuggccucccaagugcugagauaaaaggcauaugucaccacuccccugcacauuuuuuaauuagugcacaauauuuauguuuuuauacuucauaaucauagccuuuacaauucagagauguaaaagaaauaacaaauucuaaaauauuuuuagagaauauauguaaagaaaagaaaaaauuaaaaguaaaacagguugugacuacuaguucaggacaaagaaauggaagaagaaauuaaagagauuuuguaguugguuuagacauaaagaaauuuguccauauuuugauucugaggugaagguuaaaugcagaggggaaaaaagagaaaugucugagaaugaaucauuuauuaaaguaggugaagaauuaauauaauuaaauaugacuuaguuuagaaaaaaccuaagaugcuagguaggagucuuugaaaauguaguuuuauucucucucucucucucucucucucucucucucucucucucucucucucucucucacacacacacacacacacacacuauauacacacacacacacacacacacacacacacacaaguaugugacacacacacacauagagacauggauuuacacacauuuugucuuuguuacaggccucacuguguaaccucugugggccuugaaccauuauuccucuuuuagucuuauaaauacugagagauaccuugaucuauaccuugacuuucauucuaaggguaugauauuuugagauaagaucuugcuguguagcacaaguuagccuaacauuugcuuuauagacaaggcuuaccucagaccuugacuuauugcaguccuccuaccucagccuuccaagugcuugagauuguaugcuccacaccugaccucuuuuuuuuuuuuccuuuuuuguuucuuaaauauuuuauuuacauuucaaaugcuaucccgaaaguucccuauacccuccuuccacccugcuccccuacccacccacuuccacuucuuggcccuggcauuccccuguacuggggcauauaaaguuagcaagaccaaggggcuucuauucccaaugauggcugacuaggccauccucugcuacauaugcagcuagagacacgagcuccaggggguacugguuaguucauauuguuguuccuccuauaggguugcagaucccuucagcuccuuggguacuuucucuagcuccuccauugggggcccugugauccauccaacagaugacugugagcaucaacuucuauauuugccaggcacuggcauagccucacaagagacauaucaguguccuuucaacaaaaucuugcuggcaugugcaauagugucugggugcacaccuggcuucuuguuuugguuuaguaguguaagcagggagccaaguguauuagcacuuacucggcaguuggaaggcucaggcaaggagaguucaaucuaacuauagggagaaaaaagaaguugaggaauauagcucagugguggcagggaaguuacuuauuagcaugggcaaggcuuuggauuugauuccugugaucgccccagauaaauacuucacacauagccacauauccacauguuuauuuagagacguaaaaaaaaaaaaaaaauccaaggguggugguacacaccuuuaauccugguguucaggaggcagauguaagcagaugucuugaggucagucuguccuacagagugaguucuaggacagccaggguauaccaagaaauucugucucaacaaaacaaaacaaaacauccccaaauaguaguguggaauuauaagauauggccaaucuuuuuuuuuuuuuaauuuuucgagacaggguuucucuguuccccuggcuguccuggaacucacucuguagaccaggcuggccucaaacuuagaaauccgccugccucugcccacccccaccccccugccucccagugcugggauuaaugggauuaaaugugugcgccaccacugcccggcaucauuuuucauuuuaguugaucuuuguugcuguuuuguagccugcugagugccaggauuaagggcguguaccaacauaacccaacaauuuuaguagaucuuaacuaagcccuuugaaaaauuugaggguaguuacuggcagcacauuuuacuuuugagauagccuaagcuauccuugggcucauuauguagccaaggaugaccuuuugguuuuccugccucucccuucuuaauugcugagaauaaugggcaugugccgccuucccugguuauaugguacuaggagucaguuugagagcuugauucuuccaacucaccuguauccccuguccuuucuaacauuuagguuuugagaaauguauugauuuaacauuuuucuugcacugcauuccuauuuuucuuguucuugguaagaaaucaggaucugauauucagauaugauaaguuuuuauuggguuuuuaguugaugaaauacacucagguauaaguaacaucuaauccuaaauuaagauucuuuuucauaaaaaauuugaagaugcguuauaugagaaaacaaagucagcuuucaugaacuaauugcaaagaaauguaauuaguauaugcagauugcaguugcaugugguucuguaaccuuagcacucaggugauacaagaagacugaaucaugaauuugaagaucgccuggaccauagagugagacugucuuuagaaaacuaagaaguagcgggguggugguggugcacaccuuuaauuccagcacuugggaggcagaggcagguggauuucugaguucgaggccagccuagucuacagagugaguucuaggacagccagggauacauagagaaacccugucuugaaaaaccaaaaaaaaaaaaaagaaaacuaagaaguuaaauuaacagggaguuacaaauguucuuuaacaagaagcaguaguuuucagacuugaaucugcuuuagagguaacugagaaguguaucacagcccauggaaugggaaucaucagagagagagcuguacuucugaagggcucugaugcuguuuauuccccaaaaaaguauauuugagagccacugacuuuaggagaaauccuggccuaaucugcuaugucacauacaacauaaauucuacaaagaguaaugaauacuucaucaaacuguuguuugaaguuucuguuaauguuuuguuuuucucuguuuuaaggaugagacacuagugcacugcagucugaaugagcuagaagaugcagcgcucacuuuuccaguccuuuuccaagaugucauuuaucagguaauuuuaagccuaauuuuuaaaccauuagguaacauucugagugaagaaaauuuuuuuugugauguucagugugucuuucuguagauuuacuaguaguuuuaucaguauuuuaaugguuuauuaacacaaaguaguagcauuaugcuagauaguuaaugugaaacauuaauuuauaauuaaaaaacacuaacuuuucugauuugugaucucuacuaguuucauaaucuuugccagcagguggaggcaaggaacacugauacagauccccaagaacaacuugccacguuaagacugggauuuugucuuuauuuuuccccauaaauccaauuaauaauaauaaugaaauauucauuccuuguuggucauuuuuacuuacuacaguaauguuaucuguaaaauuacaguucaauauaucuaauuuauauuaauaagagaauucaaggaauccuguaguugcugcuuuauuauuagguacaagcauuuuucucaucuuugguggacagguuacagugcaaaauauaaauauuguuaagauuuuacuguggauuaucuguuggccauacuuuuauuagaauuuuuauuagaggauuggcuuaauuaagaaaugacuauacagccaggcgugguggcgcacgccuuuaaucccagcacuugggaggcggaggcagaugaauuugaguuuaaggccagccuggucuacagaguaaguugcaggacagcuagggcuacacagagaaacacugucuugaaaaaacaacaacaacaaaaaaaaaaaaaaaaagaaaagaaagaaaugacuguacuuuuaagaacugcagaauccaguugggcgugguggggcacgccuuuaaucccagcacucgggaagcagaggcaggcggauuucuauguucgaggccagccuggucuacagagugaguuccaggacagccagggcuauacagagaaacccugucucaaaaaaccaaaacaaaacaaaaacaagcaaacaaaaaagaacugcagaauccuuuuguguguuugcauuuguuaacauacgcauaacauuuacauacacaagcugcuuaaagauugggaaaagucaguaauuucuugucaugaggaagccaccucaggcuuaauaaagcugcagcauuugcuaugugaguaaugaccaggucccugguuuguaugugcucuuggugggcaaguacaaagugguuaugauuuuuuuuuuuagcauuuuugguuuuuugguuuuuggaggauuuuugggguagauuucaguuguugucuuguaggaauuauaagauuuuagaguuaaauagauguuucagggcuacuuugccaaaugcuuuaaguagucauaaaucaugaggauuuaauuuaccuggaucuucauucuaauuuaaucuagacgggcauuauaauaucugaauaguauauuccucuccuuuuaaagugauacuaguccugauacauuauuaggggaagagauacauaaaauaauggauuuuaagauuuucuuauuuugaauuguuguuugguuuaaggcuuuuucugaaugagcuguucccugccagauagagugcucaucuuuaauccacuuaagggacaggagucuuaaggccaauauaaguaaugcagcaauaacuuagugcucuguuuuccaugcaguagcauuguuguuuauucuuuguaguuugguuuuuauucauuuauuuugaaugacuuugaaaacuuguuuaaggccuuuguauuucaaagggaaagcuuauuugagaauucuuaaguuucucaauuugaaauuuaucucuuacaaauggcuucuagguuguucugugugugguuuuguugguggugguagugguuuuaguuuuggguuuuuuuuuuguuuuuuguuuuuuuuuguuauuuuuguuuuuuuugcuuuuuuauguguuuuuuuuuuuuuuuuuugaguagugaaauaaauaugggaaauggauucauuuggcuccuuucaguauggauaugcuauauugaaauuuuucuuauugcuuccaacauuucugcauuuucuuuuuaaaaguugguauuacguguggaccuggauaauuguauuuguuuggaaaaaaaaacaguacauauuaacuaaaggcuuagaaagcuauacaguauauuauaccuacuuuuauagaauuccaaaaacuacuuuuucacauauuugaguugcacuuucugaaagugaacagaaaguaacacaacuaucuaaauagcaaugagcuugauguugaguuuuagaagcuauagagaugauugcaguuuuauuuacuuuaugaaggacauaauucccucaacuaaauuuuuaaagauuguccauauuaauaucgaguaacuuccuuggauuugugguuuugccauagcuuuuuaaaaauggagaguccuuugguuuaggacuuccccccaguuuuuucagaccagcaagcucccuuuaaacagggaaugauguuuuuuaaacuuucagugguguugucuccaucuacuggcaaagaagaauauacacaagggucugggaugagcuaagagauuuuggagaaaccacauuauuagguaagauguaacuuacauaucuaaccacuguaauguaacauggcucacuuaaagguagaaacccauaaaauacugcauauacucuuauuuuaaaauaauuuguugaggugaaauuuacauagcacauucaugguaccugccuauauguucuuaaauauaucuguucuauagcaucccauucuuguguguaucugugugugcaugugugugucuguaugagucucugaugcaugugcgugucuauguguguuuguuuaaaaauuagcuucuuguugugaaucaggcaagauaaauaucuuuuuuuaggauuuacuuuuaguuuguguucagcuuguaaagguucaucuauaucuaauuucaguucuaccuuuuauuuuucuuccacuucaaaccaguuucaaguuauaaauuaucuaaaucaggaguuuuagauuuuauggcuauuguugcaaccacuuuuucugcuguuccaaacccgaaaugaaccaugcaagaaaaggagaugagcagaagugguggccuacaccuguaauccaguacugcaaucccaguacaggggaggcugugguaggaaaaucauugguuugaggccagccugggcuauauauauuacaaguuccaggccagagugggcuacauagugagacccugucucaaaaaguauucaaaaauaugguuguguuccaauaauacuuaauauucuaaaaaguacgugguagucuauaauuggcuaacaggcccuaauuugcugaccuaugaucuaauaauuaugagaauauauacuguaaauuuauaaaauugcauucuuagggguaguaauccaauacucauuggaauucuuauuuuuauaaugaaaauuugauaaagaucugauaauagacuuucuuaagauuaagggaauuuucagguagcuacuauacuuauagaucaccauacuuuguaauaugugcucuucuuauuuuggugaauagaaauaaguuuagguaauaccacccuuagaauuuucagacagauaaauuguucaagucuaaauuuaguauuuacauguccacuucuuauggagaaagaauaaaagacccuucucaaaggugacuaguuacucugaugcuagaugagauagacagacuugcuuguguauauaagaaauaugaaagaacugacuugaaagugaguauuacacucacaaaagguacagauuauuugaacugcuguacuauuuaauaaauacacacuuuuccuaaaaauuguuucauagugauugagaaaagauuuguucauaaaauuguacagaugcauuuuauuuggaaaaacaggugcaugaucacuccaaugcacguuuaaacuuguaguuaguuuaauauugacacauugucaggaaauccaucucaugguguuacucaguuaagaggucuccacuguauuuaguuucuguuccugcagauccaccaauucaagacucuaggucaucucacucccucuuccauccagaagaugacugcuauccacaagcagaacugaaucaaaagacauuuuucacuuagcucuugagcugaaacaccuccucaaugaccuuccucugucuccaucaagaacuggagcucaguuuuuugaagauguaauagagcuacucagcccaaauguggcugauugaagacaaagaagauaccucauaugucucaccacagugcaucaaacgcaacuguguuguccaucuccucauucuguacaguaaggcaggggcaucugauuuuuugaccguauucaccauuaagacuuuagccagugaguggcuuucugaggaucaguaaaaucaacaaacuuugggucagcuguccagaaaucagacuaugguaagcacucaaggagcuaggaugcuguagggagcuuguaaaggaugcuuucuuuuauugguagagguugcuuuuauggggaaagcuggggggaagaggccaguggagagcccaaugauuagcaaaguuuagcuucuucuuuguuuucuuggaaaucauauagcucaggauauuuuucacaccacaaaaagagaauuagaaguauuauggcuucuaacucuuccuagaaaaaccagcuuuacuuuugcuacaugaagagaaaaauauauauaagugaaaaauucuuuuguaaauaccagacuacauuuucucuuuuauaaauucugacuuuauaauuauuuuguugcugaguuuuauaaacuuaauuuuauugucuauauauauguuuguacauaauuaugccuuguauauaguauuugggauuauaacuuuaauacugaugucacuuuuaauuagagaacaguauuugaauaguaacuuacuguacaaaguauuaaaaacaauaccucaggggguuggggauuuagcucagugguaaagugcuugccuagcaagcccaaggcccuggguucgguccucagcuccggaaaaaagaagaaaaaaaaaaaaaaaagaaaaaagaaaaaaaaaaaaaaagaaaaaaaaaacaauaccucagaauaauuuuaaacuuucccauccuuugcaguaaguaaucauuggcacuauguuuucauuauaauuauuaguaauauuuagauuuuaaaaugauauaaauuaaacauauaauucucuccuuaucaaaaauuagaaaauauauuucauuugggaauucuugaaauaucucuuucaaauuaggaauaguucaaugaaaaaaacagauuauacagccagacaggagauacaugccuauucuugaaguucagaaggcuggaccagggagagugaguuugaggcuuguuugggcuauauaauaguggagggauagauggacugugcacagaaaguucuuauuuaacagcugacagcugauaguuauuucaauguucacuaaauugaaggguccacuaucuuuagcuuuuuuucuaagugauuuuauuuaacuuuauguauuuuugacaaaaggucucacuguguagcccaagcuggccuagaacucauaauccuucaacuucuugauugcuugcuagaaugauuuguuauuguugauguuacuacuacuacugcugcugcugcugcugcuacugcuacuggagacaguuacuguuacuggagacacuguguagcccugacuggucuagaaugugcucuuguagauucagguguuaauagcacagauauccaccugccucugccuccagaaugcugggauuaaaggcuugaaccacaauucugguauaugcuagugguuuuuaaaggcagcauuuuuuaacauggcuacuuucuuuuugcucuuaaaauaauugcaguuucucuuaauauguuguuaaaguuuuauuuaugcauuuauauacuuaaauguguguacaaauaaauggccauuuuuccauaaugaacauuauuauguucauuauuauuauugacagcuugaucaugcacagucaaauacauuaaacuucacuucauccuauuugaacucuaaaucccuuuucagauugaauucuauuuccauagguaaggaaaaacugauucugauguauuaguccagaauucucuguucaucccuagauuuauuccuccuacaaauacuuugucugcaucuaacuggaacuaggugaagcaaaugcugauguagguuaugaaguugaggccuccguggcuccuacuagaguagucuucuguccuucgagaagauguggccuuuguuucuguguuugauacuaaugcuaagaaaauauuaguggaaccaguaauauuucucuuuuaagagacuggauucucuuaaaagaacuguaaguuaucuuuagaauugugggugcucaguucugcccgguaugauaauacuggcuacugguuacuuuuaaauaaagagguagguauuaauaguuaacaguuuuuaucacuucaaaugugguagcaacaauaccaaaugauuuauauguauuaucuaaccuuuauaacuuuaggauccauuuauaggugaggaaacuaaggugugcccaaagauuggaaaugggcagggccacuuugcaugcccguguaucuguuaauuggaagauauuuccccagaugaugacagcauuuaauuccucagaaacuugagcaucauuuguuuucugcuuucagcuacucaagugcugagauuacauguacugacaugacaugcgccacugcacuugucucgaguuauuuaauaguguucacuaauuaucuuuuauuuuuaauacaaucccauuauguagcucagacugguauuaaacucaaugaaauccucugcuucugccucuggaguagugggguuaaaaaccuguauuucuaaugaguucuacuaaaacuguguuccuuuuaguguuauagacagaacccagggcccuaucuaggcugagcacacauguaaaccuuauucuaccuuauaaauuuacuauuuauaaaaaaauuauaaauaguauaucaacaaguucaaaggauguucuaaaaaaaaaauguacugaagaucuuuuuugagacaaauaguuuaucuguguggcccuggauguccuggaacuugcucuguaaaccagguugaccucaaauucagagaucagccugccucugucuccugagugcuguaauuaaaggugugcgcuaucauggccaguggggggaggggggguuuuuuuuuuuuaauguuaguauuaugcugucugggcuuaaaaaucauguaaaauauuucuuuuaauaugacugacuaguagaaacuaugaaggcuugaucaaauucaucaaauaaguuugaccaauuuguuaaauaaguucaaauuuaacuuauuugcuuaaauaaguuaaauuugaacuuagccagaguuaacaaucaauuuauaaguaguuuucuauguaauugacuuuuacuaaguaugauucuguuugcauuuuuuaguacuauguacauacaguuagggaguuuuaauugacaugauaccaaagaggaugcagaaaauaagcuauuccuugucaaguacuguuaauguaguacacuauuuucuuauguaauuuuucuauauaaaauuuaaauuuuaguaaaacaaguuucuaauagagucuaaugauuuguuguuguuguuuuguuguuguuuucuagguuuucuuuguguagccuuggcuguccuggaacucacugcuagaccaugcuaugccuugaacucacuagaucugccugccucugccuccagagugcugggacuaaaagcauacucucccaucacuaccacucagcagauucuaauguuucuaauuuuuaaaacuuuggcuuaaugagguauucacaaaugcuugcuuuugagugguugucagucuuacagauaauaaucacuuauuacuaucaguaggcauuauuuuuaaacuuuguuuuuguuuucaaaauacauuugguuuguugagaagauuuagauugaguagcauugcuacagguuugcaagaauauagguaaaguagagugagcucacucuuuuggucuuugggaauuuauacaguuaaguuugguugggugggcaugguugcucacucuugugucugcauugagaaggcugaagcaggaaggaucacccuaguauccaacccaucuuggcuacauaguaaguucuagagaagucugggcugcacaguaagacccugucucaacaaaauaaaacguuuuagguuugagucugaagaaggauaguugguagaaaaugaggagggggguacuuuagaauagaucucuuuaugagacuuaaguuuggagauggaaaacagcaaaugguuacuugaggaauuaggguuugaagcauuuaaaaugauacaugucggugcuggagagauaggcucagugauuaagagcacugacugaucuuccagagguccugaguuccauuccuagcaacuacaugauggccuuuucugaugugucugaagagagggacaguguacucacaugcauaaaauaaauaaaucuuuaaaaugaugcacguuuaccuuugugaccuaaugcaauuaaauaauaagaauuaaacuuuuaaaugucaagaacuaaauuuuugaggccaacaagaugacucagccgggaaagacuugccaugaacccugacaaucuggguuccaucccuggguccaaaaaacaaaaaaggauuuuugaaaguugucuuuugaccaguggcauguacacaccacaaacacacccugccuccagcaaauagauuuaauaaacaaaaaagacuauaucguacacugacucucauauuccuguuuacaucuaaugacacagaccauuuugggcuuauaccucaucucuucuggucuugcuuuugauugugccuuuguaucacaugguacagcucccuauggagcugaccuuuguaucacaugguacagcucccuauggagcugaccuuuguaucacaugguacagcucccuauggagcugaccuuuuagaccugaccuuuuuuuucuuccuaauuccccacccucaccccccacuauguuaucugugucuuacaaccuuucugugacacauuucugauaaaguggugaaucuguucugcagaguggaacugugauagacaucucuuguuacucuuuguagucugcaguuaaggaaacacuagcagugcacucaguucuaucuugagugcuacuuuucauucugaaagaguaucagcuuauuagauguauguuacaguuaaagauaguaauagcauaguaacaaacauaguaggguguauaaugcaauuacagguucagucuaaucuggaagucauuggaaaauacuacuuuucuuuguuuucuuuguugcaugcuuucucuguuuuaccauaaaacauucccagaacuggcauuuuugucacaggaacauuuucauguagaugacagaauugaaauugaaaacuaagccugcauuaaauguauacucaacacaggcuuguuacaacaucacaaucuuuaacucaacucgcuugcuugcuuguuuguuuaugguaucugaaaucaauacccacuuuucaguggaguauaaaacuuuuauaaaauuuagugaccaagugaauguaaauggaggacuagaaagucuuuaaguaguuucagugauuauuuauggcuuccauuugugugcuuuuucugaauauugcaguguauuacaagauuaauaguguuaagaaauuagguggaaaauuuauaucugggugguggcacauaccuuuaaucccaggacucacaucucugaguuugaggucagccugaucuaccaagcaaguuccaggauagccaagacaacacagagaaaccuugucucaacccauauguuuauauauccugaacagugggcuuugagagcuguugucuuuguguacuuacaaucucaguuaucaaaccuacccuucuacacuaaaggggggagggcuguauuuaagcucaccaauccagauaccacauucuugacuauuccuuaucuuaauauaaaaauuaaauaguaguguuuuuaagaguguuuguuuaaaagaaauucugaggaaggucauugagacaggucagcuuagaacucgacacacagucugcaaaugauuggauggaugcuaccugguuggaagauggagaugauuugguggaucaaaaucuaaugagggaaaucuucuauuuuuaguugaaaugcuuuuugaaauuacauuucagugaaguacuguuguauuuuaaaaauaaaacaauaauuacuauuucucuaaaagaccuccuuaagugcuuuugguacaugaaguauauuuguuuugaguggcacccaguaaauauuucuauuucuguggaacuuuuaaauuauaauauguccaaaguuagagcacaguaucuuaagaugguuucuauuuuauguuuauuugcugaaaaaugucuuugcauuucuucagguuuaugugagauuaagaccauucuucagggaauuccuggaacgaaugucucagauguaugagguaaauuugcuuaaacuauuuuucccauguuuuuuauuuuauucaauauaguacccauauuuagaucauguauaauugauuacuucuuuucccugaauuuguagaucauucuuuuuacugcuucuaagaagguguaugcagacaaguuacugaacauacuagacccuaaaaagcaacuggucagguaaauuuaauuaagaaauaguagaaaugucuguuacccaucuauguaauuaccaugauucuauuucauuuuaauggccauuugcuguuggcuacuaucuagagauuuauuguguugaacaguaaaugaauuuuuuaagucccacaacucuuuuaagaguuccuaauugggggcugaagagauggcucagugguuaagagcaccgacugcucuuccaaagguccugaguucaaaucccagcaaccacaugguggcucacuaccaucuguaaugagaucugacucccucuucuggugcaucugaagacagcuacaguguacuuacauauaauaauaaauaaaucuuuuaaaaaaugaguggacaaaaaaaagaguuccuaauuauuuaacuuaagacagacauuccuuaaaggguugcaaagucaaauuauauuuauucacuguuacaucuauaucuucauuucuuugggaauuucagggagggaaugggagcagggaggugguggagguuuucacuguagccuuguuuuacuuccaugucucugagauaaugcuuguuauacugacuuuguaauggcuuagagaaguagaagcagaauagaaaagauuuaagagcagauuuaccuccucccauguaaagaaaauguuacaugcauuuaccuagagauuaaaauuggcuuaaucauugauguuauucuaaucuggacucgguuccuugaauaugccauuacccagcagauagaguguguuucugguuagcagggaugccuugggagauuuugaaaaucaauuccauuauuucugucaccugaagagagaguaucuugcucuaagguuuaggagugaggcuaagugagugaucaagaguagagaaaggagggcuggugagauggcucaguggguaagagcacccgacugcucuuccgaaggucaggaguuaaaucccagcaaccacaugguggcucacaaccauccguaaugagaucugacucccucuucuggaguguuugaagacagcuacaguguacuuacauauaaauaaauuaaucuuaaaaaaaaaaagaguagagaaaggagauguaggaagcuugcauagagaaacccuaucuugaaaaauaaaaaguagaaaagagggaaagagagaaaaagggggugacagguggcuaagacuuucucuuugucauugccacuaaggcuagauuuuuuuaaaaugaguuguguaugccucuuaaauguugaacuuggacagaaugguauguagaaaaauaccuuuuuguuuguuuguuuguuuguuuguuuguuuugguuuuucgagacaggguuucucuguguaucccuggcuguccuggaacucacucuguagaccaggcuggccucgaacucagaaaucugccugccucugccucccuagugcugggauuaaaggcgugugccaccacgccuggcugaaaaugcuccuuucuugaaauuauaaaacuaaaagaacagaccgaguaguauauugcucauaaaaauuuguuuaggauuaguaagcaagacgaacucaaccauuaaggcaaagggcaugaaggugaaagacccacaagucaguuaucaguaauacuuaaaggaugauaauauauugcuuauaaauguggauugcauaauuuauauaugacuuuaaagcuuuuaauagcuuuuaaauugacagaauuuucuauuuaguuuguaaagauugguuauuaguuuacauuuguaauacuuaaaccuguuuuuuuguuguuguuuugguuugguuuuucgagccaagguuucucugugugguucuggcuauucuagaacucauguagaccaggcuggccucaaacuaaagaaaucuaccugccucugccuucugagugcugagauuaaaggagugugcuaccacuaccacugccugacaccagucugccugacaucagucaccauucuuuuagcucacccuucucuucuucccucuccccucucucugucucugucucugucucucucucugucucugucucugucucucccucucucucucucucucucucucucacacacacacacacacacacacacguuuuuaaaaaauugguguuugggaaauguugaaaugauggaaugcuuuggccucagcagcaagcaucuuuucucaaaaacuguaaggaaaacuaaaaaauuauuuuaauuccaauacagaaacauaccuucuuauauuuucuauucuggcauguacagggauagggaggcuguguggucuacugguuagagcaaaggacugggagccaggaggauucuggguuccaauacggggcuaaccaaagacuuacugugaucuugggcaagucacuugugccucagucaaccaucuggaaaauugguuaaaaagcaggaccucgcugacaaccaaaugcugcaucugagcugagcuuuccuggguaauuaaauuacaaaaacaacuuaagaguuuuaauucccuuuuguaacauuauaauuuaugacaugguauaaaccaacauuuuucuaaaucauuguaauuuuuuuuaagguuucaauaauugcuaugaauuuuuauguugaaacuagcccacagcuuagccccaguauuuauuucuauuucaguuugcuuccugagaggaaagaauauuuagaaaguuuauuguauauggaugcuucuguguauguuuuaagauuugucuucauuuuuguuuaggcaccggcuuuuccgugaacauuguguuuguguacaaggaaacuauauaaaggacuugaauauccuugggagagaucuuuccaaaacuauaauaauugacaacucaccacaagccuuugccuaucaggugggaagaagauuccuauaaaaauucaguuggauaaaauauaaagaagacaaccucugccaagaauaauaugauagaaaaaaaaugggauuuuucaguguccuuaguuauuuuuuaagauuagaaaugccaaauagauaaguacuuaugaaaaaugucuucuacaugaagucuacaacauaaauuaagaaaauuuuauguaguaaaucugaagauagacuuagaggguuguaaguaauuuaauagcauuuugauauuuuaugaaauuauaguuauaaucauguuuaaaaacuaaaauaaucaauauucugaucuauugauuuaaauaauuugaaguguuuucuuagaugguuuuagcaagggcuuggucuuuguauaagcauuugcacacauaggcuuucugauaguguuuagauugaagauaugucuuuaguccacggugacuagcauuguucuaguaacuugcuugaaugaauauugcagaaaugcuuuaguggcccuucuuuguugauuaacuuuguauucaccaaggaagugagccacccugaacaaugaguuagcugcauuuuacucauuucgcucucuuacauuauugagcugucagugaagccuuaguagcauuucuuuccaguggaacuuuuacauccauaguuacuuaagugucuuucuuuaguauuccgaagcaggcuaguguaguuaaagagaacuuaauuauauauuuauuguuuuagcuuucuaauggaaucccuauagaaagcugguuuauggauaaaaaugacaaugaacuccuaaaauugauuccauuucuggagaagcuuguagaacugguaaguauauggucuauuugaucuuuguuguuguuaauugaacuauauugaacaaaucuguauguguauuggcuuuuaaaguuaacuguaaacaaacucagaagacagaggcagcaaacucaucagauugaggccagccuagguuauaaaugucaccagacccucccuaaaaaagaacaacagcaacaacaaauaauuaaccaguagaagauuguggcagaguaaaagaaauuagguuguguuuguuuguuuuuucauuuuaaauaauuuuuuauuuuauguaugugagaacacuuuagaugucuucagacacaccagaagagggcaucagaucccauuacagaugguugugagccaccacgugguugcuggaauuugaacucagaaccucuggaagagcagucagugcucuuaaccccugagccaucucuccagcccguuauuuuuauuucauguccauuggcuauuggucugcauuucucugugaggaugcuggaucuccuagaauuagaguuucagacaguugugacaugccaugugcuaggaauuaaacccagguacucuggaagaaguagccaguacucuuaaccacugagccuagguuaauaauaugcaguagaaaucgaacuagucuuauucuuauauugaaauaaaaguugugaguguugugguacacaugggucaguugaucccagcucuaaggugguggaggcaagaauaugaggucauucuaaccuuuauggugagcuugagguuagccugggacuaaaugaaacuugugucucaaaaaaguguuuuauacaauuuauuucuguuuguucguugaaaagauaaaguaucuacaaggcacuugaugucaauccucugucauuaaauguacaaaaauaaacagaaggaguacccugcagagaucuuguugguagaguaauagugagcuuggccuugcacugugaacccagacuccagaggugcagacaguucuuuggaucaguuagcaaaaggaaguccaaagcauuucuuaaaauguuuuccuugccaggcagugggaacaccuuuaauuccagcacuuugagggagagagggagacagacagagagucagauugucugguggggugagacagacaacuaccugggaggcuaguaacuugcgaguuccuggugaacauaugauuuugauuagaagcagagaaauuuauuaucaccuguaauugccaagguucugccccggggcacugagccuccaaugaaugaugcagcugguauucagaggaaguuuauuaguggccugaaaaauugaucaaagaaauggucaagaugggguuuuguuuuucuuguuguuugaggccgggucuugcucuauaauuuugauuggucuggaacuuaaguguauuagacuggccugcaauucaaagagaucugccuuccucugccucuugaaugguauaaugccgugaaggucaagaugcuuaaacaacuuccuucuuuuuuuuuuuuuuuaaagauuuauuuauuuauuuuuauguauaugaguacacguacagcugguugugagccuucauaugguuguugggaauugaauuuuuaggaccucugcuugcuccaguugcucuggucgccccacuuacucagucccugcucgcucaggcccaaaguuuuauuaaguacacuguagcugucuucagacgcaucagaagagggccucagaucucauuacgggugguugugagccaccaugugguugcugggauuugaacucaggaccuucggaagagcagucugugcucuuacccgcugagccaucucaccagcccaacuacuuccuucuuuaagugauacguggggaaaauaguaaagaagccaggaagauuggauagagcaaggacucagaaaagguucccguucuucacagauuuuauaagaaaaauucuucccuuggaggcaaaagcagaauaaauaauauucucuccuggaggaagguagcagauuucguaauuuguagccucacucaagguccuaaaacucacuggccucuguuguuuuccuugaacaguuuugaauuauguuagaaauuaaaaugaggccugucagacuucacuguuucauagguuucguuucuuuucuuucuuucuuuuuuuuuuuuuuuguuuguuuacaggaauuucguucuucuagaaaauagaauuuaauggcacaacucuuaacuguuuuuuguuuugguuuuguugguuuuuguuuuuuuuugggggggggggguugagacaggguuucucuguguaucccuggcuguccuggagcucacucuguagaccaggcuggccucgaacucagaaaucugccugccucugccucccuagugcugggauuaaaggcgugcgccaccacgccagcuuuaacuguuuuuacaaaaagaaauuaaaauuaaaacaaaaacaaaaucuugagucuaaauuuuggguuuauuuuauuuuuauauuguacuuaauacauagucaccccuucauagcccuuuuagaguggaccaguaucccccaugauaccaauacuuacacgugcucaaguccuuuagaaaguuuaagucggguguuugcauauaacuuuuaaauaaccucccacaugcucgaaaucaccucuaaaguacucacuaauauagaacagcuaaguaaaugcacuaugcuguuuagagauuauaagacaaucucauagaaauuauauggcuuuuuaaaaguaaucuuuucuucacacagaaugaagauguccggccucacaucagagacagauuucgauugcaugauuugcugcccccagauuaaguucagagacuugucauaucacugaagggggggagagaaugcaggacccuuuuggacuaagacaaaaacauugccauuacuguugaaauuuugcauuuuuguaccccgucuugcuuucuuaucuuuggugcccaauaauaaucaaggguuacagaaagagacucucggauugaacacauacaguggguaggcuaaaacagaagcgucuguagaguagacagcuccagugagacucuauguauaggacaucugcagcucauaacgaauucuguuucugccaccagcaguuugaccuguaguuacacaggauuuuaugauaauaacagagaugaaaguggacuuucauucucucucuguuuggugcucucaguggguuuguagccacucuucuguuacuucacuauucucauuucaacaggaauggccaguaaaaguuguuuuauuuuuccuguuaagguuuauaaccuuuuuacauuucugaccuguauuagauuagaaucucaugaugcauuccuuuuaguuaaggcgcuucauaguuuucuggaaauagucaauuuuuaguuuuuuuuuuaauuauacauuugaauggccguuuuccugcuuugucugccugcauauuguauauuuguuuaaaaauauucucuacuuuuaguccauguuaaguuucauuuaaaagaugcauuuauauuuuguucuguaauauucuacuguaggugaaaucuucaaaaaucaagagacuggguaguuaagaauauaugaaugacuaauauucaaaugauuugaaugaaccauugugaugacauguauuccagaugguaauaucuugcaauggcacacguuuaauggauaaagguauaccucagacuucacugugcucacuagccuuugaggagaacgaguucaggcaccuguugggcuugauucgguuacugcugccuuuggguuuucuccaggaaggaaguauucagcacagugacucaguauuuuuacuuugcaugggcugguaguaccucuguuaugcucccaguuacaaucaguuuaaagcucuguguaacagcugugguaccuaacgguggcuaugcauaauccuguggcacaguacacucccgggccaccagugcagucaaugugcucauagugguuuucuaugcuauaugaaaauaagucgucacgccuugguucucuaaugcagcuaccacaagagguugauauuuuuauaguggcguguaaucuccuuuucaggaggcuuuuuauggaagguagaauuuguaaaagucaguaugcuuugccucucaacugcauuaacaugccgcaggcucagacuguuuuuguguaaaggaugucaaagaacggcacuuuuucuaaagagaaguuugauauuuuguaugcuuguuaagaaaguacaguauuggaaauuaaagguggacaauugauaauugaggaguaugucaguuaauuuuuuauguauauuaccuguuuacuuguacaacuuauuguacaaauuacaugcagcuucauuuucaaaugaauccuuaaaauaaggaaaucuuuuuaggaaaacauuuaauuuuuguauuuuugauuuuaaaggcaugaguugucaguuuucaguguauuaaugaagauuuuaacuuuucaucagguugaguguuuucuuacuauauuaucuguuguguauguaguuagcauauugugucacugaacuguuuaaaaaucuagcauguagagcaagccuguuuuguggaaaauccuuauucauuaaaaaaaauaaucauggcagauuuucugcaaaaaaaaaaaaagcaaaagcauuugcaauucagauuuuuuuuauuuaaaaaaaaaagguauuuugcuugcaggaacaauacuacagauucauuuuaaugagaaucuucgaaauguauuuaucuuuagggcaccugggcaucuuuaugcuguuugucuuaugucuuucuugaaauaaaauguaaauauguuaccuuuacauaugcucuuucucaaaauugugaaccuaguuaauaucuucuugcccccaucauuuuuaugcuuauacagcaaaccccaaaaccuguacaagauugaauuuuugacaaacauaauuguugacaauguacuugaucaggaauuaaguaaauacagucucaaagcccuucccacaucuuaaaaggggaaacacuuauaccauagugccugugggcacuuuaauaauaaaaaagcaggccugugccaggggaaugagcuccuacucagccaguaggugagucaacaauacacuuuuguagagaaauguaacgugggaaaguuuacauggccugagaguugagaccaaauuaauagauuauuuuuuucuauuacuuugaguaauucuaaaguuguugauaacaaaguuuaaagaagauuauaaagaaguuugcuggcuucuuuucauuuuaauagguuuaucuuucaaucauaucuuuucuuuguugguaacuguagaacgcuuccuuuuaguuaaucagagguguguacuuuuuuaauugcaaugugcccagccugucagugcacacagcacacaugacuauaguaaaugcaggggccauggguccaugaagcacacagcaagcuaccuguguacacauuacaacucuuaaggaccuauuaaaauugugcuauuuccaguuaugaauguuugacuuuuaagacauucuuuuaaauauuuguaucauuguuagagaauauuugcuugguuguauuuuuuagacccauguaauauauguaguccugaccagauuuauuaccauuuuucucuggguccuaaaagagaucgaugacaauucguaaccagaaauuguuuuauauuugcuaguauguauauuuauuuauccaauggcuuuauuuguuucccaaaauuguuuugggacuuguugaaagcauuguguaacuucuauaaauggcuauuuucuuguaacugucagugauauggauguguacauuguuuuuauauauauauacauauauauaucuauauauuucuggguuuuuuguuuuuuugguuuuuuaggguuugacuuuuuuguuuuuaaguuaccuuugccaaugacuuucuguuagcuuuuccuuucauucagccuucuaacagagcucauuuuuauuauguugucaacuuuccuguaagagagacuucaucucaucagugacgaaggcauuccauuauuccuacaagucguacagcaagcacagacucuucacaaggaucacagcucuuccgugugucagucacuuaaaggacacugaagccuucacuccuguacugauacgaugguguuauacacuacgucacuagcuaguuaagguuuucugaccugacuucucuuugucuuccuagguauuuauuuguuaccucuuuaaaucuuguaugucuaaauuaacuuagaauaguuucccaccgaauaacuaugccaagaacuaggaaagaauguuuauuuuauuuccccuuauaggggaagaguggacugggaacaaaaguguaaggccaaaaggccuucgguuaucaaucauucacuuucuuauuccucucaugggcuguauuugccuaaagguuuggggggagggggcugcuuuuuuuucagugcugauguauuugacuaugccauugcuucucaugucuucccuugaguugaaagccugcuaggacuuugcauaaaauaccuaaaaguucucagaguaagaaccacaaaacucaguaccuuauauucaaacguugcuuaaauuauugaaaucuaagucacauuagaauacauuuucauauucauauuucuguuaucuugaauugaaauuccauuguaaaucaauuuagucuuuuagaaaguuuauucuagcauaugguuuuaauauuaguauuuuaagauaauauaguugacuaccaaaccuaccugcuaaucagaauuucacugaggagcuuuuaaacugcacagcauccugaagccugggaagccaccucgucuauacagcaggcuuggagaguucuguguuuuuaaagcuuucccagugauuuaaauagauaacuuugguauauccuguuuuaaauaaugugguuugagaauagguugcaaaauuugaccagccauauuucccugucucucugucucugucucucuuucucucucugguaguuuuuuuuuuuuuuuuuuuuuaagugcugggaucauauuucacagaacguauucaaauucguggaggaauaaugaagauugaggcuacugcucauugccaguuuugucauucauacuuuuaaauuaagaguuugcauuuauagaacucugaauagcugaucauuuacauagcugaaggacaugucccugaaugagaccauuauauauauuaacuaaaauauuucacuauuuuuuuauuuuauaaaucuuuguagaaauaagcaaugaaaugcuacuuucaucuuuugaacugggauuuuucaagguuguguccuuuuggcauuaagguaggggggaguuaauauucucucuacuuauuuccacaugaaucaauaugaagucguggacauuuaaaaaucucaauuuaauuucuacuuauuuacuaugcaguauagccgugaacaaguaauguagauuuaguuuucucaucuucaaaugcccugauuacccuaccucacaggguuguuguggggauaaauaaaacuuuuauggaaguacuuucuuugaugacauuuuuucagccuuucaaaacaauggaauuuugagcauucuucccuucuguuuuacaaguauauggguuuucacauucuucacuuuuagaccuuagaacaugccuguaaggaccauagagugagucaaauaucaggaagagccaauagagaaacagggucggagcuaugaaccaagaucagacucagugcaguggagugugcuggcacuauguauaaccuacauaagucaggccaaucuacaaaauacuguuaucaaaggaauaugaagccacaucugucgggcuaaagguagcaucuaguuuugaaacuacaaggaaacugcaccuuccagauuaauucauauccagaugaaaggucacagcugggaguagaauacagguuucuuaauuauuaucauccaguguaaucguacuguucaauuacugugaaccaagauaaaagaaaauaucugagguuaauccagacaaagaagcuuggugagaacucuuuacauacaagcugacuugguucaugauuugaauucacuuuccggagucuuggauguuauuuauaaaauggguaacacuaauaucuaccuuugaggaaucuaaagauaaaccacaaagcagucaauagcaggagagggugcccauaguugcugagaacuugauauaugaguguguuaggaaauggguggccauggucggaaauacuaucaggaaagcugaggauguaguucauuggguaucuugcaugcacaaaggccugguuuggucucuggcuuggaaugaaaccauccugguggcaaauacuugaaaucccaguggaggcagggucaaacauccaaacucauucuucacuacauaacaggcuugaggccacucagauucuugucaagauacuaaugcugaagguguagauuacuaucaaguagucggcuuguuugguguguagagucaugaguucuagcccuagaaccuaaaacuaaaguccuuacuauuguuagucaacuacuaaaccaaagauuucuguuuauaaaauugacaucugccauaagcacugccuagcacuggagguuaccauugguuacuguuggagaaagggucacggaaaagagcugcagagugcuaguagucauucaagucaagucccuguuaagaguuuuuggagggaaggauugguuauggggggagaaggccagcuaggaguucuaugggucugcacaagcuucgcuugguggacccaccuggagugccagcacuucaggagauggaggcagacagacaguugaggaccauucagagcauugacuacaagaaaccucaagagcaauaguguauaacuugaguguucucuuucuucaacuucugaaggcauucauuggcugcuagugaaaguugagacugauuaaauuugggaacagccuggcuuacugucugaaucuagagaacuucuugaagaaagguauguuuguuacucuagagcauucugauaaccccaaaaggugugagagcuugaggcauguuugcuugcucucuagugagcuuuggccccuacuccagagcuuaaugguuaggucauguuucuugaguggaugugguuugggguuaaaguguaaaaagucaauuagcuguuucuguaucaaaucagaaauaaaacgguuucaaaugacuugguaauuuuggaauuuuguaggagacuguuacucaaugucuuagguuuuuacuucugugaacagacaccaugaucaaugcaagucuuauaaaagacaacauuuaauuggggcuagcuuauagguugaguuucaguccauuaucaaggcaggaguguggcaacuaggagaauacuagauuccaggcaacuaggaggcuggucuuaaagcccaggcccacaaugacacacuuccuccaaucaaggccacaucuccuaauagucgacaacuuccugggccaagcauauucaauccaccacauuccacuccuuugccccaauaggcuuguucauaggcaugagucuauaggggccauaccuagcucuagccuaaugcaagauacauuuaauccaacuucaaaaguccccauaguaaauagcagucucaacaauguuaaaaauccacaaaaucucaucugaaauuccugcagucacuuaacuguaauccuauauaaagucaaaaaauacuggacaaacuccaugucccaugucaaagcgcucuucacaucaucuccaacuccuuucauccuuguugacugcuguuggcagauauggcauucagcugcaacaaaacaaacuucauucucuugggcugguuccacuuucuguuagcagcuuuacuuggcaucuguaucccacagcucugacaucuugggauauccaagggaacuucaacuuuauaguuccaaugucugggcuccucaaagggcuuggucauucuccagcucugucuuuuguagaacucuugggcucugguugaccccacuuaacugcugcugcugcucuugguggucauuccauggcacuggcaucucuucaauaugcuggggucuuccacugcaacuaggcuuucccaacagccucucauaguagugccccuuucguagugccagaccucaauuucuuugcaugacuccuucauuccuggauuaucaacugcaacugaggcugcaccuucaccaauggccuuccauggccucucacaguaccaagccuuagcuguucuucaugaccccuucaugccuucaaaaccaguaccaccuaggugacuuaacaucaccaaguccagcuacaguuuaagguacaaccuugguaucacagcaauaucccaguuccugguaccaacuucugucuuagguauuuacugcugugaacagacaccaugaccaagauaacucuuauaaggacauuuaacuguggcuggcauacaguuucagagggucaguccuuuaugaucaaggugggaguauggcaacgucuaggcgggcauggugcaggaggaguugaguuuucuacaucuucauuugaaggacacuagaaggcuggcuugcaggcagcuagaaggagggucuuaaagcccauaccuacaaugacacuuccuccaacaaggccuagacacauccuaauagugcuauucccuaagccaagcauauucaaaccaucacacagguaaguuccaaacuccuggugauccuccugccucagcuugcaaguagcuggaacuacagacaugcaccacuacacccagcaaacaagaaucacaacucugaagggaauucuuuuguuugaaucugccuguacuuggaauuua

SEQ ID NO: 1042 - RNA, 72775 nt, Mus musculus
acaaacgucccccacgcuccgagccccaucggaggcugaguccagucuaacuccucgggcccuaagcucauuuuuuuuucauuguuuuuuguuguuguuguuucuuguuuuucuuuuggucaggaauucgcucuggugaguucccuaaggcggcagaaacuucagccucuucacgguaguaaaaguugguuuccccucccccgcugccgcccaggccucccgcauuccuucccucccgccucuccggaucggggcgggcgggggaggagggagccagagcgccugcgcagggaggccgcuuuccauccgggucccuguccgugcggugcagcaggucgguaggcgggaaauggcgacuggcugaaggagcugguucuguugcugcugagggauaagcgggaaagacaccaccuauugcgcagucgggaccaucgccggagcccgaagacacuuuucugucgucacagugaagguaauucccuugguccagacgcugccguugcuccgaagcucaguccucucucagggccgucugccgggaucuccuccccuucucuagccgagcccucagcgguuccagcaacguccguaggcaugcacuguuggcgccuuguacguccacugucguggaagcugcucuggcuuggacuuuccccagggaacggccagggagcucacuucccgccagcuucagcucuuaggcugcggccuguguugugauuucugggguuagauuucacuuugcuacccacccccaaccccaucucacguucccagucucugaccccguggacccgauagcuaauuaaguuagauugccuuuucgaaccuucuugugggcccacguaauguuuuugguauuucauucuuguagggugcauuaggggggcguugcucucucuacuugagcucuuacagacauccuuugagaaucuggaaagagguucuuggagcuucugucguuuucuguacugcuaaaauguugaguugacauuacuacuuuuuaaagucaagugugguaguaaaaaccagcguguguaggaggccucugauuuccguagugguuaguuaagggugaaucuuaauucuauuuagcauguuguuuacguuggguaaguccguaugaguuuaccuuugcguucuugaccaggauucugugauaaauaauugcauaaauaaauaguguuuauuuacuucucgcccuagugguagcuggaugugugaaugacguuaggcacucucagaguaccucggagaaaccuacugagauacugccaggaaacuacccuaagcuccugacaugaguauucuuagaugcuacuccaaggcaaggcagggaguguuaucuuucucaugcuacuaagacaauaccaagauuacgguuacauccauauacaaauuagugccuugaaaugauaggcuuaucuacauguuuuagauuguagauugccuguuacuuugauucaugaaaugccaagcuacacauuuguguuugugguccagcaauuaucucuauaaaagcagugacauggcauguggaagcuaguuuuuacuggcuuuuguuuugauuuuucuuuuuuuaauagaguuucucaauuuuuuuucaaugguuuggucaugucgaguuuggggcauuauagguguuuucuccccuggaauaaaacggaagauuaaaacauggcuuauauuacauauuaguuaauguuucucacucaguagccuucugcuucauaggugcagccuaaaguacuucacuugcuguucacauguuaggauuaaauuucaguaauaagcaggcacaugcaaacauuauaguuuuuauuugaaagacuuagcccaaggucauaaagaaagucaagguaaacauagcucuuauaugaaguagauuuaggagugaccugggccucacugcucuuuccucacugcugcuugauuucgggguuuggggagugaaaguuuagacagccugaguccuuguugagucauuucauuuuaaaaugggaccaauuauguuacucagaagaauugggauaaauuaugucuggugcaggcuuucucuguguuuuaacaauguuuuagggguagguuuuuugauaaaauuuaguuuauagguagcagaaucaguauuguacuacauucaacuagacccuauauucuuuuuuuguuuaauuuuuguuuugugagacaugauuuugugugugugugugugucacagcucuguacuggaacucacuuuguagaucaagguggccuugaacucacagaaauccaaccugccucuaucuccagaggccugggauuaaaggcaagcgccaccacagccaggccagucccuauauuccuaauagucuccuaugcaugauuugaaaggaugugaaaacugccaagugcuaucuagucuuuuucucaugugugcuauaguuguauugcaauaauaggauuguguaggaauacuaaauaggauagguauauuuuagaacauucaguugugcauagugcuggugccuuacagacauuucauuugaacuaguggugcuauuuuuccccugcuguuagaaaauugaugauugggggcuggugagauggcucaguggguaagagcacccgacugcucuuccgaagguccagaguucaaaucccagcaaccacaugguggcucacaaccauccguaacaagaucugacucccucuucuggugugucugaagauagcuacaguguacuuacuuuaauaauaaauaaaaucuuuaaaaaaaaaaaagaaaauugaugauugauaaaguuuuaucuuuuccagauuaaucuagccuauuccaagguuguauuugaucagaugguuucuuuguaggaugauuugagcaaaaucugucuggauauguagugcagugguaaagugcuugccuggcauucaggaaacccuggguugcuaaauccccaucgccagaugagcugguucuggugguuccugcuguaacuuaccucagggagguggaagcagagaaucagaaguucauccacaucccagcuauaguacacauucgaggccagcuugggcuacaggaggcccugccucuacaagaaacuugaacuugcucagaaaggauauacuggacaggcuuguaacuaacugcagaaucaauugcugauugauaaaguaguauuaugcuaacuuaauaauaauaauucgcuaugcuuuugauugauaaaucaaaaauauauaaagaauauagugguuugccagaauuugaaaaggggcagcaucucauuuuuuuguauuuguaauuuaucaaguuuuuaugaaaauauaagggaagaagaaagguacuuuaagucauguaucaagugugugaagaggaccucauacauggugcacucgcucuuaaguuguuuuuacuaguuagauuaaaguugccaaaccauuuuacacuggauuggcuacaggaagucauuugugcuacauugaaaaugaaguugcuuauuuauauacuuguuuguuuuuuagugagacagggucuggcuauauagcccaagcuuacucaaacuccagauccuucugccucagccaggagugcugggauaaaaggugagugccacuacaucccagaauuaggcuauuuaacaggcauggaacuugcuagaaggagcaauuuugacuucaguucuuguucacuuuucugacaucuuuaugcccuaaccuaagcuagauguauccacuaauguuuguaugaguauauaugcuuuuucuuccuuaagaaaaagugcugcugcuauauagcccuugccagccugaaacuugcuauauacacuaagcuggccuugaacucacagagauccucuugucucugccuucuaaguccugggauuaaaggaguaaguacaucacgacagcuauucaauacauccauuuuaaauuuaaacuguauuaaaauuauuauugaaccuacccauagguagaccuaggugguugagauuuucuugagaaaugucuuguucgacuucauuuauauauaccaagucuuguggaauucucucugaaaugcagugcuuaaaauuauaaauucagcugggcagugauggcacacgccuuuaaucucagcacucgggaggcagaggcagguggauuucugaguucgaggccagccuggucuacagagugaguuccaggacagccagggcuauacagagaaacccugucucaaaaacaaagagaaagaaaagaaaaauuucaaauucagcuggguguggugacaagcaucuucaguugcaguucuugggaggaagaggcagguggauugaugugaguuuaaggccagccuagacuauauagcagguucuaggacagccagggauauauaaagagacccuauguaaaaacaaauuacaaauucuuagauaaaacaucguuguauuuuauucauaaguguagauuagcuuguuaaacuacacauaagugagggugagaguucagagacaguggaauugaggaaacguaaauuuccuucuguuuuuuuguuuuuuguuuucuuuugcuuuuguuuuuuuuccagacaggguuucuauggcuguccuggaacuugcucuguagacuaggcuggccucaaacucagagauccaucuguuucugcuccccaagugccgagauuaaagguguguacuacugcauuuuaaggaaaguuaaauuuuuauauguugguugugaucaggagauagaugggauauaggaguguuggcuagguaagacaaacgugaugaaaguaaaauuuauauagugagaaucuuaggccuccaggggcccuuugauaaggaauggugagauuuaaggguggcuuccaagguaagacuuuauggacaaauacuuuuuuauuuuguuuggugacagggcaggcaggcuuugaaucuuccauguagcaggggcugaccuugaggcccccccccaucccucugccuccaccucaaaagugcuuggaucacaggcauaagucaccauguccaucaacaaaauuuugacauaaaaucauaguagaauaguagucuaggaucccacauuucaugauaugcauagcuuuucuauaauagauugaaaaagagagagauugaacauuacuaacaugaguaauagugcuuugagcuggaguuccaacaaguuaggcuuucauaauagcugcaauaauuguaggacaagcacuuuuuaaaacaaacaaacaugaaacaguauaguagaaaguggcacuugaauacuuuagaaauaauuaggguuaaacuuuaauaauagccauuucuauaggaucucacuguaucucaggcuggcuuuaaacuauauagaugugcccauuuauuuuuuuauuuuuauuagguaguagagacgccuuuuuauuugaauuucuuuagugacuuggauaaguaggggagagaaaaugggcaaacucaacaguagagcauccguuucaguuuagguguacuagaguguagauuacuuuuagcuuuuucuuucaugguuguguuaacgauuuuuaagauaagguaugaguuaguuaaucauagaaucuagacuuaguggauaacaauuuuuuuuguuuuuccaaaauucaguucauuguuuuaaaacagauuuuuuaaaaaauuaaaacaguuuuacauucauuuacuguguguguugugugaacaccaaagcuauaauuauuuuaaauacugugugugacugaguguauguaugaguugcuacaugccacuguguaccuguggggaucagaagacaacuuucaggagcgcauucucuccuuucaccauguugguucacaggcucaaacucaggugguaaguacacacccuuacucucaccgacccaagcaauucuugaggcagacaguugcaauuguaaauugucuuugauuaccagauuaauaguccaaguauaggacuggcuuuaucuaggggguuccuuacaauacagcaauucacaauaaugguacaaauauaaacuuaguuggaaauuugucacagaggucuucagugcacuaauuucuaccaaacacaagaaagaaaugaugccgggagugguggugcacaccuuuaaucccagcacuuggggggaggcagaggcaggcggauuucugaguuugaggccagccuggucuacaaagugaguuccaggacagccauacagagaaaccuugucuugaaaaaccaaaagaaaaagaaaaagaaaaaagaaagaaaugauaaacugcacaugaagguuucucagaaaguuaucaagacuauauaauuuguccucuuucaaacaaauauguuugcugaaaaaaucagcauuacaguggcaaauuauacauugaagaaaagaagggcagccaauaaagcuguaaaaagauuucaaaucaagcuuuaaaggcaaaaaaagucaaagccagcccagauugucuauuauaaagaauauuuggggaaauaaaagggcuagagguguagauucauggcaaaguaguucuucguguacagggcccugucuagagagcauccuggagaaaaugcugugccaguaagauggcucgaacagguagaccugacaaccucagcgcaguccccaaguccacauggcacagcauuauugcauuuuacuacacauaaauuuuaccuuuugguaaagugcugagccaggcaagaagaucauguguagcucagcacugaaagggagaucucaccaaguuugagaucagcuugggcuacgcagagugagauuuugucucaaaauacacauauacacauacauacuaaauuauugugaauugcugcauuguaaggaacccccuagauaaagucaguccuauauuuggacccuuauuguaaucugguaauccaagaugauuuacaauuuauaauugccucaaaaauugcuugggucagugagagggugugugcucuccaccugaguuugagccuaugaacccacaugguggagggagagaaggcacuccugaaaauuguuugcaguggccugaaggcacucauacgcacacucaguuacacacaaaaugauaaagaaaaucuuaaaauaauuauagcuuugguaguaauuggaaauggcugugauaaagaaaggaaaggaacuuuuuuuuugcccguuuuguaagcaaacauucuuacuguacugaugauuguucagagagagaauuuucucuuaucugaucuguuugaaauaaaugaaaaacaaauugguuaaguucaguaaagagcaaagacugaguuguagaguaucagguucuuaaagugauggauuagaucacugccuucaaggguuuuuaguucuuugcaguacuucugcaugcuuagcaagggcucaacuucugagcugcaucucuuaguccuugccaugaggacuuacucuugucaagugugauugaaucuauugaagcagauuauuuaguguuaauuugguaagagcuaagugagagaggaccucaggguuuacaaaaguuuauggguguggagguggauuuuauugguuauaugauacuugggcugaguuuuaaacagugaggauaacuagguaauuaguugaaauaauaguugugguaaaagccgggcgugguggcacacgccuuuaaucccagcacuugggaggcagaggcaggcggauuucugaguucaaggccagccuggucuacagagugaguuccaggacagccagggcuauacagagaaacccugucucaaaaaaaccaaaccaaaacaaaacaaaaaaaaaguugugguaaagaggacagaaacauagguagagagcgcagugugucagagcuaugauuacugcaguacagaggaugacagcaaauaacagugaagaaagacugcaccuggaaacccucucuggggaauuaaugcagguggauuguuggugcugaccgugagcuccagguucuguaagacccagucucagccaggcagagaaagacugaggaacauaacugguguccaccuuuguccuccucacaagcucaucagcacacacgaacaccuacuccauguauuugcaacacacucucucuccuucucucuccauauuauagggugauguauuugccagugauuuuugaguuuaguuuuuauuggaaagaaguugauaagaaaccugguaagaggaguagacaagugugcagaucagaggaugguuuuaaaaggaaagacugaaaaauuaauacuagagguuaaaaaccggaguuucauaguugauuauagggggauaaggccagugucacaacuagguggucgauggaguuuaggguuuuuugguuaguugauuacguugaugaauauaggagaaacaauaaaacaggaagaagauauuuugggauggagugagaaaaauuaauucaguuuuggguaaguugaguuugagguggugagcuuuaagucugcaauuuuagauaguagucuagaaaaucaagcauuauuaaugucgcaguuuauggucaaccuuugaaaggcuccugcagcaacaacaccuguaaccuauuuaccuguaaccuauuuaccugggcagcagguaacuacaaaacaaauuuaaguugaaaaaaauaaauaaauguuuuuuuuuuuuguuuuuuuuuuguuuuuuuuuuccauuuuuuauuagguauuuaacucauuuacauuuccaaugcuauaccaaaaguccuccauauccacccacccccacuccccugcccacccacucccccuuuuuggcccugguguuccccuguacuggggcauauaaaguuugcaaguccaaugggccucucuuuccagugauggccgacuaggccaucuuuugauauauaugcagcuagagucaagagcuccgggguacugguuaguucauaauguuguuccaccuauaggguugcagaucccuuuagcuccuuggcuacuuucucuagcuccuccauugggagcauaaauaaauguuuuaugcugucuuuaugucucaaguucuuggacuuaaaaguacuauuuucuuauuuuaucauuuucguuagcugguacuagauuuauuuuacuaagcaugaucauuucccacucuucuguuaagggguguguguguguguguuuuaaguguuauaaagagaaauuguauagcgggcuguagagaugguucaggguuuagguuguuacugcucuucuagaauaccucuguuccguuccaagcacccucauuaggcagcucacaaggugccuguaacucaagccccagaggcucugacaucaucguuucauacacaugaaggcaggcaaaauacauacacacauuuaauaaaaagaucuuaaaaauaucuuguguugauugguuucuauagugaagugaacugggccuuguauuuuacauaggguuuuaacuacauacucaauuuuaaauaugagguuaaccagccuauuuaucauuguaagguuuuguaauuuuuauuucuuuugagacaaauuuugcuaugucucaaacuggcccggaaguucuaaucuuccuaucuugaccuucugagggcugagauuacagguauuuguacacuaucccuugguugugacuaaucuuuugaggaauuuggccauuucaucugaauugguuaauguaaagauguuugaaauucuucauaauucuuucuaagucuacacaggcucuguuguaauuuucaaguuuucauucccaauauugguauuguaccccuccccuuauucuugcaguagcuugucaauuuacugagcuuuucuuuaaaaaaaaaaaaaaaaaaaagucagcuucauugauuuccccuccauuuuacaguucuaggaccuuauacuugagacaaauuuugcuaugucucaggcuggccuccuacucuugaccuccugagugcugggauuacagcuguuuaccacacugucagcuagcuguuuaccugagcugaaaccccacccccgucugaguuuuuccaucuuuguggaauuuccugacaguugcuuguauuuguuacuggugguggugguggugaugguggugguguguacaccucuauauugggggagcaugacacaguguauguggaggccagaggacaacuuuauggagucauuucuuuccuucuacuuauaugugggcucgggcuugaacuuagguugccagacuuguguggaaagugcuuuuacccaccgaguuuugcuaacucuuggaguauuuuacugaaugcugaauauuaugaacagaaaguaaacacugguauaaucuacuuggaaaauuggauuuuuggagcugugaaugaagguguuuggguuaaucaguuuugcugcagaggguaccuucuucaugcaucacugacuuaaauaaguuuucuuguugcuuuugcucagaauccuaguuggaauguggggaaguuucugcuuucugaucuguucuugacuuuaguuuauucucucugccucaguguaagcaccuggugugcaaagcugauggcaguucagagcaucuucuauccuucccuguuuaaugguuuggacucuuguuucccacaacugagguugcuccagcaccacagaucuauaauguaugcucaugcuagcccaugugcauccaguuuauuaauaauuuuaaggacuggagagauggcuuaguggucaagagcauuuguugcucuugcaaaggacuuggguuugguuccuuuacacccauagagcgacucauaaucacccauaacuccaguucugggggacccagacuucucuucugaccaggcaugcacuugguacauauacaguacauaaaggcaaaacacuuguacacauaaaauaaauaaaucuaaagaaaaauuaaaacccuaaauaauuuuauauauuucuaauuaaaaaaacaguuuaaauuuauuuaaaaacuugcaaauaaaagauuaauucugaugucugaauaaaacaauuuuagauuuuucucauguuuuuguuuuuuguuuuuuuguuuuuuuguuuuuuuucgagacaggguucucuguauagcccuggcuguccuggaacucacuuuguagaccaggcuggccucaaagucagaaauccgccugccucugccucccgagugcugggauuaaaggcgugcgccaccauacccucacuuuuuuucucacuuuuuuauggcauaauuauuucuucauuuguucuagagaagaacccuuacuuguuuccugucucuccuaagaagggcuuaucuuuuguuggauuugagauugauuagguacuucagguucuuaguguucuguuguuuucaggaaggucuuaauucuuuggugauucacccaaguuuuuuauuguugguuuugggcuagagcagcuuaauuauuaucagcuuucuguaagugaggcagaacucaguaauagcagaauuggccauuucccuuucuggaacuacagcuuuaaguccgacuuuuuuccccuugccuucaaguugucuucugauuuagaucaaggaaaggguucagguuggccagauuuauaguaaagaaagaaaacaaugccucuuuugggcuugcaugcauuuucuucuuaaggaccuuaaaguugugugguucuguagaacagucuggccucagagcugccucugucuccagaguguugggguuaagagauuggccacuuugucugcugcugacauuucuuuuugaauucagucaauuguugaucucggaugagggccauucuauauucuggauaucauuugcuuuaggcgaauaauuuguacacauuuucuucauacgugugcaugacaugauaugcauauggagcucagaggacaauuuaggagacucaucucccaccauguggguccugaagauugaacucagacuguguuuuuacuaauuggcgcaccuuacuggcccuuguacauaggguucuugguauacagauacuuuuaauuuugaugucugauuuauucucuuuugagacaagcuuucauguaucccaggcuggccuucugcucacagaguugucuuccucugccuccugaguaaugagauuaaagguguuagaguacaguuaggucauuaggcuuuggggggaggggcaaggguuuguuuguuuguuuuuuguguuuggauuuuucuguguaguuauuuuaugggcuaacuagucucauaaguguguuaauuuacaacguuguuuucuuuuuuuuucuaaaaauuuuuuuugaauguauguuuuguuuacaugugucucagcaccauguuugugcuaauacuuaggccugaagaggccgucacaucccuuagauggaguuccagaugguuaugagccuccaugugagugaugggaauuaaaacucgguucucuggaagagcaauaagugcuuuuagcucugagccagcucucuggccauccuuaaaauuucuuuuuaaauauuuguauuuguguauguguuacuggaagaaaguggggccucucauaugaccuagcagagauccacaucucagcccauaaauccaguuuuauuauguguggugagacugaacucuuaucaaagugaucaacccucucuuguuacucucacaugguuauugguuuuuagaauuguguuugugaaauucaucaagugauggguuuuccucuuaaggucaaaaggacaaaacccuuaccccagggcuuaccuagcuuguggucucagaugugauuaacugcucaauaaauauuuguacaguaaaugaaugacuaagugugauuuugacauagguagagguagcacaguuuuagaaagaucaugcacuguguuuggcauuauucaguuuucuaggaggcaauaucucacauguugaaguuauuugguagauaacauauauaaaauagaaugccuuucacuuacaaauauuaguuuuuuauuuuaguucucuuagagaucuggacucuuuuaaaggaauagauuaauaacuuguguucauuucuccugcagguuuacauguggcacccguaaaagaugaagcugagaacacggaaggcuucucagcaguccaguccaauccagacacagcgcacugccagagcaaagaggaaauacucagagguugaugauagcuugccuucaggaggagaaaaaccaucaaagaaugaaaccggcuuauugucuucaauuaaaaaguucauuaaaggaagcacacccaaggugauacuuuaaccucacaccuauguaaaacacaucaugcuuagguuguuauauuaauagagcccauuuuaaaggauaauacacauuuugguuuuauuuucagggguauaacaugugagguauuuaaugaaaguccaaaacaaacauaacauugaacuaaaaucauuuagcuuucugccgugguuguuguuuugguuuuguuucuugagacaggaucucucuguguguugucuuggccguccuggaacuagcucuguagaccagcuggcauugaacucucagagauccaccugccucugcuucuaagugcguuaggguuaaagguguaugcuuccaccuccugguaguuguuuuguguuuuugagacagguucuugcuauauagcccaggcuggucaaguauuugcuaacaaguuagcacaggcuaacuuccagucuuccuggcuuaacuucuugacaauugggguuacaggugcaugccauuguaccaguagucuucucugguuuucagcaugguguuauggaaaucagaagaggauuuuuucauuguuaauuuuuuucauugaguuauugaagaaagcauuuauuuaguaguguagugcagugagcaguggguauaguauagcaacaauagaauaacuacaugcagcugaaacaauauuaaaagaaagaauguuuacauugguguuauggauugucauaagugauuuaggaagucaguuacucuucugaccuucagggaaauuggaauuggugccaagugcuuggucucaagacuuuucagacuacuacaaaguggaaaaguaguuuuagaaauuuucauguauucuguaaaugugcguuguuauuucugauguugacuuuuggguuuuuuuuuuuuuuuaaauuuauuuauuuauuauauguaaguacauuguagcugucuucaggcauuccagaagagggugucagaucucguuacggaugguugugagccaccaugugguugcugggauuugaacucuggaccuucggaagagcagucgggugcucuaacccacugagccaccucaccagcccaacuuuugguuuuucaagacaggguuucucugcauagcccuggcuguccuggaacucacucuguagaccaggcuggccuugaacucagaaauccgccugccucugccucccaagugcugggauuaaaggcaugugccaccacugccaggcaacaaaucuuuuuuaauuuaauuguuuuuugagauuuguauuuuauguguaugggugcuuugccuguguguauguguguguguguauauauguauauguacauacauacauacacacacacacauacacacacacacacacacacacauacacacacacacaccccacaguauaccuauggaggucagaagaggcauuggaugcccuggaauuggaguuauaguuuucagcuacuaugugggugcugaaaauugacccagcucuucuuuggaagagcauucacuguucuuaaacauagcaugucuuugaaagccccuuucuccaguuaugaucuuauuuuagaauaaagcuucagcauauaaguacuagcucccuuccucauuuuuguuuuuagagguuuuuuugaguuacggucucaguauguagcucugacugccuggagcucagcuguagaguaagcugcacucuacagagacccaccugccucugcauccugagcucugggucucacuauauaaccguggcuggcauucacaagacaucuuccagucuugggugcugggacuaaagguuuaugcugccacucugagcucuccuccuccauuguuuaccuguaacaaaguacaugaaauucucaaucuguuucaaauccauauuuugguccaaagauucaauacuucucugauuucaaaauuuuaaaacuuagcaagaacacucagaaauuauuuucauauagccuuucugcuuuuaguucaaagagauuucuaauacuauauuagaaguaaaagcuucaguuuugaaaugaaauguugaaauauuuauaucacauugaaagcauauuugucaaucuccuaauuaugaucuauagaaagaaaauuuuuuauauuauauaugcaaaauaaaccugacuauagauaagacacacauuacugaacauugagcccagggcaucaugcagucuagguaagcacuguaacacaguuauucccucagcccccauuucuccuuuuauuuuuuuaaagacaaguucucaugucauagcccaagcucaucugauacucaaagcaauccuccugcuccaaccuccagacugcugugauuguaaagaacuaccauacccaauuuuuaacucugaauauuguaauggacugauucuuuucuuuuguguguguguaauuuuuaaaagaugaucauaaaacuuuaaauugauuuuaugauggauuuaugucuccuaaucuagaaaagcauuacuagauuaauuuuguuuguuuugcuuugaaacaaucuccaaaaguucuagcuggacuggaacuuuauauaaaccaggcugaccuuaaacucagagagauccaccuguuucugccuuccaaguguugaaauucaaggcaugcacuaccaugcauggcauuggauaguaauacuguaauccuuagaaugaaauaacccaugauaccauaauaaauauuuuauuacacuuuauuuguuuauuaauuguaugcauauguauauguguggauguauaugugcuauaauacaugugugaaagucauaggauaacugugagagucaguucucuucuaucaugagucccaaggauccaaggcagguuggcugcaggaaccuuuaccugcugagguaucuuacugguccaggaguaauaagcagauaaucuucucuuuuuuucuuucuguaacagagccucauguagcuuaguuucaacccggccucuguguaucagaggcugaccaugaacuccugauucuccagccucuaccuucagcugcugggauuaucaccugccuuaugggacacuggggaucaaagccagggccuuguucaugcuagauaaauacugagcccccagucacuuguugguuuuuuugagaccaugcuuuagcuuggcugaauuagacuauacuauguaagccaggcuagucuugaacucuuaagcagucuuuuugauucagucuccagaagugugggauuacagguauagcucaccacgccaagcugagucaacaaauuaguuaaguagagauggaagaguucucucuccucaucuccaaccacacaugguuacuucauguuacagagauaccucccuuugcaucagcuuuuguuuugauuaugcccuaaguucagauucauuacaaaauauuuauuuaucuuuaugccuaaauuauguuuucuuuuauacuguucuuuuuuguuuuugucuuuuuugguuuuuagagacaggguuucucuguauagcccuggcuguccuagaacucacucuguagaccagccuggccucgaacucagaaauccaccugccucugccucccgagugcugggauuaaaggcgugcgccaccucgcccggccuuuuuugcuuaauguguauaucaggcugaccucaaacagacagucuucugcuuuagccccucaagugcuggugguuacaggccugucuaccaagucagccuuucuguuaacuguguugugugagggaucuugggggaaacagaaguacugaacuuuguuuuauuucaaaacuuauuuuaugauuguuuuugaguuuuuuuuuuuuuuugguaauucaguauauauuuuagaauuaguuuagauuauuaaaaagcuaccacugcuauuuuaauaaauuuuguacaucauucacuucauugaauguguagauuauuuaccaaggauggacaucuuaguauggagucuaucaauucauaaugaugauaauuugagccaggaacaguguugaguaccuguagucccacugcuuauaaggcugagguuggaggauggccugggaaauauggugagacuuguguguuuucaggaaauaaaaaaaaaaacggaagcauggugcugcauucuaauauuaucuaaccugggcuacauagcaaggccuuaucuuaauaaagaacaacacagaaaagacuugggugaugaagcuagccucagauacauagcaagccagcuugggcuacaugagccuguugucuucaggaggaaaaauagaaguauguauagugggugauguguaaguuuguguaauccaugauacaggaggauugucacgaguucuagacccauacuuggcuacaaaguaaguaccacgcuagguagaguucagugggaaaacucaccaacuaaccaacugcacaauuauaagcagaauuaaaagugcucuguuacugaguuacagucuagcccaguggaguuaaucuuauuuuuucugaauaauaaggaagucuugcucuauuucuaccaauucuuuuacuagguauuugauguuucauaaugcuuuuuuuuuuuuuuuuuuuuuuuuuuuuggguuuuucgagacaggguuucucuguauagcccuggcuauccuggaacucacuuuguagaccaggcuggccucgaacucagagauucaccugccucugccucccgagugcugggauuaaaggugugugccaccacgcccgguuuuuauaaugcuuuuaacuuuauuuuuaguacuaacuuugagauagggucucacuguauagcucugacuggccagggacuugccauguagacuuggguggucuugaacucagagauucaccugcuucuguuuuuuugaguaaugugaguaaagauguacaucaugcugcccagcaaauucuuuuuauguuuuuaagauagucauguaguuacagaauucaaaauguagucagggacgaccuuaaacucccgauccucuugccucccagcucccaagucugaaauuacagguguguguuaauacuauguccaaugccuuuuaguauucuagaacgaauguuuuauucuuuauuuguaugaauguuuuaucugcauguuuuucuguacuacuuucaugcagugccugcuaaaucucaucucccuggaacuggaguuagugaugguugugaaucaccguguagguacuuggaauuggaugcuggaccucuggagagcaaccagugcucuuaaccacugagccaucugucuagccacuuauaauuaauacaaauacuuuuaaaaacucaacgguguaguuguuuguugcuaauacaaaauucaguuuauagggacuggaaagacagcugaauaguugagagcacaucauuuaccuuuauuggguacugggaauugaacucuggucaucaggcuuagcagcaaguauguuuacucucugagcuaccuugucagccuguuuucuuuuucuguuuugaugcaaaaaggaaauuauaauuauugccaucuacaauacuagguuuugucuuuaaaauauaacaggguuggagaugguuagcaguaagagcacuugcugguuuugguuccuaccauccacauggcaacucacaacugucuuuaacuguuguuaaagauaguuuuuggguuuuuuguuuguuuguuuuuucugccugcauggauacuaggcauacauguccagacacaccuguuaugugcaugaaauaaaaaucaguuugggggauggagagaugcucagugguuaagagcacuuauugcucuugcagagaaccucggcuugguuccuaguauccaaaacucuuaucuauauauccaagggaucugacacccucuugugaccuccuuaggcuccugcaugcauaugaugcauuaaaacucaugaaggcccacacacuuuuuauuuauuuauuguuuguuuguuuguuuuuauguuuguuuguuuguuuguuuuucccgagacaggguuucucuguguagcccuggcuguccuggaacucacuuuguagacuaggcuggccucgaacucagaaauccgccugccucugccucccgagugcugggauuaaaggcgugcgccaccacgccuggcuccuuuuauuuuaaaaguuaaaauauuuauagucagccuuuaggaaauucauagugguauauauuguauuauauuuuguguauguaugccuauguggugagugaguaccaccaaccuacucccauaccaguguucaguggacaguuaguuuucucuuuccaucauauggacugugggguugaacucuagaacaucagauuggcuuguuuccgacuuuacccgccaugucaucauagucaucaucauuacuguuguuuuauuuugacuuucuguguauggguacuuuaccugcaaguaugucugugugccacuuguguaccuagugcccgugcaggccagaagagggucucagauccucuggaacuggaguugcagaugguugugagcugucaugugggugccugguccucuuuaaaagcagccaguucucuuaaccaauaagccccuaauuaccguagguuuuuaaagaguuacuuguauuaauuuccuuuauguauaugcgugugagugugcguguuuguuauagguauauggcaugccuccagaggauagaggaggugucagaucuuucucgaguuggauuuuucaaguggucaugagcugucugauauaugggugcugggaaccacaaucagguucuuugaaagagcagcauaugcucuuaacugcuuagucaucucuucagccccuuugcuacuguauuuuaaaaguaccucaaacuagcugaugaaauggcucaguguguagaggugcuugccaccaagagucacucccagugcugaccuuugaccuccaaccauacacauacuaccuacaugcacacauacacaaucauaaauuuuuuuaaaguacccaaaagaagaacaaagugaagcagugaaccaagguagaugagaauauuguguauauaaauuagguaucacuuguaauuuaaaaaaucuaaucuuuauccaaugacuuuaguuugucuuaacuaaacuagaaacuauaauguagagcauuauauaguauugcaggagaugacucaugcaguaaugacccuggaaauuuacagaugagaaaaguaagucagaguaaugcuuggaaguaucuuuuauuauguauaugaguguuuuacacacacacacacacacacacagauauguguguguguguguaugugucugguuccuaugaaggucagaagguguuggauccacuggaaauggagcuauauauuauauggcugugagccaacaugugggugcugggaauagaaacuggguccucuccaagagcaaaaacugcuccucacuacugaguuauucaucuuuccagcucccuugguaguauauuuucaucagucauacuuaaggaguaguauaaacaggccaugugcccauaccucaaguaacacaaugaauagagugcuagguauggauuuggguguugcaguuuuggcaaucugaauaccagcagauucugugggguuuucauucuagagaucacagaaaggagcuuuguuguuuagaauaguuuuuaaaauaaaguuggcugagccgguugugguggcacacgccuuuaauccuggcacuugggaggcagaggcaggcagauuucugaauuugaggccagccuggucuacaaaguggguuccaggacagccagggcuauacagagaaacccugucucgaaaaaccaaauaaauaaauaaauaaauaaauaaauaaauaaauaaauaaauaaauaaaauaaaguuggcugaaaagucagagcauauuguaaauuucaguuauuucaggagcaugggaaauuuaggagucuugagaaaucuuggauuaucauguagaguaacuauauaaacacuuuaaaaacauugucaaucacucuucaauguuaauugcauuuuguuucuucaguauaugaaaaacaggagaaaguauguauuauuucauuuaaaaugagaagcagaacaauuauacucaaugaauuuuuuuccuauuauaucuuaaggaagagagagaaaauccuucgaagcggaguagaauugaacgugauauagauaauaauuuaaucacaucaacaccaagaaccggagaaaagccugacaaacaguugucucgaguaagacggaaaaguccagucaauggagguuuguuuauguuuugaugcuaucuguccuuugacugcaagcagaaggccuccucaccuacuguggccuuugggggauacugagggggccccuaccaccucagaagagaaaggaggggaggaugggggaauggggcaaggauugugggaaggagugaccagaauguaaagugaauaaguaaaaaagguaaaaaaaaaauuuuuaaaaccugcuuuaagguuggucauggcaggucagugccugcauucaagaggcaaaggacagagaguucaaggccaggcaacaaaucaagauccuaucucaaaaaacuacaacaaaacauuuggagcuacuuuucucuuguuuuuauaaucuuugauacuuuaaauuaauauuuuuugugcuaaauauuaauuuaaaguaucaaguaaaauuaaaaauuaucuuccuaaaauuuuuuacuucuaugaauuaaaaugagucaaggcagaauacuagauauacauuauuuaucauccaguguaaauggacugggcuaggacuaugccucagugguaguguaccugcauagccugcucaguuuccuauaccaagaaacgggaaaugggucaacauuaugacaauuuauuugaaauuauguauacaacuuuguggaucagauauauucauuuacuugacauucauuagagauagauaucaggaaaagucugaaauagccaauguccuaaaaauguagacagcuggaagcuuguaucuauguauuggaauuaguaacuuguuugcuuacaugcaucuucuuuuuugggggggagggggucccagacaggguuuacugacuguccuggaacucacacuguacaccaggcuggccucgaacucagaaauucaccugccuuuuaccuccuaagugcugggaucauaggugugcuccaccacugcccggcugcauuuucuuuauuuucuguuguucugugcugauuugaaaccucuccagcuuuuuaacuuuagguguaaaucaauguugaaaaaaacucagugaauguuagcauuuauaaacguuguaaauacauuaaaaucauuugauguauaagaaauuggccucaggcagggcaugguggcgcacacguuuaagaccuuuaaucccagugcgggggaggcagaggcaggcggauuucugaguucagggccagccuggucuacaaagugaguuccaggacagcaagggaaacacagagaaacccugucucgaaacugccccccgcccccuccccccaaaacaagaaauugaccucaggauuccuuugcuaagcacucaugaauauuaauuauuguaagucuacaugaaauaguuugagaagaaagaauuuuaaaacagauuauaguacacaccugaaaugcaguguuuucuggacauuacuuuuuuuuucccucuuucauucuuagaagcugguaguuaugaaaugacaaaucaacauauaaagcaaaauggaaaauuagaagauaacccuugcucugguaguccuccgaggacuacauuguuggggaccauauuuucgccugucuucaacuuuuuuucaccagcaaauaaaaaugguaaguaaaacccauuuuuuagacagucaaacauuaacuacaauuacaguuuucuaguuuuuaaagaucuuuuugagcugggcauaguggcacauuucuugacuuugaagccagccuaucuuuaaaaaaaguaacccuaucuuaggaaaagaaaaagaccuuuugguuuuacuggcauauuuugucagagaggagacagagacgagcguuaaaaagaccugacugagcauauaacucuugaauuuggacgcucaauaccauugaguuagaagaauaaaauguauaguuugaaaggugacaacaaguguagaggucuaugaagacuuuaaugugaaagaaaaaccaaagaagucacauagccuuguaucucugagaccaagcauauucuuauguuuaagaacaagaaaggucuccaggcgugguggcgcauuccuuuaaucccaacauuugggaggcagaggcaggcggauuucugaguuccaggacagccuggucuacagagugaguuccaggacagccagggcuauacagagaaacccugucucgaaaaaacaaaacaaacaaaacaaaaacaaaaacaaaagaacaagaaaggucuggcaguaagagauugaagagagacacgaaaacuaagggaggcuauugacugagcuggagucagaagagcaggugagguggggaacucccacagaagcaccauagagacauuuuuuacugaggcuggaaggaagaagcucaaacggaaagugaguacagauguuggcaaagcauuguauuccacugcauggcaaacuaagagcuauguguuagacuauguaauuaagaggauguuggcaauaguauauauuagauggaugcaaagaacuacagucaaaaaacauuaagcuccaaagaagcuguguuuuugccuuuauucuuuguuuugucuauuagugaaaaaucaguuaacugguggcagugaauuuuagauuguguauuagaguugggagaauaaaaauguugggauugaguuucagguuaagacauacucucuuagcggagggguuaauauuaaaacaccaagggaagaggaguguuguauaaggaaauugagauacuggaaguugauuuuguuauuuucguuuaaaauuauacuugaaggaagaaagcaauagcauuucauaguaugagaagacuuggguaauucuuuauucucuguuacuuaaaaggaaucucacugagaaauuaaucaugucuuuaaaaauuaauauuaugucuuuuaaaaaugauuuaguaagaggauucugaugguuaguaaaccauuuaaccuguucuuggacaacauuucucugguugaaaauugugguugccaucauggcuuaauguauuuaaacuggaagauggagagcuaauguuuaucaaaugacucauacaugguacuugaauggaaaguucugaauuguaguuauuugacauaggagguguuugcaaacuauuugagaacuuaacaaaaacuuuguucauaacuauuauguagcuaggccuggugacacagaccugucaucuguaaucccaagcuacuggggaggcgcaggcaggaggauugaaugaauuuucaagcccugacugaacuacuuaaugauaaccuugcuuuaaaaauugaguuggaggggcuggagagauggcucagcgguuaagagcacugacugcucuuccagagguccugaguucaauugccaacaaccacaugguggcucacaaccauccguaacaagaucugacgcccucuucuggugugucugaagacagcuacaguguacuuucauauaauaauaaauaaaucuuuaaaaaaaauugaguggagacugaggguacagaucaguggcagugggcuugccuaguauauguuagucucuuuaaguucaaugccuucuauugaaagauaaaaaaauucuuauuccccauugauuacugagguuuuuuauagauaauuucaaacaaugguacccucaguuuaaccuuuguaugaguaaucuaaaaauuaaauaaaucauaaugguguuuguguuuagcuuuuuuuuuaauauuugugcuuugaagugauucaugguuuguugauaaacaauuccaggaacgucaggcucagauuccccaggacaggcuguggaagcugaggagauagugaaacaacuugacauggaacagguggaugaaauuacuaccagcaccacgucagcuaauggagcggcuuacucaaaucaagcaguucaagugaggccaucacuaaauaaugguuuagaagaagcagaagaaacaguuacccgggauaucccaccccuuacaggugaagaaaauacucccuuaacacaucuuaugaaugguuauaaaaacacaauauuuaauauauuuuuuaauuagguauuuuccucauuuacauuuccaauccuauccaaaaaguccccaauacacuccccccccccacuccccuacccacccacucccacuuuuugucccuggcguuccccuguacuggggcauauaaaguuugcaaguccaaugggccucucuuuccagugauggcugauuaggccaucuuuugauauauaugcagcuagagucaagagcuccgggguacugguuaguucauaauguuguuccaccuauaggguugcagaucccuuuagcuccuuggguacuuucucuagcuccuccauugggggcccugugcuccauccaauagcugacugugagcauccacuucuguguuugcuaggccccuaauauuuuuuaaaauggcuagauugauaguuuuucauacuugaaguuaaaaagaagacugaauaagauuugucccugaauccugucaucauaugcaauagcuuagaccuuuaagacuaaagugacagaggcagauggauuucugaguuugaggccagccuggccuacacagugaauuccaggacagccagggcuauacagagaaacccugucuugaaaaacaaacaaacaaacaaaauaaaaacaggagaaaaaaaaaagaaaagaaaaaaaaaaaaacgacuaacgugacuguaaagagagguagucuuauaccuuuagaauaguuugauuuuuaaguggagacccccuuguccagaagagauucuucuacuaucccaagcuuugcagcuuacuuuguuuguuuguuuguuuuuugagacaggguuucucuguauagcccuggcuguccuggaacucacuuuguagaccaggcuggacucaaacucagaaaucugccugcuucugucuccugagugcugagauuaaaggcaugcaccaccacgcccgccugcagcuuacucuuaggucuuuaugagguucuaacuuaacuguuacauuccugcaguaguugacauugaaauguggaugcaagauccgaauuuauuacuuuuaauuacugugguacaugaucauaaaaaauauaagaucugauuguguuuguccuauucauuauguagaucaagcuguuuucaaacucagaagauccacuuaccucugccuccuggguguuggaauuaaaggggugugcuaccaugucuuucuguguucagauguuuaaaaagaagugugggacugagcacuuggcuuguuagagggccugguuaauuaacaugugaugaugccauguguuccagccccauuacuaaguuucaaauaaaauaaguauaauuaugaaaguuuuguaaaguauaaccuaguaguacuaguaugaaauaaaaaaaaaacagaaaauagaggaaagauaugcuuuaaauuaauuaacuaaaaguaacaugucccaaauuuuaauuaagauuauugagauuauuaagauuguuuuuaauuauugagauuaacaaaugaaucacuaauauugggaacagaagcaagauaaggagacagaaccuuugaaucugaagcuagccuguucugcauagccagcuucaugccagccagggcuacauagagacacccuuucaaaagaguaaaauuaaaaauuguggguaguucuuuaugguaauaugugagaaugacuuguuuguggcuuucuuucuuucuuucuuucuuucuuucuuucuuucuuucuuucuuucuuucuuucuuucuuucuuaaaugcugguuacuuuuuucuuuccauuuuuuaaaaaagaguuauuuauuuauuuauuauauguaaguacacugcagcugucuucagacacaccagaagagggagucagauauccuuauggaugauugugagccaccaugugguugcugggacuugaacucaggaccucuggaagagcaaucagugcucuuaacugcugagccaucucaccaguccucuuuccauuuuuugaauuuuuuuuuuuuaaugucauguuuuugagacaugguuucuuuguguaguccuggcuauucuggaacuguuucuauggaccaggcuggccucugacuuugucucuugagugcugggaucaaaugcaugaaccuucaugcuuagccuaaggcuaggcuuaaaacauuaaauccuccugccucagcuuccugcugcuuguuacuaccccuagcuacagugauuuuugugaugugaauauuugacacagaugauuaaaauaggcuccuugacuaugaacuuucuaugauugaauuaaagagccauuaugagcuguuuuuauacagaaaaauuaugauaauguagcaaaugcacauuguggguauuuuggaacgauaugaaaagacugacagaaggugacauucaucucuuauaggaggcugaggcagauggaucuccauuguggguucaaggucagucugaucuacauaagugaguuccagaaccacagagagacuucauuucaaaaucaaaauaaauaaaguacauaaauaagcagauaagucaguaauguuaauaaaaagauaauuaggaaugauaaaaaugcugcuuuuuaucacuuauugugaaguuuuuuggagguugugguuucaagacaggguuucucuguguagcccugauauccuggaacucgcucuguaaaccaggcuggccucaaacuuacagaaaucuauguacuacuguuucugaagugucaggacuugagccugaggacuauagaauugcuucuggauuacuuugaaguggcaaaguuuguuuaaagcaaugauugcuacacgcaucuuauaaaucauuuucauuauuuuuguuguuuuauguauauuuguguuucaccugcaugugucuuugcacugguuccuucaaaggccagaagggcaucaaacccuuuggagcugguauuacagacagucauaaaccaccacauggaagcugcaaauugacuccagguccuuugcaggaguagcaaguuaacugcugagccaucucuuagcuuccaagccugucaacuuuuuacaaucacuuaaaaaaaaaaaaaaaacuugaaauucuggacaaauguacauguguuuuccgggcuuguucuugugcuuagguuuccuuuccuguguguucuguucuaucucaugcuuugcuuccuucucccucuccaguuacuuuucuucuuucagauuuaggugagaucagaaauauuacaaguguugccaacacuugaaagaucaaaaguuugaggccaaccugauuuaauagugaagacccuugucuucccccucccaaccuccuccccccaggacuugucugccuuuauuuuaugcuuaaaauacauauauaaagagggaauagggggagaucaggugaaaaguagacuaugccaaaaugaauacuugaaauccuaacccgagcuaagaccaacaggaagacacuugucuuacacacuaagagcuauuagggcucaaagagaugacucaguaauuguuauuagggacacuugcuucucuuguagaggacccuggguucagguuuacaacauuuauagcuccaguucuaggggaucaaacaccauuugccccagucauucacacggugcacauacauacaugcagacaaaacuaucauacauauaauauaaaacauuuaagcaagaaagaaaagccgggaaugguggagcauuccuauaauuggagcacuugggaagcugaagcaagaaaaugagcaauuggaggccaccccaggcuacacacugucucuaagcugaucuggucuaccuauugagacaucucuaaacaaaaacaagauaguaacuuucugucuauauacugacaggaauagggaggggagguaugugcuaugugauguuuuauugacauguacauuuuaaaauauuuaaauuaagcuaaaaagagauagauaucuccuuuuuuuuuuccuggcucuuugauacauaaaguacauuuuuguaucuacuguccugguacaaaagcacgugagaacuucuugcuugaaacugccuggugaccagccucucuccuaacagccacagagugagcuuaugagcucuuuuuauccggcucauuugacuuaacgcucaaguugcaucucuguucaggauuaguggacuacuuaaggaauacucaugagucuuagauuuuauaacuguauuugguuugucaucagcaucuacuuauugacuacauguaagcacugucaaauuagaaauugauugcucuggcuugcuuuuuuuuuuuuuuuuuuuuuuuuuuuucuugagacaggguuucuccuguagcgcuggcuguccugaaacuuacucuguagaucaggcuguccucgaacucuuugucucaaagauuuacuauuauacaaaauaaacuguagcugucuucagaaacaccauaagagggcaucagaucucauuacggaugguugugagccaccaugugguugcugggauuugaacucaggaccuuugaaagagcagucaagugcucuuaccugcugagccaucucgucaacccccccaauuuuuuuuuuuuuaguuuuucuagacaggguuucucuguguagcccuggcuguccugaaacacacucuguagaccaggcuggccuacaaacucagaaauccgccuaccucugccucccaagugcugggauuaaaggcauucaccaccacugcccagcgaccacuuucucaagaguggcaccacccauugugggauagacacuuguacacuaacaguuaaucaagaaaguccccacagagcugggcggugguggcgcgcgccuuuaaucccagcacuugggaggcagaggcaggcagauuucugaguucaaggccagccuggucuacagagugaguuccaggacagccagggcuacacagagaaacccugucucggaaaaaaaagaaaguccccacagacuugccugugggccagucugauagucauuuucuugauugagguucccucuucuaaaaggacuuuaggucuuguuaauaaaaaacuaacaaguacacuauuuggguuuuuuuguuuuguuuuguuuuuuguuuuauugcugaacauuaucuucaaauaauaauagauuuccucucaguucauagacagacaucuuaauucuacuuuuuuuuuuuuuuuuaaagauuuauuuauuuauuauauguaaguacauuguagcugucuucagacacuccagaagagggagucagaucucuuuacggaugguugugagccaccaugugguugcugggauuugaacucuggaccuucggaagagcagucgggugcucuaacccacugagccaucucaccagcccaucuuaauucuacuuagccauguaguuuggcauguugauagcaguaauuuucuuuggauguagaguuguuuauuuucuuaaauuugcuuuuaagugaucuuuaugaauuauuuaugugguuaaucuaaaauacaggaagcuccuuguaggaauaauaaaaauguguuuuuugugacagaugagugaaaguaaucuuuucuuuucuucuuacuaaauagcaccaguaacuccagagaguggguacucgucagcccaugcagaggccaccuaugaagaagacugggaaguauuugacccgugaguuguuuccugguuaucaaauuuucuuucuugaacaauuuuuaguuucaugauaaaacuggaaauguuauuuguuuaguagaaaaucuuacuuuggauauugaguuucaacuuuuucucaagucagcagcacauaacaagauacucucucaugauguuggacauugaacuccaccucucauucaucuggcacuccuaaggccuaaccaguacucugcauuguuuaacuugggcuuuauaguuucuuaauacuauguuugcuagccuagguauauuagaugcauuuuuaauaggauauuucaacauaaaagcgauaaucucaugaauagaggcaucuguuuuacaaagagcuugugaucuugagcuguggguaucaguacuuggugaguuuuuguagacacuaaucuguguacuuucuuacauguuuucuaaauuaguuuacuggguuaaguguugaauuauucauggcuucauugcugugaccaaauaccuuagggaggguaacucaguauguuauaagcagucaguuaagaauagaaauaaaucagaaaggugaaaagacuucguaagugggugccuugugagcuaauggcaaagaaaaacaauaugucauuuuggacuuccuuauucuaagcaucaaggaacuuaauugugacaugcaaagaaauauaaauaccaaccacgguguagaggaucaauccgugaucuugagaagacgcuccagagaauguuuuacucuucuuagagccaaacaugcacugaaaaaaaagucacgugguugguguuugguggucugcugccaggaugauccacacagaugucugucuagagcaacgcauuaugucugucuguguucugcagucuaggagauggguugaaacaguauaguacuucaaaugggggcuuuuuuucagacccaugcagaggccacuuuuuuuuuuuuuuuuuuaaagauuaacuauauaaaaguauguagcugucuucagacacuccagaagagggagucaaaucuuguuaugggugguugugagccaccaugugguugcugggauuugaacucaggaccucuggaagagcagucagugcucuuaaccggugagccaucucuccagcccagggaaaacuuuuauacuaccaucagcaugcaaaaaaggcugucuaagaauuugcugaguccugagcagugguuuucaaccuuccuaaugaugugacccuuaauacaguuccucaagguguagugaccccaacuauaaauuuaucuucauuuuacuacuucauaacuguaauuuugcaaucauaacgauuccuguuaugaaucguaauguaaauaucugacauguagaauaucugauuuguaaccccugugauuuuacucuuaaaggguuaugacccacagguugagaacagcuacacuacaggaauaaacaaacuuuacuucuuguagguuaaaaugugucaguucuuccuacuggggagauguauguguuugagucuaguuauggcuuaaaauucagucuggcauagcaguuccuuuugugccaauguaauaaaucuagugggauagacaaugaaaacuagccaccucgagucugcuuuuauuuuauuuuguacuuggaagauugaacccaaggccuuguacauucuaggaaagugcuuuauagcuaaucauaugacaagcuaauuaaaauuuagaauuuaauacuaucuucuauguauaaaacauagaaauguugaaauuuucuuaaaauuugauuuauagcuauuauuucaucaaacauguuccgccucugacagaagaacagcuaaauaggaaaccugcucuuccuuugaaaacaagaagcacaccagaguucucccuggucuuagaucuggugagugugaucuuuacagguauaaagaauaagagcuaaaauccagaauacaaaugaacaagcagucauaauauuuacuguaaauauguucugaguauuuugaaugguuuuauuuaggcacccuagcauuagaccaguuuguuugggaccggcacauuuugaaaauauguaagacuuuuacuuuugcauuuaaauaaaauuuuuuuucucuacauuuuugagacccugugauuuguuuuuguuuauuugauuuuguuuuugagguguuggguauuauuccagggucugguuaugcaagacaaguguuauuauuacuacauuauauccuaagccuaaagcaguuguauuuauuauauuuugccuggauagaaacagcucccuggaaccggcguuacugaguaguuguaacuaaacccagaucaucuguaagagcaccaaauuuucuuagucacugaaucucuccacuuaauauaucucccuguaaauuggaaugccuagcauuaagauuuccucuuauuuuuagaaucuuguuuuccugaaauacaauuugacuucaguuaacuagccugggcuggccucaaacucuccuuguagcuuaggaugauuuugaacuucugaaccugcuacuuugaccgaaggugggccauguggcacuaugccugugucuggcguuagggaguaaaccucgggcuuuuacauacugaacccuugccagcugagcuuuaucccugaucaccaagcaacuuucaaaauagacuugauuuuuuuuucuuugaugugauuuaaaaauuuuugcauaccuggaauggggcuuuauaugcuuuuagccugaauuguggaagaggccgagacacacacaguagcuugugaggguuugggcccaggcuaggcaauuuagaaagacuuuugucugaaaaaacuuacauuuauacuauuggguagaaaagaacuuugaauuaaauauuuuauguuuugcuaacccauuuuauuauuugugugaauaccacauuuacuguuugcuuuuaguuuuccaauaucaucaaaagauauaucuaaugaauugugcuggaaaacauuuuauuguuuaacacuuaucacugauaucucauuaauagaaaugugauuuaauucucaaaaauaucuuaaagaaaagccaguucuuuaacuuuuuauuguuuguuuguuuguuucuuugguugguuggguuuuugagacugaguuucucugugugucccuggcuguccuggaacucucuguguaaaccaggcuggccucccaagugcugagauaaaaggcauaugucaccacuccccugcacauuuuuuaauuagugcacaauauuuauguuuuuauacuucauaaucauagccuuuacaauucagagauguaaaagaaauaacaaauucuaaaauauuuuuagagaauauauguaaagaaaagaaaaaauuaaaaguaaaacagguugugacuacuaguucaggacaaagaaauggaagaagaaauuaaagagauuuuguaguugguuuagacauaaagaaauuuguccauauuuugauucugaggugaagguuaaaugcagaggggaaaaaagagaaaugucugagaaugaaucauuuauuaaaguaggugaagaauuaauauaauuaaauaugacuuaguuuagaaaaaaccuaagaugcuagguaggagucuuugaaaauguaguuuuauucucucucucucucucucucucucucucucucucucucucucucucucucucucacacacacacacacacacacacuauauacacacacacacacacacacacacacacacacaaguaugugacacacacacacauagagacauggauuuacacacauuuugucuuuguuacaggccucacuguguaaccucugugggccuugaaccauuauuccucuuuuagucuuauaaauacugagagauaccuugaucuauaccuugacuuucauucuaaggguaugauauuuugagauaagaucuugcuguguagcacaaguuagccuaacauuugcuuuauagacaaggcuuaccucagaccuugacuuauugcaguccuccuaccucagccuuccaagugcuugagauuguaugcuccacaccugaccucuuuuuuuuuuuuccuuuuuuguuucuuaaauauuuuauuuacauuucaaaugcuaucccgaaaguucccuauacccuccuuccacccugcuccccuacccacccacuuccacuucuuggcccuggcauuccccuguacuggggcauauaaaguuagcaagaccaaggggcuucuauucccaaugauggcugacuaggccauccucugcuacauaugcagcuagagacacgagcuccaggggguacugguuaguucauauuguuguuccuccuauaggguugcagaucccuucagcuccuuggguacuuucucuagcuccuccauugggggcccugugauccauccaacagaugacugugagcaucaacuucuauauuugccaggcacuggcauagccucacaagagacauaucaguguccuuucaacaaaaucuugcuggcaugugcaauagugucugggugcacaccuggcuucuuguuuugguuuaguaguguaagcagggagccaaguguauuagcacuuacucggcaguuggaaggcucaggcaaggagaguucaaucuaacuauagggagaaaaaagaaguugaggaauauagcucagugguggcagggaaguuacuuauuagcaugggcaaggcuuuggauuugauuccugugaucgccccagauaaauacuucacacauagccacauauccacauguuuauuuagagacguaaaaaaaaaaaaaaaauccaaggguggugguacacaccuuuaauccugguguucaggaggcagauguaagcagaugucuugaggucagucuguccuacagagugaguucuaggacagccaggguauaccaagaaauucugucucaacaaaacaaaacaaaacauccccaaauaguaguguggaauuauaagauauggccaaucuuuuuuuuuuuuuaauuuuucgagacaggguuucucuguuccccuggcuguccuggaacucacucuguagaccaggcuggccucaaacuuagaaauccgccugccucugcccacccccaccccccugccucccagugcugggauuaaugggauuaaaugugugcgccaccacugcccggcaucauuuuucauuuuaguugaucuuuguugcuguuuuguagccugcugagugccaggauuaagggcguguaccaacauaacccaacaauuuuaguagaucuuaacuaagcccuuugaaaaauuugaggguaguuacuggcagcacauuuuacuuuugagauagccuaagcuauccuugggcucauuauguagccaaggaugaccuuuugguuuuccugccucucccuucuuaauugcugagaauaaugggcaugugccgccuucccugguuauaugguacuaggagucaguuugagagcuugauucuuccaacucaccuguauccccuguccuuucuaacauuuagguuuugagaaauguauugauuuaacauuuuucuugcacugcauuccuauuuuucuuguucuugguaagaaaucaggaucugauauucagauaugauaaguuuuuauuggguuuuuaguugaugaaauacacucagguauaaguaacaucuaauccuaaauuaagauucuuuuucauaaaaaauuugaagaugcguuauaugagaaaacaaagucagcuuucaugaacuaauugcaaagaaauguaauuaguauaugcagauugcaguugcaugugguucuguaaccuuagcacucaggugauacaagaagacugaaucaugaauuugaagaucgccuggaccauagagugagacugucuuuagaaaacuaagaaguagcgggguggugguggugcacaccuuuaauuccagcacuugggaggcagaggcagguggauuucugaguucgaggccagccuagucuacagagugaguucuaggacagccagggauacauagagaaacccugucuugaaaaaccaaaaaaaaaaaaaagaaaacuaagaaguuaaauuaacagggaguuacaaauguucuuuaacaagaagcaguaguuuucagacuugaaucugcuuuagagguaacugagaaguguaucacagcccauggaaugggaaucaucagagagagagcuguacuucugaagggcucugaugcuguuuauuccccaaaaaaguauauuugagagccacugacuuuaggagaaauccuggccuaaucugcuaugucacauacaacauaaauucuacaaagaguaaugaauacuucaucaaacuguuguuugaaguuucuguuaauguuuuguuuuucucuguuuuaaggaugagacacuagugcacugcagucugaaugagcuagaagaugcagcgcucacuuuuccaguccuuuuccaagaugucauuuaucagguaauuuuaagccuaauuuuuaaaccauuagguaacauucugagugaagaaaauuuuuuuugugauguucagugugucuuucuguagauuuacuaguaguuuuaucaguauuuuaaugguuuauuaacacaaaguaguagcauuaugcuagauaguuaaugugaaacauuaauuuauaauuaaaaaacacuaacuuuucugauuugugaucucuacuaguuucauaaucuuugccagcagguggaggcaaggaacacugauacagauccccaagaacaacuugccacguuaagacugggauuuugucuuuauuuuuccccauaaauccaauuaauaauaauaaugaaauauucauuccuuguuggucauuuuuacuuacuacaguaauguuaucuguaaaauuacaguucaauauaucuaauuuauauuaauaagagaauucaaggaauccuguaguugcugcuuuauuauuagguacaagcauuuuucucaucuuugguggacagguuacagugcaaaauauaaauauuguuaagauuuuacuguggauuaucuguuggccauacuuuuauuagaauuuuuauuagaggauuggcuuaauuaagaaaugacuauacagccaggcgugguggcgcacgccuuuaaucccagcacuugggaggcggaggcagaugaauuugaguuuaaggccagccuggucuacagaguaaguugcaggacagcuagggcuacacagagaaacacugucuugaaaaaacaacaacaacaaaaaaaaaaaaaaaaagaaaagaaagaaaugacuguacuuuuaagaacugcagaauccaguugggcgugguggggcacgccuuuaaucccagcacucgggaagcagaggcaggcggauuucuauguucgaggccagccuggucuacagagugaguuccaggacagccagggcuauacagagaaacccugucucaaaaaaccaaaacaaaacaaaaacaagcaaacaaaaaagaacugcagaauccuuuuguguguuugcauuuguuaacauacgcauaacauuuacauacacaagcugcuuaaagauugggaaaagucaguaauuucuugucaugaggaagccaccucaggcuuaauaaagcugcagcauuugcuaugugaguaaugaccaggucccugguuuguaugugcucuuggugggcaaguacaaagugguuaugauuuuuuuuuuuagcauuuuugguuuuuugguuuuuggaggauuuuugggguagauuucaguuguugucuuguaggaauuauaagauuuuagaguuaaauagauguuucagggcuacuuugccaaaugcuuuaaguagucauaaaucaugaggauuuaauuuaccuggaucuucauucuaauuuaaucuagacgggcauuauaauaucugaauaguauauuccucuccuuuuaaagugauacuaguccugauacauuauuaggggaagagauacauaaaauaauggauuuuaagauuuucuuauuuugaauuguuguuugguuuaaggcuuuuucugaaugagcuguucccugccagauagagugcucaucuuuaauccacuuaagggacaggagucuuaaggccaauauaaguaaugcagcaauaacuuagugcucuguuuuccaugcaguagcauuguuguuuauucuuuguaguuugguuuuuauucauuuauuuugaaugacuuugaaaacuuguuuaaggccuuuguauuucaaagggaaagcuuauuugagaauucuuaaguuucucaauuugaaauuuaucucuuacaaauggcuucuagguuguucugugugugguuuuguugguggugguagugguuuuaguuuuggguuuuuuuuuuguuuuuuguuuuuuuuuguuauuuuuguuuuuuuugcuuuuuuauguguuuuuuuuuuuuuuuuuugaguagugaaauaaauaugggaaauggauucauuuggcuccuuucaguauggauaugcuauauugaaauuuuucuuauugcuuccaacauuucugcauuuucuuuuuaaaaguugguauuacguguggaccuggauaauuguauuuguuuggaaaaaaaaacaguacauauuaacuaaaggcuuagaaagcuauacaguauauuauaccuacuuuuauagaauuccaaaaacuacuuuuucacauauuugaguugcacuuucugaaagugaacagaaaguaacacaacuaucuaaauagcaaugagcuugauguugaguuuuagaagcuauagagaugauugcaguuuuauuuacuuuaugaaggacauaauucccucaacuaaauuuuuaaagauuguccauauuaauaucgaguaacuuccuuggauuugugguuuugccauagcuuuuuaaaaauggagaguccuuugguuuaggacuuccccccaguuuuuucagaccagcaagcucccuuuaaacagggaaugauguuuuuuaaacuuucagugguguugucuccaucuacuggcaaagaagaauauacacaagggucugggaugagcuaagagauuuuggagaaaccacauuauuagguaagauguaacuuacauaucuaaccacuguaauguaacauggcucacuuaaagguagaaacccauaaaauacugcauauacucuuauuuuaaaauaauuuguugaggugaaauuuacauagcacauucaugguaccugccuauauguucuuaaauauaucuguucuauagcaucccauucuuguguguaucugugugugcaugugugugucuguaugagucucugaugcaugugcgugucuauguguguuuguuuaaaaauuagcuucuuguugugaaucaggcaagauaaauaucuuuuuuuaggauuuacuuuuaguuuguguucagcuuguaaagguucaucuauaucuaauuucaguucuaccuuuuauuuuucuuccacuucaaaccaguuucaaguuauaaauuaucuaaaucaggaguuuuagauuuuauggcuauuguugcaaccacuuuuucugcuguuccaaacccgaaaugaaccaugcaagaaaaggagaugagcagaagugguggccuacaccuguaauccaguacugcaaucccaguacaggggaggcugugguaggaaaaucauugguuugaggccagccugggcuauauauauuacaaguuccaggccagagugggcuacauagugagacccugucucaaaaaguauucaaaaauaugguuguguuccaauaauacuuaauauucuaaaaaguacgugguagucuauaauuggcuaacaggcccuaauuugcugaccuaugaucuaauaauuaugagaauauauacuguaaauuuauaaaauugcauucuuagggguaguaauccaauacucauuggaauucuuauuuuuauaaugaaaauuugauaaagaucugauaauagacuuucuuaagauuaagggaauuuucagguagcuacuauacuuauagaucaccauacuuuguaauaugugcucuucuuauuuuggugaauagaaauaaguuuagguaauaccacccuuagaauuuucagacagauaaauuguucaagucuaaauuuaguauuuacauguccacuucuuauggagaaagaauaaaagacccuucucaaaggugacuaguuacucugaugcuagaugagauagacagacuugcuuguguauauaagaaauaugaaagaacugacuugaaagugaguauuacacucacaaaagguacagauuauuugaacugcuguacuauuuaauaaauacacacuuuuccuaaaaauuguuucauagugauugagaaaagauuuguucauaaaauuguacagaugcauuuuauuuggaaaaacaggugcaugaucacuccaaugcacguuuaaacuuguaguuaguuuaauauugacacauugucaggaaauccaucucaugguguuacucaguuaagaggucuccacuguauuuaguuucuguuccugcagauccaccaauucaagacucuaggucaucucacucccucuuccauccagaagaugacugcuauccacaagcagaacugaaucaaaagacauuuuucacuuagcucuugagcugaaacaccuccucaaugaccuuccucugucuccaucaagaacuggagcucaguuuuuugaagauguaauagagcuacucagcccaaauguggcugauugaagacaaagaagauaccucauaugucucaccacagugcaucaaacgcaacuguguuguccaucuccucauucuguacaguaaggcaggggcaucugauuuuuugaccguauucaccauuaagacuuuagccagugaguggcuuucugaggaucaguaaaaucaacaaacuuugggucagcuguccagaaaucagacuaugguaagcacucaaggagcuaggaugcuguagggagcuuguaaaggaugcuuucuuuuauugguagagguugcuuuuauggggaaagcuggggggaagaggccaguggagagcccaaugauuagcaaaguuuagcuucuucuuuguuuucuuggaaaucauauagcucaggauauuuuucacaccacaaaaagagaauuagaaguauuauggcuucuaacucuuccuagaaaaaccagcuuuacuuuugcuacaugaagagaaaaauauauauaagugaaaaauucuuuuguaaauaccagacuacauuuucucuuuuauaaauucugacuuuauaauuauuuuguugcugaguuuuauaaacuuaauuuuauugucuauauauauguuuguacauaauuaugccuuguauauaguauuugggauuauaacuuuaauacugaugucacuuuuaauuagagaacaguauuugaauaguaacuuacuguacaaaguauuaaaaacaauaccucaggggguuggggauuuagcucagugguaaagugcuugccuagcaagcccaaggcccuggguucgguccucagcuccggaaaaaagaagaaaaaaaaaaaaaaaagaaaaaagaaaaaaaaaaaaaaagaaaaaaaaaacaauaccucagaauaauuuuaaacuuucccauccuuugcaguaaguaaucauuggcacuauguuuucauuauaauuauuaguaauauuuagauuuuaaaaugauauaaauuaaacauauaauucucuccuuaucaaaaauuagaaaauauauuucauuugggaauucuugaaauaucucuuucaaauuaggaauaguucaaugaaaaaaacagauuauacagccagacaggagauacaugccuauucuugaaguucagaaggcuggaccagggagagugaguuugaggcuuguuugggcuauauaauaguggagggauagauggacugugcacagaaaguucuuauuuaacagcugacagcugauaguuauuucaauguucacuaaauugaaggguccacuaucuuuagcuuuuuuucuaagugauuuuauuuaacuuuauguauuuuugacaaaaggucucacuguguagcccaagcuggccuagaacucauaauccuucaacuucuugauugcuugcuagaaugauuuguuauuguugauguuacuacuacuacugcugcugcugcugcugcuacugcuacuggagacaguuacuguuacuggagacacuguguagcccugacuggucuagaaugugcucuuguagauucagguguuaauagcacagauauccaccugccucugccuccagaaugcugggauuaaaggcuugaaccacaauucugguauaugcuagugguuuuuaaaggcagcauuuuuuaacauggcuacuuucuuuuugcucuuaaaauaauugcaguuucucuuaauauguuguuaaaguuuuauuuaugcauuuauauacuuaaauguguguacaaauaaauggccauuuuuccauaaugaacauuauuauguucauuauuauuauugacagcuugaucaugcacagucaaauacauuaaacuucacuucauccuauuugaacucuaaaucccuuuucagauugaauucuauuuccauagguaaggaaaaacugauucugauguauuaguccagaauucucuguucaucccuagauuuauuccuccuacaaauacuuugucugcaucuaacuggaacuaggugaagcaaaugcugauguagguuaugaaguugaggccuccguggcuccuacuagaguagucuucuguccuucgagaagauguggccuuuguuucuguguuugauacuaaugcuaagaaaauauuaguggaaccaguaauauuucucuuuuaagagacuggauucucuuaaaagaacuguaaguuaucuuuagaauugugggugcucaguucugcccgguaugauaauacuggcuacugguuacuuuuaaauaaagagguagguauuaauaguuaacaguuuuuaucacuucaaaugugguagcaacaauaccaaaugauuuauauguauuaucuaaccuuuauaacuuuaggauccauuuauaggugaggaaacuaaggugugcccaaagauuggaaaugggcagggccacuuugcaugcccguguaucuguuaauuggaagauauuuccccagaugaugacagcauuuaauuccucagaaacuugagcaucauuuguuuucugcuuucagcuacucaagugcugagauuacauguacugacaugacaugcgccacugcacuugucucgaguuauuuaauaguguucacuaauuaucuuuuauuuuuaauacaaucccauuauguagcucagacugguauuaaacucaaugaaauccucugcuucugccucuggaguagugggguuaaaaaccuguauuucuaaugaguucuacuaaaacuguguuccuuuuaguguuauagacagaacccagggcccuaucuaggcugagcacacauguaaaccuuauucuaccuuauaaauuuacuauuuauaaaaaaauuauaaauaguauaucaacaaguucaaaggauguucuaaaaaaaaaauguacugaagaucuuuuuugagacaaauaguuuaucuguguggcccuggauguccuggaacuugcucuguaaaccagguugaccucaaauucagagaucagccugccucugucuccugagugcuguaauuaaaggugugcgcuaucauggccaguggggggaggggggguuuuuuuuuuuuaauguuaguauuaugcugucugggcuuaaaaaucauguaaaauauuucuuuuaauaugacugacuaguagaaacuaugaaggcuugaucaaauucaucaaauaaguuugaccaauuuguuaaauaaguucaaauuuaacuuauuugcuuaaauaaguuaaauuugaacuuagccagaguuaacaaucaauuuauaaguaguuuucuauguaauugacuuuuacuaaguaugauucuguuugcauuuuuuaguacuauguacauacaguuagggaguuuuaauugacaugauaccaaagaggaugcagaaaauaagcuauuccuugucaaguacuguuaauguaguacacuauuuucuuauguaauuuuucuauauaaaauuuaaauuuuaguaaaacaaguuucuaauagagucuaaugauuuguuguuguuguuuuguuguuguuuucuagguuuucuuuguguagccuuggcuguccuggaacucacugcuagaccaugcuaugccuugaacucacuagaucugccugccucugccuccagagugcugggacuaaaagcauacucucccaucacuaccacucagcagauucuaauguuucuaauuuuuaaaacuuuggcuuaaugagguauucacaaaugcuugcuuuugagugguugucagucuuacagauaauaaucacuuauuacuaucaguaggcauuauuuuuaaacuuuguuuuuguuuucaaaauacauuugguuuguugagaagauuuagauugaguagcauugcuacagguuugcaagaauauagguaaaguagagugagcucacucuuuuggucuuugggaauuuauacaguuaaguuugguugggugggcaugguugcucacucuugugucugcauugagaaggcugaagcaggaaggaucacccuaguauccaacccaucuuggcuacauaguaaguucuagagaagucugggcugcacaguaagacccugucucaacaaaauaaaacguuuuagguuugagucugaagaaggauaguugguagaaaaugaggagggggguacuuuagaauagaucucuuuaugagacuuaaguuuggagauggaaaacagcaaaugguuacuugaggaauuaggguuugaagcauuuaaaaugauacaugucggugcuggagagauaggcucagugauuaagagcacugacugaucuuccagagguccugaguuccauuccuagcaacuacaugauggccuuuucugaugugucugaagagagggacaguguacucacaugcauaaaauaaauaaaucuuuaaaaugaugcacguuuaccuuugugaccuaaugcaauuaaauaauaagaauuaaacuuuuaaaugucaagaacuaaauuuuugaggccaacaagaugacucagccgggaaagacuugccaugaacccugacaaucuggguuccaucccuggguccaaaaaacaaaaaaggauuuuugaaaguugucuuuugaccaguggcauguacacaccacaaacacacccugccuccagcaaauagauuuaauaaacaaaaaagacuauaucguacacugacucucauauuccuguuuacaucuaaugacacagaccauuuugggcuuauaccucaucucuucuggucuugcuuuugauugugccuuuguaucacaugguacagcucccuauggagcugaccuuuguaucacaugguacagcucccuauggagcugaccuuuguaucacaugguacagcucccuauggagcugaccuuuuagaccugaccuuuuuuuucuuccuaauuccccacccucaccccccacuauguuaucugugucuuacaaccuuucugugacacauuucugauaaaguggugaaucuguucugcagaguggaacugugauagacaucucuuguuacucuuuguagucugcaguuaaggaaacacuagcagugcacucaguucuaucuugagugcuacuuuucauucugaaagaguaucagcuuauuagauguauguuacaguuaaagauaguaauagcauaguaacaaacauaguaggguguauaaugcaauuacagguucagucuaaucuggaagucauuggaaaauacuacuuuucuuuguuuucuuuguugcaugcuuucucuguuuuaccauaaaacauucccagaacuggcauuuuugucacaggaacauuuucauguagaugacagaauugaaauugaaaacuaagccugcauuaaauguauacucaacacaggcuuguuacaacaucacaaucuuuaacucaacucgcuugcuugcuuguuuguuuaugguaucugaaaucaauacccacuuuucaguggaguauaaaacuuuuauaaaauuuagugaccaagugaauguaaauggaggacuagaaagucuuuaaguaguuucagugauuauuuauggcuuccauuugugugcuuuuucugaauauugcaguguauuacaagauuaauaguguuaagaaauuagguggaaaauuuauaucugggugguggcacauaccuuuaaucccaggacucacaucucugaguuugaggucagccugaucuaccaagcaaguuccaggauagccaagacaacacagagaaaccuugucucaacccauauguuuauauauccugaacagugggcuuugagagcuguugucuuuguguacuuacaaucucaguuaucaaaccuacccuucuacacuaaaggggggagggcuguauuuaagcucaccaauccagauaccacauucuugacuauuccuuaucuuaauauaaaaauuaaauaguaguguuuuuaagaguguuuguuuaaaagaaauucugaggaaggucauugagacaggucagcuuagaacucgacacacagucugcaaaugauuggauggaugcuaccugguuggaagauggagaugauuugguggaucaaaaucuaaugagggaaaucuucuauuuuuaguugaaaugcuuuuugaaauuacauuucagugaaguacuguuguauuuuaaaaauaaaacaauaauuacuauuucucuaaaagaccuccuuaagugcuuuugguacaugaaguauauuuguuuugaguggcacccaguaaauauuucuauuucuguggaacuuuuaaauuauaauauguccaaaguuagagcacaguaucuuaagaugguuucuauuuuauguuuauuugcugaaaaaugucuuugcauuucuucagguuuaugugagauuaagaccauucuucagggaauuccuggaacgaaugucucagauguaugagguaaauuugcuuaaacuauuuuucccauguuuuuuauuuuauucaauauaguacccauauuuagaucauguauaauugauuacuucuuuucccugaauuuguagaucauucuuuuuacugcuucuaagaagguguaugcagacaaguuacugaacauacuagacccuaaaaagcaacuggucagguaaauuuaauuaagaaauaguagaaaugucuguuacccaucuauguaauuaccaugauucuauuucauuuuaauggccauuugcuguuggcuacuaucuagagauuuauuguguugaacaguaaaugaauuuuuuaagucccacaacucuuuuaagaguuccuaauugggggcugaagagauggcucagugguuaagagcaccgacugcucuuccaaagguccugaguucaaaucccagcaaccacaugguggcucacuaccaucuguaaugagaucugacucccucuucuggugcaucugaagacagcuacaguguacuuacauauaauaauaaauaaaucuuuuaaaaaaugaguggacaaaaaaaagaguuccuaauuauuuaacuuaagacagacauuccuuaaaggguugcaaagucaaauuauauuuauucacuguuacaucuauaucuucauuucuuugggaauuucagggagggaaugggagcagggaggugguggagguuuucacuguagccuuguuuuacuuccaugucucugagauaaugcuuguuauacugacuuuguaauggcuuagagaaguagaagcagaauagaaaagauuuaagagcagauuuaccuccucccauguaaagaaaauguuacaugcauuuaccuagagauuaaaauuggcuuaaucauugauguuauucuaaucuggacucgguuccuugaauaugccauuacccagcagauagaguguguuucugguuagcagggaugccuugggagauuuugaaaaucaauuccauuauuucugucaccugaagagagaguaucuugcucuaagguuuaggagugaggcuaagugagugaucaagaguagagaaaggagggcuggugagauggcucaguggguaagagcacccgacugcucuuccgaaggucaggaguuaaaucccagcaaccacaugguggcucacaaccauccguaaugagaucugacucccucuucuggaguguuugaagacagcuacaguguacuuacauauaaauaaauuaaucuuaaaaaaaaaaagaguagagaaaggagauguaggaagcuugcauagagaaacccuaucuugaaaaauaaaaaguagaaaagagggaaagagagaaaaagggggugacagguggcuaagacuuucucuuugucauugccacuaaggcuagauuuuuuuaaaaugaguuguguaugccucuuaaauguugaacuuggacagaaugguauguagaaaaauaccuuuuuguuuguuuguuuguuuguuuguuuguuuugguuuuucgagacaggguuucucuguguaucccuggcuguccuggaacucacucuguagaccaggcuggccucgaacucagaaaucugccugccucugccucccuagugcugggauuaaaggcgugugccaccacgccuggcugaaaaugcuccuuucuugaaauuauaaaacuaaaagaacagaccgaguaguauauugcucauaaaaauuuguuuaggauuaguaagcaagacgaacucaaccauuaaggcaaagggcaugaaggugaaagacccacaagucaguuaucaguaauacuuaaaggaugauaauauauugcuuauaaauguggauugcauaauuuauauaugacuuuaaagcuuuuaauagcuuuuaaauugacagaauuuucuauuuaguuuguaaagauugguuauuaguuuacauuuguaauacuuaaaccuguuuuuuuguuguuguuuugguuugguuuuucgagccaagguuucucugugugguucuggcuauucuagaacucauguagaccaggcuggccucaaacuaaagaaaucuaccugccucugccuucugagugcugagauuaaaggagugugcuaccacuaccacugccugacaccagucugccugacaucagucaccauucuuuuagcucacccuucucuucuucccucuccccucucucugucucugucucugucucucucucugucucugucucugucucucccucucucucucucucucucucucucacacacacacacacacacacacacguuuuuaaaaaauugguguuugggaaauguugaaaugauggaaugcuuuggccucagcagcaagcaucuuuucucaaaaacuguaaggaaaacuaaaaaauuauuuuaauuccaauacagaaacauaccuucuuauauuuucuauucuggcauguacagggauagggaggcuguguggucuacugguuagagcaaaggacugggagccaggaggauucuggguuccaauacggggcuaaccaaagacuuacugugaucuugggcaagucacuugugccucagucaaccaucuggaaaauugguuaaaaagcaggaccucgcugacaaccaaaugcugcaucugagcugagcuuuccuggguaauuaaauuacaaaaacaacuuaagaguuuuaauucccuuuuguaacauuauaauuuaugacaugguauaaaccaacauuuuucuaaaucauuguaauuuuuuuuaagguuucaauaauugcuaugaauuuuuauguugaaacuagcccacagcuuagccccaguauuuauuucuauuucaguuugcuuccugagaggaaagaauauuuagaaaguuuauuguauauggaugcuucuguguauguuuuaagauuugucuucauuuuuguuuaggcaccggcuuuuccgugaacauuguguuuguguacaaggaaacuauauaaaggacuugaauauccuugggagagaucuuuccaaaacuauaauaauugacaacucaccacaagccuuugccuaucaggugggaagaagauuccuauaaaaauucaguuggauaaaauauaaagaagacaaccucugccaagaauaauaugauagaaaaaaaaugggauuuuucaguguccuuaguuauuuuuuaagauuagaaaugccaaauagauaaguacuuaugaaaaaugucuucuacaugaagucuacaacauaaauuaagaaaauuuuauguaguaaaucugaagauagacuuagaggguuguaaguaauuuaauagcauuuugauauuuuaugaaauuauaguuauaaucauguuuaaaaacuaaaauaaucaauauucugaucuauugauuuaaauaauuugaaguguuuucuuagaugguuuuagcaagggcuuggucuuuguauaagcauuugcacacauaggcuuucugauaguguuuagauugaagauaugucuuuaguccacggugacuagcauuguucuaguaacuugcuugaaugaauauugcagaaaugcuuuaguggcccuucuuuguugauuaacuuuguauucaccaaggaagugagccacccugaacaaugaguuagcugcauuuuacucauuucgcucucuuacauuauugagcugucagugaagccuuaguagcauuucuuuccaguggaacuuuuacauccauaguuacuuaagugucuuucuuuaguauuccgaagcaggcuaguguaguuaaagagaacuuaauuauauauuuauuguuuuagcuuucuaauggaaucccuauagaaagcugguuuauggauaaaaaugacaaugaacuccuaaaauugauuccauuucuggagaagcuuguagaacugguaaguauauggucuauuugaucuuuguuguuguuaauugaacuauauugaacaaaucuguauguguauuggcuuuuaaaguuaacuguaaacaaacucagaagacagaggcagcaaacucaucagauugaggccagccuagguuauaaaugucaccagacccucccuaaaaaagaacaacagcaacaacaaauaauuaaccaguagaagauuguggcagaguaaaagaaauuagguuguguuuguuuguuuuuucauuuuaaauaauuuuuuauuuuauguaugugagaacacuuuagaugucuucagacacaccagaagagggcaucagaucccauuacagaugguugugagccaccacgugguugcuggaauuugaacucagaaccucuggaagagcagucagugcucuuaaccccugagccaucucuccagcccguuauuuuuauuucauguccauuggcuauuggucugcauuucucugugaggaugcuggaucuccuagaauuagaguuucagacaguugugacaugccaugugcuaggaauuaaacccagguacucuggaagaaguagccaguacucuuaaccacugagccuagguuaauaauaugcaguagaaaucgaacuagucuuauucuuauauugaaauaaaaguugugaguguugugguacacaugggucaguugaucccagcucuaaggugguggaggcaagaauaugaggucauucuaaccuuuauggugagcuugagguuagccugggacuaaaugaaacuugugucucaaaaaaguguuuuauacaauuuauuucuguuuguucguugaaaagauaaaguaucuacaaggcacuugaugucaauccucugucauuaaauguacaaaaauaaacagaaggaguacccugcagagaucuuguugguagaguaauagugagcuuggccuugcacugugaacccagacuccagaggugcagacaguucuuuggaucaguuagcaaaaggaaguccaaagcauuucuuaaaauguuuuccuugccaggcagugggaacaccuuuaauuccagcacuuugagggagagagggagacagacagagagucagauugucugguggggugagacagacaacuaccugggaggcuaguaacuugcgaguuccuggugaacauaugauuuugauuagaagcagagaaauuuauuaucaccuguaauugccaagguucugccccggggcacugagccuccaaugaaugaugcagcugguauucagaggaaguuuauuaguggccugaaaaauugaucaaagaaauggucaagaugggguuuuguuuuucuuguuguuugaggccgggucuugcucuauaauuuugauuggucuggaacuuaaguguauuagacuggccugcaauucaaagagaucugccuuccucugccucuugaaugguauaaugccgugaaggucaagaugcuuaaacaacuuccuucuuuuuuuuuuuuuuuaaagauuuauuuauuuauuuuuauguauaugaguacacguacagcugguugugagccuucauaugguuguugggaauugaauuuuuaggaccucugcuugcuccaguugcucuggucgccccacuuacucagucccugcucgcucaggcccaaaguuuuauuaaguacacuguagcugucuucagacgcaucagaagagggccucagaucucauuacgggugguugugagccaccaugugguugcugggauuugaacucaggaccuucggaagagcagucugugcucuuacccgcugagccaucucaccagcccaacuacuuccuucuuuaagugauacguggggaaaauaguaaagaagccaggaagauuggauagagcaaggacucagaaaagguucccguucuucacagauuuuauaagaaaaauucuucccuuggaggcaaaagcagaauaaauaauauucucuccuggaggaagguagcagauuucguaauuuguagccucacucaagguccuaaaacucacuggccucuguuguuuuccuugaacaguuuugaauuauguuagaaauuaaaaugaggccugucagacuucacuguuucauagguuucguuucuuuucuuucuuucuuuuuuuuuuuuuuuguuuguuuacaggaauuucguucuucuagaaaauagaauuuaauggcacaacucuuaacuguuuuuuguuuugguuuuguugguuuuuguuuuuuuuugggggggggggguugagacaggguuucucuguguaucccuggcuguccuggagcucacucuguagaccaggcuggccucgaacucagaaaucugccugccucugccucccuagugcugggauuaaaggcgugcgccaccacgccagcuuuaacuguuuuuacaaaaagaaauuaaaauuaaaacaaaaacaaaaucuugagucuaaauuuuggguuuauuuuauuuuuauauuguacuuaauacauagucaccccuucauagcccuuuuagaguggaccaguaucccccaugauaccaauacuuacacgugcucaaguccuuuagaaaguuuaagucggguguuugcauauaacuuuuaaauaaccucccacaugcucgaaaucaccucuaaaguacucacuaauauagaacagcuaaguaaaugcacuaugcuguuuagagauuauaagacaaucucauagaaauuauauggcuuuuuaaaaguaaucuuuucuucacacagaaugaagauguccggccucacaucagagacagauuucgauugcaugauuugcugcccccagauuaaguucagagacuugucauaucacugaagggggggagagaaugcaggacccuuuuggacuaagacaaaaacauugccauuacuguugaaauuuugcauuuuuguaccccgucuugcuuucuuaucuuuggugcccaauaauaaucaaggguuacagaaagagacucucggauugaacacauacaguggguaggcuaaaacagaagcgucuguagaguagacagcuccagugagacucuauguauaggacaucugcagcucauaacgaauucuguuucugccaccagcaguuugaccuguaguuacacaggauuuuaugauaauaacagagaugaaaguggacuuucauucucucucuguuuggugcucucaguggguuuguagccacucuucuguuacuucacuauucucauuucaacaggaauggccaguaaaaguuguuuuauuuuuccuguuaagguuuauaaccuuuuuacauuucugaccuguauuagauuagaaucucaugaugcauuccuuuuaguuaaggcgcuucauaguuuucuggaaauagucaauuuuuaguuuuuuuuuuaauuauacauuugaauggccguuuuccugcuuugucugccugcauauuguauauuuguuuaaaaauauucucuacuuuuaguccauguuaaguuucauuuaaaagaugcauuuauauuuuguucuguaauauucuacuguaggugaaaucuucaaaaaucaagagacuggguaguuaagaauauaugaaugacuaauauucaaaugauuugaaugaaccauugugaugacauguauuccagaugguaauaucuugcaauggcacacguuuaauggauaaagguauaccucagacuucacugugcucacuagccuuugaggagaacgaguucaggcaccuguugggcuugauucgguuacugcugccuuuggguuuucuccaggaaggaaguauucagcacagugacucaguauuuuuacuuugcaugggcugguaguaccucuguuaugcucccaguuacaaucaguuuaaagcucuguguaacagcugugguaccuaacgguggcuaugcauaauccuguggcacaguacacucccgggccaccagugcagucaaugugcucauagugguuuucuaugcuauaugaaaauaagucgucacgccuugguucucuaaugcagcuaccacaagagguugauauuuuuauaguggcguguaaucuccuuuucaggaggcuuuuuauggaagguagaauuuguaaaagucaguaugcuuugccucucaacugcauuaacaugccgcaggcucagacuguuuuuguguaaaggaugucaaagaacggcacuuuuucuaaagagaaguuugauauuuuguaugcuuguuaagaaaguacaguauuggaaauuaaagguggacaauugauaauugaggaguaugucaguuaauuuuuuauguauauuaccuguuuacuuguacaacuuauuguacaaauuacaugcagcuucauuuucaaaugaauccuuaaaauaaggaaaucuuuuuaggaaaacauuuaauuuuuguauuuuugauuuuaaaggcaugaguugucaguuuucaguguauuaaugaagauuuuaacuuuucaucagguugaguguuuucuuacuauauuaucuguuguguauguaguuagcauauugugucacugaacuguuuaaaaaucuagcauguagagcaagccuguuuuguggaaaauccuuauucauuaaaaaaaauaaucauggcagauuuucugcaaaaaaaaaaaaagcaaaagcauuugcaauucagauuuuuuuuauuuaaaaaaaaaagguauuuugcuugcaggaacaauacuacagauucauuuuaaugagaaucuucgaaauguauuuaucuuuagggcaccugggcaucuuuaugcuguuugucuuaugucuuucuugaaauaaaauguaaauauguuaccuuuacauaugcucuuucucaaaauugugaaccuaguuaauaucuucuugcccccaucauuuuuaugcuuauacagcaaaccccaaaaccuguacaagauugaauuuuugacaaacauaauuguugacaauguacuugaucaggaauuaaguaaauacagucucaaagcccuucccacaucuuaaaaggggaaacacuuauaccauagugccugugggcacuuuaauaauaaaaaagcaggccugugccaggggaaugagcuccuacucagccaguaggugagucaacaauacacuuuuguagagaaauguaacgugggaaaguuuacauggccugagaguugagaccaaauuaauagauuauuuuuuucuauuacuuugaguaauucuaaaguuguugauaacaaaguuuaaagaagauuauaaagaaguuugcuggcuucuuuucauuuuaauagguuuaucuuucaaucauaucuuuucuuuguugguaacuguagaacgcuuccuuuuaguuaaucagagguguguacuuuuuuaauugcaaugugcccagccugucagugcacacagcacacaugacuauaguaaaugcaggggccauggguccaugaagcacacagcaagcuaccuguguacacauuacaacucuuaaggaccuauuaaaauugugcuauuuccaguuaugaauguuugacuuuuaagacauucuuuuaaauauuuguaucauuguuagagaauauuugcuugguuguauuuuuuagacccauguaauauauguaguccugaccagauuuauuaccauuuuucucuggguccuaaaagagaucgaugacaauucguaaccagaaauuguuuuauauuugcuaguauguauauuuauuuauccaauggcuuuauuuguuucccaaaauuguuuugggacuuguugaaagcauuguguaacuucuauaaauggcuauuuucuuguaacugucagugauauggauguguacauuguuuuuauauauauauacauauauauaucuauauauuucuggguuuuuuguuuuuuugguuuuuuaggguuugacuuuuuuguuuuuaaguuaccuuugccaaugacuuucuguuagcuuuuccuuucauucagccuucuaacagagcucauuuuuauuauguugucaacuuuccuguaagagagacuucaucucaucagugacgaaggcauuccauuauuccuacaagucguacagcaagcacagacucuucacaaggaucacagcucuuccgugugucagucacuuaaaggacacugaagccuucacuccuguacugauacgaugguguuauacacuacgucacuagcuaguuaagguuuucugaccugacuucucuuugucuuccuagguauuuauuuguuaccucuuuaaaucuuguaugucuaaauuaacuuagaauaguuucccaccgaauaacuaugccaagaacuaggaaagaauguuuauuuuauuuccccuuauaggggaagaguggacugggaacaaaaguguaaggccaaaaggccuucgguuaucaaucauucacuuucuuauuccucucaugggcuguauuugccuaaagguuuggggggagggggcugcuuuuuuuucagugcugauguauuugacuaugccauugcuucucaugucuucccuugaguugaaagccugcuaggacuuugcauaaaauaccuaaaaguucucagaguaagaaccacaaaacucaguaccuuauauucaaacguugcuuaaauuauugaaaucuaagucacauuagaauacauuuucauauucauauuucuguuaucuugaauugaaauuccauuguaaaucaauuuagucuuuuagaaaguuuauucuagcauaugguuuuaauauuaguauuuuaagauaauauaguugacuaccaaaccuaccugcuaaucagaauuucacugaggagcuuuuaaacugcacagcauccugaagccugggaagccaccucgucuauacagcaggcuuggagaguucuguguuuuuaaagcuuucccagugauuuaaauagauaacuuugguauauccuguuuuaaauaaugugguuugagaauagguugcaaaauuugaccagccauauuucccugucucucugucucugucucucuuucucucucugguaguuuuuuuuuuuuuuuuuuuuuaagugcugggaucauauuucacagaacguauucaaauucguggaggaauaaugaagauugaggcuacugcucauugccaguuuugucauucauacuuuuaaauuaagaguuugcauuuauagaacucugaauagcugaucauuuacauagcugaaggacaugucccugaaugagaccauuauauauauuaacuaaaauauuucacuauuuuuuuauuuuauaaaucuuuguagaaauaagcaaugaaaugcuacuuucaucuuuugaacugggauuuuucaagguuguguccuuuuggcauuaagguaggggggaguuaauauucucucuacuuauuuccacaugaaucaauaugaagucguggacauuuaaaaaucucaauuuaauuucuacuuauuuacuaugcaguauagccgugaacaaguaauguagauuuaguuuucucaucuucaaaugcccugauuacccuaccucacaggguuguuguggggauaaauaaaacuuuuauggaaguacuuucuuugaugacauuuuuucagccuuucaaaacaauggaauuuugagcauucuucccuucuguuuuacaaguauauggguuuucacauucuucacuuuuagaccuuagaacaugccuguaaggaccauagagugagucaaauaucaggaagagccaauagagaaacagggucggagcuaugaaccaagaucagacucagugcaguggagugugcuggcacuauguauaaccuacauaagucaggccaaucuacaaaauacuguuaucaaaggaauaugaagccacaucugucgggcuaaagguagcaucuaguuuugaaacuacaaggaaacugcaccuuccagauuaauucauauccagaugaaaggucacagcugggaguagaauacagguuucuuaauuauuaucauccaguguaaucguacuguucaauuacugugaaccaagauaaaagaaaauaucugagguuaauccagacaaagaagcuuggugagaacucuuuacauacaagcugacuugguucaugauuugaauucacuuuccggagucuuggauguuauuuauaaaauggguaacacuaauaucuaccuuugaggaaucuaaagauaaaccacaaagcagucaauagcaggagagggugcccauaguugcugagaacuugauauaugaguguguuaggaaauggguggccauggucggaaauacuaucaggaaagcugaggauguaguucauuggguaucuugcaugcacaaaggccugguuuggucucuggcuuggaaugaaaccauccugguggcaaauacuugaaaucccaguggaggcagggucaaacauccaaacucauucuucacuacauaacaggcuugaggccacucagauucuugucaagauacuaaugcugaagguguagauuacuaucaaguagucggcuuguuugguguguagagucaugaguucuagcccuagaaccuaaaacuaaaguccuuacuauuguuagucaacuacuaaaccaaagauuucuguuuauaaaauugacaucugccauaagcacugccuagcacuggagguuaccauugguuacuguuggagaaagggucacggaaaagagcugcagagugcuaguagucauucaagucaagucccuguuaagaguuuuuggagggaaggauugguuauggggggagaaggccagcuaggaguucuaugggucugcacaagcuucgcuugguggacccaccuggagugccagcacuucaggagauggaggcagacagacaguugaggaccauucagagcauugacuacaagaaaccucaagagcaauaguguauaacuugaguguucucuuucuucaacuucugaaggcauucauuggcugcuagugaaaguugagacugauuaaauuugggaacagccuggcuuacugucugaaucuagagaacuucuugaagaaagguauguuuguuacucuagagcauucugauaaccccaaaaggugugagagcuugaggcauguuugcuugcucucuagugagcuuuggccccuacuccagagcuuaaugguuaggucauguuucuugaguggaugugguuugggguuaaaguguaaaaagucaauuagcuguuucuguaucaaaucagaaauaaaacgguuucaaaugacuugguaauuuuggaauuuuguaggagacuguuacucaaugucuuagguuuuuacuucugugaacagacaccaugaucaaugcaagucuuauaaaagacaacauuuaauuggggcuagcuuauagguugaguuucaguccauuaucaaggcaggaguguggcaacuaggagaauacuagauuccaggcaacuaggaggcuggucuuaaagcccaggcccacaaugacacacuuccuccaaucaaggccacaucuccuaauagucgacaacuuccugggccaagcauauucaauccaccacauuccacuccuuugccccaauaggcuuguucauaggcaugagucuauaggggccauaccuagcucuagccuaaugcaagauacauuuaauccaacuucaaaaguccccauaguaaauagcagucucaacaauguuaaaaauccacaaaaucucaucugaaauuccugcagucacuuaacuguaauccuauauaaagucaaaaaauacuggacaaacuccaugucccaugucaaagcgcucuucacaucaucuccaacuccuuucauccuuguugacugcuguuggcagauauggcauucagcugcaacaaaacaaacuucauucucuugggcugguuccacuuucuguuagcagcuuuacuuggcaucuguaucccacagcucugacaucuugggauauccaagggaacuucaacuuuauaguuccaaugucugggcuccucaaagggcuuggucauucuccagcucugucuuuuguagaacucuugggcucugguugaccccacuuaacugcugcugcugcucuugguggucauuccauggcacuggcaucucuucaauaugcuggggucuuccacugcaacuaggcuuucccaacagccucucauaguagugccccuuucguagugccagaccucaauuucuuugcaugacuccuucauuccuggauuaucaacugcaacugaggcugcaccuucaccaauggccuuccauggccucucacaguaccaagccuuagcuguucuucaugaccccuucaugccuucaaaaccaguaccaccuaggugacuuaacaucaccaaguccagcuacaguuuaagguacaaccuugguaucacagcaauaucccaguuccugguaccaacuucugucuuagguauuuacugcugugaacagacaccaugaccaagauaacucuuauaaggacauuuaacuguggcuggcauacaguuucagagggucaguccuuuaugaucaaggugggaguauggcaacgucuaggcgggcauggugcaggaggaguugaguuuucuacaucuucauuugaaggacacuagaaggcuggcuugcaggcagcuagaaggagggucuuaaagcccauaccuacaaugacacuuccuccaacaaggccuagacacauccuaauagugcuauucccuaagccaagcauauucaaaccaucacacagguaaguuccaaacuccuggugauccuccugccucagcuugcaaguagcuggaacuacagacaugcaccacuacacccagcaaacaagaaucacaacucugaagggaauucuuuuguuugaaucugccuguacuuggaauuuaaaaaaaaaaaaaaaaucuguccuuuaacccuuuccuaucccauauaagguugagucuggugcuuaagguaccuaaaaaucagcuuggauuaauuuuuuguuggggugccagcccuggggucagguucucucugaagcagcuaagggagaagagagcaugcagggagggggggggaaggcaaaacuuggucuugcgaagguguaggguugcuuuguauaauaauuuauuccuaucuugacuuugaguuacucugaggucagaggcugcaggccucuggaucuauugacagcaggugauuagguaauggauguacugcuagcucuccuuucucuggccaggccuccagaagcccuucacuaggcuggcugguuaacucuuugugaaccagagaggaaggaaaagaaaagaauuaagaugcuuuacacagacaaauauguacagaaacauacauauucauacauacauuuacauuuucauuugauuucucauuuacauguuaacagucacauuuguauugggcucaaccaccugucucaaaugcucuguaagcaaaagccuuuuacauggccuugccuuauaguacacacuuguggcuuuauccuugaaccuaaauuugucccaagccuauuucucuuuaauaauugugaaagcucauuguauuucuuauuauguggccuuuacuauuaugagugagcacauucuagucuugauucuaacuuuguuccaucuuucuaccaaaacaacuaaguccaucucuuaaaacuuucuuccuaagauugaaucaaaucugggauucuauagagucacuaauucaucaaaacagaaugaguucaugaaacuucaucuuuauguugcucugaagaaaaucuggugaauaggguggacuaaugccaagagauuaucauauuuauuuaauaaugauagaaaaagcauaucaagcuggguggugguggcggcggugcacgccuuuaaucccagcgcuugggaagcagaggcaggcggauuucugaguucgaggccagccuggucuacaaagugaguuccaggacagccagggcuacacagagaaacccugucucgaaaaaccaaaaaaaaagaaagaaagaaagaaagaaagaaagaaagaaagaaagaaagaaagaaagaaagaaagaaagaaagaaaggaaggaaggaagaaagaaaaagcauaucaucagcuucaagaagcaauccugagaugaagucucuuuggaacccugccauggagcucaccaugcaaaaaugacaucuaaccuuagucuaugcuacauggcugcugacaauauuugaugucauuuauucugcuauagcuuuaauaacacacuccuugagccaggaguauugacacauacuuguaauccuagcucuaguggggguuaggcugugguaaaaaagauuaucccaaauuuaaagacagauuagguuauauagccaucucaaaacaacaaagaaaauagcucaagggaagaguucuguaauguuagagaucaaauucauuggcugagcugggguggcgcacaccuuuagucccugugcuuuggaggcagaggcaggcggauuucugaguuugaggccagccuggucuacagagugaguuccaggacagccagggcuacacagagaaacccuaucccgaaaaaacaaaaacaacaacaaaaaaaaaaaaaccaaaaaaaaaucauauaaaauugauuuuuauaaaucuguagaauaggaacacagccaguguuuuauacccaucaguuacacauccaguuuucccaacuacugauugaaaauauuauaccagaguuguagacuuuaucucuuaaugauuaaguauaaucacaugacaggugauuguggaguaaggggauaauauauucucaugcuauucuauucaauuucauauaaaggacuugaaaauccauacauuuugcuaccagugggcuggagagccaaaccaauuuuccagauagagaugacugugcuguuacccuuuaaggggucccccagagcagugguucuuaaccuuucugaugcuguggcccuuugauauaguuucucauguuguggugacccaccaaccauacaguucuuuuguugcuacuucauaacuaauuuugcuuagguuaugagucauaauguaaccaucugauaugcuaccucucugaaaggucauucaacccccgaagggguuucgagccacagguugagaaccgcuguccuacaggguacacugaacaggauagccuuuaaggacuaaauacagcccacagcaguuuuagacacuuguuuccauuuguuugaaaaagcagcaugcccaguuuugcagaaguucucaaccuguggguugaaacccauuggguguggggggaggugucaaaugacccuuucacagaagguugccuaagaccauaccuuaacauguuuauauuacaacuuacaacaguagcaaaguuacaguuacggaauaacaaugaaaauaauuuucuguuggguaucacaacaugagcuguauuaaauaaaggauuguagcauuaaaaaaguugaaccacugcucuaucaugucugguuuaaugugguguugaggauugaaccuggggcuuugaacauacuagccaaguacucuaaacaacuaagucacauuccuagccuucaaaaccaauuuuuaguuucagagaguaucucagguaucccaggcugguccugaacuugcuguacagcugaucaugaccuugaacuucugauccucuugcuggacaaaacaaaagaaagaaaagaaaaaacaaaacaaaacaaaaaaagcaaaaagggcuggagagauggccucuuccagagguccugagcuuaauuccuggcaaccacaugguggcucacaaccaucugcaaugggaucugguacccucuucugguguauacucguauaaauaauaauaaauaaauaauauuuuucaaaaaaaaaaaagccagacagugguggugcaugccuuuaauccagcacuugggaggcagaggcaggcagauuucugaguuccaggccagccuggucuacaaagugaguuccaggacagccagggauacacagagaaacccugucucaaaaaaaccaauaaauaaauaaauaaauaaauaaauaaauagacaaacaaauuaaaaaaaauaaaaaacaaaaaaacuucaaaaccuaugaucccuuauucauuucccaggucuuggaauuauaggugugcacuaccaugccugcuuuaggcaguccuaaagauccaaauggaacucaaggcuuugugaauaguaagcaagugcucuaccacgggagccacauccccagcccucggaaucuccaacccccaugcaugugugucugugcaucauauugugccugguggucagauccuguggagcuggagcuacaguuaguuguuagcuccaacgugaacacagcaauugaacccagguuuucuucauggccaagucaccuauguagcucuuauaccuauuuuaaauugcaugugauuuaagccuugaaguuaguaacuucagaaccaaguauaguaguuguguaccacauaauuauuugauaaaggaaugaaugagcccauauuucaaaauuuggauuuauaaucccagaaaauugauuuugugcuucuggaauugaugaugcucagggaaacagauucauacuacacagagucacuaaguguuaagucuaaacuucacuuuuauucauuuucaguaagaaaucacaacuagggcuagugagauggcucagugguuaagagcacuggcugcucuuccgaaggucuugaguucaauuccagaaaaccacaugguggcucacagucaucuauagaggaucugaugcccucuucaggcagguggauguauaugcagcacagcacucagacauuaaauaaaauaaauaaaaaaucacaacuagauucuacuuacugaauaguacuagagaaucagucuaaugaaaacauuuuuucuuuuguggugggaguaagucgauagauagcccugacuggccucaaacuauguagcugagguugacuuugaacuccugauccuucaauauucuguuaccaaacccagcuacuuaaagaguguuauagcuaauaucuaguuaguuaacaggauguuaucacuucuguuauauaaauaucuguugggcuggugagauggcucaguggguaagagcacccgacugcuuuuccaaagguccagaguucaaaucccagcaaccacaugguggcucacaaccaucuguaacaagaucugaugcccucuucuggagugucugaagacagcuacaguguacuuacauauaauaauaaauaaaaaucuuaaaaaaaaauaucuguuaaaguaugcuggccagggguauaggguggguguggcucaauauuagaacacuagcaagcacucaugaguccuaccuaaaucccaugucaaacaaguucauauauuagcuuaauuucucuggugaagaaauacuaguuuuguuacuuggucuugccuuccuuuuuaguuaacuuuuuuuguuuguuuguuuuuguuuuuuguuuuuuguugagacaagguuucucuguauugcccuggcuguccuggaacucacucuguaaaacaggcuggccaugaacucagaaaucugccuuccucuuccugcgaagcgcugggauuaaaggcaugugccaccacgcccagcuuuaguuaacuuuuaaagaacauacacugucaucaauuccagacaaaugagacugggauacuuagaguauuuuuuguagcagacaugaagcccuggguuugauuuguacauauagcagcuauauugacucauuguuuggcuaauuauuuggacucagcauccucuuagccacgcguuuacaaguuuaaaauacagaaugagugccuccggcuuauauaauaaaaacacuugcugcuuuagucgucagcucuauuaauuuuuauuucagguuaccuuucaugaaaugcagguuuuuccugaacacagaacaaacucaguucuuuuuuuucccccuuuguuuuuuugagaugggaucugaccacagcucaggguugggcuggaguucccuguguaacuccacuugucucagccacaaugcccagugaaaaggccccaguucugcaaggauaucuauacaugaagucacuuaaaugcuugcaauguacagcaaagcacuggccuguaaagaugucauuacugccuuacuguguaugaagauuuuuagcugagaucaagaaaucccuggaaaggcacugguguuuaaaggagagcagauaucuucaccaccacagagaagguuuguggcccuacccucagccaacuccuaaguucuaggaacucaagguucaaauuuugacauuuugggggaaacaauuuuaguuacgucacaauaauuccacagagguguuuaaaauaacuugauuuucacagauuugaagacuggugagguuagcugugccguucuugcuuaauuccaaaauuguguucaaaaugugacuacagaagaaauaaucuaaggcuuaacuuaguuggauauacaagaugguuucuucaaacccgugugugucaguggagcugggaacagucaugaucuggcugaauguuucuccuuguauagcuucuccauguagucaagucggaacuucuucagagcauggugaucucuuauagcccuuaccuuuaauccuagcacucgguaggcagagaaaggcaaguggaucucugugaguuugaaaccagcccagccuacaaagcgagucuggggcagccagggauuguaacacagagaaaccuugucuugaaaaaccaggaaaaaaaaaaggaaucuuuaugugaguuagguauggugaugcaugacuguaauccaaauacuuaggcaacagagggaagaagaagaguauaguucaagauucuucuccaguuagugaguuuggggccaaccuggucugcaagaaacccagucucaaaaaagccaaaagugcugggcgugauggcgcacgccuuuaaucccagcacuugggaggcaggggcagguagauuucugaguucgaggccagccuggucuacagagugaguuccaggacagccaggccuacacagagaaacccugucucgaaaaaccaaaacaaacaaacaaacaaacaaacaaacaaacaaaaaaaacaaaagcaaauuuuuuuuuuuuacuuuuuuuuugguuuuucaagacaggguuucucuguauagcccuggcuauccuggaacucacuuuguagaccaaauuucuuaaauagcagauggcaucuacaagagcacucuaagaaauaauagguagguuccaggucaccuuauggcuuaggauuugaugcuucuguaaauucaauaguaacaaaaagaaaccguaaggguucagagucuagugaagacuaugacugaaggcugaaauacuguucccuaggcagucaacacuggaacgauuuacuacacauuuggcauugguauuggggacccuacuuggggacaggucccaacuauaugaucuaucuugaagcacauaguauuuggaaggcuuguuggaaaauauaagaggugcauaaaacaagggacugugugcuacagauccaguggauuuagacucuccuaagucucuacgucugcuggguaaacagcuguguaaaccagcaggcauggcucucuguuguguacacuccagcacucucuagagaaggagaaagugacugcauguucucucauacacacagccaaguaaccaggucgcuaaaagcagagccucugagugacuagaagaacgugccacauuccagaguauauuuacauguauuggauauauacagaauuggaauguaaaaacaauccaggggcuggagagauggcucagugguuaagagcacugacugcucuuccgaagguccagaauucaaaucccagcagccacaugguggcacaaccauccguaaugagaucugaugcccucuucuggggugucugaagauagugacagugcacuuauauauaauaauaaaucuuaaaaaaaaaauccaaagaauaguaaacaucucuucaagaucuauguggucaaacaauuuuuccuguauucuuuauuguaagaaggauucauuauugagucauuuuuaaggcgaauuacugagcauuuauuauguaccagguacugggaauacagcagcaaagaaaagagagagcuacauguuugcacacaggucugccaccccaucucaccuaauugggaagcagaggcaggaggaugaaucuagagugaaggucaacaauuaacuagcaaguuccagaucuaagaccuuguuuuauccccccccccaucucacaauaacggggaacaagcaagagacccaugcuucagauagaaaacaggaucaucacagaaggaaugugaugacaaaccuggaaaacagauaaccaagcgugcuaucacaguuuauaugaugcuagggacugaacucggggccuucugcaugcuaggcaagcacucugcccacugagcuacaugucaagcccacagaagggacuccugcaaaggggacauuuggcuuuaaugugaaagaggagaagcgauccauggggagugugggaagagcaccacagucagaaauauugacucuaaagcuccuagaaguagccucagcaaugaagggaauaagggagguggggguggggcaaucagaggguaggagaaauggcagagggagaaaaagaugaagaaaaagagaccagcauaugucugaaguaggacagccuaugcaaggucuuauugaccaggaaaagacgcugaacuuucauuuggggacagggucacauauaacccaggcugcccucagacuuccuauggaguugaguauggcuuuccuuuuccauccuccugccuccaccuccugagugugugggguuacauugugugcauguaucauuuauauggugcuaaggauugaauuuauggccuugugcauguugggcaaacagucugccaacuauguuacauccccaggcuaaaaaguugagguuuuucuaaaaacaaagucauuaaagauauuuuaucuggaaggaagcaauguuauuuacuauuuauucagacagguugggacagauccuggaugcauaagucuuccuuccuagggucuugucuuaauuuggauucacgacuggaucaacauguauuacaaugcuuuacucaauuuauugauuuaaacauuagucacaucuaacauucacagcgauuagacugguauuugacuaaaagcuaggggacauagguaccacagucuagucaagcugauaaauagaauuagccauucuguugccuuugaccuuaaaauaguuuucagacugguuccuuccucuccauugucacuggcuuaauuugggcuugaguuauccuugcagaauuaauucauucgaguuggaaaucgcauagcucagugguaaugcaaggaaggcagaggcucuugguuuuauccuauacuuauguacuagguacuuuguaaaaucauaaauggauuuuuuuuuuuuuuuuuuuugguuuuuugagacaggacuucucuguguagcccuggcuguccuggcacucuguagaccaggcuggccaccacgugugccaccacgcugggcggaugcuuucuuuuauagagcgucaucucucauuuuaauaaugcugucgaacagcugagcgugguggcgcacgccuuuaaucccagcucucgggaggcagaggcaggcugauuucugaguuugaggccagcuuggucuacugagugaguuccaggacagccagggcuacacagagaaauccugucucgaaaacaaacaaacaaacaaacaaacacaaaaaaauugcgguagaacauuucuugaaagaccaccuuauaaaauguuuacuuguagacgaaaaauacacaagaaacggaaaguacuaagaauggcugaugugugucuguuuuuuuuaaagacuuaaaaccuaagcucaugccuuuaaucccagcaccugggagccagccugguucacagagcgaguuccaggacagcccaggcuacagagagaaacuugucuuaaaaacaaagcaaaacaaaacaaaaaacuuuaaaaacaaugaauauauuggaaaaucagacaauaucuaaacuagcuccuuccuucuuaauguccuuacugggaagcccugugccaagggggagagaauuuugcuccuuuuagguucuuuuuaucaguuuaccuguuagaaugcacucagaugagcaccacaagccuucucucuaccagaaaugcaccggagcacaagucacuugguuucucaaacuccagcuucaccagugccuaccgcgggcagaaaacugaaacuuccgucgucguuaaugcuaccuuuuuaacaucuaaccucauaaugcuucuuuuuguugcagccacugcacugugucgaaaucuguuuacauaacuauuuugcuacuguguugaggacaaacuagaauaagccugggacggaccacggaacuccgaaauguuuucgccaaaacaaucaccgugcaggacuucgggugaucaccggaagggagaaccagggagacuuggaguauacuuccaucuccgugcccgaaugcuaggaggccacgggauaucugcccuguccacuuccuccucgcugcucgccugcugccggcucacgaucagccagcacuagaagacccacucgcuagccgagcaccgcccgacucacgcgugcgcacuuccuuucucuucucgcggggggugggggaugagggggugagggguguggcuuggggggaccaggcugguccgcgucucccagcccagcgucgccccaccccgcccgccccgccccugccgcgcgcgucgcccguggggcggagccucugccgggcgcccagucagccacugucccagccugcccugcgcgggccaacgagagccagcccagugacucaccucugccgcgcuaacucuucgcagcucuucccaucgcacacgcucacccccgguucgagauggcggcggcggcggcggcggcagcggcggcgggggacucagacucuuggggugagcagaaguuccggcccaaaugcgggcuguggcggccccgcucccacgcggguacuaacgcgacucgcucucuuccguagacgcggacacguucucuauggaggacccggugcggaaggucgcgggcggcggcacggccggcggggaccgcugggaaggcgaggacgaggacgaggacgugaagguagguucg

SEQ ID NO: 1043 - RNA, 2907 nt, Mus musculus
cuaacggcuacaagauguucuuagccuuuauuuggggcauccaggcugcuuuuaauuaaugcuauugaguguguuacauucagcuucacacugcacaucuuuaggacaguccuagcaaacagccuuuagauaaguaugugcucuuacaggauucuuucuuggucaggugacuguguaugcuccccaacaaugaggacacgccuguuuccuuguuuucaagacagcuuaagauuuuauugucauuuccauucuauucauuuaccuuucauuggguauuuuaaacacuuuauaaaaccaauggacucaguugauucucuccuguggucccuggcugagaccuuagauauacccuuuuuucugggcagaccggcacccugaagacagcccuacuagacuacaucaaacguugccgcccuggagacagcgaaaagcacaauaugauugcccugugcuucaguaugugccgggagauaggagagaaucacgaggcagcagccugcauccaacugaagcugauugagucucagcccugggguaagugcagucuuaggagucuuaggagcucuggggagcaguccagguggcagaagaugacaguucacagaaacauuugaaccuuaggacugaacaugcuaaggugucauccaccaaaccuaggaguuacauucuauuagggcauauauuucucaccagccuucacccgagugaacacaccugcuugugaauauaccuaggauguuuuucccaucuagccugccaucacugaguggaucugagccacugagcuuucuaacaacuguccuuuauucuacagaggaaagccucaaggauggagcccaacuaaaacagcuccugcuuaaagcccugacucugauguuggaugcagcagagaguuacgccaagguaaccaguguuauucuaaccuggccuccagccuuggcaguacuaggaauuacuuuggcuugggcucuuccagcgaagagggaguguauaaugaauuaagcaaaggucagagaacagaagggacggucacaauaaaguucucccuuccugugucuccuccacccuugucccucaggacuccuguguucgacaggcccugcacuguaaccggcucaccaaguugauaacacuacagauucacuuucucaacaguggccagaauacaaugcuuaucaacuugggccaucagaagcuaauggacuguaucaugacccuaccucgguucuaccagguaagaauacucgggcaaguacugccagcaugccugcucauccugugguguuucacucuuggccccaggggcugagucugaccuuucagggcuaguucucccaauuuagcuauuaguaccaugcggaggcaaugugagauggaugugugugcuuuuagugauucaggccaaacugaggucuucacaaaugcacuacuuaaggcacacucccagccacuacugauuguuauacaucucuaacacaugauuugggcaaaggauggagaauuuugauguuugucaguuaugggucagguauccuuugccuauccucuuaagucuuuccagauuguguucuuggaauggucuucccagagaucaguucuagccuuuaaaauaaaagggacuggccaggcauaguggcacacuucuucaguucccaguacuaaggaggcagaagcaguggcagacagagcucucugaguuuaaagccagccugguccacaauguaaguuccaaagaagcaaggcucuuacacagagaaaccccaucuugaagaacaaaaaauaaaaaguacuaaugucccagcaccagcuuuucucccugcuccucacacaguugaguuauggaaauaauucacaucucagcaguuuugcuguccauuguaaggaagacuaaaaacaaguuacugcaugaguuuuaugggagggaaaugccaaucaauaagacuuuaaacgacccaagacagagcauuuagcacuauguucaucauaacucacuguguguagaacugucucugacagucaccacagcccaggcucuaacggccccucccaccaugcccauccuuugcaggcuucuauuguagcugaggccuaugacuuuguuccugacugggcugaaguacucuaccaacaagugauucuuaaaggagacuuuaguuauuuggaagaauuuaagcagcagaaguuacuaagacccaauauauuugaagacauuuccaaaaaguaaguauuuaaacuugacggcaaucccagcaguugccucagucagugcuaguguaucccaggacagucagggugguuuaaaaaaaaaaauguugcuuaugagccaaaaacccuagcaaaagugccuuuuacaguaguacuacauuuaguauguggguacacguauuuaucuuuaaugaaauuaauucaucaagacccaauacuaguuugacaauuuccuaagcuacaaaaucccaaccucugcagauaguggugguggaguugaucccucucauugacaauacaguauuuaaccuguacuuauacaucuuuuguguagauauaaacaacaccagccuaccgacagggucacagaaaaccugaagaaguuacuuucauauugugaagauaucuaccuguauuacaaguuggcauaugaacacaaauuuuuugaaauuguaaauaugcuucugaaggacccucagacgggaugcugccuuaaagauaugcucgcagguuagaagauuggaaaggcgccugauugcuuguuuguaccuauacagcucuaagggauguucaauccuaauaaaguauuuggagaucuuuacccccauuugaguugaaaagcccagaaauauaccauacugcacuagucguuuguggcuguagggaacggaggaaaaauuaguauugagaucagaaguguuu

SEQ ID NO: 1044 - RNA, 2099 nt, Mus musculus
acuauaaccaagauuauagaacaauaagaugauuguaaaggguucuuuuucuaauaauaugcaguauugaaagggcaauaauacaaguaguguaugacuguaacauucagauuuuucacacugggaaacuaagaauacugucugagagguuggugaggucuggagaggggggcaccuguucccucugauggagucaguagcucccgugucaccucuucagccacuaguucagccacagugucugcuucaaggcccuggguguugaugaagaccugggcuugucuacaucggucaggccgcugagaagccaagauugcucggagcauggcuucacugucccuagcagcaacaucuccauaggaacagcccaaauccuaagaggaagauaacaggagcagagucauuuuuagaagcaaauaguaggaaauguguggacaggccacuacugccugaccucagcaaucccaauaccccagaagaguaagugaugccucucaguccugcccuucaccacgucaggcucgucacuuguggaacgcucaucuuuucaauuacacagaguaaaggaauagaauaaaaggcuuauccuggagccagggcugcagccugugcuuccagacacccuagucuuuaggacaaacuucuuguacuuucuguuucucaaccagcacagagccacacacauccugucuacugugggagugagagggugaagaagucugucuuuguaugcaucacauuauguguaauguucaaguuagaaaguaaaaucagaaggaacucauguucaagccauuauuuauagagaggagccaggaacccauggaaguuaaauaucuugcucuaccuuccugggaagacuccacuggcacgucccgccucccuuucagacagugcuccuuuggggauccccgucuggugcauaccuuggcaaguucauacagacagaggaccugccggcaguaguucuucccauggaggcacuugcuuaugagaguguggagguucugggcuaccucaucagugggugguaccaucacaaaugacugacuguccaaacuugaagcugaaagcaaacacaagucugaggagagcucuaggguguccucuccccaugacuucagcacucugaaaagcucccugaauucaauucccaugaugcaucugggccugcagccacuucugacagaaccccacuuaaaacuuucaucaccacccuucgggaaauccauccaugauuucaauaaucucagaccaccucaggcuugaagcuuucuucaugcucuagagaucaguaucaagaugucugcuucuaaauuccucacguuguauauauacuccagcaggucugcuuaucuccaaacaucucucaggcaccuugguuccuacucugagaagacagagcuccugcucccacccccacuccccuuucuccuucagaucgcucccccagucucacucuuagucucacagcucaguguggagugcuugcccagcauuucuaaggccuuagguucagccccagcacugucugaaaugggacacaugcuucuuuacuucuugguaccaggagaaaguaaaagugaguauggaacacuugcuguccuuccccuuuugucucugagcaucucauuuuuagcuuuaaguucaacgugauucuccugcuuuagcuucccuagugcuuagauuacaguugugagccaccaucccugucugucguaaagcuucguuaaacuaugguacaaccacucaguagaauaaucuuagccuguuggugcauccugacaggaacaugcacgugcuugcugggcaugcgaaaauaacaaaaaggcauucugagagcuuugagaagacagcauugaauguacuuuggcagccuauaugaguggacucugucauuugguacacugagcagaucuaguucaugcaguugagugcuuacuugguaugcaugaagcccugggcuccauuucuaacuucacauagcuaggcgugguggcacacgccucuaaccccagcacucuguaaauucaagagcacugucauucauacagugaauuccaggccagcccaggauacaaauaaacagaaaaaaaaaa

SEQ ID NO: 1045 - RNA, 1095 nt, Mus musculus
ugauguuuauagcaacuuuauuuacaaucagccaaacccagaaacaagccaacugucuaccagcagagugacuaaacaaauagauacaucucuuuaaugaaaugcuacucagcaauaaaaaggaacaaauguccaacaugcacaaugacacggaugaaucacaaaagcaucaggggaugagaaaggggccaagaucaaaagugcauuccauaugacccaaaguacagugacagaagccaugcuagugguugcuuuuacaugagggagauucaccggcgaagcuuccggggugacuggaauguuggaauguuuucuaucuugaccaggacggcagcuacuauaagauuuauacacuuuaugcaaauacaccucaacuguacauauguuacagcucagcuuuuuaggaaaaucccagggaaagaaggaaaaggguuuuugcggguagagguaacaucuguguacugcgguuggguggcagcugauuccccuaggguaagaggcuuccagcgcccgaacugcacaaaccaggaaagcuguuuugcuuccucuggggaaagggagcugagggguuuggggugugugguagagauaccauuacugccuugacccuggagcccagggaauggcuucaugcucacaggaggauucacugaagggucaagacagcagacacuacuggaugacauuaggaacucuggacauuuguucucuggcagccuuaugguuugugguccucucagagcaggaagguguggggcagaagcugggggguagugggguggggaaagacccagagccugaguugaggcaggagggcugugcgggcuaugugcagugugugguuucugagacaaacucagagaagauugucaugcuuuucuuaauucccccaacaaaaguccauagcaauauaguaauuuugugaaggcaaaacagaaacagagacccaucagacgugauccccaguguucuguucccauccacaguugucagaaauaggggcuuuccucuccuugcuauacaucgcaaagcuuacugugacaugagcuaaguauuggaguggccuugucuaccugcccagaacauaggcgcugu

SEQ ID NO: 1046 - RNA, 10589 nt, Mus musculus
cuucuuggcgcaugcgcgccgccugcauccggcagccggguggauugcugccgggcuuuccccggcgugguuccccgagucauggcuccggacucggggcccuuccccgacggacaacuuuugaagcugcugccgguggauccccgggaccgggacacccagcgcugccgccuggggccggccgccuuccgcagcuugggugcgcgccugggcucgccgcugaggaucucguugcccgccggcggcugcugccucugcacggccuggccgcggcgcgacaggguggauggcuuugugcagcuggacccgcagugcgcuagccccggggcccggguggccacggggaggauagguauggacugcuugcaacccgugcccuguccgccccugcggcgccuagagguguggccggugcugcggccccaggcgggagccccgaguuccgccgcggugcuggagguagugcacgagcugcugcgcaaccggccugugucucggggacacguggugaccaccccgccggguguccccggcccugucgcagcucugcacgugaugggcgggacaccggacccagagcccggcgggugggucacaccgcauacccgcaucacgcucagugacaagccuccgccacaggucgagccucccggggaggugacccuugggggucugucggagaccgccgacucccuacgggagcugcuccgccugccgcugcgcuacccgcucgcccuagccgcgcuggggcuggcugugccccgcggggugcuccuggcgggccccccgggagugggcaagacccaguuagugcgggccguggcgcgcgagacuggcgccgagcugcuggcggugagcgccccggcguugcagggcucccggcccggggagaccgaggagaacgugcggcgcaucuuccaacgagcccaggagcuggccagccgcggacccagccuccucuuccuggacgaaguggaugcccuguguccccggagaggcggcccgcaccgagcucccgagagccgagugguggcccagguguugacgcugcuggacggcauccacagggacagggaguuugugguugugggagccaccaaccggccagacgaguuagacccagcgcuucgcaggccgggcagguuugacagagagguaaaguuccugaaagcucgccuuuuuggaauguugggucaggcaggaguuguagaucacuugucacaugcaagcuagaaccuggguucaaaucguucugggaagcaggauggucauuugcuuuguugaaguaacuaauccugaugcaugcauauuaaacugaaauagccuuuggaaugagaacuuagucacaguaagagaaggcagggaaggugaauaaaaacaggcauaagcccuuaaauguauucaaaugucaggauaccagcuuccuguucuacguugucagggcuggcuuuuuuagcgucuuugguacucaagugauuuuuuuuuaauuucuaagcaauuauuaguaauuaaauaauaauuaaaauuugugguaggauucucuuaagacuuuggaggaccugaauggauuucuuccuugaaccaucuauuaaagggcccugcuuccaaagaacaaggaccuagauuaucuagucugcuauuugaucccagauugucagaacuugguguguucuuaaaaaacaacgaagacuucuucagugaaauacagaguuuucauuguggagauucuagccacuguuguuccacuggacaguuaucauuuucuuguauucauaauccaaggugugcuuagaaguucaugauacaaguuccacaaggguuugcugaaugacuguacauacuggugagggugcuuuuaaaggaagauuuuaaguugucuacuucuaauuucucuauuuuuugcuuugccuguagguugucauuggaacucccacccuuaaacaaagagaagcaauucugcaagugauuacuucaaagaugcccaucuccagucauauugauuuaggucuccuggcagaaaugacgguuggcuauguuggugcugaccugacagcacucuguagggaggcugccaugugugcccuucucaagaaugagaagguaggaaguguucaccugucacuuucagaugaauguaaugguaaucuuucagauuaauaugacagaucaaugugggguuagaauaggugcuacauacauucauuccuuggcauggcugcuaggcuccacagcuguuucgggcgugugugugugugugugugugugugugugagagagagagagagagagagagagagagagagagagagagagagagagagagagaaacaaaaacugagaccuugccugauaaagaccaucuuacuucuagaagagauuaagacaccauaauaaaaagcaugugugugauuuugucaggagaguuauuucuguuuggccgucuaugacuuugaacuguaucaugcuuaccaaaggcugcaggagcagagcagaggucuucuguucuagccuggauucugcacucuagcgucugucacguuugucuuugcugcuuccucugcacaccguuuucugaacagcuugagacuacacuagagccuuaagucacuuagucuuggggaugacacugagaugacauugggcaguuuuguugugagugucguggaguugugugucuauuccagcaagauagugacgccacucucauacaugccugucacucaggcuguaggugcacagugcuccauuacagcuaguguugagaacaugugugccucacaaaauugccuuaugcuacaauuaacucacaaaccccggaaaguuuaacaucgacaacuguauuuuaauguauucaguguguuucucucugccccagugcugcccugugugaugaucugucaggugauuuagucugagauuacacacugaguuuaguugucaggagucuuccaugucuuaacuuggaaacaguucucagucucucuuggccucgacaccuuugagaaaucuaaaucaggguuguuuguuuguuugucuguagaacagucagcccuggacuuggguuugucagggugucggugguuguagguuggaaaacucccagguggcuuuacucucaguaucacggauggagacgugcucucaguaucauggauggagaugugcucucaguaucacggauggagacgugcucuccgcaguguuggugauguuugucugaaucacucagcauuguuacuuucucuauuauacacuuaacuuucucccuuuuauauuauacauaauuugaggucauagauuucucuguguguuuuuauuuuuauagaagcaacuaaaaauuaaaaacccuuugguauuuaaccugccaguucgagaucucuuuucacccccaaaguaacaguaguacacuguugcaguaaaacuccaacccccauagccugugcaaaaccacacaacucaguuacaagauuuacaagcugcaccuccagauuggacagauccaccacugcacugcucuacuccccagcugugcugcuuguggcuucuucaggccacgugguucugcuccaucuucugccuccuccuuccauccucuuccucucucccuucuacucuacccccacucuaaaaccuuucccuuccccaccuuucccuaacacugcccaaucacaagcucuagcccuuauuugaccaguuaaaauggggagaagguucacacggaaucaccugagguagcagaacaugcuuuaguuagcauauuauaguguccuaagcugguuuucaugacauucugacaggcgugcuuuguuuaugucucccccaugccuucuuucucacuggauucucaccccaaauacucccuguuccccuuuuacaccaaaaccaucuuuguggaaaguaaguucuuggccugggaagacauaaguaaguuggcaguguguaguuuccccugagcucccagacugcucucuagccuuaguugacccuagcauaaagaaugccuggaaaucccagugucaaaccuggugagacagcuaaugaaggauggggugauggaguuagugcaucccacuguccaggcuugucagaaagaacuucaaacaauuaaggaggauucuccauuuuucucaucaagccugacagggccgcuuaaguuuagauccgagggcaagagacaaccaaccauggcuuaaugagucaagucacaguagcgacagaaggcucuaaaagaguccaguacuugaggucagggagacaaagcuuccucgaagaacuggcaagaucacagugauacuggccaguguccuggugggaacucuggggccuaccagaccugcuucacauccuagucucccccgcagcaguccuggaugccagagcucacuuggugcuugaguaagggguguguguguguguguguguguguguguguguguguguguguguguguguguggugguggugguggugguggugguggugaggcuaugagcuuuguuucauuugggaaaguguauucugacgaacuggaugauggggaauucugaaugcuucugcccacagcaaccuuagacaaaagagcacaaucuaugaugguucuuuagucauuuaccuauuuuuguaacaauauuuauugagcagguaauuuacuauuuaaauugauacaguugccuuaauaaguaagauuagcuguuaaauaaaaaccauccugaacugcuguaauucuauuaauccaagggggaaacaacuaacauuaccccuacauccuccagaacucagcacgccugggcauuaaugcaaaaggacaaaaggguggcuuccuagaucuacuuguaaucgccacaaguagaaagaggcauauuuuaaagauuauauaugcacaauauauagauauauauuuuccauuccuuuggcguuuuauucugaaagcuuagacacaagaauagaaugaccuagcaacuucaccaucuggaaccuauucugaauaauuaauacuaggguaaauuugcuagcuauugugacuagagcaguuaggaacacugauaagcacgugucucugcaguaggaaagagaguccuuugauaugugccuagacauguacuggauggugcuauguaggcuucugagggguggggaguuaucagugaacauuaccaagcugugaacaacaauagugaccaaugugugaggcuggccuuggcuauguugcaguaagacacugcuucccaacccccuuacgugcaaucauggcacgcaugcuauggaguuaaccaaccauuagaaaaauggauuguauuuaagaaaaucugauuggauuugagacuccacagaaggagacccaugccugauacuguaaaccuggacaagcaccuauaguugggaaguccacagccccaggggugagccuacuacaauagcuaugcaaaauagauaacaucacugcccuuuaacgccauauaucuacaaacuagugcagcgcucaggccgcagcaccucagcagaggugcaguggauaaugguuaguacgcaaacccacagcggguuaguuaugcagagacuaaaugcagagacuaaauugucauuugaggauucauccacagaugggacaucuauaccauaaccaacccugcaaguucaaagguaaucauggggaggaguuguaagaacaggaggugaugggggaccagaacuaaacagcgucaucugacaugacaggacggcuguacccgugaacuugugggugcagcaggagcagaggaagagcaaacuaauccaaguuuagcauggggaaggaguucacaaacccugacccuuagcugaggcaccauggacaguugguggcuuuuccagagggagaaucaguuuucuuuaagcaggugaccaugcuccagugugagaccccacaccccagauuauguggaaagcacaaacuggccucaguggguuauuuuaaacaagcgaacuaaaaacuauuuaguugagaggguagagugguagguguggaucagggaggaguugcaggaagaguggaggugaguaugaucaaaacccuugaaugaaauccuuacagaauuauaaaauaaucuuuuaagagcuguucucuuuuugcccagugugguuguacacaucuauggucccaacaccagaucagcagaauaggaugaucuuaaguuugaagccagccugggcuguguuguaguaaaacacugacucccccuccccucccccagcagaaacguuuucuaacugcggagggggguuuguacaggaaauguaacccaggucacaggaucauccaaccuuuuggcauugugacaucauuaucuguaaaugcauccugugacccauaggcccaggggccauaggcugaacguucuagcacaugcuaggcuagggguuucccacuaagauauaacuucagcccuucaaugucuuuuuaaauaacuuaacccaggcuuguuuucacuuaaagagaagggugcacugagaauucuaguguuaggagccagacuuauguucugauuucaucccuaccacucaccagcugcaugucuugaacauuucugcaucuagcaagguauucucgcccccacccccacccccauucaaggaauccaucucagugucuggcauacagccaccggccuaguggaauuacuuccagaaacugugagccaaaagugaugaguuaggggggacccaaagcugaugcuaauacucggaauaugcagcagaaauaggcaccuggaaucuucugcaguugaauuuugguuuguuuccagaagaaggaggaggaggaggagaagaaaucaaucaaucaaucaauccggacccuguuggaguuaaucugaauuuuaccauuuacuuuuaaauagucucuauauaugcagcgugucaugauuuggaacuuuuaugugguugauuuuguucaaauuuaccccacucugcaucuggcagucucuguugguacuggggugaagguggcagccagcgcuggagccucugcccucccuuagcccucucuccaccccuccuuuuuaaaggaguugcgugucuuucacucaggucuuggcugcuaucacaccugaaccugaaccucccagacguuuggaggugcaggaccaggacagaaagcgauggucgaccgcagguaaggaccgcggucagcggccgugcugcacuaucguccugcagggggcgcacgugaguugacucagugcgacgcggucggaucgguccccgcgugaccaggacgcgcggcccuccccgagcgguuggcugcauauaagggccgcucgcuucugggcguuaacaucuccuggccgcagccgcccuaggugcgucuccuuucugaaaaguucuguggagcgggcggucgcccggcuuucugcgacuguuggacggcugggugccuggguccgggggaagauguuuuugaccaguauguuggauuuuuccuucuucuagauuuggaauucuacacuaaagucaucaugggcguuuuccagauauugaugaagaauaaggaaguaaguuucuaaucuuaacuucugagaguuuuccuuuuuaaaaagaggggaaagaugaagauuuugaauuuguuguuuuuuggaguuucuuacugaguuuaucccccaccuguucucucucagcucauuccuuuggcguuuuuuauaagcguggccgccaccggagccacaucuuucgcuuuguaugcguugaaaaaaaccgacgugguguaaguacuaacgcuuucuagguaggacugucugggggagcuuuucucugacccggagauucugaaacacgcugucagugucuggguuuuuuccuacaaauaagagcaucuaaacauggacugaaaaacaguucugguaacagaaagaaauguaaccaauucugauacauuuguuucuuauugucugacccugcaaugaauuagauuugauuucuuuuuaaauuuaagcuuugaaauugaaguacuuaaaauuagggguacauaccaucacacaucauuuaaguuucaagauuucaacuuuucuucccuggugugguagaacugaaacauacagcuaucugcaacaaacucuagugucaacuuuggaaaaaggacaguaaaaagccuuaucuccugggaugcaggaaaagauaccucugaaacugacuauggcugguccagggucagagagggcagugacucuaacgcaggucgaggguggucccuggagccaaugccuacacaguucgagccuacucucugccccaucccuccuagaacccccaggaggcucugccucuuccuccucagccugccccuuauguaucuaucgcugccuguuugugggagcaguuuccaaucuuaucaaauaaagcaaauagaccucuuacccugcccugcagaggaggagauccuuaacacuugaaacaaacccugaauuuucaguggccgcuuauuuaacuucagcugucacugaaguuuagcuggugacugcaguguaguuucggugugaagacagagucugucuccagaaaguuuauagauccaguagcucuuccggguuuguguaaacaaauuuaccuaaucauuuaauuaaucuucuuuuucuuuuaguauugaucggaaaagaaacccagagccuugggaaaugguggauccuacucaaccccaaaagguauugcugaccuacaguacaugauuguguccagcccaaaccauuuuuuuuuaaagagcaaagcagacugcauguaguccuugcacuuacaaagugacauucagaguccuuugaacaguggucuagagaccugguucaaguccuugcucuguucggcacagacgacuauggacaguuuggcuucucugaaccugugaaauguguacgauaauaaaacuugcccuuagagcuaaaagcauuaaaauacagagccuguuagcauagugcccagccccuauauuaagcacccagauauaaaccuuuauauuauuaaaauuguauuauguuguuuccuuauuacuuaucuaaauuaauauaagaugugaugaacaauaggaguuccuaaaaaugggaguggauuaauucucaguggaauuagcuacacuguuccaaagguuuuauuuauuuuuuauuauuuuuuuuucuuuuuaguuuuucgagacaggguuucucuguauagcccuggcuguucuagaacucacuuuguagaccaggcuggccuagaacucagaaauccgccugcuccugagugcugggauuaaaggcuugcgccaccacgccuggccaaagguuuuauuuuuaagcauuuauuuuuaauuauuuguuggggccugggagucaugccuguaccauggcuuguguauggaguucuucucccaccacgugaauccuggacaucaaagucacauagucagccucggugacaggcacauucacccacugugccaucucaccaccucccuggccuagguuuuaguuuuuguagcuuaaauauucugaagugcuagaagcacggggucagaaugaacacuaauugggaucauuagcaaagacuacaaaaagcaaaacucugauaacauuuaggaucuuuguaacuuugugucugucucccagggucugggaugagagaacacugaugagggcaaaugucaggaugucugacugagaacugacuucggcuuauaccuucaugaagcaauugcaaugaggaaguuuuaagagacuauugugugccuugcccuguguuuugaccauuguacaugcauuuacaaggaacgaaugugccucuugaauuuaaaugcuaucuuagcaaauuaauaaucuugaaacuucuagugaaagcaagacagguguaugacugcucucccuggucccgagacaccuagagaccaagggauuuucggggacagacugguagaaacaggcccagugugauauucugugcuuguuucagagaugaggagaagaguguguguguauguauguguuuuguuuuuuaauuauugcuauaguuuuuccuuagagggguauagacgauuccuccaaggaagugugaggcuggagaguagaugguuaacacaaugucuugcuuucuguuuucaaagcuuauaaccaucaaccagcaauggaagcccguugaggagcugcaaaaaguccggagggcaaccagaugauugcucaccacuccucucuuccaaagaacacucuaugaaucuaguggaaacauuucugcacaaacuagauguugaugccagugugcggaaaugcuucugcuacauuuguaggguuugccugcauucuuuggauccugcauuagcaagugaagguagcacauagucuaaaauaguuuucuguguuuauugguguaaauuucaauuuuacaguugaaauuuuauguuugugaugcuuggauauuuuccuugaaauguauaaacauguaaaaauuagauuacugccuguaauaaaauaauucgaugacuaucuguaaaacaugauuugugcaagagauaucaaaaauuacuuacuuuaaaaguggggggggacaucuuuuuaugggaacaagcacauuuugaaguauaaaacuucaucuuuugaaua

SEQ ID NO: 1047 - RNA, 23673 nt, Mus musculus
ucguguguugaguagucacacuugcucugugugacagcagugugucuaauuugugguucuccuuuuacagcagagcuuaguccuauacaguugcuagaaugucagucuuguuuucauuucuuuguaauccugcaagauaguaggccauuuaaagucacccucagcguguaaaaaguuagguagauugauuuuaauuauuugaaaauuccccucauaaauucuuuauuuuagaaagaaaauacguuuauuucuguuuucauaugguugggaaauguggaguuuaccuuaguguagugagugccuguagucuugagccagaaugccugaggcgggaggacucuuuggauuacacaguaaauuacaggccauccugggaaaauuggugacauucuaccuuaaaaaagauuuaaaaaaaauuuaaacaaaccaaaaguugaggaugugauguggcucagcauuaacagccuugccugguaugugaaggccugggcucugccccuaagugugagaaaggaccaagccagccauugacuuaggcuucuuuguguaucugguuuacucggauaucuuggggucuguaggcugaucucuaucauguaaguauccaaugugagaagucucuugagucuuaaccaagagaucauugugagcuuaggagucuuuauaccuaagugaucauucccuuaaccaaaagggacaauuuagcuggaagauggaaagagaauccugucugaaagauuaaaagauaguuuacuuaagagaagguaaugcguuuucagguuacuuacucacguaaacccaguuguugcuuauaacccuaugcugugaaacuuagaaaaaacuacauuuuuagguaaagaauaacagaagaaacuccagcuucaaagcuuguacaauucacaguccuuggauaucucuguaaguccaccuuaauggagauguuccuuucugaguaccgguuccuuacaugcuggacgauuuuggauauugcauugucugccacucugcugguucauuuuuagucagcuugacaagcuagagucaccuugagaagggggagccucaguugaaaaauuccuccauaagauccagcacuaggcaacccuguugggcaucuuuuuaacuagugauugauguguccacuguggguggugucauuccugagcuggugguucugguuccaugagaaagcagguugagcaaaccaugaggaguaguaagccagcgcuccucacggccucugcaucagcuccugccuccagggcccugcucugcuugagucccuguccugacuuucuuugaugaacugugauuggaagaguaaacugaaacccuuuuucuuuccaacuugcuuuuggucguauguuuuaucauagcaguaguaacccugaccgagacaaguauuaaugucucuucuagcauauauguuucaauaucauucugugacuccccccaccccacaacaccaacucgaaaauagauuuucuuuuuauguauuuucuuuucuauguuacuaguuguggaguaaauauuauuucaaucuacuuuaaucauucuuuauuuuuucugggauuagucuguuuuaaaacucuuagggacauacuuaacaaguuucuauuuugcuuuacaaguugugguuuugaaucagugugacauugucuuugcgcauuaauguguucagaaggugaaggauugauuaucaguuggcuuugagaaguaaugucauagaaaguggcuuagaaaagcagccuaggguguuauaaaugaggucuuucagcucaagcccuugaaagggaaauacccuugcuuggucaucaagaggaauguuaauuuuuuaaucuggaaagggcuucacuucuugacagauccucaccuuuuacuuuuguuuuucuucccuauuuguuccuuuguaaaacuaaaugugucugucugguuugguuuacauacuaaaguuagcacaguaaucuagcuucuguaauagucaaaggcuagcaugauuugauaggugcaccagcaugggggaguaucgcaggcuacggccaucugccugggugugucucaguuggccugagcuggagucuuacucguuuacaugggaucacuacucccucccuccuguuuagucucagcagugcucuuguuuaaaacuacuaguuucucugagaugucccuuuaacagcauuguuuuuaucguuaauguuuuaaaucugcugucguuuuauaaccguuuccuuauuugaugccauccuuaaaaauuugaaucuaaauugucacaguauuugaaaagucaaauuggugggcccuuuuaugaacugacugaaacuauaguuacucuugugaggugcaaagagaagauaaaaacagaagggagaaauauucaggagauuggacagugagcuacuguaucauuuucauuaaagguguaaugucaccaggggucauaaugaguuguuuggcauucacgcuagcuagccuuuuugcuauaacaucuacuucagaaauuggggacuuaaaaccaaacuccauguccaauuccaguuucauguaagcuaauauguauguauauguagucauuauguaagaauuguauucagacuguaaaaugauaaugcucucaugcauuuuauaguauuaaauuaauauguuuaaccaaauuaccugugaucucucuccauugcugugaagaguugaaaaaauuugucuagugaaauggaacccauuuaaaugggcucguaauuguguaacucuccuuuccuaggucauguaauguuugcagagauaaagauggagaauggcaagucaaaaggcugugggacagucagguuugaaucugcagagucagcggaaaaggccugcaggaucaugaauggcaucaagaucagcggcagggaaaucgaugugcgcuuggaccgcaaugcguaauuucaagcaugguuggaaccuuuccucaucuguuuaugacucuccuaguaaaagucauuuuuaguaauguuguaugcuuacaaaugcuguaaaaaugaacuuuuacaacucccaccagcuauuaacaggauaguguggaaaauguacugugaguuuuuuguuuuuuguuuuuuguuuuuuuuuuuuuuuuuuuuuuguucucaaguuugaguuucuaaagacagcacaucugaucauucaguuucaguggauggacauaccauuuuuaaugaaauaagccauuuuguuauuuucaguagcagaguuugucuguuccaguuuucccgaccuugguguaagcucacagauacuuuguuuucuuuuaaaaucuuugcuuuguaugugaguuaaaggaaagaaagggcucagacaaauuaggauggauuuugguuugguuuaaauuacuuuucucugcuuauaaagaauaguaauuaaguguuagacucuaaaguugaagaugcuuuuuauuugaccuaaaugaagacaugaauuuucuucuuuuugccccucuaccauuccaucuuuccacauaacacuauuaaaaaauaucaaacuccacaaccccuuauucuauuauuuccaauaauuccaauuucauauagaacugauaaaguagcaaguccuaaguauaacacuaggcagaccacccccaacuuucggucuaguuuccagccauuaaaaugaacugcuaagaacagaaauaaaauugaaauguugagagagauuguuauauaugugagucccuugcuauucacuucuauaggagcagaugcauucguaaaugcagucuuaauaaaccagggaagaccuaggcauagcauaucaaacacauuggaucccacgauguuagauauagccaugucuccuuuaccugcagaagaauagcauguuguuaaaaugugcacaucaauacuauauuuuauuaauaaucuucauaagaaaaacacuggauacuuuuuguugguuaguuuuagaaaacuguuauuguuagagcaagagucuuauugaauuuguauuuccuuggguuaguauuuuaaagucuuaacauuuauuuaauaauugucuuuauuuauuaaaccauuuuuaauaagguauacagcuuacuuguugcuuuuuauucucauuugacagugaauuaccaucuaauucacauuucagguaaauggucugguggggauuagguugguggaauuaacuuauuaaaaacuaaaugcuuccccugagucacuucuuuuuucuuuaaaguauguuaccaaggaaguauuauuucauuuaccuugacuugcuuuaugguaagagaauucuagucuuaccuuuucuugcaacuaacacacuugugacuguaucugguaugcuugucccugcugccaacaaaguaaggcccaucacugugucugggaucccuaguguuuccccuguaacaggcacagagacugcagauuagaaaucucaaaucuuagauaaacaguuuucagaaggcagcuugaauauuucucuagucaggaaaaauauuuagguauguuuagauauuugaaccaguauaugcuuaugugguuuuuagauggcaaaguauuugaaacagguugauaguugggguaaccagauuagcacaucuucuuaaugucagauaucugaagauaucaagcagccaaaguuguagcaggaaaagccuuguguuuggcauccagaggaagcggugggugucaccgcugccgcuuuggacuguugcauucucucuuuucuagacauuaccuagaguacugaagaauuaagcaccguauagcuaucgauugcuauguuaaaaugugaaaugcuacuuggcuuacugguuuuuuuccccguuuguuuuaaggaaguacauagauauuugagguagacaagaccuuguucuuuccugccugagucuaacacauggcaccguuuucuuaauauuugugucaaauugauagcagaaauagguucauucugagaaauaaaaccagaggguacuuauaaaggaucgggacaugaaacugcucucuuaugguugucaugaaaacuauaguucauagugaggacagagcuguuugucaucuuugggacuuaacugagaucuuguauuugauccuucucuuccaguuugccugaugucaaauauguucuuauugggaaaaauuggauacggcaaauaugcaagcuaccuggacauucuuaucuucuucaugaaaaauaaaacuauuuuguuuuuguuuauuuguuagcauacaguuacaauaaaguuaguuaucugggagaagucagaccagccaguuuggagaggguuccagguaguaguuauuccaacucuacaguguuugaauuuguguuguaauucuuuagccccagcagugugaggacagcaguguguacauguuaguaggugucugggcccagcuguggucagugaagcuucacugguacaaucugguugcaugauuuaggcauggaggaaagaguauucacuucuaauggguauauuacaacuaagugauaaaauguacucuggaagaugcuagaaaccuaaaaacaaaacuuugauucucauuauucauuugcauuguauuugugauacauauuuaaagcaaaagaaaauaccaucuacucaaacagagagcaccuacugcuuucuguugaccccagucaucucuacuuucuacuauggauuagaauucacuuuuaugaagaauucucaugaaaccuguguaauuauaaacauauccaaugaauuauaccccugacugugucauagcauacauaggaaaugcuuuugauauguaacucacaaaaacaugaaugagcuugcugguuuugcuguuaaagcuuucauauuuuguaaauaguuuuuagucuugcugaaaaaaaauauaugcucccaagauuacuuuaaaugaauacuuccaauuuguuuuuacauggaauaauuuucuugugcuauuauacuuaaauuccauaccuguuacugugaccauccaaacuaggauguaugugaaugcagauauccauagugcagacaugaaaaagguuaucacaaaguaauuuuuccaaaacuuucuccugcagucugguguugucagagcaaguaauguaauaauaggaagagagagaacccaaaaaauucuucuuaagucugcuucuggcaugcugaaaacacuugguggaucuguggugggaaaguucaacauuuugaguuuucucaaaugugcaauuauguuagaaaggcccauuuagaaggcuguuuugaaguaaguuacuguaugcaucuuuuaaagaccgucuagaacaguagucucaaccugugggacuugaccccuuugguguugaacaaccauuuuacaagggccaccuaagacccugagaagucucagauacuuacauuacaauuuauaacagcaaaauuacaguucuauguagugucaaugaaaauaauuuuaugggugaaaguuaccacaauaagagggacugugucaaacggucucagcauuaggaaaauugagaagcacuggucuagaacauuggaauacucauuacuauuacugcuggucagaagaaauguaacuaaaacuaggcagacaguauaagcugugcucuacaucccuuaaccgacugcucgaaucaaauaucuugaacuguuugcugaaugugcuggugacaguguucacggaguugaaaguaggauuugcuugcuuuacuguaguauggguucauuagagacgugaugcuuucucucccagcucuuucacuccucaucucuuuuccaaaacggacgcugcuuaugcuuuguugcacacugaugcacgcuuagggaguguucccucuaacucucacugugccgcaucguuuacugaacgcaggcuucccgggugcuagaaggaaucuagagaagguugggccuagcauccuugguauaguuccggggugugcucuagaauggugaggagauuggauaaaagugggacgaggcuguacacuaaugaauauguuaaguaugugaagguuggaucaaaucacaaauauuauuauaacucauaaaagcucaccaagacucagacagugcaccauuaauuuagacacagauucuagcaugaacauuuuugacuaguucuuuggagucuuuguuguuuuaaaucuccucagucuuaaagacuacaaaguaugguuuguaaaaauaaaugucucgugucaaaauuuuaaaguaauaaauuagaagcuugcuucucaauuaccuaacugaaguuggaaccacuuuuauaaaagcuuuucuagucuggaaugcuauugcuauaucgagcauaccaagcucaugugcugcuucacacggcauguuuaaguuacaccugcguucuuuuccccauucuguuccccugaaucauccccuuuccuuuuauugacaguuguuacaaagauguucuuucuuucuuagugaaaauccaagcuccagcguugucucugcucccucucuggcucggcauugcugccauaguuuggugcugcugcuucuacugugucucauaauucaucccccugccuuuucuguuuuguuccuguccuuucaucuuagcucagucuucugugaacauugggugagagaaaagagccuaacaugcaucucugacucugucuuaggaaugcugccugcucagugggguaucuugcacgaccuccugcacuuccuuccugucagccugcuccucugcugcuugcugcacuugcauguguuggcucugugugcaagcaugugagcaggccuuugcuaguguucccaggccucaguccagagcauacuuauaccccugaaucauguaugcaauaaaagugucagcuguugcuuccugacuacacauacuauuagauuauugaguuaaagccucucuuaucccauggggcccaaaccaauucaaaugcuccuuucuccaugugcaucucccaucugagugucaucaaaguuuauucagucugccuguaugaaccaugguauuagcaguuuauguuugcuuaugguguucacacuuugaaauucuagcugauuucauucugugucugggaaauggcucaguggguaaagcgcuuggugcacgggcaugagagucugagaucagauucucaacaccacauaaaaaagcauggcagcccacauguauacucucagugcuauggaagucagagacagacagaucccuaaaguucacuggccagcuagucuagccuaaucagugagcuacagguucauugaaugacuguggucucaaaaaaugaugugaagucucaaagaauugagggcuagcauccaugacugacucuggccuccaugucuguguguucucccuucccccacacuuuuagcugauuaaaaaaaaaauuauugugaguuccuuaaaggccaggacuuacuugcaguucaucaucucuggcuccauaguguguuguguaaccauguacuaauuacuaacucucaaugagaacucaggucuuuuagaguguuagauggcaggguguaguuguuaccuucagaaaccugacuaagaccaugcaagcuuagagaaaguugggaguaaccggaaucuuccugaaauauuccacugucuguccuugacuggcgacgaaugaagagcuggcucucauccucccaucccaacagugucugcuguucaauucucuccuccauagcucuggcaaggcagggacaacagggacugcauguuuucaugacaugccggcugaucguggugucaaaacacagcagcagaacauagagcccauauaucaguagcagcccugcuccuucguaccuagacguggaggaaagggcugugcaguuauccagucauuuuaaacaauauucucuaacaaaagcaacaguggaaaauucaaggaaccacuccuaaaugcuuuuauuuacccaguuuugguuauaguaugguuacaaauucauugauuaaaaaaucugccucuuuaaaaaguaauauaaaauccauugucugacuuuauagauuccuuucaaguaauaggcacaaaauagucggagaguuaaaacuaauuaauagauauuuuuucaguucauuuauuuagcauacuacauuucucaaauauuuaauaauuagaaaauaaaauacuaucucuuagauuuucugauacagaaacaugguguagaauacuuagacugugcuagguuuuugcuggagcuuugcaguuuguuuuacagagauucagaggaaagccggagguggugggguguuguuggcuuugaggucucauuguaaaagcccagacuggccuugaacacugcacccuagauuggccucagacacucagauuauuauccuccuaccucuuccacuugaguuuuggggguuuuauaucuguacuacuaugcuuggucccuuuuugaugaauugauuguagcuuaauuggguuuauauucauaagaaauaaagaauauucucaaaaaugaaauucuggcauacagcaccaagaauugucuaugcuuugguuucccauuuuacuguguauuaggcuaauuuuuaucacauuaauauuguuauuuuauuucauagcagagaaucacuucucugcuucaacuaaaaaaaaaaaagaaagaaagagaaaaaaaagaguuccugauuuccuugguuccugucauuuacaagugacagcugaauuccaguguuuuugcuauacuagcaaccugacuuuuaucuugcuuucucccuguuuggauucuguggacacacacacaugugguggccauauguuuuauaucacuuuuuuaugguauccagcauagaacaccuaggacaauuguucucacagcccuuuggggcuugaauggcccuaugacaggggucacuuaagaccaucugcaugucagauaacuuacacaaugaucauaacagcagcaacauuacaguuaugaaauagcaacaaaaauaaugguuguggguccaccaugaggaacuguuaggggcucagagcagcaggaugccugggaacacuggcagaaccgcugugugugccuguuuggcaaguucacgucuuuccaccaaauuagcugccuuuuccaguuuucuuggaccuguuagguacagagauuauggaaaagcagcaagccuuuuugauggugacacauaauucuggguuguuaaagaaggcagcaguucuucccauccuucucuucugggaggaugggaggagugcaagggcuucugcuggccuccaggcuuuuauuacuaugacccuuucuuuuuaaccaaggccagguaagcaacagcagccggggaaggugugaacauggagaccaaggaaaaggaagaauggcugucuucagugacuaggacaggagagaaaagcagccaccagcaguuuugaaggagucagcugagacugcaauagcuguugaagugaagguuuugagaaacuauacuacuaagccaucagacuucaaaaauucuguaauuauguuuuauguuaagagugacacuuauuuaaagcuuaccaguaaauucgguugucaaauauuaugccaaaaacugcuccuacacuaacugcauacacugcacagucucggaagaggggccagcaggagaguguugaaaccuggaaaaugaugguuugauuuacugugugcauuacaguguaaggcauucaagaacaguguauaauacugaaaucacguauauuugugguaaacuauuguuaaguuugcauauuacguagagaaaaacaauuuuaaaguaaaauuguauauaaaccuguacugacuuuuauaaauuucauuaagagaugcuuauggauuaugucaauugaguaaauguuuuucuagugguuauuaaauuugacugaaugcaauuccagugucauauuguucaucccuggcagguuuagaauuugucaagaaaauacaucuuauugaauaguuuucuuaccauguuggacaggaggccgcaggcagcacagaugccgaggagauuauaaauugcagauccuaguauggugcugauaccaauaucucccuuugugauaaauacaccugggagcgagagaguaguagcuaaguuaaagcugacuugaaacuaaaaccccaccgaauaagcagcaagucaaaggaacaauauuuacccaagaaggcgguaacuaguucaggggcggagcuaccagcugccaugaaaguugcaccugcaacauccugcgacaguccaagggcugaagaugaaggaagugauuacuaugggugaugguggcaagguguauacagcagagcuauguaaaagacacucagauuacaccuguacauuacacucauugacucaagcuggaaauuaaacauuuggguuagaaauagaggaauccuguauguaucuugguuuccuaugaaugcauuacuuaacauuucuacagaaaggagggcuggugagacggcucagcuggugaagacgcaaugcccacuaggcaacaugaguucaauucccagaacccaugaaaaacauggagagagauaccugacuccacaaacuugucauuuagcuuccgcaggugcaccaugacaaguguacgcucauguucacacaugcacaggaugucauaggguuucuauagcugcaacgaaacaccaugacuaauggggaggaaaggguucauucagcuuucaauuccacguugcuguucaucaucaugaagucaggacaggaacucacgcagggcuggaaguuggaggcaggaacuuaugcagaggccauggagaagugcugcuuacuggcuugcuucccaugaagcaauaggacccaggccugcccaccgaggcauggcaccacucaccauuagcuaggccuucccucacuaacagaucacuaauugagaaugccuuacagcuaguucucauggaggcaucuccucagcaggcuccuugcccucugaugacgcuugugucuaguugacauaaaaccagcuaguacacaagauaacgaacauuuaaaggccauugagggggucagaggauaaggggauuugccucuaaggcugauggccucaguuugguucccggaacccacauagcaggagguagauaaccaacccuucaaaaguugucuucuucucucaacacauguaccacuucaugucuccagucccaaacaaauagauaaauauaaaauaaaaaagaggagacaaaguccgggcugucgagcaauucagagaaguggcuuccagcucuaugugagcugcaaaacaacuccuuugacaaauucuaguaguucaggauuccuaaccugacuuggaagaagauaggguucagugguucuuaagauccacagcgaagcuggauugcguucuuuuacagauucacaaaaccaacauuaucuaauggaaaaggagaggaaaucaauaaacaaaaagcacaguaaaucuggcauuaugcaaauuacacaacagauuaagucuguccuauuauuugaguaguuuguggguauuguuuagacuuagaaucauacaaggccuuucacuuaauugacauuagggagagucuuauguggcucuuccagcauuagagccaagaaauguacuacaggcaggagaagagaaagccacauugaagaaacaacucagucuuuugagaaaucuccaucaaguuugucaguaaaaagguaugugugcaugugcgugcaugcuuguguguguguguauguuacggaggccaaugucagugucaggugucuuugcucaguuaacuuugaggcuccuuggggacucuccugcaccaucuccccaggguuggaauuacagucaugcaucagugcaccuggcguuucauuugguccugggaaucagaauucauccucaaguuugggggccaagcauaccauccccagccacuagaacucagauuucuaagauuugauggaagucuuuuuuugaugcuaacugcuguuacuguacuaagguuuuagcccucaaacucugguguauuugaucuggucucucaugguuggcagugucuccugguguuugcuuguaaagacuggcuauuuuuccuuuuuuuuaguaugcauuggugugagggugcuagauuuccugugagcugccaugugggcacuaggaauugaacccagguuccucucuggaagagcagccagugccuuuaaccauagccaugucuucaucaccuaacuggucuugcuuacucuuacguacgcauuucuucucugcugaaacugauuucuggccuuauaaauuugggguguagcagauugaauuuuacaaaacuuacuacaguauuuguauuccacacccuuuccaauaacuuuucucucuuauuuaaaaggggacugagcauauggcuuugugguagagcaccuggcuagcacaugugagcgcagaugaccuuugcaacugcuuugacaaauugagggccauggcagugugacaguauuuucaaggucaggacauuaaagcaaaugguagaauuuccucaagugaccucucuugggacauuugcuuuugugcccuagacaccacacauguccugguuuaucuugaaaccuccaccugggacagacgucaugagcccuuauugaaagacauaacaucaacauccaugcuuugcauccuuuugagccuuccaagcuuagguaccagacacaugggagaacaagccuucaaggaguccagaucaauccuuucacuauaacugcaguguggacccaaucagcugccuguaaagcuccuagaccgagggacaguaaaaauguugcuucuuucuucuaagcuagauuuguugggaguuuguuaaguagcugucugacuuucauugcugaauaccaacacuuaauuauuccagaugcuucucugugugucaggauauggcaguaaacagacaagagcugugucucucaccuuauaguguggugaauggacagacacaaaauauggggguuuuagaagcagcaagaagugaaaauaaagaagauaggaaaugccaugggauaaguaacuuuggagcagagguuucaaaaugagggugugacuguguaauuaagaguauaguagguagguuaacuggcuacagacagcaucuauagaacugguguauuugaagcagccucaggucuagaaugaagagccccaagagagaauaagaggugguaagauagaaggaacaucauguauggccuuguggacccuaaagccuagggaauauucuuuuccucugaagcacuuuucaguugguggaaaggcccagcuacuauuuguaucguuugaggccauuuugguguaaggcaucagacauguccacucugagguccucugccaugugaugaugauugugagcagaguucagaagaguuggagugagagaauucaauccaggcucucucaucaauuccuacuugccuuaacugugucacuuaaauauuugacuucaguaaacaaugaagggagagaaacauaauggcuugugggccuugguuucaugguguuucuuuuaguacauauauaaaccauacauacucaacccuguccccacagguuacauuacauagccucagauucaaccaccuguguaucaaaauauucaaagagaaauuaccuucauucugcauauggacuagacucuucuuuuucuuuggacaauauaguguaaagcuauuugcacauuuugcagacuguauuaguucuuauagaucacucuggaaucuuuaagcuacucaggaggguagugaacacuaugcacacacaguagaugauuuuaugugcuagaccucaguguccucagauuuugacauucucaguaccucaggaguacugagcagugcuuauuugucauaauguauagaaugugaccaauauguacauagaugcauacacauguauauacauauauuacuaacuugccauagacuuuuaaaauugaacaaaaaggcaaagugaauugcuguauaaucgaacaucauuuuagaaaugaaggcauuaucuugcacaguggcauucagcuuacuuccauauuucuaguguuagaugugaguuuuagaauuuacauuguacaaagaaucaguuuugcuacuacauaugaggcacuggcuuuauuacccagcacauccaaccaaacaaacucaucaggaccugugaguaaagaaacaaagucaagucucacggauuguaaagauuguaaauguaggaauuuggcagaccuugagggcaagagcauuuccauggcuucgugcuacugacaccauaacuaugucuauuugaugcuuuuuaacauuuucuuugaauggucucauguaucccagguuggccuugcauucacgguguagccaaagauggcauuuaaccucuuaucucccugccucugccagggauugcuguugugccaacacuucaggauggugcagaguugggauugaacccgggguuuugagcuugcgaggcaagcacucuacccacugagccacauccucaguccgccucuugcgcucuuacauaggagaaaauugcuuacugggaaacaagaaucuuugaccauuuucuagcagguuucuaggaacugaagaguuagugcugcagauucuuaggcugugccuuccaaagccagugugggaagccagggaagcagccaguguucuuucugacauugaugcugcacacucaugggcccugaagacugcccagccuucccucacugcggccugaagacugcuucaucggacaaacuccguuuccagagggaaaagaugguggauugggcuguuuuaagguggggaaaaccgugguccuucggacuucuuuuggucucagaaagcauucuugcuauucccugggcuuuaauuauaguuaugaaaggaaagauucugcuagauggcuguauaaaacuugaaggauauuuuuuuucaagcccuuuuguuugauuguaagaauauuuuguaaaaugguuuacaucucugaacuuuacaguagaugggccuugucuuuccugaccuuuggguaacauuuuccugugcuguaguuuauuauuaaagauaaauuguucuguuuuuccauuauugcuauuacucuuuuuuuuccuauuaaucugaaagaacaaccacauucacuucaaguucuaggagacauguccgagguaugaucucuuuauagguucaggugccaauacauuguuuauauaauauacagcauuguagccaugagaugcuuugaaaaucaccagacuuucuccuaacuguguccuuuucuguaaugucccgucagaaaguuugugacuuuuuggaaauaccucuguaccgaguaguaaagagaacuaagcuaaaacggagacccaaauucugucacugccaaauaauugaaugugagacuuuaaagagguuguuuagaaaagccucagaccacaucagauuuuuaaacugaacgaacucugaaacaucucuauaaugcuuuuaaaggccugauccuguugaaaaaggauuucccccaauccacuagguagaccacuacaguggauucaccugcccucugaaccccgugguuccuguugcccaaggucagaggugggauaggaccuauaucguucugaugccaaagaagugaugcuuucugccacucccagagaaagggauuagugcacagugcgauuuuaccaucacugccugugccugcaccuacaucuugauagcgccuagaguacuuagcuccuacuauuacucuuuuuauugguugcaugaugcauuuuuuuugguugcaucauggugcagagucaguccaaggaauuacaguugaggccagagaaaagcucaccagugggggcuuuggccaggcucucaggagccugugcucacccagcagggaagaggcacuccucugagucuuuguucuuugagaaugcuuuugccucuguaaauuucuugaggcuuaagaguucagauaauccccucaaacuguaagcuauccaaaugucagacucagaauuacuaaggcuccuaacuucacaaguuagaguuagcucuaccuggaauuaaaacuuacuuuuuuuuuuuuuuucaaucgucugucacugaaacauaguguggaacauagacaaacauuaguucaaggcagagguaguaaaaguaauuuuuaaaagauaaaaaguaaauauuuaaaauacuuuucuaaaacaugggaauuuuuuccccuuaaaauguguuauaacucaaagauguuagcaugauggagagacuagauguuggaauugaauagcauauuagguuagcauuuaaaugaaggguucuguaguuagcuuccuggaauuuggcugaagcaagugacuauguuuguauuuuuguuguuguuuggcugaaacaagugacuguguuguuguugagacaggguuucucuguguagcucuggaugucggggaacucgcucuguagaccaggcuggcuuuaaggucugccuccugagugcuuggaucaacagugcagaugauuauucuuaaagaguuucucuguauuuucuaugucgcuauuuuagaaaaauugaaagaaggucguucaggagugauugagcauagcugagauaccugugacacaguaagaggauacgacuuuuauacuguauccuguuucuacagagaugugcaucucaucucugcacaggagagugaaucuuaguugguauguguguucauguguguacaauaaacauacauuuauauuaagagaucauuuuuuugaacaaagauuacuaaauugcaauaguacaauaggaauuuugauucaagaaagaacccaaaggaacucuuaaaaaugaguguaaaguugccgcauagguuuuuaaguagagguuuuacaagcuuacaucuugccuuaugagacugucugauuuguuuuuacccuaagauaggcuucaagcugucauaaugcaccauagguuugguauuugcuccaagcacuuuuuuuauugacuuaguucccuucugcacuuugauuuuuuuuuuccuggguaaaggagucuuaguaucauucuugguauauuuuguaauaaugaauucucaguggcugcucccugugugcaauuuacuguuauuuuuuucucgugcacacaggacagaguucuuugaacuaaacuauaauuaucuguuucacagcugacauaccugaggcauacagauguuaagcacuugcucaaaagcuaguagcugcuugccaaguugggaguuggacccagaugugucuugucucuaacuuagacacuuccaaccauucuagcaauuaugucaccacaucaugugaucauuggguuccccacccccuucagcccuccuggaugucauagaccuuucauugagcacaugaacauauaggaggaaaacacacaggaaggaaaugccccaagcaaguaagacccagcaaugggaauauaacuagcugcacgaaccaagcaugauagucauuggcauagauucuuuuagccaguauuacugaaaugaccaaauacacagaggcacuguuugucuuggcacuuuaccucuucucugucucuuccacccacacccacucuucagcauccuucaggucagggucugaugaggacaacuggcagggcugaggagagucacauccuucaguucucuuggcucuagaaggcgacugaccuuuccccucccuuuccagaguccacauucugcucuugccacagaagccaggucuuuucuacaguuacaaugguguggacagcuauucucccugcauaauauggauuaauaucacuucagaccuuuguguuuaggggaucuccuguaacuaacuccucuuguaccccaacuuaaacggacaaagaagcaggauuggaaucugagucagaaugagaaggagggcagggcugacagaucagaagagagggguauagccagcauugcuucccugucaugauuucacauagcucaaauaauagcagacugucucuagcuguccaggggagauaacugugugcuuuuucagaguugaagggcauggggaagcuguguggcuuuuaugacccuaaguagagcagagaagaagaaguggaaaauccuugcuggaagccucuaguggcuacagcuauagggaaaauugccagcaugccauaguuagaaugagcaagaacacuuguugaccuagcugggguccugcuauauuaucaguaagaggcuuugccuucuacugcuucuaacucuccccugcauggagacuaguuuugaggccucuacacuuuucaccuugcuaaagacucugcugcuaaccccauaggcugcuguugauuggaggagagagugcuauccagugauggggcuauccugggacaguuuuuccaucacugucuuauuagagcuagagcauauaugccaguaggaauuauaugugaucuuugaauuccauuguacuguacaguaacucaaagugcauguuaggcaaaauuacuaggccgagaggcuagucaucucagaaaguguuuacaaaauuaauuuauaacccuugguagguuucuaagaguugaagccuauuucaguaaacaacucuugguuuucuaauauacgucauaguuacagugaaugucucauacauguuuuuaucaaaauuuucagugcccuuggguggaaaauugcucacaaaauuguucaaauagaacuggccuucugaaacaaccauaugaugguaaauaaucucuaaagaggauggguaaaauugcaguacauagcuuggacuguggaacaccagagagaggcaggaucugcuuugcaucagcugugguuucagcuucccuuuccucaaaguaaagccaguguauuaguaccuaucuuguaagguuuuuauguaggugaagccacacacauauguauaugcagacacacacacacacacacaugcugugcuugggcuuccaugauugcaucaugauggguaucugugagugagggaccacucauaggaugugaaauaugguauguucuguggacuguauuauuacucauuagcugaugagaugaguggaacuguacaacucugcuuaucaaggagcuuggaggaaaggcaugcaggcuccagaagucagugccuguggauggagacaaauugugcugaucgauucuaauugcugaugcugucauuugaauaugaguauggcagaccuugaaagaugaaugaucagacuuuugacaaauaggucgaacgaacauuauuucuaccucauguuguugacuggcauuuugauacucaagagcugagucaaaucuuacagcugaggaggauugguguuacaugggcauccaucagucacauaguccugauagcuaccauagguacccaucagccacacagcccugauaaccaccaugggcauccaccggcuacacaguccugauagcaacccuguuaaguugacaacagggauuuucuugagaaaugcauguuugcugaugauguuucaaagaaauucuacaagugguauaguggaagucauuaugacagaaggaggaagccgcuuaaggaagacuauauggagggcaugcucuaacgcccaaugcaguaagucaugucuucugcaggacugaaaguuuauuuuguuuuuaaucuuuuacuucuuacaggcgaccucuguaaacagaauuauugcuggauuuguucugucagcucagcugaaccaccgaggcuuacaguuuuuagugcggugugagcaauauuuugcauuuucuguuuuucacguucuaauuaaauucagugcugacaugagaaugaaaagauuacuagaguugggauuauggaaacacauauacacgcacacacauauauguacuugguauguguggacugaucaaguuugaaaaaggaugcaaucugugaagaugagucuggggugcggggauaagcguagaagcaaaacaagugaaaagaaagugcggcuuuugggggugguacuuagacagaucuuucuggaucagucacgggacagaaagcugaagcagacuuccuaaccuuaaaauguuucagcugcaucaccaugaaugccuucaaucuaaacggaaaagauaaaccguggaaacuuauaucagugcuaauaucuguacaaacuuuuaaagucuugggaaaguuaguaagaaaaaugagucaauuuaccccccaccccaaccaaaugcagguaagaaaucacaaaaguaaguaaggcuaugauuuucaguagacgcauagaauagccaugggagaaauaggaauuuuuauaggaugcaguuuuaguuuuauguaacaaugauauuaaaggugauguuaacauccaggaacagacacugcugaggccuuggaggguguaauaggcauagccuuggugggauacuucugacgauaccuaucagaagucuuacauaugcauagcccuguccuuuaucagacgguaaucagagaagugugcugagaauguauacacuauggacagaauacuauuuaaggcaguucuuugagauuaauagcuuaaaaugaucauuuuuuuucaccagacacuguaauaaguaagguccaguguuagguucugaaauuacucauaggaucacgagcuccuaugcugugacuagaagucaugguuucgaagagccuggcagugugggaaaguuaaagacccuuaguagguggguggaugauaguaacccucaaaaggcugacagaaaagacucuagcaaaaugggaugcuuagagaucuuuggggaucuucaagagauacacacuuagguggguugacuuauguuacugcacuucauuaagcaaaaauaauguguuaaagucagccaacacuaagauagcaaugaguugucagcauaaaauacaauacugguugcaucuucuuaaauauuaacaauuaugguaaacuuauuauugaacagauggaaguuucauuccucugccauuacaggugcuguaguucauaagugugcugcagccauacaagaaagaaaggggaccacuugccuugcguuccagcaagggugaggcuaggaggaggggaaagaagagaguauacacucaguucaugcauguguguguauauaugugcauguauguguaugucuguauguuugugggggggcauuaugugaauguguguguguguguuuaggugugcauauguaugugugggauggaguuaagggugcugcuguucugcccuguguagucuugugaaaggacacagcccuuccuuuugauuuagcugugaaaugaagauacucagcaguuuaaucagcuuugagagaggcugcagacuucggcagcuccguguggaugaacagcuaucauuuuuccucguguuaggaaccagagcauccacaaagcgaugcuuccuauucagaguucugggaaaucuacagcgccacaggcuuugcguaucugagcuuaucuucagaaucuacuaacacuuugcacccaggguuguuauuaccugauagcugaggucccauuacuuggaguuuagaauuuauuuacuuauugguucaugaauuucaguucucuuaacugcaggaugccagucaaggaguagagagaaaggagguccuuggccacaucuccuucugccccacucacagagcccaagugaaaaggguuugaaauagaaaacagugaggaccaggcacccagugguacaaaaaaccggggggggggggugcuguuccuuaacagccccuggggugcuggaacaaaaggaaccuucuggaagcuagccauguauaauaacaacugaaaaaaacgugcuucugccuggacucccaggauggaccccacagaaccccaggacagacaugggugcucugccaccagcugagauggacacaucugugugacaacagcucuuccggaaggucauaggagaccuucccggcaacuuacagucacugaugauuuccagggagggcaagaaguacuugucgcagacgauggagauggccaugcacauguagaggauaaugaggaaguagauuacgauaccuccauccgugcucuccugcuuggugaagaacccuucgggaaacuccgaugcuggagagacagcacauugcgugcuguuuccugccgaggaaaaggaaaagaucacaagaugugggagucacacgucugaagcccacaaagccuaaacugggguauuugggagggauauggggaaguugguggaaauacgaguaugauucaaagccuuagauagccuuuguaagagauuauuucaugaaauaagcugauagaagagaguuggagggaggcauuauuacagcgccucucugugucugcuucuaaaugggaagaaugcacugaucaugucuccaacaauaagaagagcagcccuguccaccccuuggucucugaacuacuacagaacgcucuugaggacgcauuggcugaucaagagcgcuucccauccucggcagggcuccgaagcagagcagauacagcaggagucggggauggggagggggcaaggccauuccccucuccaucccacaucucuacgugggacuggggugucugggcccacugccaccuaccuguggcccuugggaggcgcgggggcagggagacaccacggacaggcagguaugcagagacccaaaagauccccagcagcaggacccuccuuguccaaguugggccccauuuuguccgcauuuccagcgugcucuuugcagugugugguucaggaagggagcaagggagacuuaugcug

SEQ ID NO: 1048 - RNA, 42689 nt, Mus musculus
ucgcggggccucguccgcucucgcgagaucccggccgccgagcgcucggggccuuuucaaaucgcgauccguuaccgcuucuccggccgccgccauuguagcgcucggagcccucaucgcggccgaggcggagcccgcggcgggauggccgaugccgacaaguccgaggcggccgcgggugacgacggcucgcagcagcaaccggcugagccgcggcgagacacgcaccccggcgagcccgagaaaccgccgcgcagcagcgccaacggcguuaaaauguauugucucccccgggcggccgggcgggagggcggccgggcagggcgggaggcgcgggcggccccggggcgggagcaggugcggugcuggcggccccggccucgggcgcgcggaaaaacgguccccuuuaaaaggcccgaggcuagccucauccucggggaggacccagggaugacaucaucgguccuuuccccucccggcccgguuccgagccccggugagggccgcgugugcggugguggcuuccaaaguguuagagcucaccgaacccauuguguuccucuugauuggcuuucgaaaaaggaggacuuggucuccuccacccacccggugaugguugugggccgugcaggcugguuuauuuauucauuuuuuuaaaaacacaaacucaguguguaguggccuucauuuuacuauaauucacuuacgauauaauuaaauuacugaaauauaaaucugaauuuggcaaaacugggaacgcaacccagggccucgugcagucuccaggcaggcgcuaggccacaaaaugacacccccccuccaccgaaugcagugcuuuuuuuguagaagaaaacccgagggcugaagguuggaucugucaucugugucuguagagaauuuagucgacguuaauccauaagaucuuaaguuguaaggcaguaggauaggggcagauugugcucggcuguccuugucacguggggcuaugugaaggcaaacauuuauuuuccuauggcuuauucuguaaaaacugaaguugaaaauaaugccaguaauuuguuaaaacacccuccaccucuccauccugccacgguagaaagcagugaacacaugcuuucugacaugaagucagaaaagggaaaaugucuuucuggcuuuuguguggaaauacuugaggcagugauuuggaccagucuguugaaaccggcugaauugaauugguugcaaacuagaugggguagugcuccucagcuucucuaugacagucucgcucuuagggugacaucauuguauauuuuuucuuaaccacugacaacguauuuaagaggaauuaccccaguucccuggggccuauccugagcuuuagaaguucaguguuugcuguuuuccugaugccuauauucauuuuugaaaugauauaugauauauguggagaggcacuuuaagagcguuccauuagacagagccuguuguguuaccuuugaauuggcuaggaauaccuuaaauauggacauucgucucccuacccaccuggugacuuuugaacaggaagcaucgugugagcagaacagaauuuugcagguaucagauuugcagggcuugaaagucagugcaguuugcucauggauggagagugugcaugcaucaaccaccgagaaaucagaaagcaaggaaagccuaucucuuaugccugucagaucuugggcuuuuucagagauuugcuauuaaaaauagaaaaaaaaaguggagugacuguaacaauauagucacccucugugucuuuggauucuguauucauggaguuaauggugaauuggaaauacccacauuguaucuauauggaaaguaagcauacaugauacacgcguuguuuuagguauuauaaguaaggcagagagugaagugugugugagauugugcuacgucccaugcacacacuguguuuugggaaagggcuagaguaucuggacucuagcuguggggugcaauggggcugagggguacaggguuguauuacuaauguguaccuaguagugagggugccacuguuuguuuuuuuuuuuuuccugaagaaaauaaucauugaaucuuauaauguugguauuugugaagcugguaucuaaacuucuauuagacccaaaaauacagugucuacaguugcauugcaggaugggaaaagaggugagaaagaaccauuuucuaauuuaaggagagaaaauauagggcaauuguuaacaguaaauacagauuguuuccuuauucuaauucauucuuuccauauuuucucaguguugaguagagaccaauguacucuaaggaauuucuuacaccucugcugggccagcguagguagucacagugaauacuuagggacuugaaucuucugugagucuacagugugacaaccuguggggugguugacacuuugggcugauuaccaugcuuucaaugauaagucauuaaaagaaauuugauaaccagacauugcuuuacaacauccacugcuucgaagugagccaugugcugcuauugggacuggaacaccuuguauuaaugcagucacagcagacagagggggcuguccuuuucauccugucaccuuaaauguuaaagguucacugaguauccauugaagaaauagaggaagacauuuugagauccugagacucauggaaaagauuuaguuggcuuguucaucucuagacaggaauuaaagauccuguuuucucugucuacacugaaguguuuuggaaggaaagcaguaacuauuuugugacucuucauuagucuuguaugauuacagauguauuuauauugugcuauuuauaaaauauucaacacuaggguaggaugaagugauuaaaagcaucgguuuuaucaugagugaaggucaaaaccaugauguuuugauuugcuauuauacaaugauuauuguaauugaacuaauuaauauaccugugagcucauguagcuacaucuuuuguaauuguuccaaauauuuuacuacacauugucuccagaacuugguuacuggaaguuuguauacuuaggcagacaucucauuagacuugugguaaugaucacuauacccugaugcuuugcguuuuguugaugucaugcaguauuugguuuucugugucuggcuuacuucacuuagcacacuguccuucagguugcuguagcuggcaggcuuuccuucugaacgcuggaucucucucucuaugugccucugucuguccgccuguguguguguguguguguguauauauauauacaucuggaauauguauaugcccauucccacccuucuuuaauuagucuuugaucuguaagcagacuuuuaguucaguuccuuaucuuaguuauuaugaaaaauauagugacuaugaguucagauauugagaugguuuuauuucuuuuauuaaauaaaaaaauggaauugcuagguuauuuuauaguuugguuuuuuaaaaagaaaucuuuaguuuuucucuggucagucuuuaaguaaacauaaagaaaauauccuaauaauguauuuuguaaugaauugucaagaguauuguaagcaaauguuuauuacagucauguaaccuucauucagccaggugaagaguagaggaacuuagugacugcuugagaauuguguguuuucacagugaauucauccgcugugaguagacaggagggaucucuucuuaccugacuuccccuggagacgcucagugaacucagugacagcgcauuguuagauacauuguuaugcaggugcuucuuccuaggagugaaaaaggaaggucuguuccgucugcuggagcuaggaaccagagaggagagagagaggccuuguagauuuuggcugcuuguuucuauucucagaaaugcaacuuuauucacaaggaggcacauucuagaacaauugagaagacuccuuucagaucaugccuuauucuuauaaaagaauaagguugauagagaagaagaugucccugucacaaucugaauagcuggugaagcaaguuugguucuaguguuucuuucuagauuacaggagcauuucucacagauggugccgccgucuguucaguguggauucuguuuguuuuugagauagggucuaaucuaagcccugacuaacuuggugcuuuuuaguucagacuggccuugagcucuuuugcuugucucugacuguuggcauuacaggcauggaucaccauuuuuggugaguuuggguuuuugucuguauguuucuguguguaugcacacauguauguuuucuuagagguuucucauugaaccugaaucucacugauuaggguagcuuggcugaccaguagaguucaggaaucugccauucuuccccaucccccaucccuacaugaguuuuuauguggaugcuggagauccuaaccuuggcacucagcuuugcaaagugagcacuuuaccaacugagcuauccucccaaccuccagaguguggauccugacugacaguugagaaauuaugacuuauccagcagaugguaugcuuaguugccauucuagauacaguguagagagauagcagagaagacagguuuuauucuuauagacuuuaugugcuuuaucuguggcaguguugucaccugcucaggagagugcugucuaaacagugacauuuuccuucuaaugccgcaagacguuuguuagcugggcgugguggcacacgccuuuaaccccagcacucggggaggcagaggcaggcggauuucugaguuugaggccagccuggucuacaaauugaguuccaggacagccagggcuacacagagaaacccugucucggaaaaaacaaaaacaacaaaaaaaagaaguuuguuuauagccuuccagaauugcucaccuuagaauuuauagccuggauuaugaaauuugguuuguuguuagaauaauccaugagguuuuuaagaaaucuguuuucuuaauuacucauagauuuugacucauuaaaguuuauuaaaaaaugcuuuuaaguuaacuuguuaaugaauuacuugagguugacuaaagcuuuugaguccuagggagauagcaaguugaaaaggugcuuuccucacuugggccugcguuugcucuccagaaccaugugaaaauauugagcauguauguccuuguaauuuuaaugcuugggagaaggagacaggauucuugggcuuaucuauuuggugagcuucaguuugaagacagacacuaugucaaaggauaggaaugacauuccugagacugucccccgcucuccauacauaugcucacagacaugccugugcaccugcacacacacauguaccugcauacugcuuuaaaaauguaaauuguaguuuuaaauauaaauccagauuuuuaucuguagggauuacuuuagguauauacccauaucuuauuuauuucuguauuaguauauggcaucauaauaguuguauuuugauugaagucuuauaaauuaauuuuuccaauuagguccauuaaaaaagacugcucaugauguguuuaauuuuuccucuuuaacuccagccuuucauuauagacagcuuuacugauaaaacagacacaguucugacauguccuauccuuuguucaacaugaacauauauaaggauaucuuuuaaauuuuucuguguuuaucuaaguaggaaauagauaaaacucaacauacaguguauuaaauaggcaaauagaugugcuguaauuuugauucugguuuuaagggaaagagaaaauucuagggaaaauuuguuacucuauaaauaaaaguuuuucagauaaucauuuauucaucucuuuacuucuuuuguggcuagugugggguggauaggagggugggggcagagucuuaacuauauagcucuggcuuggcuggcugccuuauaacuuaauauauggaacaggcagucuugaaacuugugguaaucuugcaucugucuccuagugcuggaauuauaaguaugugccaccauuuuuauaauaugagcuagcuuuuaauauuuaauuuaguuaagacaguuuuaagaauuuuuauuauauucacauuuguguggguauauguguuguguguguaugauguaugugugugagccaugauguucauauugauaucagaggacaauuuauauacucaauucucucuuuccaucuuuaacauggguucugguuuugaacucaggucaucagguuccuguaguaagugcccuuguggugguccaaacuggacuuuagaguugaagaaagcucagaaaguuaauucuccccuaaguggauacugagaugacucacaugcucccuccauaggucuauuaauauuuauuacguaguauccaucaugggaaaaauuguguuuggggauguuugcaaguauuuuuuuuuaaauuuuuuaaaaaaagauuuauuuauuuuauguaugaguacacugucgcugucuucagacacaccagaagagggcaucagaucauauuacagauaguugugagccaccauaugguuguugggaauugaacucaggaccucuggaagagcagccagugcucuuaaccauuucucaagcucuacaaguauuagugcagaaggaaaaugccugcugaugacugagaaauuaaaaggcuuggacaguauggagcucucaggccggcuuccugcuucuuugcugaguucuagguuaauugagaauuuugugaaguggcagaugugagugauuguuaauacacagaguucuuagaagaucaacucaagaugcuuuuguuugucuucuaauucacagggagaaugaugagucagugaaggaagaaaaaucugauuuaaaagaaaagucuacaggaaauaagaaggccaaucgguuccauccuuauucaaaagauaagaauucgggcacuggagaaaagaaagguccaaaucggaacagaguguucauuagcaacauacccuaugacaugaaguggcaggcuauuaaagauuugaugagagaaaaagguaacagugucuucaguaacuuacuguugucuuuguauaggaaggggaggacguaagcagacuuuauuccucuuagccacacagacucaaaaacgagagagacuuuucuuucuugacaugugaauuaaucuuuucuuuuuccuuccacuuggcaauuucauuacaaggaaguauggauaaaugaaguauuuuucuuuuugccaucuuagugggauagugaagccagcaucugcaugccaccaagaauuucguuaaagugauugcuuugucuuguugaaguuuuuuaaaauagauuuuaaaaggacuauugcauuaguuaagcaaugcauuuaguuuguuaauguaugcauaaaaagguugauuuuuuucccccaaagauguuuuugguggagucuggaaucuggcuguggaauucacuuugcuugccuugucacgccugccaugcugcuguccucgcaguucuguuaaaugugucacugcugcugcaguucuguuuucagaauagcugaaaacuucaucuucuacacacgcuugguuuugggggaaaacaaugucaauacuugaucuuguaaaaguuaguucuguuaguucuugaaaaauugagguucaacaguccugcaaacuaucuacuuggcuuugagggugaucuucuaauaauuuuuuaauugcauugguguaucuguuguaaggugacaacuaugacugguuuuacucacugacuuagaaguguguggcuggcugugaagcauuacuuaguuuacugauggcaaacaugauugaagacauucagguaggaagucaccuuaaaacagcuguuguguguaggcugaccaaaguuaccugaaaagugcuaauguuguuaauaugacaggcugaggaccauuuguauguauaugugcauuuguucaccaccauaccaugcuggccaaguacgaucugcaguaugaagugggcuaacacgguuguuagcuuuucuagagaauguggaugaggaaaucucugaaaauuaguuaaauuucuauagcuauugauaggagguauguugaucugguccugacugcuggugaauaauaggugcuuuucuguagaguugugcacaggugugcaguaaagcaagauacugguguuuaaauguauuguuucuugguaucuuccuuuuguaugucuuauguaguuggugagguuacauacguggagcucuuuaaggaugcggaaggaaaaucaaggguaagugcugugggccauaaucugcucgagguguaaaaguuccucagcaguuuacuuuuguauaauucucuaccagacuuggaaacuuaaguuucauuuuguuuuacuuuaagauuugagguuuuaucugagcaagucugacauaugccaaccaaacuagcuaccugaaagggauggguuuuguaaaugcuccuaaagggcauucauuuucuaaugcuuuaagguaugcuuuuucuuagcuaauaaaacuuuaauaugcucuuuguuguauuuugaugacuucagggauauuuuaaaagucaccgaauugauaacauccccuaagaguuucaugagaggccuguggcuuaaagguguuaauuuagaauauaauuuugaaacuuuuauugaaaagcuuaauuuguuagccugcaggaccauguaagaggcagugcucugaccaauugguaugaaugaugucuaugacuaaguugaccuggaaggcugaugauagauucugauuuagcagcaugaguauaccgaagauuauaacggaaagaucucuagcagcgucucaucauauucacaaaaugguuggguacaugagaaauauaaauaauuuugucaucauauucaaguggcaccuugaacaguaaucucaggaauuauuuuuaaaaaaugauucuguaaguuucuuuaacaugguuaauuuguuuuacaugcuuccaguuagaugcuucuaaauugugugcagccaguuuuaaucuaauagauaacuuuauuaaaagcaaaauugaugggggcuggagagauggcucaucaguuaagagcacuggcugcucuuacagaggacuuaggcucaauucuagcaccacauggcagcucacaaccaucuggaacucaaguuccaagagaucuaacacccucuucuggccucugugggcaccagacucacacacugcguauagccauacaugcaggcaaaugauauacauaacaaaagaacauugaaaauucauauuuauuugcuauuuuaauuagauuuaaaaaguauguugugcguaauauaucuugaaaucuuuauuaccguguaagagaauauuggagccuucaguuucuuccuucacuuacuguugacugaauucauacaguggugcuaguuuuaauuuuaagaaaagucaccugaaaguaaaauguacuacaagcuuguaacaugcuagaugguuuuaaaaauuuguugaaaaugcauggucacuugccuguuacauucuggagguguaaaagaaaaauaaaauguauucuugauuacuuuuuaacgacuuaaaaauuagaauuuuccauuaaauucaucuacugaccuaaaaugguuuuuuuucuuuugcauauauugacaaucuaccggauacaggguuguggguaagaauuuuuuuaaauuaucuuacguuaaauuaaucuugugauugggaauaagaaaucuuuguacauaagcauuucuuauauauuuuccuuuauuaagcgugguugaauucaaagaugaagaauuuguaaagaaagcauuagaaacuaugaacaaauaugaccuuaguggaaggccuuugaauauuaaagagguaaguuuuuuguauuuguaauuuaaauaguuaauuuuaugagcaugcuuccuuuguuuuucuuucauuuuuuuucucauguaguuaaaugacuacuuuuuuaaggauaggugcuuauuuaaaaauuguagcuugugauuauuuuacuuaagagaugauuugcuauuaauccauaaguuauucuuuauauuuauuuagcuucuaguuacagauagauagaaguccucaauuuaaaauaaaaaucaggacccaaaaauuuaaagaugacaaacuuaagguacagacuuuauuugcuauauaaacauuuucaauuuuuagacuuugagaauucaauagguauuguaguugauuacagguuguuugaaaauacacauaacuugugaauuugaauaagauugguauucaucuuuaauaaaauuuagauuuuguagacuagaauuuaagaagcauagcuuacugagguguguaacaacuuagaguaaucuacaguggggauuguaguauaaauagauugacaaaugaucagaacauucuuuacacaauagcacuugaaggagugguuuaucuugguaauaauuaguuugaguaauacucaguuucgugggcuguuuuuugugggcucuuuuguuuuauguuguuuugccauauuaguuugaucaugggccaaacuauacauauaucauugcuaaaccuguauugaaagaaaugcgcaguguuauuuugagucugauauguugagcuaauacugaugcuguucguugacugguauucaacaagagaacagugguuuuugaguuguaauuuauucuuuucuggacaagugauaauacuuaugaaguauucucuagacuuuacuuaauuuauuuuaaugccacugacaccuaaugugacuuuaagaagauuaagugugauaauaaguuauagcucacucucugucacuagaaaagcuaagugacccaggaagaacaaaucacauaaccuuuguuuccuugucacugagauaggagaaauacuagaaaucccuguuagugucaaaguguuacuaguuacuauacuagugauauuauagaaggcuguuggcacagugcuuaaaauaguccaacucuaucauaaauguuagcuguaaaaacuauucuuguuagugauuguugguaucuuguucuuuagugugaugauaagcuuccgugccuuaguaccaaaaauaucauguauccuacauucuuuacuggaauuaacuucaaauuaaagagauuggcagagauuugguagggaauguuuaaauuuuguuguuugacuagucauuuauuuggugcauuuaugcaugucuggacuuaacuuuagaaaugugcaguguccuaaagaauuugucccaauuuauaauuuucuaauaauuugguaaucauaauuugcagcauauugaagagcacagaucuauuguugagaccccagaguaaagguuuaggaugccucuauuuuuagcuauuuuagaaggagaaauggggucaaauuuaugagugauuuauuuaacuccuuagcuaauguuuaacaaugacagucauuuuccaggaaauaucugauuuauaaaucaguggcugguaaaacuacugaggacggcuugcauaguuaucuaaugaagauguauuuacaguguucccuagcagcuuuuuaguauucuauccaguuauaugaagaucaguaggaaucgaacauguauuauuaggcccacuaauagcauuagcaguuagugauuggcaggcuggacagcaaggggaaacaggaauaaaaacuaagauuacauaugguauguguguguuuguguguaaaauauauauuguguuaacaugugacaaaacacauacuauuaacuauuaauacaaacaaccuguucuaaaaaguaauuauaauuaauguaaucaagguuauucccuacaagcaugcccagaagucaucccccugcccccacgacaacuaacagaauacgucucaacuaacaaacagaaugagcacuaagcauccugacuacuuacuauaaagucuugccacauucuuuguuaacauguauucaccucuguaaucuuuuuuaauuccuuuaucaugaagaaacacaccggaguccagcguacguuuauucugacauucacuuuuuuccuuuuguccuuuuagcuaugcuggagaauuuauuaaagucaucuuuccuuauuugcuuuuuuaaaucaauauguacagacugagauagcagagaaguuuuuggugaauauuuucucugagaauuucauacaauguauuuugaucauuuuauccuuuuucucccucagcuccucccagauccauuccuacauucucacccucccaacucuuuguguuccucccaaauagcuuuuagaaccugaguccacucauucucucucucucucucucucucucucugcgggugggggagagggguagcauccuccucuguuaccugguugaccugccagggaacacaccuuuaaagaaaacuggcucuuucuuucccagaagccaucaacugccaguagaugccucauagguaggagcucugagucccuuuucccuccauguuagaauguuggcuagucugauguuguguaggcaagcauaaaugcuguuaaugagcucaugaaugagaaaguagaauuucugguaugaucauuugccuacacaugaugguccucuuaauguaauuuuauuugugcuuuguuguugaucuucuaccuaauagaagcacauuuguacuuugauuuguuuuaauaaaggauauuucuuuuaaaaguuaaaugaacuuaaauauauuugcuauaauucuuuacuuggacacuuggcauucuguuauccccuuuucccuucacaaguccuuuucacuguucaggaagcuaagagauuauacgaugaguaaggagugauguuagccagugauaauaaacuuuccucuaucucagucuaccugaguuuauaguaguguguucucguagugagagggucaaucuacaggauuuuauggacucacuuucuggauaaaaauaacaaaacccuuaguccucacagauguuaguaguuugguccagcuggguuagcugcuguccaacuuuaagccacuugaauuguauauauucacugauguauuugcuggcaguuaacauucacuacacauuauaggauccggauggagaaaaugcucgccgggcacugcagcgaacaggaacaucauuucaaggaucacaugccuccgaugugggaucuggguuggugaauuuaccaccuuccauucucaauaauccaaacauuccuccugagguuaucagcaauuugcaggcugguagacuugguuccacaauuuuuguugcuaauguaaguuuaagcuuuaguuuaagcuuuuguugcuuggauacuuagcccuuaucaugagauuauuuuguuagguaugugcugauagguuuguagaucauuguuuauuuuuaacuuaauagacaaaagucauaaauauguuaaaaucaaguuuaauuuauauauguaauuuaaaguuagacuuaaaauacagguagcauuuuuaacucaacuggaaaucauagacauugaacaguuuuucuuaagucaguucuguguguucuuuauuuugguaguugaauuuuauucuuguaguccucauguuuguaaaugucuguugugguugcuuugccauuuguuuuaugcucuugaaagucuugugaaauggacaguuuucuaaaaccugauuuuuccauaauuauaauagaugccuaaguuucccaugugcagaauaggauugaggaauugaaagaugaugugaggaguuuaaaugaagauacaaaacaagauagauguagcugaacugauuuuaaacaagaccuuuuuuauuucaacacuguugguauauuguugagcaagaauuacaguuuauagauuuaugagguuaaaaaagauaauuuguuuuuacaaugagagagggccauuugcuaggaauuuaacuuuaugcauucuauguuaagcuugacuucaaaguugguuggaagaaauuaaaggaaguguucagcauagcuggaacugugaagcgagcugauauuaaagaagacaaggauggcaagagcagaggcaugggcacugucacuuuugagcaggcaauugaagcaguccaagcaauuuguauccugauuguauuuagcauuaaauaucguuggucaggcuugauaccuuuguacaguuguuguucauguuauguaaugucaccucauuuagaaauggaggcuuuugccuacagcaggaaaccuuguuguuucuugaggacuagagucacucacuuaaacuggaauugauuggccacaguguucagggcugauaggagcuuguuuucugcugauccuuccugcugcuagacagugugugcgcacucacguucuuuaacacuuaacuccguuguguguaguugcuguugguaaaaccuaguuaauuuugguuaaugaaguuauaaaucaaacugagagacuaguugguaugaauaaagucuaaugauguuaagauaguagaaaaaguuucagacucuuuaaauaugauaauuugccuguacaauuuuacagucaucuuaacuggcuuuccuugacugaaucaacagccauguucaaugggcaguuuuuauuugauagaccuaugcaugugaaaauggugaguucccacuucucauuucaaccuuaguuacuaauugcuucagaucucuuccuaacauaauagcucuuguuagcuguuuuuaaacuauauguauaauaaacuucuuuuuuuuuuuuucuuuuugcaauuaggaugacaaaucugucccucaugaagacuaccguucacaugauaguaagacaucacaguuaccacguaaguaaaaacucuuguuagaaaacagcuuucuuuuucuucauuaugucuaagaagaagucuguuuuuaugcuuacauugaaguuguucacucucugagauuaguuugggguuuuggacagugugccacuucugauuauggaaagacuggaaagaaauaugggacuuuuaaguuaauuuauuuuuuguccuacuaguuaugaguucagauguauuuggugaguucauauauaagaagggaggagaucccuauaauuuuaccauagauauccaccauuuuuaaaaacauuuuuauguauauucuuucuauguaugugcauuuaacuaguuucagacuacuauauaaauuauuuagugguugagcuuaacauuaaauugcgaucaucuuuccauguugaaaauucuuuccagauaucucuauuaguuuucuauaaucguuuuacuguuaacauguuuuacauguuuuaaucuuuauuucaugaugcaauuucaugaaaguauuucuuaaauucauagagauugaacuuuuacuguaccucacagccaaguuaauaucucuugaacauuuaagaccauuuagucugcuguccuacuauguacucagccuaaauuuagccugucuuuaagagaacaauauaauaaccaagcucucuauguguuggcucucugugcagucagccuuuacaacauaaccuaccuuuuuguuuuguuuuuuuaaagauuuauuuaucugucuauuuauuuauuuauuuauuuuauuuaugaguacacuguagcugucuucagacacucuaggagagggcaucggaucccauuacagauggcugugagccaucauaugguugcugggaauugaacuuagggccucuggaagagcagccagugcucuuaaccgcugagccaucucuccagccuaacauaaucuaccuuuaaucuuaaguuaucuacuacucuuccaugcccgauccagaauaauauauguguguauauugugguaauuauuuguugaaaacagccaacagguugaaaggggccuuaaauauccaccauaaauguuggaagcagcauaagauauagcuugguaaugucuguaugcagcauuuuuuacuauucuggguaaaaguucuguuacagauuucugaagaacuuuuuauccuuuccuaugcuauguuucugugcuguuugauaaauacaggacagagcucuauguuagagagaggcagacauagggacaaucagacaucugaacaguauucaggcagucacagacacauacaauagacagacuguagauaguucaguaaccagaaauuacaggcaaauggaagauacaaagacaaaaguggaaaauucaaauuuggguucagucuuagucaaauuaaucuaagaggagggcuguuuuuauucuuuaaugugaaaaugauguauuuuggugcaucugagauuaucuuaaauuacccaguacaacagaguaaauuauacuuuucauagaaaaauauuuucuuuagauuuucugagucaaguuugguggcacaggccugugauacuuaacagacuaaggcaggaaacucugaaguucaagucuaaggcuugccucaccuguagagugaguuccaaggcaaccuggauaacauaaugagaccugucucaaacugaaguaugaaggcuggagauggauucaaugauaggaguucucaccuacgguggauaagucccuaggucuagccuuagcaccaaaagcaagcugacgucagaguaguauuuagugauagaacccuugauuagcaugcaugagauccugaacucagucccagcacugaagacaaauccuggaggaguagauuuauuuagauuuacagaaugucaauauaugcccacuaauuacucuauuccauugcauuacaaaauccucccuguuguuaauauaaaaaagaaaaggccgggcugaggcauaaaauuuauuuaugcucuauaguucugccugaauuuuagggccuaaugaagaaaccugucucagugggauuucuuaacuuuuuuuaugguaaaugguaucuggauaagacuguccuuucuguccuaguaaacaacuagcagauuagcccugagcuguaggcucugacuuuauaauguuaauuaguacugaauagguaacugccuaguugaauuuuaaguagucugcuacagggcguuggaacccuggcaaggcugacuauaugaauuugaaaggcacuuuacuaugaauaacacugaaggagaguacuuggauauuucucugcauucuugguugacaggcggcuccuuaguacaaggccaauuggcuuuuuagggugggaggcugugaagggcuugcccuucuggcgauauggucuccaaccucucuuccccccccccauuaaguuuaauaaggccacgcuuaacugaggugaucaagugauuuuuuuuucauucguagauaaguguacuuuaaccuuggcuuggagggaaacugacccuauuccucuugugggugcugucacgacccacuugugacucuugguauuuuuuggggaggggaggcagagccuuagaaagauauuuuugguuauaauuggaacuagauaucaaccuccaucuaaaccggguguaucucacagggaauccagaaauggucaagcuggaccuuccccugcaguaaauuuuugcacccaagcgguacccauacuguauuuguaugaucacgaaucaguaugcacaguuaugaguacugugcagcuccuaaaggagaauugucaaccucagaauuagcaaggccucgacaagaauuaugucauuaguaacaccacaauuuguggcuaaauuaggagcuggaggucacccucuucaucuccguuauucccacagccugaggaacuaaggggaccuugcaauaacagcaaggguggaaaaccagagaccagcuaagggacuaagcccgucuaucagaauaaaaaccaaucucuuuuaauauuugaaauuuuugccuuuuuagcccucguaguaaacuuaaaucucaaaucagaccuaaagccacaauacgucuuagaaugaaaauaacagcugccucuaguacgcucuagggggcaaggaugcacgcccacugcagucuggcugaagguguugauugaccugcuugaaaaaaacaggaucuagacaaugagaaaauagcaaugcaaagcuuuuggggaagaccagguacuuuauucaguuguaaauuagcaaggcacaagcucagucucugggcugguuuuagaauaguaaaaaggccagagacauucuggaagugggggaugugcucugaauuaacuuugcuaggaaauuaagaauauaguuaucuacaauaggaaucucuaauguuggacuaaauauuagaccagucuaagauugaguuagaaugacuggucacacuggagaaaagagaaaaaucauuaugacucuauuaaaugacuaaucuuacuaagucagaauauacaaucucugauguacuauugccauaaaguuaaaaggcuugaagcuagucuaaacuggaaaaaugguaagcaaggauguuuuugagacauuuuccucccacaugaugcaguuuuuuuuguuuuuuuaaaaauuuuuuuuuuauuacguauuuucuucaauuacauuuccaaugcuaucccaaaaguccccccccccccuacccacccauucccauuuuuuggcccuggcauuccccuguacuggaacauauaacguuugccugaccaaugggccucucuuuccagugauggccgacuaggucaucuuuugauacauaugcagcuagagucaagagcucugggguacugguuaguuaaaaauauggaaugcuucacgaauuugcgugucauccuugcgcaggggccaugcuaaucuucucuguaucguuccaauuuuaguauaugugcugcugaagcgagcacaugaugcaguuuuuuaacugcggccaucgccugauuaguaauuucuuuuuaauaaacccuuucuuuauucacgccuaaaaauguaguuucugggagcuacggcuaaccgccuguuacguuccuagcuccugacaugacucacugcugaaccuaagugaauuagcgcucagguuaaacgcuguuucagcuuagcccauaccgaccuucuccgguaugaauuuccuuuaauuauuuucuucuucuauugagcuccaaaccagcaguguuucuuccaaauguccucugccguuucucagccccacguugggcgccagauguuguguccagccagcggcucacaugucuggguucuagucuggaaaggcaucuuggaaaccuggaagagaagggggcggggcuaggcggugcgagagaaagauguagcuaagacaaaauucugaucaaagcucaauuuuacuauuacgacacucaguuaugaagcaggggaagggacccgauuccugccaaaucaucuuggaguaaaguugcagguggacacgugauaggucuggaacagcuaguuggcaggcagcgguagugggaguggcaggacguuagggaggcaagcucugccccaugcucucuuaugcugaaaccuucuauguuuacuaaguuuguuguugauugucuuguauccuuucucuuuauauaauuuuaucuauuuggguuaucaguuacugaaaagugcuuaaugguaaauuuuuuucaguauauugauagauuuagucacauuuuucuuguugaaaauauuuuuaaauauuuuaaguuagcaaguauauccaagauuagaauugucuuuccuggugaagcaaguaauuuauuacagggugauuuuguaauuaccuuaaguccuuguauaaugcuaaguauaauaauuuuguguuguuucuuuauacuauuuuauauuacuguuuuugaucuguguguaaauguuauagcugcaauuacaucuuuuaaaauuggcuugacaaucuuuuaugugaaguugaggaauuaauuucuucacauuuauugguucauuuggauguauuuucauuuucuuacuuuggguuucaucuuugguacuuuguaauacuugucuguguguuuuuagugguaacccuguauauuauguauguauaaagcuuaaaguucauuuuuguauccucuuccuugacucuaacccuuuucugguaacuccaugcuacugucacucucugggaguuacuugucggauauuauguuucucuauuaccugcuacuauucacuuucuuuugcagcuucuauuuguuaagcuuuuauuuuauuuuuucaacaaggauuuauuguuaguaaauucuuguaauuauggcugcucuguaaaugucuucuaagguaguuugauuuguuaguucaauuuaagaucaaguuacuuuaucuuagcacuuugaaaauaguuuagucuucugcuuucuguuguugcuacuucauaauucagauaagguuuuuuguugaauuauaccuuuuuuugguugucucuuauucauggagcuaauuuuaaaguuuuggucccugguugacaguuuugcugcaguuugaguggagguuacuacugacugagcuuuugcaguggagaauuaucagccaugcauaguugaguauucccuuuauaaggcagcuucuuccagucccagguaaucugguuaggcucaccuuguugaagauccuaacuguauugccucuauuaacaauaaauuuuagugcucaagaccugcacuguuaagccagcuguacucucagccuggaugagauuggcgaaggaugcgugcagucccacccuuaguugagaacuaauguugcugaggaagagagacuugguuuucuucagaaaacaggaacgccucuguuccaauugaugucccugcauccaugcaaaugcaguacuaagugcacuuaggaggcaaagcaacaaagaagugugugaaguugggaggcagagaugcggguugguggagggcugugguagggguugggaaggagugggcaauaauucagucaccauuuauuuguauacaugugugacuuucucaaacaggaaauuaaaaaacauguccuguuagguguucuuuacauuuuuaaaaaugauuuguauuuucauauuuucuuuuaucuugauauauaauaaagucacaagcuaccauagaaucaaauuuuuuacuacuuucaucugauuuacucaaauuuuacucuaacuugacaagugggaaauuucucauuuuccaugcuucugaguucuuugagauuauaauuacugugacaucagaauugacacaauggugauuguauuuaugagcaugggugauggucaggucugggucacaguuaggccuagggacacauuuacuugauauuaaucuguaguuuaaaauuaccaugucuguacacuguuuuaaaaacaacuuacagaauauaauucuuacucagccccaagcuuuaauugcuacauuuuccccguaacugggccagugcauuguaacagaaagcuuuggucucuuuucugcauuuuugggcuugaccuccccuucacuuguuuacuuuaguccugcauauguuguaggguagggagggccuacaggugagggagaaacacgcagaguccuuucugaguuggcucaccacauuuaauauuauacuuucuagcucaccagguuuuuuuuuccuccaaaucgcacuuuccuuuuaacauguuuuuauuaucuccaucuuuugguagacauuuaguuugguuccuuuuuuauauuuauuuuuuuccaugguguaauaaagcaauaaugaacguagauauauagauagauguguaaggauuugaaguucuuuggacauuuguuuaggagagguuuuuaacuuaaguuuucuacaguuacuuauuuacuuauuugcuuauuuaaagagcaucagaauauuaaaaaaacaggacaagcagaaaacaaaaucugaauuuaaagaugagauaagcucuaaauuuaaucacauagguaaauggugguguucagauaauguaaggucugaaauuuuuccucauauuugccugauaugagaacacuuauuuuguaaauguaauaaauaaaugucaugauaaagccaagcaauuagauuuuucaauguuguggguuuuaaaaagauacuuuauguguauggguguuugccuguaucaguuuugugcagugucuggggccagaagaagguguuggagucacauuccugaguuauacacgcuugugauuugccauuuggguucugagaacugaacucagauucucugcaagaguaacaaguguucuuaaucagugagccaucucuccagacccuuauaacgaauuuuaaaaaugguuguuuggucuuguucuguagcuuuggcugacucugcacucauagaacuguguccgcugaauaagcucagucuuaagucuucaauaauuguugacuguucaguuuuauuugaacuauuuugaaugcaauacuaguauuuuaguuguucaacaaacugagcaagguacucauuuucagguauguauguacugugucucagacaucaagaggaugucugagaaauguaucuuuagccagagagggugcccgccaaucauuucuuuaggugaaaugauucacucaagucuuauuuggugaauuggugcauuuaauuaugguaauuuacaggaucaugggcaacucacaggugcaauaccaccaagaaauagucauaugugucaccccuccucucacuucccaagccaaaaguuauuuccuccaggguaucacuguuuguuaucucuugucaguacacuuaguaaucuuaguuggcccaaucuuggcagugucuccugugggugaucacaacugcucuaaucucagguuggcaauaucauaaccgguccuggagaagagaguuccauaacaugugacauguguuucacacuuucuuggaugcauuuuuuggguguguaugcauguguaugugugggggguuggagugguagguauggaagugaggcuagaagagagccuugaguguuuuucuucaggcagugucuaauuuuuuuuuuuuuuuuuuuuuuuuuuagauugaguuagacuuaguguuuuuagacugaguuucucauggccuggaacuugcugaauaagcuagacuggcuagccauugaucccuagggaucugauaccauaccagaucuaagauuuccaugcucaacacaauucugguuuaaaaaaagugcuuuucaggaagugaaagcaggguuucauguuuacaguggaagcccuuucucuacucauggagccauuuccucagacccccucuugucagguugucucuuaguaccuuuaaguggaugaaggcugaaccuacucuacaaaugguuugucacucauaaaugguauuguagucuuuauguauggugcuuucuaaaugaaaagaagaacccuugcuguuugcaaccuuuuaggauacuauugcaagcauacagcuaguuuuacagguuagugucagguaguuuuaucugagucuugguaaugcuguuuuuugugauuuagguggucuuggaggcauuggaaugggacuugguccagguggacagccuauuagugccagccagcugaacauaacugguguaaugggaaauuuggguccaagugguaaguuuuucuuaaaaccuguguaagugaucuauuuugugguuuaauaaagcuuauauucauuaguuucagugcuuagagaacucuguuuuagagauguuuaagaugucaauucugucugaaaaagaaaagaaaccuugugagagucgcugacaugaaaagagggcagauggagguugggauggccucuggggccaggcauguggaagguagcccuucaguaugugcauacugacgugacuuuaguagaugaugucuccacauggugcccucuacaugguggaauaaauagagggucuauggaauggguggcaacaugccauacagagcacgggcaauuuaaauguauuacauuugauagguagcuuugaaguagcuauuugccugcuaguuggacucuuaauuaucuucagaaauuggcuuuccaacuuuuuuuuuucccaacuuuuuaauuucagcaaacuucauucuuucaaguuuguugaaaacccuaacaucauuuuaauuaugugacuguuucccagugucuacuguauuauaaaaaacuuaaaauuguaaaaauugacuuauucauuuaaaaguacugauuaacucugaugccaaucuuaacucuaaaaauugauguauaaaauaugaaacauguaauuaacauaaguauuauuuuuaagaaaauaaaguauuccuaauaagaaugagaagagugauucuguuuuuggcaucuuauacuguuuggguuaauguaaauagcuguacuacugugucugcauuuggguuugcuaugauaacaagcaucggguaguuuauggaaaguuccacauugucaucaugagagcaugagaggaagcagucauguaauucagaaguauugaguuauagaaauuauuuugaccucuugacccuucaaagguuaccagauuauccuuugagaauugcauuccaguuuaugggcugauaaacgugucauaaucuuuuuguugggaugauacaaacuuuacaguugauaagguagugucggagaucuuucucauucucaagcaaaaccccuuuucuuauuuguuuuaggauauaauacccuucccaucuaaacacaagcuacuuguuauugauuugaccagccuguaggcugcuguguuuacaggcaucuuugcuuuguagucuuaaucucuaaaucuucuauggucacauccuuguauuugaaagaguguacacugguucugguuacuucugacuggauguuguaugugaacaguaaacuuuuuuucuuguaugaugcucagaggccuguuuugaagauuggugacugguuagccacuaugacauagcucuguaaaccauccuucuauauacacccuguaccugcuucucuaguguuccguugugacuaaaccaaugguauuuacuuugcuauaaugucauucguuagucacaaaauaagauuuacugaaaguccauacuauguauuuuauuugagguaugggaauggaugguccggguuuuggaggagugaauagaauuggaggagguauguauaaguauuuguuucugcauguacucaccgccauuuuaaagaaacuagaaacuguugagaauuguagaaaacagucaugguuuauuguuggcucauguucuaaaggcuguuggcaaacauugagccuaauacaccuuuaaaggauggugcuguguuaacuaccugcucaacaugaaauggaggaagcgcuuacuggugacuuaacauuuccagaauguaccacucaucugcagagcuauagucaagucucacaacuauucucuauuucauaggaguuggguuugguggucuggaagcaaugaauagcauggcaggcuuugguggaguuggccgaaugggagguaggugaauguacucagggguauauuaucuuugcuuuccuuaguauugagauacuucacacacauacacacacacacacacacacacacacacacacacacacacacacacacacacagcgguauagauacuauagaagucuucagaaggcacaugggcacuagagaacacuuguaaacaugccaggaagggggaagagggauggguaguggguuguguagugaguguaugaaauaaguugguaugccacacacuauuuugaauugguaacuucugauuuuuuuucuccucaguguagcuuagacauauuccucaaugguuuccaugcauugauguacuugaagaaagguuaauuugcuguacaucuuuucagagcuauaccguggugcaaugacuaguagcauggagcgagauuucggacguggugauauuggauuaagucgaggcuuuggcgauuccuuugguagacuugguaggguuggcuguauacuuuuuuccuuuugcaggucauagucuuaacuguucuuuuugguguaaaaaaauuguuuuaaaaguuauaauuuacauaguucuuuacuagaagaaaacauuuuagggauuuuaauuucaugguucucuuauaauuuacauaguucuuuacuagaagaaaacauuuuagggauuuuaauuucaugguucucuuuuacgguauugugaauauuuuaaguauuuccagaaaauuuuauguuuaguuauuugugaguauaguaccuuggacauuuugaagugucauuauguaaauuaauuaguauauuaucuuuucauccuuguuuaggcagugcaaugauuggaggguuugcaggaagaauaggagcuucuaacauggguccaguaggaacuggaauaaguagguuuaaauuuuaauagaauuuacugaguaguauuugagugcuugcaaggaguuuguaagaguaguuauuguaguacaguaauaguuugcuuuuauuuguuaaugugucuuaccauauuuugagaaacuacugagucauagcuugauugguguuugaaaaaucaacuccuuauuuguuuguuuguuuguuuguuuugauauuucucaacuaacaccagaaugcguauucaguagccaguccaugaacugucuuuccacacccaugucauaaguuguuauuucuugaacacccucucaauucugcuuuauuuugcccaguaucuccuaguuuguuucaucugugcaccuuaugccucuggcagauggagauaaaacaccaaacuuuuaaggacuuccugaaguugaggaauaagaaugaagagaugguugcuuuccucucuuccuagaucuuucaaaacaugaguguauugcagcucuagagaaugcccacuacccccauuagcucccacuuccacagaaagccugcacacaugcuagauugcauuugugacgggcauuuuggugacuugguugucccuguuaaaucuccacaccuuacuggcuuucuuugggugaugaaauuuuaggaaaaagaaagucaaguuacuuagugugcauucugaaauccuguccacuggauacauuugcuuuccaugugcuucucuuuugauuuccugcucugcccgacauccugcagccuucauuucccucgggacuauccucaccuucccuuuuaucucagugguuauggcucugucuccccaguuacucugaguaacagagccagcuggcaagucuuaguacuuuuuaaugcucauguaggaauauuagggaugagaaugagacuaggcuaauuaguuguaugugguuacugaaaguugaauucgauauaaaaauugagguugugggaaacagagcuccacauacugagguaaaaggugaggaaggaaaggaugacguguagggaguguggugagagaccugugugcuggagugugacaguguuuguaucucugugcuuugguuuucaacaguuacuauauuugcuauuguaaaauauaagaauuaaaagcuauuauaauaugaaaguggaauguuuuauaauaugauuggaaggcuuaaauaugugauguuuucuuauuagaauauuaguuuauagaggcacauguaauuauguagugacuaaauuaaguuuucuuaaguaaccaacuguauaccaaaauauauuacuuguuuuauuuucuguaugaaaauaaguuuguuauagaagugaauauucuucuccauuuucagaacugauuuuucuuuacuccauccuuucucgucuuuucuuuugcuuuuuuuguuuuguuuuuaaaaccugaaacucgcgacuccuccugcccuuguuggcauugcaggcggcagcaugagcggcaugagcacugugacuggaggcaugggcaugggacuggaccgcaugagcuccagcuucgacaggauggggccaggcauuggagccauacuggaaaggagcaucgauguagaccgaggguuuuuaucaggucccaugggaagcggaaugagagacagauuaggcuccaaaggcaaccagauauuuguuagaaauguaagcacauaaauguauugcaaaauuaaaauucuguguauaucuuugucugucucuuuguaaaauauuaauuuaucauuauuuaauuacuuucauguauaugaaaauauaaauauuauguauaacauguguuacuaauuuuuucauuuuagcuuccuuuugacuugacuuggcagaaauuaaaagagaaauucagccaaugugguaaguauaccaguagcugcagauuacgcugauauuucuuguggggaaauuuugaguuuuaaacuuugagauaccauguuuagaucuuggcuuauccuaguuauggucuugucugauucaaccucagaugaguaauaguuuugcuauuugguagauuagaacaaacaacagggcuuacuuaguacaaacucacucaauggggaaggcuaucaucauuuguuauaaaacaaucuuuuuuauuacuagauuuuaaagaaguugaugguuuugcauugaaaguuuuuuuuuccacgagaaacaaaaguaaauaaauggcauauuuacugccuugcugaugcagaguugauggaagauccauucuguauacuuauuguuugcacaucguagaaaccuuaagccuguagcauaggacucugugagacacagguacauuuugguggcucuaauaguccuuugggaacucuucuucacuaucaugagacuagcuacagaccuuuauguuaacuuagguuuguauauugacugguuuauuaauuugaaauaaagccuuuucuguacuauacacaccuuuuaaguaaagcuccccccccccccaauguguguuugaaagggggguggggagaauuaaaauaggggaauuguguggucagcacugagcaacaguuuuccuuccguuacauagaauccagacucacagcaggaagaugcacagacagcacguuaugcugagaguagugcacuugccucuuagaguucacagaguggagaacugccugccucccuucauagugcugagauuaaaguugugcaccaccaucccucacaucuugaauauuuuuaaaggcauaaaauaacagauaacuugaguguucuucuacaauaauaauaacuuuccuagcugaggcuggucguccagccuguaauucuaacuacuugagagacugaggcaggauaccccaaguucagggccugccuggaccacagagucaauucacagccagcuuggacaauuuagugagacugucucaacauaaaaauaagucaagagaggauggaggacacugggaaaacauggcccacugaguccacuagcaaggcucacauggacuacagaagugaacagcaguccuggggucucuauguucugcaccaggcuauggcuauuaguuugguguuuugugggacuccuaacagugggaacauuugugucccuggcucuuucaccugcuuuugggaaucuuccuccuuuugaguugccuagccuuacuuacuguaucuuguuuugucccuuuuggcucccagagaugucugggaggacuacucuuucugacgaggaaauggagggggaguagaucugcaggagcagggaacuggggcaugcagggaggauuggaggggggcggggggacacuguaguuaggauggauuguauguauggauuguauguaauguauguaguuaggauggauuguauuagagaagaaucuauuuucaauaaaaauaaaagaucaaaccaaaaaaaguuaugcagaauaauuaaaaaacacaaauagcaaaaccgcagagaugguguugcucagugguagggugcuugccuaucauucaugagucucuagguucaguuccaaguacuuaaaggaaaaaggaaggaaauaaaaaccuucguggauugcucucaggaauaauauuaucuacaggguuagguuucuuauaccugcauuuauuuuagcguuuauuauaauaauuuacuaauuuucuuucaccccagauugagguuuuuuaggguaauucuuaccuuuuaaagcuaguaucuuuuauugucuguauauauaaaagaguuaaaauaugugcacaaauacuuugauuaaaucuucauccaguuauuauuuucucuaagucuaugaucacugcauuuuuagcagucugcccaaccuuugggggugaacaaaaucaaauccugaaguuuucaaagaagcuacaccaugagucugucuugguguucuguugauggcacuucuauuucacauuaauuuaacauuuuaggaagaggcaguucugauaaagaccuugucaaaagcaagugaauugacagguguuuggaaagguguugggagccuguggcguguaagugcaugcauccuuugaacaacacucuuuugaggucaguaggagugacacaugauagccaaagcgagggcugggguagcauugacagauggucugaaugggaaggcauugugugaggagagaagguauccaacuaugcaaagacauccaagucuguauuuaaaaguaguggcuaaaugauaauggacucauuuuuuuucuucuauucuucccccuucgaauuagcugucuuaguuacgguuucuauugcuguaaugagaugaccaaaaugcaaguaggagagaaaaggguuuauuggcuuacacuuccauauugcuguuuauuauuggaggaagucaggaaaggaacuuaaaugggaguaggauucuggagacaggaacugaugcaaaagucauggagggguacuguuuacugguugcauugcucgaccugcauuuauuuuuuuuuuuuuuuuuugguuuuugguuuuugagacaggguuucucuguauagcccuggcuguccuggaaauaacuauguagaccaggcuggccucgaacucagaaauccgccugccucugcuucccaaaugccaggauuaaaggcgugcgccacuacugcccggcucagccugcauucuuauagaacucaggaccaccuaccauaggcugggccuuccuccauugaucgcuaauugagaaaacaucuuacagcugcauuucauggaggcauuuccucaacugaggcuccuuucucucugaggacucuugggucaaguugacauacaaaaccagccaauacacugauaguuaaaaggucaaauuaauuuuuucuuuuuacuuucaaaucuguuauaaagcugcuauucaauuuuauauuuaguacuguauuucuauaacuccauaucaucccauuuuuuaagcuauaaauuaacagugauggcaaagaauguaaauuauaguaaugcagaguuaaaucuuuauuauugccauagcauuuaucugacauguuugaaaugaaccaacuguuucuugccauaucacauuauguaugaauccuagaguuuuucuguuuuaguacaguauuguuuuaaccugacacaagcaaauaaugaccucuguagucauagaggcagguguuuuuguuugauuuauuugcuguuuuguuuucccgaguccaagcuagcuaaguaaauauucuugcugaggcagaaucuagugguacuuuagacacaguaucuaacuuccuggcagaugccuugcugauagaaugcauguagugaacuguccucgggagagcagucacaaucuuaccaagccuuauaguucagaaaagaugcuuucaaaucuccuuuuuuuuuuuuuuuuuuuuuuuaaagauuuauuuauuuauuauauguaaguacacuguagcugucuucagacacuccagaagagggcgccagaucuuguuauggaugguugugagccaccaugugguugcugggauuugaacuccagaccuucggaagagcagucgggugcucuuacccacugagccaucucaccagcccgcuuucaaaucuccuuaaagaugaagaguaauugagaaaauuucuguuuccaaguucuagauuaucauaagcccccagaaggcaacauugaacucuggguaguaauuucauaacuuuauucagucaggaaauuuauuauuuauuuauaaauguauuaguuuaacuuauuuuuaguuguggugaguauacccucaaauauauaccauuucagaaaguaauaaccuggacuuaauaaauuagaaaguguucuuuuuucguguguugaguagucacacuugcucugugugacagcagugugucuaauuugugguucuccuuuuacagcagagcuuaguccuauacaguugcuagaaugucagucuuguuuucauuucuuuguaauccugcaagauaguaggccauuuaaagucacccucagcguguaaaaaguuagguagauugauuuuaauuauuugaaaauuccccucauaaauucuuuauuuuagaaagaaaauacguuuauuucuguuuucauaugguugggaaauguggaguuuaccuuaguguagugagugccuguagucuugagccagaaugccugaggcgggaggacucuuuggauuacacaguaaauuacaggccauccugggaaaauuggugacauucuaccuuaaaaaagauuuaaaaaaaauuuaaacaaaccaaaaguugaggaugugauguggcucagcauuaacagccuugccugguaugugaaggccugggcucugccccuaagugugagaaaggaccaagccagccauugacuuaggcuucuuuguguaucugguuuacucggauaucuuggggucuguaggcugaucucuaucauguaaguauccaaugugagaagucucuugagucuuaaccaagagaucauugugagcuuaggagucuuuauaccuaagugaucauucccuuaaccaaaagggacaauuuagcuggaagauggaaagagaauccugucugaaagauuaaaagauaguuuacuuaagagaagguaaugcguuuucagguuacuuacucacguaaacccaguuguugcuuauaacccuaugcugugaaacuuagaaaaaacuacauuuuuagguaaagaauaacagaagaaacuccagcuucaaagcuuguacaauucacaguccuuggauaucucuguaaguccaccuuaauggagauguuccuuucugaguaccgguuccuuacaugcuggacgauuuuggauauugcauugucugccacucugcugguucauuuuuagucagcuugacaagcuagagucaccuugagaagggggagccucaguugaaaaauuccuccauaagauccagcacuaggcaacccuguugggcaucuuuuuaacuagugauugauguguccacuguggguggugucauuccugagcuggugguucugguuccaugagaaagcagguugagcaaaccaugaggaguaguaagccagcgcuccucacggccucugcaucagcuccugccuccagggcccugcucugcuugagucccuguccugacuuucuuugaugaacugugauuggaagaguaaacugaaacccuuuuucuuuccaacuugcuuuuggucguauguuuuaucauagcaguaguaacccugaccgagacaaguauuaaugucucuucuagcauauauguuucaauaucauucugugacuccccccaccccacaacaccaacucgaaaauagauuuucuuuuuauguauuuucuuuucuauguuacuaguuguggaguaaauauuauuucaaucuacuuuaaucauucuuuauuuuuucugggauuagucuguuuuaaaacucuuagggacauacuuaacaaguuucuauuuugcuuuacaaguugugguuuugaaucagugugacauugucuuugcgcauuaauguguucagaaggugaaggauugauuaucaguuggcuuugagaaguaaugucauagaaaguggcuuagaaaagcagccuaggguguuauaaaugaggucuuucagcucaagcccuugaaagggaaauacccuugcuuggucaucaagaggaauguuaauuuuuuaaucuggaaagggcuucacuucuugacagauccucaccuuuuacuuuuguuuuucuucccuauuuguuccuuuguaaaacuaaaugugucugucugguuugguuuacauacuaaaguuagcacaguaaucuagcuucuguaauagucaaaggcuagcaugauuugauaggugcaccagcaugggggaguaucgcaggcuacggccaucugccugggugugucucaguuggccugagcuggagucuuacucguuuacaugggaucacuacucccucccuccuguuuagucucagcagugcucuuguuuaaaacuacuaguuucucugagaugucccuuuaacagcauuguuuuuaucguuaauguuuuaaaucugcugucguuuuauaaccguuuccuuauuugaugccauccuuaaaaauuugaaucuaaauugucacaguauuugaaaagucaaauuggugggcccuuuuaugaacugacugaaacuauaguuacucuugugaggugcaaagagaagauaaaaacagaagggagaaauauucaggagauuggacagugagcuacuguaucauuuucauuaaagguguaaugucaccaggggucauaaugaguuguuuggcauucacgcuagcuagccuuuuugcuauaacaucuacuucagaaauuggggacuuaaaaccaaacuccauguccaauuccaguuucauguaagcuaauauguauguauauguagucauuauguaagaauuguauucagacuguaaaaugauaaugcucucaugcauuuuauaguauuaaauuaauauguuuaaccaaauuaccugugaucucucuccauugcugugaagaguugaaaaaauuugucuagugaaauggaacccauuuaaaugggcucguaauuguguaacucuccuuuccuaggucauguaauguuugcagagauaaagauggagaauggcaagucaaaaggcugugggacagucagguuugaaucugcagagucagcggaaaaggccugcaggaucaugaauggcaucaagaucagcggcagggaaaucgaugugcgcuuggaccgcaaugcguaauuucaagcaugguuggaaccuuuccucaucuguuuaugacucuccuaguaaaagucauuuuuaguaauguuguaugcuuacaaaugcuguaaaaaugaacuuuuacaacucccaccagcuauuaacaggauaguguggaaaauguacugugaguuuuuuguuuuuuguuuuuuguuuuuuuuuuuuuuuuuuuuuuguucucaaguuugaguuucuaaagacagcacaucugaucauucaguuucaguggauggacauaccauuuuuaaugaaauaagccauuuuguuauuuucaguagcagaguuugucuguuccaguuuucccgaccuugguguaagcucacagauacuuuguuuucuuuuaaaaucuuugcuuuguaugugaguuaaaggaaagaaagggcucagacaaauuaggauggauuuugguuugguuuaaauuacuuuucucugcuuauaaagaauaguaauuaaguguuagacucuaaaguugaagaugcuuuuuauuugaccuaaaugaagacaugaauuuucuucuuuuugccccucuaccauuccaucuuuccacauaacacuauuaaaaaauaucaaacuccacaaccccuuauucuauuauuuccaauaauuccaauuucauauagaacugauaaaguagcaaguccuaaguauaacacuaggcagaccacccccaacuuucggucuaguuuccagccauuaaaaugaacugcuaagaacagaaauaaaauugaaauguugagagagauuguuauauaugugagucccuugcuauucacuucuauaggagcagaugcauucguaaaugcagucuuaauaaaccagggaagaccuaggcauagcauaucaaacacauuggaucccacgauguuagauauagccaugucuccuuuaccugcagaagaauagcauguuguuaaaaugugcacaucaauacuauauuuuauuaauaaucuucauaagaaaaacacuggauacuuuuuguugguuaguuuuagaaaacuguuauuguuagagcaagagucuuauugaauuuguauuuccuuggguuaguauuuuaaagucuuaacauuuauuuaauaauugucuuuauuuauuaaaccauuuuuaauaagguauacagcuuacuuguugcuuuuuauucucauuugacagugaauuaccaucuaauucacauuucagguaaauggucugguggggauuagguugguggaauuaacuuauuaaaaacuaaaugcuuccccugagucacuucuuuuuucuuuaaaguauguuaccaaggaaguauuauuucauuuaccuugacuugcuuuaugguaagagaauucuagucuuaccuuuucuugcaacuaacacacuugugacuguaucugguaugcuugucccugcugccaacaaaguaaggcccaucacugugucugggaucccuaguguuuccccuguaacaggcacagagacugcagauuagaaaucucaaaucuuagauaaacaguuuucagaaggcagcuugaauauuucucuagucaggaaaaauauuuagguauguuuagauauuugaaccaguauaugcuuaugugguuuuuagauggcaaaguauuugaaacagguugauaguugggguaaccagauuagcacaucuucuuaaugucagauaucugaagauaucaagcagccaaaguuguagcaggaaaagccuuguguuuggcauccagaggaagcggugggugucaccgcugccgcuuuggacuguugcauucucucuuuucuagacauuaccuagaguacugaagaauuaagcaccguauagcuaucgauugcuauguuaaaaugugaaaugcuacuuggcuuacugguuuuuuuccccguuuguuuuaaggaaguacauagauauuugagguagacaagaccuuguucuuuccugccugagucuaacacauggcaccguuuucuuaauauuugugucaaauugauagcagaaauagguucauucugagaaauaaaaccagaggguacuuauaaaggaucgggacaugaaacugcucucuuaugguugucaugaaaacuauaguucauagugaggacagagcuguuugucaucuuugggacuuaacugagaucuuguauuugauccuucucuuccaguuugccugaugucaaauauguucuuauugggaaaaauuggauacggcaaauaugcaagcuaccuggacauucuuaucuucuucaugaaaaauaaaacuauuuuguuuuuguuuauuuguuagcauacaguuacaauaaaguuaguuaucugggagaagucagaccagccaguuuggagaggguuccagguaguaguuauuccaacucuacaguguuugaauuuguguuguaauucuuuagccccagcagugugaggacagcaguguguacauguuaguaggugucugggcccagcuguggucagugaagcuucacugguacaaucugguugcaugauuuaggcauggaggaaagaguauucacuucuaauggguauauuacaacuaagugauaaaauguacucuggaagaugcuagaaaccuaaaaacaaaacuuugauucucauuauucauuugcauuguauuugugauacauauuuaaagcaaaagaaaauaccaucuacucaaacagagagcaccuacugcuuucuguugaccccagucaucucuacuuucuacuauggauuagaauucacuuuuaugaagaauucucaugaaaccuguguaauuauaaacauauccaaugaauuauaccccugacugugucauagcauacauaggaaaugcuuuugauauguaacucacaaaaacaugaaugagcuugcugguuuugcuguuaaagcuuucauauuuuguaaauaguuuuuagucuugcugaaaaaaaauauaugcucccaagauuacuuuaaaugaauacuuccaauuuguuuuuacauggaauaauuuucuugugcuauuauacuuaaauuccauaccuguuacugugaccauccaaacuaggauguaugugaaugcagauauccauagugcagacaugaaaaagguuaucacaaaguaauuuuuccaaaacuuucuccugcagucugguguugucagagcaaguaauguaauaauaggaagagagagaacccaaaaaauucuucuuaagucugcuucuggcaugcugaaaacacuugguggaucuguggugggaaaguucaacauuuugaguuuucucaaaugugcaauuauguuagaaaggcccauuuagaaggcuguuuugaaguaaguuacuguaugcaucuuuuaaagaccgucuagaacaguagucucaaccugugggacuugaccccuuugguguugaacaaccauuuuacaagggccaccuaagacccugagaagucucagauacuuacauuacaauuuauaacagcaaaauuacaguucuauguagugucaaugaaaauaauuuuaugggugaaaguuaccacaauaagagggacugugucaaacggucucagcauuaggaaaauugagaagcacuggucuagaacauuggaauacucauuacuauuacugcuggucagaagaaauguaacuaaaacuaggcagacaguauaagcugugcucuacaucccuuaaccgacugcucgaaucaaauaucuugaacuguuugcugaaugugcuggugacaguguucacggaguugaaaguaggauuugcuugcuuuacuguaguauggguucauuagagacgugaugcuuucucucccagcucuuucacuccucaucucuuuuccaaaacggacgcugcuuaugcuuuguugcacacugaugcacgcuuagggaguguucccucuaacucucacugugccgcaucguuuacugaacgcaggcuucccgggugcuagaaggaaucuagagaagguugggccuagcauccuugguauaguuccggggugugcucuagaauggugaggagauuggauaaaagugggacgaggcuguacacuaaugaauauguuaaguaugugaagguuggaucaaaucacaaauauuauuauaacucauaaaagcucaccaagacucagacagugcaccauuaauuuagacacagauucuagcaugaacauuuuugacuaguucuuuggagucuuuguuguuuuaaaucuccucagucuuaaagacuacaaaguaugguuuguaaaaauaaaugucucgugucaaaauuuuaaaguaauaaauuagaagcuugcuucucaauuaccuaacugaaguuggaaccacuuuuauaaaagcuuuucuagucuggaaugcuauugcuauaucgagcauaccaagcucaugugcugcuucacacggcauguuuaaguuacaccugcguucuuuuccccauucuguuccccugaaucauccccuuuccuuuuauugacaguuguuacaaagauguucuuucuuucuuagugaaaauccaagcuccagcguugucucugcucccucucuggcucggcauugcugccauaguuuggugcugcugcuucuacugugucucauaauucaucccccugccuuuucuguuuuguuccuguccuuucaucuuagcucagucuucugugaacauugggugagagaaaagagccuaacaugcaucucugacucugucuuaggaaugcugccugcucagugggguaucuugcacgaccuccugcacuuccuuccugucagccugcuccucugcugcuugcugcacuugcauguguuggcucugugugcaagcaugugagcaggccuuugcuaguguucccaggccucaguccagagcauacuuauaccccugaaucauguaugcaauaaaagugucagcuguugcuuccugacuacacauacuauuagauuauugaguuaaagccucucuuaucccauggggcccaaaccaauucaaaugcuccuuucuccaugugcaucucccaucugagugucaucaaaguuuauucagucugccuguaugaaccaugguauuagcaguuuauguuugcuuaugguguucacacuuugaaauucuagcugauuucauucugugucugggaaauggcucaguggguaaagcgcuuggugcacgggcaugagagucugagaucagauucucaacaccacauaaaaaagcauggcagcccacauguauacucucagugcuauggaagucagagacagacagaucccuaaaguucacuggccagcuagucuagccuaaucagugagcuacagguucauugaaugacuguggucucaaaaaaugaugugaagucucaaagaauugagggcuagcauccaugacugacucuggccuccaugucuguguguucucccuucccccacacuuuuagcugauuaaaaaaaaaauuauugugaguuccuuaaaggccaggacuuacuugcaguucaucaucucuggcuccauaguguguuguguaaccauguacuaauuacuaacucucaaugagaacucaggucuuuuagaguguuagauggcaggguguaguuguuaccuucagaaaccugacuaagaccaugcaagcuuagagaaaguugggaguaaccggaaucuuccugaaauauuccacugucuguccuugacuggcgacgaaugaagagcuggcucucauccucccaucccaacagugucugcuguucaauucucuccuccauagcucuggcaaggcagggacaacagggacugcauguuuucaugacaugccggcugaucguggugucaaaacacagcagcagaacauagagcccauauaucaguagcagcccugcuccuucguaccuagacguggaggaaagggcugugcaguuauccagucauuuuaaacaauauucucuaacaaaagcaacaguggaaaauucaaggaaccacuccuaaaugcuuuuauuuacccaguuuugguuauaguaugguuacaaauucauugauuaaaaaaucugccucuuuaaaaaguaauauaaaauccauugucugacuuuauagauuccuuucaaguaauaggcacaaaauagucggagaguuaaaacuaauuaauagauauuuuuucaguucauuuauuuagcauacuacauuucucaaauauuuaauaauuagaaaauaaaauacuaucucuuagauuuucugauacagaaacaugguguagaauacuuagacugugcuagguuuuugcuggagcuuugcaguuuguuuuacagagauucagaggaaagccggagguggugggguguuguuggcuuugaggucucauuguaaaagcccagacuggccuugaacacugcacccuagauuggccucagacacucagauuauuauccuccuaccucuuccacuugaguuuuggggguuuuauaucuguacuacuaugcuuggucccuuuuugaugaauugauuguagcuuaauuggguuuauauucauaagaaauaaagaauauucucaaaaaugaaauucuggcauacagcaccaagaauugucuaugcuuugguuucccauuuuacuguguauuaggcuaauuuuuaucacauuaauauuguuauuuuauuucauagcagagaaucacuucucugcuucaacuaaaaaaaaaaaagaaagaaagagaaaaaaaagaguuccugauuuccuugguuccugucauuuacaagugacagcugaauuccaguguuuuugcuauacuagcaaccugacuuuuaucuugcuuucucccuguuuggauucuguggacacacacacaugugguggccauauguuuuauaucacuuuuuuaugguauccagcauagaacaccuaggacaauuguucucacagcccuuuggggcuugaauggcccuaugacaggggucacuuaagaccaucugcaugucagauaacuuacacaaugaucauaacagcagcaacauuacaguuaugaaauagcaacaaaaauaaugguuguggguccaccaugaggaacuguuaggggcucagagcagcaggaugccugggaacacuggcagaaccgcugugugugccuguuuggcaaguucacgucuuuccaccaaauuagcugccuuuuccaguuuucuuggaccuguuagguacagagauuauggaaaagcagcaagccuuuuugauggugacacauaauucuggguuguuaaagaaggcagcaguucuucccauccuucucuucugggaggaugggaggagugcaagggcuucugcuggccuccaggcuuuuauuacuaugacccuuucuuuuuaaccaaggccagguaagcaacagcagccggggaaggugugaacauggagaccaaggaaaaggaagaauggcugucuucagugacuaggacaggagagaaaagcagccaccagcaguuuugaaggagucagcugagacugcaauagcuguugaagugaagguuuugagaaacuauacuacuaagccaucagacuucaaaaauucuguaauuauguuuuauguuaagagugacacuuauuuaaagcuuaccaguaaauucgguugucaaauauuaugccaaaaacugcuccuacacuaacugcauacacugcacagucucggaagaggggccagcaggagaguguugaaaccuggaaaaugaugguuugauuuacugugugcauuacaguguaaggcauucaagaacaguguauaauacugaaaucacguauauuugugguaaacuauuguuaaguuugcauauuacguagagaaaaacaauuuuaaaguaaaauuguauauaaaccuguacugacuuuuauaaauuucauuaagagaugcuuauggauuaugucaauugaguaaauguuuuucuagugguuauuaaauuugacugaaugcaau

SEQ ID NO: 1049 - RNA, 10189 nt, Mus musculus
ugauucauagggccugugugcuuuguggucugcccgacuugaacagcgucugccucgggcuucugcugccagagaugaagcaagucaugauggcucaucuugagccaaaguaaaucuuuccuccuuuacggggguuuuuauucuguuucgguuuuguucagaagaccaugaaagcauaagcagugaguauggcugggaggggagaacagugucacaugugacauggauguagaaggaggccagggggugggguaggaacaagagaagggggaagggggacaaaggggggaaggaacaacaaaaccaaaccuugccugaaaaacacuaucaugaaccccaauucuguauguuaauaaaaagacucuuuucagaagaagugaauuacaagagcuacaaaggcaugugcgcuuguuuuaguccaguuaugcuccaguuaugaguaugguuugugacaacgcuaaauagguacccaaccuucugaaauuuuaaauuaaauuuaauuaagguuaaguuguaugaguuuuuguaaaugauaaaaaaaaaguccaggagacauggauuuagaagugauaaauauuuuucuaaaauauuuauuaauuuguuuaaagauuauuuuuauuuuuuucaugugugugugugauaggucagacguauugaaucuucauggagauggaauuacagguuuuaagccaccugauguggguacuugggcuugaaccugguccucuuccucgggaagaagagaacugcugagccaucuuuccgaucccuauuuacuuuuaugugcauccuuggaguucagcccaggauguuacacuuuuucuguugacaagugugugcugccaugugggugcuaggaauuggguccucuggacaaacagcagugccuuuagacaccgagccaucucuccagcaccauguuuaaaaguuuuugacucugacauggauacaaagauggaguaucaggugagccaggccuauuuccuaauccucaucacuggguauccuuuggcaugccguccguauuauuucuaguguccuugccuuugagaauuguuauuuccuggcucugaugugaagaggcagagcuggcacugcugcucagugcagcgccgaaagcggcuucugagggagccucuucagggccccccucugaucuagcagguucugagggugcuuugcucuguucuccucuguugccacguucugagccugucgguucugaggcaaguaucucagauuguuuuuauauccuuaagacuucugagacagaaaguacauuuauuuguagaauggaccaaacucugcccuuccuuccaugcaaaucaaaacuccuggaggaaccauuaggagagccugcagguuugggcuugaucuauagcucaaaagaguugucaccaccucaaaccccccccccccuggguugguguagaaccccuguagagcaguguuugaacuccuaggcauuaaagcacacagcguuaugacuuuguuuuucugaacaccaugguagguugacauucagaaaaaguaccuccgaaccaaaacaagugcuguaauggaggcucgaacaagccuugcuuaaagaaugacgcuggugcucccucucaaucagaaugggaggaggaugaaugacguccgugcucccucucaaucggaagagcaggggacugagcuuugacuuugaacuuuccauugcuuuuccagacugugucauuuacuagagacuaauauacaaauaagacaauaaugggaaaagaaaaaaauguaaagccuuauucuaaucacaaauuuuaagcauuuauuuauuuugcacauguguaugugcaggcacauaugugccauagcaugcauauggaagucagaggacaauuuggggggaauuacuuucuccuuccaccguguggguucuagggaucaaacacaggugaucaggucugguggccggcacccugaccugcugagccaccucaaaggcccuuauuacuaauuuuacaucaguuccaacuucagauucaaaccuauucucaugggagugugugugucuugugugugugugugugugugugugugugugugugugugugugugugucuguguguguauugagacaguuucucuacauagcucuagauauacuggaauucacuauguagaccaggcuggccuugaacucacagagaucuuccugccuuugccucccgagugcugggauuaaaggugugugccacuguuuagggagggagaugacguuuuaaagugcuugagaaggagcuggggagauggcucaguguuugagugcugcucuucugaaggacagauguucagagcccaggagccaugcacccaugucagauagcuuauaaaccccugacacaccagcuccaggucaucuaguguccucuucugauacuuauacagacucaagcacaaacacauacauuuaaaaacaaaugauuuuuuuuuaaacuuggugcaaaaaauaaggcuuugcacaaugugugggauacaaauuguguuuguauuuccugucacccuuauguuaccaaggugaaauuucaaccuugggcuacaugcaccagcauaaggcaacagaauuggauuauucacaggucagaaaguggucuucuaaugcugcugucacccuagaccaggagccagcagugcuucaguuugggucuugccccugauagugaaccaguguguaccggucucugguguucuaugugcauucugacuuucgaccagcagaggucacuguggaccugauuaaaaucaaacuuacucuccauugagaaagaaggugauuuucaaaaguaaauggauaaacaagucuccuguuucuacaacuuaaacaaauucucucauuuuugauccucuguccucgggaugucuuccagacaugcagagauaagcuuaccacuaaacuaaaacuacaggcaguaauccguguaagcagagcaccaagucucucauuaugguuagugacagggauguuucuagcuguauuuccuuugccuuguauacuagcuaacuauaugccccugacacaucugcaagguaaggauugcauauuuguaaggaagauacauugaugggcauugcugguucuaaauuuucuauuuuuccaucucagcagacauucugaggcagccagucugucuaagcacuagcuaacuuuuuuuuuuuaauauuuuuuuaauaguaaggaggcauacagugcuucaugaugccacuuuccuggaagugauguuuuggugccugcccauacucagggucuuagaugcuuccucugccccuucgugaugaucagcuuugugcccaccuugaagucaugcucuuaagauuuaaaagugcucaccuuucuugggggcuggcuugguaauguucagcuugccggccuucuuaaacaagccucggaugccccccuugcccuccucacacucguugucuuugauugcggccuccagagccaaucucuccuguuccaguuucuccaguucgucugaagagaguagacacggucagcaccuucacucagaggaacaaagucucuaggaacaaucuuaugcauaaucuagcauuccauauaauaauacaauagagugcaugcaaauaugcacaugguuugauaauuuucugucucaaucauuaaaaaguaauauguugcaaacacagaaguggaugcucacagucagcuauuggauggaucacagggcccccaauggaggagcuagagaaaggacccaaggagcugaagggaucugcaacccuauaggugguacaaaaauaugaacuaacuaguacccccggagcucgugucucuagcugcauauguagcagaagauggccuagucggccaucauugggaagagaggccccuugguauugcaaacuuuauaugccucaguacaggggaaugccagggccaagaagugggaguagguggguaggggagugcagggggggguaugggggacuuuugggauagcauuugaaauguaaaugaagaaaauaccuaauuaaaaaauaauauaaaaauguaauauguucaguaaguuguauucaggaaguaguaacagcuggcucugaaaaacagcaugaagucacggggcuuuuauuugugagggcaagaauggcuacuuauuuaaaccauugagaaaacccaucuagugagaugaugucacugcuaagucacugacggaucaaguuaccagguaagguuuucaaacagcagcagaaacaauuguagaaguaugccggacacauaugcugagcaugaaugccugcauacauagcaaggccucugaacuggaaaauaaaacuaagagcaggaaccacagaaagguaccgcuuggcagugcgcacacaucaucccagcacgucggaggcgaaggguccuccuuggcuacauaaguaaguuuaaugccggccucaggcuacuacaagacuuucucaaaaggccaaaggggguggggagcaaauuauggaaagauauucagaucuuauaaccaacaucucugaucucugaacauaaacugcagugaacaaaauaucagguaccgauuaugucuccuacauagagaaaacaaaacaaccucauggugugagcccccagagccaaagaaggaaagagagcugagguuucugagagaaugccagacaguggcugagaaguugugcacagugcuugagucuaaaccgagagucaaacugugcaaaauuuccuucagaagguucaggccacuguccaggcuuugauguuguaucuggcugccuuuuuagcuucucugaguuuugauuguguugggaaguuccuaguuucaaauucuuucucucucccucccucuuucucugucucucuccuaucuuucccucucccucucuuuauauaauauaauaucucuccuugaccuuagcaagugagaguuuacagucacaggacagugcugagcuaacacgcauauucuucaacuugugucagauuuccuaucucauugcccgcugagaauccagccuugggaaguaagcccugcuccaagggagaaugcagaaaauguagauucccuguuacaaaacccugcuaggacuucuguaaaugucagcccuccgaacccauugccuuagcucucugugaaggggcaauuccacauuaacuaaaucugucagaacugucgcaccccauggauguugcuguuagccagcuacucagaaccaccuggccccuuuccagguuuagcaacuaaucuuuugccaguggcuugagauuuagaaucgagucacccaugugaucuccccaaagcuucaaagggucucaagaagagcagccauaggaaggcugaugguguuagaguucgggcgggucguuuuugcccugacuuuaaaaggugaggacaaucuacagugugucagggccacagcccaggagagcuccacagcaggcuuucuguggcuucagucuuucuaugccucaggccuccuguggacugagacaucagaacacuuucucuucccuacccgaugaguuucauaaaacaaauaaacagcaguccgccuuggagccucaggaggaacagagaagugaugugugccucaggcaggcucucucucucuguuucuucuggaagugggucuucucaugaaaagcacaugaagcguuugagagggccaggcgcuguuuuaacaccgcuuauugcacacucucugggcacuaugguuuauucuuucccaaacagcuuggaaauagcuacaauuauucucuuuguuuuguacaggaagaaaccagaguuccgagagguuaaauaaugugcgugacugucauggagcaaggucaggaccugagcacagagguuaguuaggcgucagucucugucuccagugggaaggccuucuuguggcuuguuaagaugacuuaacaguuguuucuauuaacugccagccucuucaucaaacaaacuaaaacauuugcaggcacaggaugccaagccauaccccccgugaugguucuggagcuugucaucuuagggcgggcucucaugaccuggguuguaugggaggccucucagagcuccagcuggaacagucuuuuccaggaguuuagcugugaguuuccuggagauggcuguaacggcagcauagaggacgagcuucucccuuuuugacaggcuccagcccacucugucucuagcuacuaaccaugcaccccaacuagugcucugcuugggcaaagaugguuuacauccuccuuuguaaaggaguuugcugucuuaguuacuccggagguuuguuccaggacaagcaaacugcagaaccccagauccaggaggagacaggccaaagugugaaaucagcuugccuagccaucuugggucucagggccacaaaguggggccaucuccacugcacagugagguuuccaguuuuugucagagauuauucuucauuguuuacuuuguggaagcuggaagacccccaucccggacaccuccucccaucacagugugaaacagaaguggccuucgacggucuggcuuuucaguuauaucugauguaccgcacaccuuuguucucacuggaaaugaggagcaggaaggacaguagacuuugcuaaaacauuucagaaggaucccggccaggccaguuguguugcaaaaauaaccauuagucacaaaggaggaggugacuuaauggagccaggagggugacauuaaagauuacucguuccacagccauagccacaaccaccaccaucacuacugccuuuuugguuugguuuguuuugagacaggguuuucuucuguagccuagaagucugcacauagcugaggcugucuuuaaccucugccuccucaccccaagugcugggauugcagccugugcaccuaugcacagcuacaacuccacuuugaagauugaggaacgacgguauuuaggaaguuuucauugcagaugcucguguguagggaaagcugguuuuaguuugcauuucguucuaaaggaaacuugggcauagccagcccaggcgauucguccaaggucauguagcuagugacaugucuucugcgucuaauucuaacauuagauucugucaccccugucuuugagucuuuuguagccucagcuagccucaagcucacuuuguagccugggcuggcucucguucaacuccuggucuucuuacuucugagucuuuagugcugggguuacaggaaugugccuccacacccuauuguuuaauccccauuaccagugggccucaaccuuccugaugcugggacccuuuaacccaguuccucauuuucuauugacccccaaccaugaaauuaucuucauugcuacuacauaacuguaauuuugcuccugcuaugaaucauaauguaaacaucucuguuuucucccacagggucaaggcccacagguugagaacugcuacucuuuacuccuuuucagugacucaaucaugauaucugccugcccuucgcuguuauagauuuugagagagaauuccagggcuguaguggaggaaguaaaugaccuugagguugucaguugagagcagguuuugaauaacuuucuuccugcacaccccaaaacaacucuagugagaccagauacccagacuuugcugaauagccaucaccguguucccaagugcuucauaaaccagccacacaguaaaugacuggagagacugcauuuugaaauuggauuuaguggccaaaauugccucaugaguucuacugugccauuuuuuaaaaagacgucauuuaggggcuuauaauucaccaucugcuuugaaucuuaaggacagcagaaggaggagcagagaaagccagagggcagucguauucucgcccaucucacaacccccuuuuccuuuauucauuauuaaauuagaacucuuuccuuggccaaucaccuugaagccgcacgugcuuacauggaucaguugcugaugccuagguggagucaggcuggauugacggcaggauggcagggagcaguccugcagcccugccuuccaaucaagcaauuauuuacugcuaggccaucugucuuuauuuugcaaagccacucgaucagacacagcaguaucaccgugcucugagcgggucauaaaucgcgugguacuuacacaggguacucaauugugacucacacucuaucacuuuguuuaccaccagugcaaucuggauucuuuguuguaauuggcaaacuugcuaaauaccucugggaugugaaaaauaugaaaugucacauuuuuuuuugguguguugucaggcaauaaauuaauuuauuaagaagaaacauuagucaucaguaccgggugacuugccgcagugaacgaguuauaauguuaugagcaucgaucuuauuuauacaaaaaguuauugucguaugagucugugacacaguauagaaacgacugccauuagcugguaaauuaccaggaaagcugauuucuacucagugguuuauuaacuguaguauaugggcucugaauugcuaauguuucccuuaaauuauaaucugugaugacacugcagugcccauguugggaaagcuaugaugauaaucauuaacauacuguaaugcaauacugaagauuuaucaggcucuuauuaagcccuacauuacaguauaauauaaugaacugcaaguuuguuuuuucuaauccaaaaucuacuaugaggcuugugccauaaauuacugaagcuucauaacaaagcauggggcuguggcaucaagcuaauuucugucauuacguuuguuuguuuuuaucucacauguucucuguguauuugugugacauugcauuuuuguuuaccuagacaguugguacuuauuuuauuaacaucuaacuguauuuucccaucuuaguuaagaaguagaaaguauccaaacaucaaagcugaucuaaacacuacuuguucuuugggaaauuuaaaggagcuguaguucaggauucuuugagaaacacuacauauucuaguaguggcuucaugggaauaaacucgcaguacauuccggugccuggagcagugagagguaguagaggugauguuuucagcuccaucacauauaucagcuugaagagacuaacauaauacacaaagcaaaugcacaaacuaaaugcaagcugcauguuuuucauucuugcuuuuagauagaaaacauaacggcagcaaagccagaaaaaaaagucaaaguagauaggacacaggacuccgaggcuacaagguggaucugaccaggaagccuuuuuccugaggauuagcuuuuauaguaccagaagguucuauggaagcuuccauaggagggaagcaguucauagccuuacccagcucugauguccaugaacuacaacaaugaccagcaugguaagaugcaauaguggcacuuauagcuuggcaguaaccaacagcucucuaauuggacuuaaggccagcucaacaugagggagaccaugccuaguucuggagaccugccagcuacccacgacucgugaagucauggaucuuagaggagaacauaccacugccacuuuacuaaagcagcaacauccuuaacugaauucuaagggcuuauacucagggccuuaaaagaguagucuucauuccucauccaagaaacuucucuuuccaguagauggggagaaugacagaaaccauaccugaccaagaugcagagaagaacugaccgcguguugccuagccccaacuggcacaucuacaacacagcucaugcaucuaaggcucaggggacagcauggcagaaguggcauaaugauuguaagagcuagagaaccaggaaaucugcugugggagagugucuccuagacaugaccggcaaguuuuuccugugacaacucaacaauauggcugccuaagcaagaccugaacaaggauuccaacacuauuauucuagagaaaucuagacuauguauauauacccuugcaauuaaaaaaaauuaguuucuuaucuuacuauuuugugggguuuuuggacauuuucaaacauauauaucauugugucuugcucauauuuguacccccugacuacccucuacuaucuguccugcccucuguuacugguucccuuucuaccuccaaauauacccacuuaugcuucaaugucacauauauguaugcauauguauacauauuuaaaucuagauuucacauaugaa

SEQ ID NO: 1050 - RNA, 207446 nt, Mus musculus
ugaaacccaaaucacaggcccccacaucacagacugagacuuucgcagccucuucauuuagccuaggugaguagcuugaccugagccucgggagaauugcuccuccagcgggcuccugacacuggcaugccccuuucgccgccgcuaaccuguuggcuggcucaguggugguggccucaccacaagcccugccugagccucggagccuacaauuucuccucccagccagacagcagaagacugggcugagaagcgagggccacugccacagagccccuuuccagccagggccuccugggccucguuggccaagguguccagcaugcguucuccgcgcagguggcccagcucuccgugcuucugaucgcgggaaucucgggucuggaccucucagccgcaggcagaucggucuaaaccgcuacuccaccucuucccauucccucucuuccccacccugggacggaauaucccaggccaggcaggacuggaucaccuccgccuccucccagggcacugauccugcgaaugagggaggcccggguccgggcgguggcuggcagaggggaguggaaagggaggauagauggggccgggggugggguggugauggggggagguggggagggugucauuuucuuuuucuuucuuucuuuuuuuuaaaaaaguauuucucucgcgagaaaccgcugcgcggacgauacuugaagaggugggaaaggagggggccgcagaguuggggcagagacugugggugccacaggcggccacagcugggacagcugcggagcagagcagccaccgccgccugagaguccgagccgcuaguccagugggucucauggggucccgccagggucgggcggcaggcggguggcuggagggccguuugcgcggcauccagggcaggaggccgggcagggugaggggaugucucgagcaucugcagcuggcccucucugccugacagcugcaagauccgggacugcagugcccugcuccacgucggaugcaggggacuggcgggguuggccaugacccgguaugugggcggagaggacccuuuuuggagagcuggggcgucagccgucaccgcgcgcaaucagugccauuaagaccguguaggcaguccgcucgcgggacgccugggcucccuagggacacgguacuuggcgccgcgaggccacaggguccgcggaugccagucgccggguucuggcucugcagcuaguugggaucgagugguccucguuccuccgaguaacugcgccacgcgcaggcggcgcgcggucugggcucggcaccggggacugcgagcuuucagcaucccggagcccugagugucucaccuccccgccuuggggacuugucuguguugcaggacaggcagggacuacccgaagugggagcagucccuggagaagaaagcuguaggacccaggccggggaccucucugcaucaggacagccggacagugagacagcgggaccccggagacucgggccgcuggaaggcgcggcggcggcggcggcggcggcggcggagcgaguggcggccggcggcaccaugcggcgaggagggcugcuggaggucgcgcuggcguucgcccugcuccucgaguccuacacgagccauggggcggacgccaauuuggaggcugggagccugaaggagaccagagccaaucgggccaagagaagaggcggcggaggacacgaugcgcugaaaggguaagggaagcucccagcugcuucggugugccuccccucgcccuucuugggacuuuaagauccacagcaacugacagggcagguucuggcccguagaggacccugggugagauccccgggagacagccuggaagugccaaaguuacucggucaucaacucuuguucagauaacucgccuuguuccuggcccagaggagaaguccuggcuggagggaauccugggccauuguugaagcagauuuggggaggcgagaaugguuccuuguggaagaaggggaggagcugaaacccagagaaagggagaagcccacugcuucugcugcuuaccaauuccaguugcagggagaagugcuuuucccgugugggcaucagcuauuugggaggcaucgcugaaagggaagaauccagagacugagaugagaugcguggucaggagaugguccuuccuuuaagucauucucaugaaaaccagagcuguacacucgcguucagacaccuacccuggaaguuuguaaggcagaggguuuugaacacuaguguccggccugcgugagcucugcaugcagcuguggcuggcucuaaauggguguucaugcgguaucuucuuggaaagcccuguacuaucagcuucccaugcccuaguguugcagcugggaugacuuaaaucggucagguuggcugucuaaggcuuggcaguuuccggagcugaaggagauggaaauaauuccccuaagaguuuuuaaucguuuaaaaaggacaaucucugagauuaaguuggagucucuauuagaagugguaagauagaaauaaacggccacaguucuguccuuuggaagagccugcucaaugauucaagcgagugcacaugcugaaguuucuugucauucuaggggugcauuuuuccugacuugauaagaguucaguaaauggguggaaaauugauuuuaauguucucaagaggccuuuguuugguucagcaucuuucuuucaaaaaucuauuucugcugcacaagaucaucuuaguaucuauugugauggcauugcucauauauaugccaauauaaaugcauauauauauauauauauauauauauauauauauauauauauauggagggggagagagagggagagagagagagagcgagggagaucuuucacucuggguugcaagucuuaaggccagaguuuugccggaucuuagugugcuucuguuaccaauuugcaugucucuuuuugagaagacaaccugacaaacagagaggugucccuucucugcugacagagcugcacuuugccacaccauuggguuucacaugagcuuaugaauauagaguuauugucuguacuucuccuagugccugaucugacagacuccuguccauugcaguuuuuaaaagauuuuauuuauuauaaauaagugcacuuuugcugucuucagucacacgagaagaaggcaucagaucucauuacgggugguugugagccacuaugugguugcugagauuugaacucaggaccuuuggaagagcagucagugcucuuacccgcugagccaucucuccagcccccauugcaauuuuuauaaaucuuuuuuuaaaacacauaguauuaguagaacagcuacuaugaguauuccuagcucuuaugauauuuuuaagguuuucugccucuauuucuauguauggcugugguaaaauuacuuuaaacgauauacaauuaaaaguacuucucuccugcuuuuuauauacauuacacauuuuuucuaacaaaauuauaaacauauauacauauccacauaugcagcacauauauauacauauauacauauauguuugaacauauguaugugcauauguuuuacuacauggaugugcuguauauaauaugugccuucacuuuuuauauauuuucaguguaucuaacuguuaacuuauguucuuuugguuuguagagucccaugauaugguggcacaggucucaaauaaugguucuugagauuauaguaaaucuuucacuauuaacaacaucuuucuguguaauuacaugucuaugcauaagcuuauaugugauccaaguagaacugccggaucaaaguuuuuccuagguucucaacacacccauucaggugcuuauuuugaaauuucucuuugcucacugcuauuacagucucacaugaagagucucucagccauggucugcuguguaaaccauaagaagagcaaacuaugcacgguguuuguccaguuauaagguuucuauuugucuucacuaacguguguaguucaaagcuaccucuaacuacgcugacaccugcucauuguguggaugggcgugcuggguuucugaaguggaggugguuuguaguccccaaggcuuaugugaaacacaggugaugacuuuugacaccucgcuaauaauuuacacacugaugucugucaugggcugucugcuugcccacacccaacucccucugcuuuuccucugacaugaugguaccagcuccaaguccugcguucuuuuccuaucaggugucucuugcugugcaaacuggagaaccugacccccacuaggcaugccacccaagucugucuccucuccugauucccauugcagguguuuucuucccuuuuucuucuugcugggcagcagaaguuuuuccacuguggaaauuuaagcauccucaguccccaccccaacuuuugcuauguuuucuuggaacaaauugccaauuauuguuuuuaggggaaaaugucuuucuuuucuuucuuucuuccuuccucucucucucucucucucucucucucucucucucucucucuuucaauuaaaaaauauggugauuccccauuugcucaguaaaaaccauguuuccucagaaacauuuuccucagaaacauuccucagaaacauuuuccacagaaaauuugaaucuguauuuauuuuuauauuauacuuauuuguuguauguauuugggcaacacaguguguguguguguguguguguguguguguguguguguguguccagagggcaacuugcagacauugaaucucucacuccuucauuagguucuggguauugaacuaaaguugucacauuuggcaguaggcaccuuugcccacugagccaucucacuggcccagaguuugcaagcguaaaaauaauuuucaaauaguaaaugcauguaguaguuuucuuuugcauggccguauguaaaaagacuugaugagaaauaacacagucauaacugugggcauuucaguucguaagaacuuuucucagcuaaauuuuaacaccaggauuggguaaaaaguggaagauggcucaguaguacacacccagcaucaccaaggacaacaauagcaagaaaagcaacaagccagcccuaguuggaaagaggaguuacacgcccuuucuuuaugauggccuuauugcuuuagugcccaaauaaggaaauauuacaguuuuaugccaaagggagacauuccuuagucugaaacuccuuuucccaagucuccaguaauagggaaugagucuuguguccuuguugcugguucuugauagacugacagguagacaggcugacagguugacacaggcugacagguugacugauagaaugacagacugacacaggcugacagguugacugacaaauugacacaggcugguaggcugacagguugacugauagacugacagauugacacaggcugacaaucugacagguugacauauugauaggaugacagguugacaggcugacaggcugacagauugauaggcugacagguugacacaggcugacagguugacagguugacauguugacacaggcugacagguugacacaggcuguuacaagcugacagggugacaggcugacagacugacauguugacagugacaggacucccauguguuuugcaaacuuugucacccuucucaugauucuuuuuggucuuuguuuauuucuuuacauuguccagaguuuuuauuacuauaaaaacauauggaacagcucauagucaagguagauuaugugauggcaaauuccagagauuaauuacagaacugaguuccuaaugaaguuucaugggaauaaugaggcuuugaaaagccuguuuaacucauaaagacaguguuaagacacugucuuuugucgucacauuuaugagcagaggaagcuaauauauugggacacaaguuaaaaaacagauuuucuuaagcagaaggcuuauguaauuccaauuuuuaaauaaaaaagauaaaauauuugacuuuucaucuaugccuuuagggcauagagaguuuaaagaaaugaguaagcuauugguauaaaugaauaaaaacacacaucaacauacagcgucacaauuugagagugcacagcaaugcaagucuagacaaaccuucaagcuuuuuuuucuuuucuuuuuucuuuucuuggagacaggauuucucuguauagcccuggcuguccuggaacucacucuguagaccaggcuggccucaaacucagaaauccaccugccucugccucccaagugcuggaauuuaaauuaugugccaccacugccuggcacaccuucaagcuuaacuggaauuuuaaauaauauugaaaguuuccuuuguugaaaaucauagcauuauacuaauaacccauaacuacuccaacaaaaugccaaacaauuaaaauauucauucaaaaccaaauagcuuacugggacacucuggaagcuuuagcuuugguuuuuacugugaaugcuuuuuuggaagacaaguaaacuauuuuaacaacuccuuugauucugggcacugcccagcaaaugggcuuauuuuaauaaaacucuucgagaaagcugaaaucaauaauaaaucaaacacaacacaaaaagucugugaacauuuauuguuucaugauuauuaucccucguguggucacauauauggguguguguauucuugggugugcagguguacguguguguuugugugugaugagggguggugaaccggcacauguauggauagaggucagaggucagcucaaggcaucauuucucaggagccaucuaccuuguuuacugaagcugggguuguucucugguuagacuaugcugacuggccagugagcacccgggauugucugucucugccucucagggcuguagggcccguuuugcacuaccugucuggcuuguugaguugauguuagggauugaacugaagcccacguuuugcugugaaggucucucccuagacccuagacucgauuuucuuuccuauuaauuuguaaaaucaucaaaggcaagagucaaaucauaauaucaucaaucauaacucauaacagcacuaauaaaaccacuaauaucauuaaaugaguuuuaaaggaccacuaauucugaaagccuuuauugaaacccaguguuuacuuaguucaguggaauuccagaaacguguaacaacacacagcuuggaggggcuucauaguuuacagaagaccaaaaaaaccauuaacagaagaacagccaaaaacagagagucugcuauuaggcugaacaacugcugcagcauaguucuccuugauuugaugaaguuaagcacugauaaauucugccaaggacuuugagagaguguauuggucauccuggaggugagggcagggcagggcagggcagggcagggcagggcagggcagggcagggcagggcaggguagggcagggcagggcagggcaaggcagggcaggggaaaucaaaacuacgugaauauaguuucuauuaagcauguacccauuucacagcauuauacauuaaaaccauuguaucucuaaacagugacuuagggcccuauguaauaauaguguaugaagcauugcuuaauaagcauuuaugugcagaaacugcucuauauauguuauaaguacauauauaauuuucaucuaauucaugcaguauuucuaggagagagcagucugauccauccacucauccugacaaauauaaacaaagucuuacuauucaauuuuuaaaaauuauuuuuuugugguuuugauuucuuucaucaaugggcuaagauauaagaugcagggcuaaguuauugguaaaauuccacugaaaauuucuaauauucuguaguaauaguucaaaaauccuaaguauggauaaucuuauuacuuaguuaaauaaaaauguuuugagacuucagacagauauuaauaaacuagaaagaaucauaagaugccaguaccaucaaggacuuggguggugcauauauuguuuuuuaauauuagagcucgcauauuuacuaaggcgguaguaaccaucucagauauaccuuucugugcucucuagccucugagcugauuguauuacauauuaauuuuaucauccagaaucucuuauuuuccauuucuagguaggaaagcucucucaaguagaguuaagcaacacauaucucuuuccaggaaugcugauguguaguuuacauuuuagcuggcaaagaugaauuauguaaguauuugcuucacuuuuuuuguauagcuuaucugcaaacucacaauuuuuuaauauuaaauggaagcaauuauugcuaaaauagcaagcuuuggugcaucuacgacaaucauacuuuaguaguauuaauuacucaauuauaacuccuuacuagggagauuaaacgucuuugcacauuuaacaguuuggaaaaaacccccaaagaauguagaguuccauucauuaccccagggaaaucaacuagaguuaggaaaccuggcuucgcaaaacuuuuaacuuaauauuuuguugcuucucggcuaaauuaaauuuuauagcugguaaaugucuuucuucagucuucuugguaccuucuuucccuaggaugaucuccuggguaguugaagguguauucuguuacaggccaacagaagcauugucggaaagggauugauaagaaaagauaucacaguaaaauucacugugucugcagacuguggacuagacugcguugagaacggaguuuugucgacucauuugugcauauguuaccgcagggccgccuacucugugcagccccugaaugacgcagcugugacagaggagaugggacaucugcaaaauggaaguauuugcugucugucccuuuacagagauaguuucacagccucugacugcaggaaaaaggugguggagagguucaugccuugugugcuucacuucucugagaguucuuaggaaucgggcauggguaggggucaguaggugguuguggaugcuuagauaugaaccaauuuugacugacugacugugcaaugcuaauuauauaaaucagagguuagaggaaacaggaaaugggcauaaagagaaaagaugagggaagaagacauaaggugaagaggaugugaaguauuugggaugggggagggggacagacacccagcacaggaggccagguuugcacugcacugaucuacuggcaccguucaguguggucugguuugcugccuugugagccugaacaaagaggcgaugcuguuaagggcaggagagggaaucagaagaaguaucacacuccucauugcugagaaaagcuaggaugaggaaggcuccaagauggcagcaaggucagcucugugguacggaagcaguggggugaaagccaugcagugguguaagaggaccagaggcugggagucucgggagcaaugugggguucaccgagaguagacugagcaaaagcaggggaguuggugaugaagaagaugcucacauugcuccaggucuaacugaacagcuggugggaagagauaaaggagaagagaaccuagaauguuccuaccacauauaaauuaaauuucucacacguugaagacauaauagcucauaccucgucuuaaaagaagagcacacaggaucacccugggauucccaugacuuuuauucaugguuugguuaucuuuugcuauuaggaaguugcucugaauaccuggcuuuacaguucugugggucagcaauauagacagagacucccguguuggcuccucauagugccugguggucagggugagggacagcaggaggcucccaugucugagcuaucuaaauagagagaaauaaagacauugggcucuggugggggguucucagguuuguuuuuguuuuuguuuuuuuguuuuguuuuguuuuuucgagacaggguuucucuguauagcccuggcuguccuggagcucacuuuguagacccggcuggccucgaacucagaaaucugccugccucugacucccgagugcugggauuaaaggcaugugccaccacgccccgcugguucucagguuuuaaagcucucucauguaaucucuggccuggggcaguccccaggagccauuaaguauguuuuugucaaugggaaaacugagcccaccauacacagcuaggcuuugcucaggcugugucuguuggcgcugcuucuuggugacauauuggauccccguguccugaauguaggccaacucaaauggcugcagacuggcugagcuugacugggcucaugugcuccaaggguuggcuacguuccucagcccacuuccuguggucucggacugucuuccauugguggccuuucugcaugaucuccccagaaacaaagccagacucucuacauagugguucugggucucccaggaacacgcacauggaggccacuagauuuucuucaaaccuagccugaaauuauaugaccaggaauuccauggaagucacgggcuuugcccagauucaaggacuuggacaacagaugcugccuuugugcuagaggagcagugugucucugcaagguaaggagggacucuugugagcacaguuagagacgagugugcagauugaagcagugggucuuugaaagagauaacucaguacuuuugguuugaauucuggugugaucugaucccuguuuuccacugagggugagacugugauguguggcguaucuugcugcguggccucggagugagaaugccccauggauaacaugccaggacaguucuauuggaccaguguuuaagagcaguauccccgccucaugcgcagcuccccacugaaaacacacauggccuucagaaaugagauuacaguuuauuuacauauaagcacauaaacacacacccuuuuugccuuccuuuagaauuaugaaauucaguggaaacucugaugugaaaccacuuuguuuuucuccuccuucuccuucuccuucuccuucuccuucuccuucuccuucuccuucuccuucuccuucuccuucuccuucuccuucuccuucuccuucuccuucuccuccuccuccuccuccuccuccuccuccuccuccuccuccucucuucuucuucuucuucuucuucuucuucuucuucuucuucuucuucuucuucuucuucuucuucuucuucuccucuuuuuuuuuuuuuuguuguuguuguuuguuuuugaagacaggcuuuaaugcuguccuggaacguucucuauauaccaggcuggccucaaauucagagagccucuugccucugucucuugagugcugggauuaagggugcgcacuaccacgcccaguucguguucagcacguuggccucgcuuuucugugggauucugccuucaauuccuuuccuagccacauguuucuccaucuguuggacaauccuucccauuuugguuuuguguaugcuuugguuuuggaaccagggguuacagaucauaaccagcaguagguuuguaguugccaguggagcugaucuugucaaggaaccggacugcaccacgcuuguucuagugggagugaccacagcgccacugaagaaaaacagaucaggacugcagccagacucggauugugcgaguucugcacuauagcaaaucuggcuugaaguuuccugugacuuugcaacuuucucaacuuaagugguauuuucaguuaaagauaucacucaucguguuuacucaagccccucagagcagaagggagaaaggaaaaucccccaucuccaccauucccagccagaaauguauuccagacagagcaggccgggugggagaacggccccauuagacaagugauuugggucaguguuucgaagggcugugaauuccuagaccauccgucauacuuacauucaaauauacacaucgaauuccaaauauagcaccgccauuuaugacacugguguugggagacaggauuuaugucagcccuguggauacacucggucuguggucaaauuucaugacgaucucuguauuaaggaagagccuaugcccagggacgauuuucuuuccuuucaccucuuccucauugccaucuuuguuccuugacuucuuccucuuuuaccuuuuccuuuuuagacagacuaaucaugaugcaguccaggcugccuuugaaccuuccuacaguggcuuuccaggcggaguguguggugacaugccggugauuccaggcagaggccaaagacagcagugaugaagguggcagcaaaacccagcccuguacugggacugcaucacugccacugagccuggauccgccuucuccuucucuuacaucgccauuugcucauugacucagcuuucucuucuuuugagaguaacuuuauaacuucagcuacaaacaaaacagggcgaauagaaguauuaaaguuugacuauuaagaaaaauaaauacaucccaaggaauaagaaagccuguuuacgugggagacuaggaaucuuccaaaacagagauauaacuaagguuuugugagaggaaggaaggaagagcugagagaggugaagcugaggagagaguucuggagcgaaguuccuuucaguuaugggguggggcuggacagaacaggucuggaguuuccauagacaccauccucacaccuguggccuucagcuucuucaggguuucugacagagagucaauccaagucagaaaagaaccccaaaggaaugcgguggaaggcagguuaccacagggcuuguuaugcaccugugaaugugguacuguauaaaaaguccuguggguaacagcuaauguccacaguuagcuguccucucaguacuauuuguaagacugucugaccauaaagaccccaauaagacuaugucuuugugaaugccuuuaagagauuuguuuuauuuuuaaucaucuguguauguacuuagcuccguacacuugagugcaggugccugacgaguucagaagagggcagcagauccugugagccguacaacaugggugcuaggaaacagacugggaccucugcaauaggugcucuuaauugcugacuggagucaccggccccuuugggaacacuguuaaaggcuuucuugguggaguuagugauauaugucuauagaaaggggcauuuuagaagguuuuagaugcuaaccaagacccagagaaggaccauuaagacaugcuaauguacauauuuucuucuuuauuucauagcuguagaggccacagaggagcagaucugguuuaacuggaagcagugguuguuggguagcgcaucaugucucuuuguguucagauccuggagaguugacaggugucuucaagucuuguaauauucuaggcacaagcaaggcccugacauauuaaggacccuacuuuccuuccuuuuuuucuuucccucuccccucuccuucucucuuuccuuuucuuucuuucuggaaacaggguguugcuauguagaccaggcuggccuugaacuugcuauguaaacuagguuagccuaaaacuugcuauauagaccagccugacuuugaacuugucagccacucccuugccucugccuuccaagugcugaaauuauaagugugugccacugugcccaacugugaucuauuccuuccucucucccucuuucccucccuuccuuucucccucccuuccuuucuccuucccucccuuccuuccucccucccucccuucuuuccuuccuuccuuccuuccuuccuuccuuccuuccuuccuuccuuccuuccuuuggaaaguacuaugcaauaguuuuagauauuuacuuuuaccugucugucgacagaaggcuccauuaagcagucuuggggggaaggaggaguuuuguaaaggagcccaauuuaauaaaaguauugggggguagcuaaaggaaagcaggaguugucuuagggagugagucuaaggagggaugcaccucugcuuccccaccccuucuccauaugugcaggaucaggagcucuggcgugggcuaggacaauuccggaugguaguuaagcuuuuguucuauaaugugcauacucuguuauccaguuacugauuuauguacuuagcaucuaugagauuaaacacgccaagaugaaaacauuuuuuuuuugcauucuugcauugucuucuccagccccccucauacguugggagaacaucugcuuaauuuuaaugacaacuguuuauugagcguuagcuguguuugaauuggauugaguccuuagcacucagaaugaacgcacgacucaagccguugauaguacucuuuucuucucaacgauucugggcagaccugccauuuagccauccuucuugcugauggagaaagucggagaugauauggacacgugccaggcaaggggagcccugacacgcacccuucaaguccacaaguaguuuuuaauuucccacggccgacugcuguuucacacccgagaauuuaggccacugaccucaaguuugcaaauuuuauaucccauuaccacccugcgagcucucaacuccccagggccacacaguugacguuuuagcuggaaucugagaaagugucugaacauuuccuacagagcuggcuagaagugauuuggcaguucagucauaaaacccuagagcugguggcuggggguuaugcuauaauuaccucacacuguuuccuguuggagccugguuguggguaauggggcagagugguauugcuugugggacuauguuuuaaaagauagaggacucacuuucaaugagcgcuaaucgccaguggucuugcuuucagggaggcucgggaauguggggauagacauacuugggucagcuccuggcuccaccaccuacugggaaaaaaccucagacaaguggcuugaccucuguaagccucauuuauuaccuuguaaacaagacuauagcacacaccuuucuguguuguccgaagauugaaugacauggugcaguuccuacuacagugccuggcaugucucacugugggaaugaggucagauagaaugcuauuauggguaagcaaaugacaaucaaaguuuauuuaaaaacaucgaaaauauaaauauaaauaugaguacuuccugugcuucguuaacuuccaggaaaaaaaugaguuuaaaauagaauaagcuuuuuuuuuuuuaauuuugauuucuuuuucaggacucuuacaagaauaugcaaauaauuuuauccuuuuguaaacaaucuagacaugacugaaugugugaaagccagacucaagguguguuugagcuuggguuggguuauuucucauuuauguuuuuccuugaaaaacaaauuauugucuugggguuucuauuguugugaagagacaccaugaccaugguaacucuuauuaaaaaaagaaaaaacguaauugggucuggcuuaccuuuagagguucaguccauuaucgucauggugggaagccuggcagcaugcaggcagacaugaugcaggagaaggagcugagagcucuacaucuagauacauagacagcagagagagaaaugagacacaaugggccuggcuugagcaucugaaaccuacagguccauccccagugacaaaccuccuccaacaaggccacaccuacuccaacaaggccauaccucuuaauagugccacucccuaggggauauggggaccauuuuuauucaaaucaucacaaauggauuccucauuaggaaagauugagaaugcauguaaaaaugaaucauugccaacgugguuaacggcuugcaugggacguuaagguguuuguucucggauucuccgucuggugagcaucauucugacguuuuggcugcuguugagauucacagagacguugguuaguucuggucaguuguuugagaugguugggguggacuguuguccuuucuggucugggucucuguuccucucagaaaugcagaggcauguaacagauacaggugguucauccaggaaaugaaaggaaggacacaugugaggaguugaugguuugucaaagacucgcagucaggauggaccagggggaccaccagaugaugccacgaaguugucacuugucaaugugcagaauuuccguuuaguuucuagaacaugccaguuucuagugagaaggaugcagugaugucuuagcuccagcauaucaauggauagucuuggggcuggggagauggugccacaggugagagcauuugucucgucaugagggccuaaguucaaaucccugcaacccacaggaagcugagcauguugcguacaccugagggaggauugcucgggcuugaugaccaccagccaagcuccauugggauuaugaacauacacugcugugcccgguuuuaaagcagguccugggggacccaacaagguccccacguucccaugacaagcgcuuuauugauagcacucucucuaugcccaccaaaugcuuuuauuuguaaauauuucaacauguaaaagaugaacuucccucaaaaaacauaaauccaauagcagcaucacauuuaacauuaguuuuuaaauauuauaucuggugagucuuaaauuuucuuuaguaagucagaaauguuauuuuauaguucauugaaauuggggucuaaauaaaauccauaauuuguaauugguugauccauccuuuacacauuuuuaaaaaauguagauugacuaucacuuuccccuugugacacuuauagaggaaagagggcuguugauaggccaguuugcagaccucgcauuggacaucugaaaagaagaguaugccccuguguaaagucacuaugucaccgagagcauucuucagcccagccaagagaauguuauguucuugugcaacugagguguucucagugguaagacuuucucaggguagaaagguggcucucuuccagcccagguuccccaucugaguguaggaugguagaaucuaguuugugggcccccgcuauggugugggcuuauuguguuugcugugaauccugcaguuguuuugucaaucacacuugauaaguguguugugcucuuuugccaggaagcacauuugcaaugcaagaguuucuuucugugacuuugguuguuaguggucaucuccuagaacugcugauuuauuugggugacagaauggcaauguucuuacucugacacucucuguuuauuaaugcuauaaagcuuggaaagugguuuugaauauggacccaagguucauagccagccaaguuugcuuuuucugauccauggcuuuaaggaguauagaaaaaaagaaaucacaaaacauggaacagcaaagauuggcuaucaugagguuggcgauugugggcaguuucuaaugagugagccugguacuugaggggcaaaugaaagaagauaacucuguaggggucuauuccauagcuggaaucccuagguuccuugaucuaguguggcugucaaaguggaaacaauauuuuauuuucuuuuaaaauuaauuaauuuugugaaagcauuuuaacauguaguucugggcgaucugagucaucugggugcaccauauagcccagguugugcucaaacugcugucucugucucuugacugcugggauuacagguguguuccaccaucgcuaguuuauuauuauuuaagaggagggauuucaugcaaggacacuacaaagcuuuggcaacuuuuucacuauaguuggaaagaagagguuuuuaaaauccacucaguguccagaaggaaauguuuauacccucauuuuggcauuucugccucgggacugcucauuuuaucucaugccugaguauaacuggugauuugaacagagauggggaacuccacugaaacagccagcaucucuuaggaaaggacaugggagugggagcgacccaggagcuuccuugaguguuggugagggguuggugagaaggugcgagugcaaggugcacugucaggcugagucuugagaauggacauuauuccagaaggcccaaggucugucaucuuuugagaaaaucucccaggaaacacccuggcccuggcuccuguggaggcaaaugcuguaucacuugggugagagaaagcuuucauguuggauuuuaggggagaacuaugaugccgggaagggguagggacucugauuucucaugaaaugggucacccuaacuucaugugacccauugucuccuaagcaaggguagauaguugccaugucacugaacggugcaccuguagcuacuuuucuaaaaacaagccaaacucagugcucauguggauguccagugugcauuuuggaaccagcugagagcaggguucaaaucauuguccuuccuacccaaccagacauuucuugcaaaucccucaaacucuuauuugagaaauggcuaacauuuuuaucaugggagcuagccccaguacucaugccacaggaaauguguuuauaacagaaacauggcucuauucccuucacauacacccacaauauacuuuguauaaucgaucuuaaaagcggugguuuuauuuuguagacccagaaaacaaacagcaacaacaacaagaagcaaggcaccaaacuauacaaauuaguaaaaagcaggacacaucuucuuugggcuauuauagaaacaucuuucuaagcucugcuccagaacucuguaaccugggaguauuuuauucauagauuccuuugcucuuuauuugaugacuucagacaggucuccauagaguagccuuuuuaaaaaaguuaugugcuuaauuugguuuucuauaaucuucugcaaaugagcagagcaauguguuuuccugauaggguuuugggggaaauccuucuguagguuauaauguucuccaaauuuugcuaauuacuguuuuuauuuuguagugugauauguuuaaucaauucccuuaaaaugugcacuacuuucauugcuuuuucacauguauauguaaauuauuacaacuuuacuuuuaauugggagaguaaaaaaaaaucugucaaguuuuagaccauagcagaaucaaguguuaguuucaauaaaauaauugcauuaacuguaagccucuugaauugcaaauggacaggcuugccccuccccagacuacucuaauggcuuuaauggccauuuccagcuccuuaagauucagguggccaaacuuugccuuacagaaaaaagcccaaggucaggccacagaaucccaccaaucccaggccacagugggaagcucugcacagccccucuccagaaacccuauauaaagccugccuccugcucagauauuugcugcuuuucucuugaguggauguguccucugcucucuugugucuuucccaauaaaucucuuguuugagauuuguuguguugugugacuuugugguauuccuuggcucccaacugccaggauaccuuuccccucagagcuguaacacucauacuaucagccuuuacuuaacuuccucuggcuuuuaggaaacuuaauguuuacgauugcacugcuaaaauccccucucuggggaguagguaaagaucuagccccguccccaucuccucuucuucuucccccuccuccuuuuccuccuccuucugcuccuccucagguuuuuaaggacaaagcaaggucccauuacauugcagcucaccuuggggaaccagugaguuuauuggucuuucuuacauaucacgggugaccccccagcagcugcauuagaaagucaccaccuggcauggaugaaugcuuccccauggcugcauacauggagaccuuccccugcucuuucacagccuguaaccccauggguuuucauggccaaguuuccuucagauucucugcuauguauuguuucccaugaaacauuuuacgcugugguuagguucccaggucaguccacaauagccuauuuaguggauaaaguagaagagagccugcuguuucucuaguuuaggaaccaaaccaccaccuaauuacacuggaaaagcuauucaaauaccaauagguagaaauaaaauuucggagcccuaucuguucaucaggcaggagcugccaguauucagagcuaaagcuugcccuccuauaaucuggccccugcuuccucuaagcuguucccauugguugcucccccagagugauaagaacacucaggaaguaucgucuucccaggcagaacucuaaguuugauauuuucugcaaagugugagaguccugguuugccuuaacccccugguucuagugugagagauaacaaggagguaggaacagagaauuccauaugccacccuggacugcccauccccucaaggcuccccaacccucuuucuuuaucugauguuuucaaucacuucugcaauuucaucuauccuuuggagaaguauaauguggcuuuggcaucguucaucaaagcagacauaaaagaguuugucauggucaaccucaagcucgguggaugaaucccaggggucacaagacucugucacauagcuccuuauguuuucaugaugcuacuggucaacucuucucagagauuugagaaauagaacuuugagacaugcccguguuucuguuuuuuaaaauaacauuuccuuaccucucaagggccaacuaguucccauuuuggggcuaaaacuccucugucuguguacuugaugucaacaccuuugauacgcccagagauaaauaauccccacucgaauguaguccccaccccauaggauagcaaauuaauugucuguugcucaggcuuugggggaggcucagguggcccaggcaucugagcagacuccccaugcucuuaggaauauuuauuccagagaaccagaaucagaaggugccuagugccuugaaggaaucaggaccugccaugcccagagaugguucuuaaacaccuggacagcugcuuuucacagcccagcaucguuuccuguuauaaugaaccuuggggauuuuuuuuuugagccuuaaauucuuucuuucuuuccccaagaaauacacauaccuauggauggccuaucauuugagauagguucuaaaagaacugaaacuagcuguugguugaaguggccuuccagguuaagggaaucacuucugcgucuucagcuucccagagcuguaugagccaggagggcacgggugugugcccugugaauagcuucuuugccugucauggcccagucauuacaaccagugagcaaguacugauguacuggaauguauuuagguccauuuucaauccuuuuccuugacuuuugccuaaucauccuuucaugcccuuacccccauugcaggacaccuaccacauuacacauugcauuuagucaguguggucacuuuaggcccuggagaaauuuucaacuuuaucuugucuuuaaugauugauguagugccgagguugaucagguguuuuauagauggccccuuaauuagaauucuuucaugguuuuggucaagauuagccuggaaggguuuugguggaagaaagcacugagcugguucuacuuguugaguggcuuugugauuugggguaagauggcuaaucgaucccguaucugaugcucauaugguacugaaguugcuggcuguacaagcugagcugugugauuggggauucaguuaguguuaguucaaggugcuaacaaaacauugucuucuaaaguccugaaaauggccacuaaggagagaagaaauggguggggucaaaaagaaggaggcaagaggcagagauggaagggagagaaagaaggaaggagaaagagguaucagcccacaguuugggaagagaagacacugaaaucaguaguugaccauugccagggaaagcaaguagggaacaaagauuuuggaaaucagagugugaaauauucuuucugauuucugauuauauuuagguugucuuagaauaauauuuuuggugauuuugucaagaaaaaguccucgaaguaaauuagaaagguugguugguuuguaccuucaaaguagagagucaggaucgucuauuuccuggguagugucagcucagucaagccagaaauccgucucugauccagagugucuggcggaggccugaggcggucacggaagcggcuuccauuagucacauuguugugacuggcagaugggcuggaacacuuacaugugguauucacaucacugaggacucgaccucugccuuccgcugaggggaucagaauaaaggugcuaaaauaacaaagguugggaugugagaagcaggcugagauguauuuugugcuucaccaggaagugugcauugaauuuucuuuuucuuuucaucuugguaaguagaaguuugucaaagaacacaugcaaccaugcuauguaguugacuauagguagaaccacuuuggguacugcuacuacuuuccacaaucuaggaaaggcucuaacucuggaauggugugauauuaagauauguccuuagccaugucacaugaauccuuggguacucuuuguuacaugacaguucagauuuccucuucagauuucaguguuuauacuugguggguuccauuauaacuucucucuuagagguuaaaaaaaaagccuguaacuuggggcacaaggucagccucauuugcccaaaccuuaaguuaaaguauuuaauugcugaguagacugggaaacucuuauaugaaauaaaagcccucugacuuuguuuuuauaacaccaacccuauuuggaaaaggcuuuucacuuaggagaaaaagcagaaaggcuaucuugcuguuggacaggccaagcuugcagaagugggcucuggcuaaaggaauguagacaucugcagacaucuuucacagaggccaauuucugcaaugauguggucagaugugguagagcccagcuguuugcucuacugagagaggcuuuaguuagcccacacagccuccaagugcugugucugaacuggcuccaacagcaagccuguuaaggcucacuauccccagggugauggaguuugguaggagaaguugcagaugaagucccaccuaacuauuaaaaacaaaaguaucacaauggggagguagaccaugcacauucuccucuuauuccauggacuguuagaaugcaggcaaaacauaauuuaucccuuaccucuagucuauugguagacauguugugauuuugauuaucuaugucaccacacgugccauugagugaaauaccaucuuccuuucugaauaccucugugcccuaaaguuuauugguucagaggauagacucagaugcagauuuccugaguucagauucauccaugacauauugcuaagcuaugggacuuugguaguugguuuaaccuuccuaaggcccuaauauccucagaguaaaagauaaugaccgcaauaaucaccuccaagaguugcucugaaaauaaaacauaagaauggaauccuagcgguuaguggaaaauucuguuuccucugaauuuuaauucgucuuaauuugcuaagggcugcugcuaucuccacagaacacuuagcuauaugaccuuuaaggagcagugcgucaacagagaggaugauuaaaaagaaagagaaagucaugugcgugcuauacucucauuuacacaggaguaacuuaauuaaagaauuaucuucuuuguaaaugcuguuuguacugaaaccuuagaguaauauccucuauaaugaaaacagccccaugugucuccuuagacucucucacgccuuacugccuuccaacuaaaacaagacauucauuuguuccuagauuagagccuuuuuuggggugugugugugugcaaguagaacaaauucugcucagcuuguuuaagaaauuucuauuagcucacaauucucaagauuggaaucucaggaaagacauuguaaaucucuaccacuuucuguggagcuauacaaaggagagucagaacuaccaucggaugguguggguugaaacaacugaaaauuucaaaguauguuauuuauuauaaaagauaaaauuaauggcugggcggugguggugcauaccuucaaauacagcaguuaggagucagaggcagguggaucucugaguuuaaggccauccuagucuacaauagucuacaggauggccagggcuacacaaagaaagacuaucucaaacaccccccccuccccgcaaaagauaaaaguguaaaauaaaagucaaaaaugugaauuaagccaaucacacuccauucugcagaucuuaaaggaggcaugguaaaguggugcggugcucggugcuccggggaguguggagaaaggaacaggguugucuguuuccuucuauucaagcagagcauucuguugcuaggugaaagcauucacacuuuaauacugaugccuuggguuaaaggugaggaccagguuaugagccaaguguuuaccugugaaaguaugagcaggguuguaagggcagaaaguggcggcgaagcaaaccaucuccccacugcuggccugacgcacagucuguuuucaguucgcaugcuugugucuguaguggcaucugcuacacccaugccacuauguccccacucaauagccgucuguuuccuaggaaauauguguuuagcccauugagagaugaauaccuugucuccuucugcuucauuucuuuaguggggugguuugguuuuuauuugguggagggcggggucucacuguguagcccuggcugaucuggaacuuaauauuaaaccaggcuagcccccaagagcauaacuuuuauuugucgguuguuuugaaauucuauguaauauucuuagcacccguaguucuugaaucaguugucuuauugauuuccaacccccuuuuuuccaacuuguuucuaaauucaugcugacugugccauuauuaucugauuauuuauuacacuaacuugucugugguguauuuaucugugagccugugugugauggccagagggguacaucaagugucacauucacuguugaucuuuugagacaggaucucucacugaauggagaacuauguuggugacuggcaagcccucuagaucuccugucugugugugccacagugcuggagucauggggcacgugcgguuauauccauuuuuuauguaaauuugcgcucuucauccaugggcaucgaaagcucucuuacccucucagccucuccccagcucugugcugugacuuuuacacugcagacacuuagaacacuaacuuccuguuuuguaacugugauaaauucuucagccuucuaugcuuuugguaauggaaugauucuauaaauagaaaaacaauaauguucauaguauuauaacuuuucaauaccuugggaagaaccuuuugcguaucuugcuuuggaggauagaaacaacggacucuggacuuuuuccauaggccguuucaccuuguuauaugcaaugccacuccauacgugcauucauuuaugucacagaguucuggcuuuuacugggcacccugcaaaggcucaggggccuugugaggcauuccuaggauuuggugugggggcugggcuggauccaguggagcuguuguaaugggccauugguggggaaggauuggagcuauugacuuuggcuggcuuguuauugaaaaccgauagacuuuagguuugagcacccuccucccuauaccccuauauucuauuuuucuauacaucuguguccaagcuuuugcuugcccaggauguucugcauucugaaguuuuggaugagacuuugucacaugagggauaaaaugacaagaucugugcaguuaaauuauuccccccccccaagcuuuaauuguaugaguggguuggcugauucucguggaagccagaggaggguaugugacagucuccuccaucccaggauuggaacuacagaugguugugagucagguuggugaugggaacggagcccaaguccucuggaagagcagaaagugcucaauugcugagccacgucucagauauauuuuuaguacacuuuugucucuuccugcagaaaaugaguaggugagaugacuccaucuggaugcugcugcucuuugguucucccguucuccuucuuacaagcaaagcaugaauguccauuauuguauggauaugaaugcacacacacacacacacacacacacacacacacacacgcacagacacacacacaagcacacaugcuugcauggccacauucucucucaccgacuguagagaaggcaaacaucguauuaucacaaugcaagcugaaaucaaugaaguccaaagaggccgaggaaaccuggcucuagacccucaguuuuccugcugcugaguaugaaguucaaggcugcugccagcccaauucucuccccugacccuaacauugagggugcauuguacgcuguagauuguuccagaacuucuggaacuauaagcaaggugaaggacaggaacagauuuuaccugagucccugccugcaagagggagaagagagagggacagcguacaagcaggcggccuuugcauguagacguaggauguauccagcucagaaauacauguuagcugugcaguugauuuauucuugagggacugugguauuuauacuagaaagcuuuggaaugucuucuguuuuauaaaaauugacuguaaaacaugugaccuuuuaaaaaauaauacuuuuuaaucuuugagacuuucauauuaugcccacugcuacuucccuccagcuccucccaaacuucccccaaaaugucucugccccgacuucauuaguugccuuuucuuccuuuuuagcuaauaacuuacugaguccaauuacugcugcccaugugggcaugggugaggggcugggacuuccuccuccucagucaucaacugcccaaaguuccggagcuagggauggauagucucaccaucccucccccauccauucuggaauuuuggcuggcuugaucuuguguggguaaccauagcugcagugugcucaugaguguaacagccaugcuauguccagaagacagcaguucacagcucugcuccccauuuucuggcucucacauucuuuccaccccccucucucgugauguucucugagccucgggucaggaguuuagaugugagcacucagaacacaaaccuucugauuagcucuuguuggcaacuagcaucaauguuuaggcuucaggacacgcacgcugaagagcugagugcuuuucuguugguguuccgccuugccuuucagauacagguauagccacaccuucacccagcucuccccaggaacucuuaaagacccacuuucuggauucugaacggagucuuuaccccaagacaugugacaaguugucuguaaacaguaacgccaaagugacacugcuuuuauuuuucuagggauuucugguauugacuguuuccaagcuuuugcuaaagaaauauuuacauguuuggcccuuauuuuuuuucagacugaugguagaguuugaauuccuguaauuuuugugaaggaagaaugugguaauaguugggaggugaucugggccagagagggggaaaacgucauuucugagaguagacauugaaaacuuuguaacagauuucaaugugaccuuucugaucuggguugguaagaaguuggcuuaauuuagaccuguacacaucgcuccauggauuuuggcacccgagcauuugaaauggcagguaucuuuuuggcaucucccaguuuucauuuccugguguacuguguacauguugguguuaagggguuccuaccaugccaauauguucaauguuccaaauguccuaaacuacccaacuugaucaggcuucuauauuuuaguguucucugucugcugggguuugcuugaucacuuagaggguucucucucucucucucucucucucucucucucucucucucucucucucucucauauuugcuuauuucuuauuuuucaaaguauggaauucuguguuuuguuucagacccaaugucuguggaucacguuauaaugcauacuguuguccuggauggaaaaccuuaccugguggaaaucaguguauuguucguaaguaaauggauaaccugucacucacucaaaugcuaucguggcuuucguugcauacuugcuacugaauacuaugaauguguuuacagcucagccuucuggagauaagaguuuccuauuuuuucugaaucccauuuggggaacacaauaacuuuccaaagcacugcccuucuuuaaucagggauuuccuuuagaacauuucuaaaucuacagaauggagccauggggacucuuugauuacaguugugugcuguuugcacgugcugcuccuggcugcauagacgacuguaaucaugcuaaugggauuuugaacaagggcuucucauugcucacuuccucguuuuaauuucucccuguuuggcuguaaugugccugggccuccucaaaccaccuacauuaaacuugagggaaagggcaggucuaacucuuggacaaagagcaaaggcagugacuuauuuuaauggucaaagucacgacuggcuaugucaguacacaccaccaucucagaacuccaggagcugaggcaggaggaucaagagcuugaggucagcuugggcuacuuagugagaccaugucucuauaaaaacccaggcaagguguuaugcacuuuaauccuagcacuugggaggcagagaagguuggaucucugugaguuugaggauagccucgucuguccaugccagccaggacuauacagagagaucuuguuuaaucacaugcauguccacacaccaagaauaaagaaaaaaauuuacuagugggguagggauggugggauucaggguuuuguaaaggagcuuggcaguagaguccuuuccuccuaguucuuuggaauucucuggaaaauuuucacuaggcaucaaaauaaauguugcugugauucuaugaucucucaucugggaacaguuugucauaucuaugaaaccauuuaccauguuucaguuguguauuuacccuguuuauuauuuuagcccuuuucaucauguuugccucuuacaggcucucaaggaguuuggguaaaggaccacagagucuaacaaguagugagcgagucuuaguuugcugagaacuacagcuugucugccauuuaauuugcucuagaggacacuagcagaacacuuggcucugggugacacugguagugugagugucuccuugacuuguagaaucaauucacagugguggauuccggauucuccccucaggcugccaguauaauuuggagcggaccgacaauuaaauguuuauaauaaaaucauaugccaagaauacgguuauaagauuuccauuauuaaauuauaaauuaauauaagaacagaguucucaugagauuuuuauuuauuugguuuucucuucauagccuguccagggacacugagcgaauggguucuguugaauaagagaaagggaaagaaauaccaauaucaauaagggaguuacugauuucaaacuaguuucuuuacucugguagacuugcuuuguacaugaauacaggaggggcagugggcccugggcccucaucugagccuuggacccuaugccuaguugugugcugaggaacucuaugcugacagacuucugauuugauuugcagccauuugccggcauuccuguggggauggauucugcucgaggccaaauaugugcacuugcccgucuggucagauaucuccuuccuguggcuccagauccagugagucuaacaugucauuauagacaauauuauuuuaugugguuaugcccuauuuuccccuaaauuugcuguuagguuuuuuucuuugccugcaauacauuucccucugacuagaacaucugccuuuuucacuuugccuggaauucuuggacaggcauuccuggaucuagccucccacuucuuuacucuuuauaugaaaauugccuaugggguauaguuacuaggaagagcauaaagauuaucaccuucaaugucacacagcccccguucaucucuguaucuuuaauagaagcacuggagaaaaguguucacagaaauggucauagaaugaacgguuuuuugguuccagaaaaugaaucccccccuuuuuuugugcuaccgaaaaauaaaacugauucaaugacaaacuuauuugaaacucaagacauuugccuuucuacaaggaaaccacgagacucagugacauauggacauacagacauacagacaugauauaagcaugcuguuuauucugucuggccacacaaacauccacaguucaugcuagagagccacccuucugguuuuacuguuucuuuuaucuuuaagugugguauccaaaguauugaaaagggggacauguggggaccgggaggcuaguccuuucuuaguuguuuaaaaaguuaaaguucauguguguauaaacaguccucaaaauuucaacuguugccaaggcaaaacaaauguguauuccuauuucccuucuaguuucuggaggagaaagugcacacccuuacugcuauucuauguuggaugggauuuucagagucacugguguggugcaaguguguucuuuuuuugucuggugccaggagagacugcagugugucaagauucccugucugcugagaggccucacauugaguuguggcuguuaugagcccaguggcuggcuccagugaauugucugguacagcagaucuucuuaguguccacucaugucccuuggcguucauaggggagcacaugaagucggcuugaaagcuuggucaacauuuuucuguccagggaugauccagaguagaggaagugagggguguggccagcucaguggacacagaagcaacuuuccauuggugacagauggagcagcucuggggcuucugggcuagaguuuggauagcucugagauuuguucugcacuacuuccuaaaauuccugaccagaacccagccucagcccauaguucgcuuccuggaaucacucccaagcaaacuaccuuugcugaaauugucucagagucugcuucuguggaacccaaguagagcuggccuaauacuaaauaaagcugguuguagaucaggauaaaaauucccccgugaccuaggaaucuuaacuccacacacugagcauggcauacucguacuugauuuuagccugguuuuacgugugugugugugugugugugugugugugugugugugugcgugagcugacucuacccaucaaaggcacccaaacuggaggaacagaaagagacaaccaagucaacuggccauuucaggaacaugcagggcaucucuauguguaccccaaagaccccagacugccacugaggagagacagccucaguaugggaaagagcaaaguuaucaaaacggggauaaaaccauccucuuagacuggccucucuuaucuaauggucaccuuaagggaagaaagucacagcugaguguccagauagaaaguuaauccagugacaaugugagugcugaagaugucugugaggaaaaaccaugggauguggacaggauuuuaacaaggcuagagaugguccugguaugcuucaagcuagucaugagguuggaagaaguauaucaguaaggcccuaggccagauguaagcuagagauuugagucuggguguuauggguggugcuuccuagaaaguuuggaucugucugggugccuggacuuugggcaaagccccagagccaaguguagaucagaauaguguguagaaagacuacuacuuccucaagaucuuugagguauauggagucuuaaaaauuauuggcuugaacucucuuagaauuaacauugucuuaagagcaugaaaaaaaauuaaaguuggcaauauuuaaaaaaauuaaguguagcugaagauagccaaaaucccuuucugguuuuuggaaaugauguuuauggauuaguuguguuguguuagagaggcguggucauccuguaaaaguugucugugcauauggaucauuugauaacucuccugcuaaugcuaaugggauaacauccaucaaugagauauugucauucaaauaccuguucuucuaaaagggcccaguucccaggguaucuaaccuuuuggucuugugacagaacacugucaucuacagcaacccuggggcacuugcagccugcaggcuucagguugggcaggucugauuuccaucauuuuuacuacuccguccuauggaaaaagaaacucuaauuauuaugugaugggggaugaaggguuguggaucucugaccucuuauuguucuggucugauggaggaaaggcuggaaggaagcuguucuugcaggugguguuugacuugaauggcccaugaauccuaaacgggaagacaucucuccacaaguuuuaauccccagccggcgauucucaugggaccagaaggauucagcuucccuuagaccuagcaggacucuggccacuggccacuuaggcucacaaguugaagaaauauuagacaaaacgagagcugggguuuuucuuuguuuguuuuccuucuggauuuuaauuccaguucugguuaggacccuauuuaaguuucugaguccaggguuggauccugagcaauccuacuucuuauaaaguccuaccauguuuauuaaaugaguuuacaacccuccuuaaauauguauguacacauacauuugcaaauucauauuagcuugcaauacuaggauaaagaacuguuucagggggcuggagagaugguauagcaguuaagaacauuuguucuucuugcagaggacccaaguucaguuuucagcaucuauaacaguaacucacaaccaccuguaauucuugauccaugggcucuggcaccaucuuuuggcuucugugauacaggcauaauacucauaaaauuuuuuaaaaaggaaggaaggaagggaggaagggagggaggagggaagagagggagggagggagggacagagagaggaagaaagggaaggaaggaagaaagaaaggugauuuagagggcuggcuuagugguugggacucuggcugcuccgcagcaggacccagguucuuuucccugaugcucuugccaggugccucacagcugucaguaaguccagcuccagguaauuugaaaccuucugggcuccuuaggcacccaugcccauacacauaaguacaauuuaaaaaauuaucuuaaaaaagaaaaauguuucaggcugccauaacuaaauaucauggaacuuuauuuuaugguuuuagaaacugggaguuguaaucagggcccuggaaguuuucauauaaggguacauauucauagcugucgcucucuguauauuuccacaugacagcagaguaaacagucuccugguccuccuuggaagggacugucucaguuauuuccccacugcuguaauaaaaauaccccagagaaaggaauuaucucgcucacagucucaggcuagaguucaucacugaagguaggucagcguggcaggaucuugaagcaggaagucacaucccauguacagugaagaguagaaagcaugaaugcaaugcaugcaugccauugcacuccucacuuucuccaucucuguucaguccugaauccuaagcacgggaaugguggcaccugcaguggacagcuacuuacccuauuauccuagcucugucugaccugugaucugcagacauuuccgagcaagccuuucuccaugguuugcuuuuuccgaaucaguaggcucuuccaccaagcaggauuuuaaagccagugcacuguagcuuaucagcccuuccucugcucauucaugcuucuggcauccagccccagaauguguugcauagucuuugaucacagagauuccucucuaacuugucucuaacuguuuauaguuuuacaucaacaucugugguuuccauggagauacauuuuguguuaagaaugagguugggguuagggucagcuguuaccuauggguguccaguugcuucagaagaaaccaaaauucugucuuuaagcauuuaguuuugccaugguuugucucauaaagguugaggagauggugggagcgaugaguguuccccagggaagguuccucagguuguuggauguccuggaaggaauuguccuuuguggccuuuccccgaggugagucaucuuacccugccacacacuccugccagugugugcuccuuguaggcacaagacaauggggcugaaacuguaaaauggagucuccaaagguaugagccagcaugaccccugucucucugcaggucgauuagucaagugguugacauagagauaggaaucugacugacaagauuuacuuuugugguuugucaacagucucuugggugugcuuuugugagucugagcucucugcuaugccauugaucugucccuucuccacugucacacaugugauaaaauaaauccauacucuugcuuuggucuuucuuuccgaauccuuucgguaauccuucaccuguccauaacaagcucgggcugaccacaccuauuccuucacagccuuagcauauuuugauaggaauuauauuaaaucugcauaucaaauggaggagcacuccuaucucacgggaacccgcccuuuucaagcuuugucguuuucuguuuaauucgauuccaguugugucuagggacacuucuacuuccagcauagaucugagaccguaggaagaccaaggaagguuaagagugugguacaaccaugugccaggauugugagagggcgcagaggaagagauacuuguaccauagcuucucugaaaggcuuggcucuagaaaacacauuuuagggaucuguaguguuuacacugacagggaggagcacccaaaggcuguccagacucauccuuuacacuuguugaauuaguuuucucucuacacagacuuuacggaaacuuauggcagaugauacuucaccuaaacuuuucugaacagcucaggugacuuuuauguuuuggaggugcucuggccuuguuuuaagcugugugagucuguagacacccacagauguuuaugcaccuaagggaauuaucgguccaaaugaaaacugucugugucuugcagugacucaggccaccucaguggauuguugucucagguguagaggcuagaguuuggucugccuauuucauuuuucuguuugggcuuuucccagugcugaaauuaaagcacacauucaguugcuuauuugaaaauuuccuaaugcucucucugggggcugagccugccuagagggugaugguugagauguugagauccaaauguuggcccugcaucuuucccuuccugugcugcaugcaugccauuccuuucuaguuagucauuuuaaugaguuuguaccgcacuuucuaaagacaggcuuugagcucuuccugcgaccuucucaauggaagauuuucagugggugcuuguugagugauugaagggaccgauucugaaaugaauacaauacuuauuugggaccuuuuguggcugcagguaaaugugggccgugucuguuacuucuagguuguggauccuggugugaaaugaucagagguucucuggccaucuuuaaugggacuuuuucauuaggggucugacugcacaggucagcuucaacuugcacaaugacugcuuagacucucuuaguauucuguuucugguaaaaucucaauacggguugaguuuaggcaugugucuugacauggguuuuuuagcacauccauugauggauacugcauccuaugagugugaguagaacucauagucuggucccucuaaacaauuuccagauuaggcggcaaaggcaaagccuugucagagauacuagguuugcacccaccuucuaaaauaacuuuugagaugaagucucagucuguagauuaugggaauuuacucuguagcccaggcuagccuugaauguaugccaacacuuccacacgccagccucagucuacccagugcugaguguuuguacagacaaaccacauaccaggcuugcucccacuuuuaaaggaacacuuuuuccuuaagcucuaggacccaucuaugaaagcagugauggaggccuccauucugcugauaaccccaaggcccacugggcagcgugaccacugggcucacaaugacuuuuggccuuccaagucucacagggugguuuuguuuuuuauaaaggagaaagaauauuuuuaaccuggagaaguuucaacuggaaagaggggguuuaaggaaaugaaagcuguaucaagggaggcuuuugaucugucacguuucaguguacacagaguuguucuuccuggaaaggagauuuugcccugacuuucaauuugaacaaguaacugggaagccacugugcaagccacuggucacucuuuccuuuuuuuguuugaaauugcagaguagcuaagcggcuuuguugcucgugugggaauggaaaucgggccuuggcaugagccacuuuaauugaaaucaguuugugcacugaguuugcucgaaggaugacgucauuuccugcccuuucccaguccuugcuguuuuucuaagauagcauggaacuaagcauagcacugaguuuuaaagcaauuguacaccauuuccugacccacuuagaauaguauccaaagccuuaagcguauuuuuuccuuucuauacuuguagauuguuuuagaguuaaaaagcauuuggcuuagaggcuuuaauggagccuaaaguaaccguuugucugcaugguuugcuugaugucuguagcagggggagcuauuagcgcuuguagauggagggaaaaagguuaaaauguuugaaucauuauccucuuagagcuauauaggcaccugggacacacggggcagcuucuuaaccuggguuacucuuccagucugcucaucaaaccagaugugcaggguuucaucaucucccgucuggcuugggagggagggcagagcagaagucagagaggagcaaagaaacagagaggcauuuaaaggcugauggagacuggugggauuugaugagagcuuuaguuugguccccgagagcuagggacaaagaaacaggagagguuaggagggguuccacaaagggaccaccucagaauaccuugcauuuuuaaugacucauaguaggcauucagauuuauuugucaggggaccgaaugaucuguuuccaggucaggagacuguucugggagcucugauggguuguuuagggcccuacuggagaggcuuugagugcugaggugcagggaucuucuagcucaggagaaauggagccuuuuaugacauuccaggaagagagcaagauucuugaaaaggcagaucacuuucaacucuuugugucugagaggcugcaguaagaauaggaguucaauuuuucauuuuucggcugucgggcuagguugaccucugaauauuuguagcucuuuagacaaauguccuuuccucacauagccaaguagucauuucuuagcacugcugcgaggaccucucacagaugagguuggcuguggggaggacucucuuguacucuaaggggaagaguacucuggcuugcgcauuccaugaagacagcuuaagagugcucagagcccauugacuccugcuucugcauagucgggacagaccucuguucccugcugagccauuuccacugggaauugacucccacacauaggacacaccagaaaaaaagccaaaacuccagcuuccaacuauggccucauauugagaagugucaacaggacucaugauucccuuagccaagccuuuagucuccucuagguaggguaguuacugcuucuagcaacuagggaucagcuggaccuuuugaaaaugcuaccagcacaagauagcuuacaugcuagaggagagagcauguucugugacuauggacaucucucauaggagggucuaccagauauuucuaagacuccacuuuuagugugucacugcauuagcauaucacugucugucucaggucugaugguauccacccauagucuaggauuuagaaaugcacacuucucuaggugagaaugugacacagaauggauuugaaauacugauggucuuucauuuaacguuacaguuuaaaugagcagcgcuuucuaaguucaacucucuguccaucaaacaucguugcuauuguaacgcuucuaguauguccuuuuagccugccaucaaaauggaagaaaaauggguggaaaguauuacuccaaccuuuucccuggccagauacuuugaacucugaaucuuuucaugggaaucauugcuaccucaaccuuguccuggggccaucacucagacucuccuuucuuauugguauaaauuacagagaugacacuggaauauaaauucugcuaaauuaaggaagucauuuagucccauuaaagcaagugccaaggaaaaaacccacauugcacuguaagugguuuuauacauaacauaaugagccucgauaauuaggacccuucugcuaucugcaugauauaugaaucucgaugaauuauuuuauuuuugucaaauagccacaagucaugucaggugaaauguugccaccugcacacacaaacugccacacuaagccuuuccucucuuuuuaucccuaguccaacacugcagcauccgcuguaugaaugggggcagcugcagcgaugaccacugucugugccagaaaggguacaucggcacucacuguggacagcguaaguauaccgugugguagaugcuggucacacgcagaccuguggaauuaugagacaggugcugggaauuuucuuugauaacucagggcgccacauuuucgcagaugucucgggacccuugcagauggacagaucaccccaacauuuaguggcagucuuccaucccgggguugauaguaacuugcuugguuuacauucuuuuuguuugccuuuaccaccugccuugccucacaccuuagacuuauagguaugaaauacuucuuuuaaaaaaauauuugacaguuauuuaauuaauaaacuacauaccccauccuuucccacuguagggcuucauaauguuagcucaucuaccagauggggcaaguaucaccauaaaccaguuuuagagcauuuucaucccuucagaaagaaauuucagccuaaguuccacacauuugccucuugauuugcugacugucucuaccugaauuuucaggaaguauuucaaaacaaaucucaucucucuuuccaaauuuuuuccuuguauugacuaauugugucugcauaucuccagcuccccaugacggacucugcuacacucaugcugacuggaugucuaguuugcuuguucacucacaagcaccauugauugugucugcacucugcugguccccgcacacugcuuagaauagcuguucaucuuaugagcuucuucauuaccguaggaugaacuauucacacuauagaaaaucuuggaaaauucauuauuaguaaaacaaaacuaccuauaguucuauaaucugaauacucuuucuaggcccaagauagagcuuuuauaguuaauauuuuauuauuuguguuuucuugucaauuauuauuucacaguuguguuaaauucuacuauacauaugcauacuuaauaaaauguuauuguccauguucuuuugaauuuuaccauuguauguauaugauggaaaaugcuacuguaaauaaaucagcaccuauauuaugcccagugauuaucuccacacuacuaugugacaagaauauugaguuuugggcagcccaacuuggaaagaggagagagucacagcagcccagcuggaaauuaauaugguggcaauuauuccuugaccagcuaauuccccaaguaaccacacagagaccuuuuaauauuucaaagcuuaggucuuuucugggcagacucucaacuagcucaucuaaguuaaucugaucaucuagccuuauccagacuuccaggucaggagucacacuggucuucccuuauaucuccugaugaaagaccuuucucuuuucuucuucccagaguuccuuucucucccaggaaguccugucuuccacuuccugcccagccgauuggccaucagauuuuuauuaaagccaaccagagaaugccuuagauaggcgaggaaggacagagacccagcuucacacagugaaccucaacagaaucccagacuuaacauuuggucacuugcaguuaauggugcuaucagcaugaacauugcugcuccuuagggacgcccucucaaaauuacacaucaguccuaagcaagaguccacucacucacaugaaguuuguaucuggugaggcgaguuugaaacaugcaccuuagauggagaacugaaagcauuucucaggggcugcacacacugagaugagaccguaagcaugacccagguacagagucggcuguucagggagcauccuauggugaucugcaacuguggggugucugcccaaagcaacacugaggggagaucauucccauuguguuugcugcccuuucugaguggaaggguccaagugcagcauccugagacuuucucuccuuaucuugcagcugucugugaaaguggcugucucaacggagggagguguguggccccaaaucggugugcuugcacguacggcuuuacuggaccccagugugaaagagguaaaguguuuucuaagugauuuguauaaaggcauucuggugacuaaucuguuacugguuuauauugucaucgagugugugcagcuacuuccugaaguuggcuggccaggcuucugaaaugugacugaagaggucuccaggaugccaaggauacccaggcucuggguuugcaugcugcgcaggucuuggcaguggaugcaguguuucauaguuagcuuacacagaagaagggugggcaccaacauacaaagaggacaauuucccauacaggugaaaucaugaacuucacaugauccuguagguucgagaaaugcauucccacaagaacacacauagaaagggaaauguguaggaugaaaaaacacacuagaagagccacugacccuggcagcagcuggaaugacaaacacggaguccacgguuaagugcaggggucugcuaaguagcugggcucagcacuguguacucaguguguagcccaggaaguguggacaucuguucuugcccuugccuacaaaaagccacagcucagagauguccaggaauagccuuaaggccaaaugaguaucaauaaacuuucauuugaaucuggauuuuucaguuucaaauuuacugcuccauguuccuaucaguuaaaagaaaaauuuugccugcuuugccuagcuaauacgauauugacuuauuuggggaugcauaauguucuuaauagaugccagcuucauuuaucauuuugucucuacauucauagucauuuucucaucauuucuaguuaaaauuuuuauuuuaguguuguuuuaaaacuggucuuuaaaguaauuuaucuguuucucugcauguuauauauuguauaugcacauguaugcacacccauguucuacauguagaguccagaagaggauuaugaauuuacacauaagcagacugcgcaccaagauacaaagggacaauuuccccuauuucuccuucuccaccuugcguauugguguuaggaucucucccugagcacaaagcuuucuguuuuggccagccuggcuggccagugaguucccagaaucuaccugucccuuccacgaaaugcuggggucacggggauccacuccaccaucacaccaaucuguuauauggcuucugaagacuugaacucagugacucugacuucuauagcaagugcucguacccacugaagcaucucccuagcccuaccauuuguuauuuagugaagcuuaaaagguuuguguuauauaaagcugaaauuggaaauucuccagagcuggggaugauauagcacaugcuuuuaaucccagcacuugggaagcagagagacagagguaggcugaucucugugagaugauggcuagcuuggucuacauaacaaguucuaggacggcuagggcuauauggaggaaucuugcauauauauauaaaagaaaauuccucagaacuuuucaaaauugcaaugaucacucuucucccaaauuguauaaagaucuuauucuaagauggaaagcaaagcuaauuaugauugugauugacacaugucacucaaaccauggagcugaaacaaagagcacugcaguaugugagaaguuguuuauuuuucaauguugacauaaauucaguuguuuucuaauauaccaaagguacauuuugauaagcaacucuagggcaguugcuaugauuguuggauaaacgacacaguauuucuguucuuuggcccacucugaguguaaugagugaggccauugugcuguauauugacaucuuuuggagucuguguuuaaguguuuucccuuuauaaccugugcacauauauuacugaccuggagcuaagacauauccaguggcacccuaacaaugaaggacaauuuguaauagauaguagccuucuguggccuuacuguuagcucggugaagaugcuaccgauuaaaauuguugauguauggcuugguggcaugugaagggaacacuuuagacauuguugcugaguuuaauuuguuuuggagaaacaaugaauaaaauaaacauucuucuucaaacaaagugguccaagguugucugcaaagaauaauugcuucccauggugggaggugcugauguggagcaccuaagggauuucgagcuguugauauuuacccguuacuauuucaaaaaugugauguuugccaaagauggagaaauggccugaaugcaugagauuaccaaauuacuaaucaaaguggugaguuucgauguggagucuccaaguuuaggguguauuuaaguagccuucacugagauguggaaggacuuggccacagaagaguagcgacuguggcagcuuuccagauaauggagaaguggaggcuggggacaggaagucggcuuucccuagcuguuacccgccauuguucucccaggagcacagagcugcccuucagugagggaggggaaccagaaagccuuucuucucaccacgggggaggaggaaguaccauuuugauugcagaauucauuuuuaucuacugaaucuucaccauuuuguucucuuccgaaaguuuaaagaaugggguccuauaucuuuuuaccuauuacauaugugagauuucaugaaugguagaugaauguguagaaucuaucaugaccaucaauguugaagggaagacagcuucucuugaugaauuguguuaauggauaacuacuuagguuagugguagucuauuuucauugagaugaggcauuuuuguuuggaaaccaacuuuuuggaagccauuauuccaucuguucccucuauuccucucucugucucugugucugucucucucucucugucuccgucucugucucucucucccccccuccuauaauggcauaauggcagccauuaaaugauaaugaaacugcagguugccuuuucugccucuggagugcaggcucaggagcagcuguggguucagaauccuuagugccugacccauggaugugaacugcguuccucuagccucuucaggagauccagaggcauaguguuggacaugaaccauuuauucuagaaggcaggcaguguagguugucuacauguagacagauuagcauucuuaucauuugugccaaccuuggcuucacaggaaguucaggaccagccuggauaccugaaacccagucucaaaaagcaaauuauuauuauuauuaaaaauuaaggcuaggaggguaguuuuucuccauguuacaguucaaccaaguuuguuuuaaguaauuuuaaaaaccaaaagaagguugaaucuaacauaagguccuggaauuuucugacucauuuugauuuaaaggcaccagucuacucuucggaagaacaauucuaguccggcugcucucuauauuaaugggcucccaaggacuacauaggcuaugagcgugugccuagcuucuuacauccagaugcauuuguucagauaaaucccuguuccugucuccaggauaaggacaauauugggcucuguacccacuccagagaugcuuuuaguuguuagcuauuuaucagugaaguucaggggaagcacuguuggaauccaacagagggcaugagguagcacaaagcuggugccagucacugacgggacccaccuccugcaacugugccugucgugcagaugggcaggguuuguuuuuuucuguagcagugaauaaacaacuaggcugcuuguggcucaucuguaccuguaggugcggaugacgugcgaggauuccuguuuccaucccuuagcuucucuuacguuacaaaaguugucuucauuagauauauucaaaauaauuucauuaagugguuuuuaaaacuguaucauauuaagcaaccaguaaguauuaugugaaccaagaagggcauugacuguagugucuggugagugggaaagacuaauacucggugauacagauuuaugacaaccauguaguccugucuggauauaccacuucaucaaagaaagcggaugcauuguugauucacaggagcugauuagagcucuucgugacugccucccucccucccucccccccccucccucccucccuuccuuuguuuccuuuuugucuucaaaguuuuucuuucuuuuuuuuuuuugaguuuuauuuugugcuguguagccagauuauccuuauuuugcaauccuccugccuuagcaccgaccccccccccaaagugcaucauauuuggcuuaaaaucuguuauaaauaaauucuauggcaaauaguugggacuuauggcacaguguuaugggaugcauagagaaaguaauguggcuuccauagcggaucaaauucuuuuaucuucucauauauuugccuguuggugauaagaggacuuaacaaaaaccuauagaguacagaaaccuauacuauauggaaaaagccacauguccauggaugagggaaugaggagaggaaguggcagacacauguguacuagacuccucgguagcuuuugaaauagggaccuaccauuucccacaaauagacaggcuggagaagauuauauuaaauagaagaagacaucucaaaaaguuaaacauuucacagugccacuuggcuuggaagcuaaaaacaaaaaauucaaaggccaaauauuccaaugcaaaaaauaguagaacacagccuauacacaggaaugaaggagucuagagagcuggugaauggcggggucuuuuggugugccucuccgagacuugucugggauuggaaaugaagaggaccuuccuuuucucacuggaccgcuuccucucacugccucaauguuguuuuaaauucuaagaggcuguggauaagguucuuggagucagugcugcaaaccaacccucaucccucuggggccuuugcacguaggucagaacuuggaaugcugcugauuucccacaggugacaagcaauagucacaucacuaacauaugcugaaguacucugugcgccucgccuuugguauucagucuaacagagagggacaaugugaagacacagaaugcuccaaggcugacucuaugacuaaggugguuuuacaacugggcagcuggcacaucaucgaauacaccugauuuuuuuuuuuagacgugguccagaaacuacaccuauuaacaaagaugugcauauuucugauugaacagcugugguucagagggcacacgcaccucacagaaccaguugugugcaauuggaaacugccugauuucugucuuauacucucucgagcgcgcaccuuaggcuagguuuucuguugacacagagcauuuuaugauugcuuuccagauuucuuaauguagacaaagcacccuaccuuccugcuuuggcuuccaccaacaucaccaucuguaggucucuccuuuuagagucuaucaccuuugcugucuaggcagccuuugggggaaggauuccagcucacccacaccagcuuucucuuuugguagccuauggcuagaaacauuugugccuuuuaauuuuugccaccacaaaccaccaacuuuggcacaguaaaaauccaucuuuggaccccacauccauguaaccuacauugggcauuccugggugcucuguguccuucagggggcaggaccuaugguacaugccuuuguugggcacaauuuugaaaccucucuggugacuuguauugcaaaguagauucccaccaguucccucagaaguacuugugacaccuaguucugucagguaagugccucccaugggcacgucgauauacacacagauuuaagagacuaucauauccacauuugcaaauucugcaucaugguaucauacuugaccuugacagugucacguauuggucuuugugcuucaguugaaaggaucguuuuaaccuguccuugcauuagugaaguaaggauuuaauauuuuaaaaugugauauucuuauaugauauaagcauguggaacaugaucauaugugugcagguauacauacaugcagaggccagcaauguauaccguguguccugcucugucacuguucaccuuucucccuugagacaggguuucucaccugaccaggagcuguacagaccugagcuggcagucucaggaacucucuugucuucaucuucuacacggugcuauggguacagaaacuccugcagcaguaccugguuucuucugggguuuucaagcucgggccguuacaugagcacaggaaacgcucacgagcuguaucuccagccccaaggcuagaaugcauacuauaaaauuugcuaucacagagaauuaguuucaaaucuuaccuuuuacuuuuaguucuugugaauuuggaauuuuuguuuauuuaucguguguguauuugugucugugugucuguacaugcuucuguacacaugccacagcacguguguggagaucacaggacaacuuuuggaaaucuauuuucuccacccacuaugugggacccaggggacaaacucagguaauaaaguuuggcaccaagugccuuuccccacugagagccauuuugcuggucccgugugaaugcguuagaaaacaaagcuggauaugagcauccaugugugauauuugggaaacuucuuaguuuggaauguguaaagcucaccauuuuaauuuuugucauagccacgggaagagaauggcaaauucuauuuuuuaguuacauuuuauuuuaaccugauauaucuaauuucauuagauagcauuagagguuaucaauauaauguauuccauuauuuuucuuuaguaugucuuugaacaccaaaauccauguuuuaccacaucucagucuaaagcaucagauagcugcuuguggcucauggcugugguguuauccaauacagcccagagccuugcuuccagcguggauagccaaccuuaagcaaggacuuuucucccuccaacugccuuuuuuuccaacuuuacagaaagcaguauuuuuacacaaagcaaaaaggggcagcauggauacucaaaaaguaaacaaauccagaggguaccauggcuucaaagcagccuaguuuaucaggacuuuuuaccggaauccuguuaagcaugagcgaggaacacacuagcugcaucaugucaggugugacaacuacaguaaauguuuaguaaaggcccagccuugacuuacacaagugguaggaucaggaaguaacgcauggcucuugucaucagccuugaaacacacacacacacacacacacacacacacacacacacacacacacacauugcaaagagccauuugugcaggagacagcaaaguagcagaggugacaagaaauaauguaaacaguaggaagacagugcacagauauacagacacucaguuuguucuggggcaaaaaggaggacucccugcugggagcacccuuuuaugggagcacagauggagccuaaaggucuucuggccucauuccaaagcgcuggguucagggcucucugagguccaccccccuccaccgggcuucuguauaacuucuguccaaggcaagguaugggcuuuuaaagaaauucuccuuuguauuaaggcaggguaguggaguuuucaagaaauucuccuuugcauguauaaauugggagcgggccagucuauuucugaaacuguuucagcucugucuaugaacugccguccagagacucuuaccaaguuuauaugcacaguugagagcauuaggggauacguggugcuuauguuuccugguagucauggucccuagggagucaaucuuugggguuuauuaauguauauuggacagauaucuggagcuaugugguccaucugaugugccaaaguacuuuuuguagaacauuagucccaagagggguccaugaagcguaguuuccauggucaauaucauuuuggaaauccuauacuacagcccuacagccuuauucuuggagagguaaugggggcauuaacuuaugaacucuugggaguucugugugaaacaaaauauuuuggcuuaacuuaaaaacuggauauucucaaaucugcccaucuauccuuccagaagccuccauuccccccgccccccauugaugucuuugacauccuuacccugaagcucuggaugcugauuguauugaugauggucgcucacaugcccaugcaauagcuucauguuuugggauuaaguucugcuucuuucaugauccccacuccgacgaggugaccagcuaaacuccugggugguuuuggaugaagagcaucauuguaaagacacucccucauucucugagaggauugaaaauguucuguaucccauguggacaugacuguaaaugccuaucaccaaccuguguggagggauggagucuguggaggacaugaauggagcauucaacagcuuucccacugugccuccucaucaacaaacccuuggcucugaauuguuccagaacuuuaaaagucgacaauagauugggaucuuuguuuccuuagaaaaugaaaauauucuagagcagcauuucucaaccuguggguugcgacacuuugcuggucacauaucagauaucuggcauaucaaauauuuacauuacaauucauaacaguagcaaaauuaguuaugaaguagcaaggggauaauuuuauaguuggggaucacuaugacaugaggaaccauauuaaaggguugcagcacuagggagguugagaaccacugguuuagggucucaauucauaaaauagggcugugucuguuucuuucuggugagcuguucccuggcuacuguccccacggaggccccuuugaccuucauuguugcaggacacugagccaggcuauaagugaaggcuugcaagucaggcccauguuuauccaaagggaaaguguuuuuuauaagcucgggcuugcuuuugaggagcugggcuuuccgucaagucacccugggaugcuugcgcugucucagagauccuggucucucuaaaucagucucaugaacuuuagagcaaagcaacacaagguccccucagcaguuucgauccagucuuuccuuauaugacuuauaaacuucacuugagaagaggacaguauuuugcaccuuucucuagcaugggaagaauaaaauccaaggcacacggaacaucuuaaugauucggggcuggcacuggaaacaguaugcaguagaauugaccugucuuccuugaggaagacagccuuuaaacagcauagaaaauucuugauuauuuuuuagagcucauaaccuggaguagcucggcgcuugucagccuucauuuagaaccacauucuuccugucauguuuccacuuaccaagugggacaaguucucacaaaacccauagaagacagcugguugaagacauccacagccccaucgugggucccucacugugggcuccuuguggcuuauggguuguuuuucuuuaucuuuuaugaauuagaggaauuaauaggaaaaucauuuccagacuaacuuccaccccaaaggagccccuauuucauuuuaauauuauaugacuaucauuuuaauguuacuuaaaaaaauuccugucuaggagauaucauuuuucuuaacugcuuugccauucccggaauucuugggaauauacuaagggcacagguucuggagagaaauccuuccauuugcuggccauggggccguaggcaacuaacugcuuucguuuuacuucucugaucuguacaauggaugugaugaaggccugugccuggugaaaguguugagaagguacaguggaagcacugaacccaggacucaaucaugcauugcuggugacuggcguccucacucuuugccagauguagcuucuucauaaaugaugucaugaaaguuaccauaccaauaaaaucagaccucuccuuuagaggcucuacugugaucaccaacaccccccccccccgcaucccccacucuccauuuagaaguuuucggaucgauucagaugcaaccagcuuuccucucgaauauauuaucagccauaugcauuuccuuaacacacgcccagcuauugcaugcaguuguaccacagacugacaccacaggagggcaacgugcaaaaaauaaugaggaagcagaggucggccacauccuugauaauauauaaugccgaucgaggcugugagaagcgcucacuguccacccuagauaaaguuuauggaagguuuuacuacuuuuauggacacauacaaccaaaugaagugugaaccugccccuucacaaaaacccagcagcaagauaaaagagguacuuuagggguguguuuuuauuccuuauuauucucauggcuguuauaaaauaucugacacaaauguuggcucgugguuuaagaaaggauacagucuguccuggcagagacagcauggcaggaggggucggaaguggcuagucacaugguaucuacagucauguagcagagagcugccuggaagcacugcuaccccccccccccccaagucccaccacaagugacucacuuccuccagagaggcuccgacuccuaaggguuccacaacccuccuaaaacgucccaccaaaaacuggggaccaaguucacacagguggagauuacaggagaagcuucgcacucaaacaacagcugugugacccucaguaguguggcauucuaaaaaucagugagacggguuagauacugauggcuggcagaacgguaggagcagcugcccgaauucauacuuaauuuuacaguggcucugauaacuugagucuacagacagcaucgucagguuggagucaaaaaaggccuccagguguagcaccacaagccacucuucuuuuauuucaaagcaauaaaaauguugguucuggaagacgcaagcuuugaaaaccaaaauauuggaguaguuuaaaccuacagcuuucaaagcaucuuuauuaguguuaaggucuaugaagcucagccugaacaagaaggcaucuuagcgcuggagagaugacucagugguuaagagagcacacgucucuuuucagaagaccccaguucuaguaccaacauccacgucaggcagcgacucacagccuccaagggagucagcaccuuuggccucccgagaaaccugcacucacaugcauagaccucucacaugcacacaccuacacauuuucauacaauuacaaauauaaauagaucauuuuaggcauccuaaccugaaaggaaauugcuauaaguggagaggagauauaaaguuacuacuguguauuggugagagagcgcaugucugaaguagcagauguaauacaauugccccagcuccuaaacugugcugguaucauagcaccucuucuggacauacugaggagccucauauaauagauuuuucuucauuacauuaauagaccaagucucagauugauacauaaaaugcccccaaugagcccugaaauacugacucuguuaagaugagaggguucuuugugguuuucuuugaagacagagggaucuugauaauuuuaucauguacauugcuuucuuucucuaauuccugugcucaugcagcucugagccccuaguuuuucccuggaaucaucauugaguuggaaucugggugaccuagaaacaaggacaccaugaacgugaauuguugaaacacuacgcauuaugagacaaugcaugcuuuugaguggaugucugcagacuuauccccugggaacgccuuuggauguccuaauugcaguucugcccuccauaaaucagucgcuauuuggacaagucauggccaccuccucagucacuagauacauuuguaauaguuucugucagaaauaacaacagccaccuagcaacauacuguuuggucauguccuguuuuagaaugccacguaugguuuugugggcuucagaaggguaaguucuuacugggucuaaaagauauugaaaacgaaacaguagauagugacaucacuguguacaagaguaggcugcauggagcaguuuauauaagaaugaaguaggggccgggccgugguggugcacaccuuuaaucccagcacuugggaggcagaggcaggcagauuucuuaguucaaggccagccuggucuacagagugaguuccagggcagccaaagcuccacagagaaacccugucucgaaacaaccaaaaaaaaaaaaaaaaaaaaaaagaaucaaguagggguuugcugguuuguuagcaugguucuauuccaugggggggggggcagguggucacucaucuuguucaccaccuuauaaccaaugucuagcauucaguaacucaguaagcauuuaucacaauucuuuugagucacuuaagaaaugauugaucuacccccugaccccuguaggcaggguugcuuuggguuuuagguuaguauacaaaacaauggcacuuccauauauauguugaaaauccucuaacuuuuaaaacuaugaacagugucaaacgcaaccagugaauucugugaaaagugcucucuccuaugccaugaagccuagaccuguaggauacacauagacaucccuagcucacuccgccuugggaggcaggauuauuuuauagccaggaaaacuggggcuggagggaacccuaguagccaacaccaaagugggggccuaaaaaugagguccauggcuuccacaacagcucaggugucauguggaugugcccccaaccuguggcacccauggcugccacucucaaucauuggcuauuuuuguuuauguuuuuugguuuuuuguuuuguuguuguuguuguuguuguuuuguuuuugagacaggguuucucuguggagcccuggcuguccuggaacucacucuguagaccaggcuggccccgaacucagaacucugccugucucugccucccaagugcugggauuaaaggcuugcgccaccacugcccggcucauuggcuauuuuuaauggacccucugauauuaagcgucuuuauuucuuccucucgguccauacaccucuuuaauuuuggauugacauuuuguaauuucuguccugugucccuuagucuuuugaucagucuuuuuaagaucucaauuuuauaugaccaagaaaaucuuuuggauugaguuuauugggagagauugucuuuaauuauaaaacgcuauuguaugauuggcagucuuuggcugaggcugugaugaauaaaauuuuuauugaaauaugagggguuugaggccucauggaaauugagcuuuggcuuaaauaggaagagaagaggucccgaaggagcuugaaaucucucucucucucuuuguguguguguguuuucaggagcugggucucuccuucacuauguggguucucggaugucaggucaucaggcaugacagcuaaugcuuccaccgccgagccuuuucucuggccucuuuugagggucggucauggaagcuaggagccagggaaagguugagaaucaguugucucuugggaucagucuggcuuguuucucaggaggcauggaguucucuuuaucaugcaaacaacugggaauuugaaguagaaagucucugugggaacaagcuuugggacugccaugucacagaacuagagaaugccuuuaaucuaaaagacauucaaugagugcugaaagcacucaucuguccuguccccaccuguggcucaaaguggagaacgugaguggccacauggcuguggagauguucagugauuagcuuccucaguuaccaagguaacagcacaaaaucacagcaagcguuuggccugccguacggagcauaacuuuccagucacugugcaugauuaugacguugccuuaguuuaauuccauauaacagaauagucaguguagcuaaucuguggcugcaaagagggggguuaagaaugacaggcauucaguguguuccuuuggguagccuaaagugacauggauuaauaugcugccaguguucuuccccugagaaauauuuggucacaagaagaucuggcuuuaagaagaaacucaaauucggguguguggcuuuuggcacagucuugacucacuggaauggccuaauguauaucugguuucuuuuuucccaugcuuuauuugggguguccaccaagacacacuuccugccugugggguuaucuacauccauagccugagucuugguuugcaaagucacacagaggaagcagcauacagaagacacagggcaguguagagacuggacagaaacacuuugaaacuggaugcaggauuacauacagcaaguuuccuaggucaguggaaacugggguguuugacugaaggccaacaguuagcaauuguguucuguuucugagacuagaaguggcaaacauuugucagauucccucagucaucccaugaaaugcaaauguugcaacugucagauugucagaaaccuaaagacuccauauguucucuuugcugugauguauacauaggcuguauggccuuugauagugucacaguguaggaagguaccugaggaacaacuggaaaauuggaguaaaaagaaaaaggaaagaaaacuaagauguuugaugagaaauaaaaagacguguauggaaaugcuguuguugccucaguaacugccgaaaaagaagaauggaucaaacuuugacauucuccauagagugacccacacucugguuuugucuuuaugcuguaaaagugaaguauugaaugcauuacaggaagcuuuuuaaggcaacauaagugguuaguauggaauucuagcuuacagcaagaauucucacccgaagcguugcaaaggcagguccacagcugcccgggaacaauggagacacuguuucuuucucuaucacuauuuuauccuuuaaaugguugucuggauucuuuuccucuguuaucuuucaaaaauucacuccuuuuaggauaauaguugacuuuauacagagcauucuaguuuuagaaguuauuuuuaaaacgcuccuuuuuaauuucauaaaauuaauaucaaugauuacucuauuagaucagacgguuacagaaaacuuaucuucccuaacagacugagaauaauugaaggaugggcuuaguaacuaacauuuaagaaguccccgcugaagcuugacucaggccaaggagccugagggagcucaagcuugaauuugcuuuucccccugggagacugugaagggcugaggaguacucuugcuucuuucucagaucaguguagguugaggugagacguauggaccaaugaaagaacuccagacugaagcaaaagcuucuuagaagaauucccaccauuguuguucagcaucccgguggguugcagauggcuuuggacuccagaaggcuggcuuugggggacuugagucuucguggacuauggaaauugagcaugccaacuuucuugcuuacuuaucuguaaauagguguucuuuguaaauacauauaguccuuauuaaaaaccaagcagcagccuaacaggaaucauauagcucucuaacuugauagggcaacuccuauguucacuugucucugcauucguugggcuggagugcuggccugccccacucagggguggcagacugcagucuguaguggggguccucagucuguguuuucuugguggaaaacaguggagucuggggccauugcugagguugccagucuccuguguacccaggcacugccgguauacugcugggaguugggaaugaggccccccaauccaugccuccccuugggauguccacaugcuaggcaggaaggggaaggcaaagucugggacugagguggaacccaacuugauuccgagugagugccgagaguucaggaggcugggauagagaaggccuucucugggagauuuggacucugcucuuuaugauuaaggcuuccuccuauggugauccuugaugaagagacagucuuugcuuguccagucugcuuuauuugauggcgaaugugaaugcauacaccuuacucaggugaaccagggauugaauaacuuugugggaagaaaugucugggaagggaaacucuuuggcugaacacucagggucugucuagauaccucauuaacauggagaacaucaggcuuuugugcuaucuaacugaugcugcaguccucucaguggggugucaugguuaccaguuucagguagaguuuggcagggaguggccucauuccuaccauacuuaguuaugagucuuaugggguuugggcucacucaaccuuaccaguucauccgucugguggcaugguccacuuaccucacaagcaugugaacuugugagcauguaaagcauugucucuucucuacgauuacugcauucauaccauaaucaugacagggaacccuucucuuucuccugauggucuugguuuucucacuagacuuucccuaccugccuucccuucaaagucauagccccuacugauacccaguccuugaaaauaccuuaaaaggguuuuaccacacuggagaugcagcuucagagaucacaucuuuaacuuugaaagaagucagagaacacacuugaaagugugcacauccaugaguggaacaaugucagggcccaggcuccuauagcccaguucacaguccugucucaaagcuccccaguaacaucacuggcaaagguccugcccuaacugcucagccguuuuccuuucugcacggacacauggauguagcauagcuugugacuuuuaccagggagaugcccuucuccuuucuacuucucugcuuuaaugaaaaacuuaaaaaugaauuugaaagacuugccaaccccaaggcuagacuuuuaaagucuuuucuucuucuaaaauauuggaaauaacagccccucucaugauugcuuagccucacuuccuggacuccagucuuuaaguucuuguugacaacccuccccaacauuguguguuggugggaagagguauuaccugguaacaaguacacagcaacagccgaauuuccucuugaauuguuaagcugcacaagucaguccgugccagcugaaggucgcuuuuacaauaggggauguguuaagugugcuaauguuaacaguguguuucccaugggaaggggccaagcaggaccuuuccucuucucuagucagcuuaccucugugcccacaccagcucaugaguuauggacacuuaccaacacaugaaacacgaaauuagaaauggcacuguugaccagagggguaaugagaauuugcagggccacuuaacuccgagaaagcacaagcuuuguugguuuaagaggccaguuugcaaguuucuugauuucuuacggugcaaaugccaccguaugugacaacagagaaggcugaaaggagaugauaaacggagugggucagcaaaacauguugggagcuguuugaacauccacccccucggaguuaaucagugguucgcaaacuuaaaaaugccuuuuuguuuugagaaccaaguuucagacucaaguuacacaagagaaaauauuauuuggcuugagaacggaaggaacuugguucacaugaauucggacgcagauucuuuuaucaugggggaauugcaauuagggauucgggaucuugagaacaugauugugaccuaguuauuccugaacuuggaguacucauaggagguacuggcugggacugaaaauaaugaauuaagagguuccagcugggcugugaugaaagcucucugggagucuccgugucuuggccagacugcauggguuauaacuuggagggaucuaaacuagcgggaguauaugacagauuuauggcccaauugauguugggcaucaggaaaaaaggcugagguuuaaacugcuuugaugacucugacuucuggaaguucugccauugggcagcuaaagaagaaaagggugacuuccuucugugauggggauacaaaaccagcuugagacagccaacuggaaccaacuuuuugggggguggggguagcagcuauuccuccaugaccccuucuuugcccucucuucuggcaguucucauugaccuauuccauacucugcagcuugcacgaugggguccuguuagugcuaggccuugggacaucaugaggucaggcacuuuccucacugugcccacacuccuguucuucgauguagccacaacuacuauaauaguaucaggugaagcagcucaggguaaacuuuguugagugaaagagugaauggauggagucaguuuaagcuagaaguucauguuggccucuuugccuucccuuuaccaucucucccugcucuuguccccucugucuccaucaaguguugauucuggccuccgagagcacugcaugaacacggugcacauacauacaugcuggcaaaacucucguaauguaaaagacacuaaauaaauauuguuaaaagucuaagacuuugaagagugaccuaaucuuaucaggggaauuucgugugcuucacugugauggagaugggagguccagcaaauaaugccuugaggaaguaaaaucacccgugauacagggggguucuguaguuuuugaguaaauugaaaggauuguaauuucuuuauauugcagacaaauaccacaaagcugcccaguguguuuggucaucuuacuuuucucuuuucugacuuucuaguugucuccucagaccuggaugccuucagugaggcucaagggagugugacuuccaguuucuugcuccaucauuauuuguaguauggagacugaugugagcuugugcuugugggugcguguguguguguguguguguguguguguguauuugcgcacuagcacacaaaggccagagguugaugaugugugucuuucuucauuguguucuuuccuauguuuucaagacgggaggucucugacugaacccugcccuuucuagauuuguucuacuacguggccacccagccucggagguccaccuaucccugccgcuccccccagcccuugguuuacagaugcucuuaggugcucccagcuuuuaugacuuaagcuugguccuuaugauugcauagcacgcacuucacucacggaguccuuuccccaggccuuaauaaccaaguucaaagcugccacacccuuauuagcaaacugccucuuugagcuuggagucuuuuuguuaguuugcuucuuagauugauacacagagggggauggguuucaugguggggcccucacaccugcuuuguuuuccucgaucccuuucccacagucccuuccaguugcgccccucccccgccccccaguuucuuaccucuggcuguggugucccugagaacacagcaugacugucaugucauucacuggagcuuccaugugccucaugccagacaccugggaguguucccuaguggaaccuaccuuuauauuuaggcucuagggguaucuacuaguaaguggauacuacuguguugaucuaacaaaagcucugauauuuuuaaaguuuuuucuauuaauaccuuuauaugugauaauaccuuuauaugugauaucaucaguuuuuuuuuucccacauaagcugauauucuaaacuaugugaaaaagugaugaugcucuuggugacaccaguugcuccuugguggcucccugaguuucugaguggagcccacgggaacuacugcguucuugagcguuuccauguccucgaucaucuuauuaacauuucacugaauguuuuauagcucauaucauucauguugcucugguuuuguucugauaagaacagugggaaauacucagggcccugauguguccauaugcagguauucacaucaaauaggugcuuaauauguacuuguugagugacagaucagaauuauauuuuuaucauuaauuaauuauuuacuuuacaucgcaauugcagcccuccccacuccuguccccuccuccucugagaaggcggaggcccccuagguaucacccuacccuggcacaucaagccacugcaggacuagguguauccucucccacugaggccagacaaggcagcucagcuaggggaacaggauccacuuuggagggacaaaggcugagggacuggccagccaaugacccgcccaacuugaggcccaucccacgggcagaauuauauuucuaaagcaugugucugcucauugccuucaggcaaaaguccaguuugcuuuucacaagagucucugugccauuuggagucuggagcugguaaaccuucuucgucucagucucccacugccaaagccacagcccagucugcgguaucuucucaaaaugcugugcuccacucuuucauauuuucacugauccauuagacaagaaagugaucgcuaguaguccuguaugagaugauuucaauacucccaagccguuauggauaccucccugguacuccacucuacagacucaccuccucuaguuugugcaacauggacucuuguuauuuguuuguuuguuagcuugugccucugcuuguagcaagggacugugaucaaagcaaucugugcugaauuaauaaguagugugagcaggccagugucauggccugagaacagccuagcucugugguccauguggcacacagagugacuuggucuuugcaucuggacugaggcucaugagaccuuacacaugggcuugugauagcccaugcuuaggcugccuucacucuggaguuccaucuggucgcagcaguaaaggaauggcaguugcugucuuccauauucuagcgcugucucagccacuugcugagagaagcuaugcugagacaucaggauuguugagaaguccaagccuuguugugagaguucccuuagcugucugucaaacaucuuccuaaaagaaguagacauugagagagugacaagagcccacuguuuccuugcuagaccacaaacuguaacugagagcuacaaauuaugaugcaaagauagaugauuuuccucagaacuaugauuucacauuugcugaaccucguguagugcccaucaugcuaaugcaauugcagccaguguuuccuugggucuguuucuauucuuuaccuaguaauuucuuuucccaaucagcacagagugcagucuguauuccaugcuuauccugagguaccccuuugagaagcaguacgugaccccauguuuguguuuuguuaagcuuugggacucuacccuuguacuucuuuuucugcuaugucaccaugaguaacuuuuuuuuucuuuuuucuucuuuucuuuuauuuauuuacauuucaaauguuauccccuuucccgguuuccccucugcaaacccccugcucuaaccccucuuacccugcuucuauaagggugcuccccgccccaccaccuaccuacucccaccucaccacccuagcauuccucuacacugagcaucaagauuucauaggaccaagggccucccaucccaucaaugccagauaagaccccuuuaacuccuucaguccuuccccuaacuccuccauuggggucccugugcucagucugaugguuggcuacgagccucugcaucuguauuggucaggaucuggcagagccucucaggagacaguuguaucaugcuccugucaacaagcacuucuuggcaucugcaauagugccuggguuuggugucugcaugugggauggauccccagguggggcagucucuggauggccuuuccuucagucucugcuccacucuuugacccuauauuuccuuuagacaggaccauauccagaggaguaacguuuuugguuugugugugugugugugugugugugugugugugugugugugugugugcagagauuucucuguacuugacauaaccuucuugacacccaguuuaggcaccuuaaagcacuuagcauacauggccaaugugaucacaugugugugaaugucugaagcacuuagcgugcauugucugugugguugugugugucuuuuuuucccuuuuccaauuuuuuaauuagguauuuuuuucauuuacauuucaaaugcuaucccaaaaguccccuauacccucccccuauccugcuccccuacccacccacuccuacuccuuggcccugguguuccccuguacugggacauguaaaguuugcaagaccaaggggccucucuucccaaugauggccgacuaggccaucuucugcuacauaugguugcaugugucuuaaugucuggguucugguuuugccucauucuggccagcaugugaucauucuaaauaguaaaaaaauuaaagccuuuuucauccuaucaauagacaguaggucuaaagcuuuuguucaaccuauugaucgagagugggucuucagagaauuaguuuuuaaaauauuuauucuaugguuuuuuugacgcuuaauuucuguuaauauuuagaguuuuuggagacauggucucauauagcccaggcuagccuugagcucacuguguagcuaaggauguccuugaacuccugauguuccuguugccaucuccaaaguacugagauuacugagauauguagcacuugggauugaacccaggauuuuauucaugcuaggcaacucuaccaacugaacuauaucccagcuaagcaauauucucauuuuuauuuacuguaccacgggaauauuuucuuugugauuuuugucuauugcucuugagauuauggauuccuuuagcuuccagagacuggauaaauauuuuaauuuaccuucuucuguugaauuuuaaauguauugaugcauuagcccaauauggauuugcugcaggcucaggacagaaaccaguagagcaucaguguucuucugugccuccuccaagccagugugagaccagugcuaagcaaugaacuccgggauucaucccccacugggagcaugggucuuacugaaaauguuacuuaccuuaaacugauuguuggucuaaccuuggacuuuccucaucucugcugccuucuuccagguggugggaaucuggcguuuguuucucaaaggugcuuucuguucuguggccugguaaugccaagucuuuggcuucucucucggcuugugaacucugccuuucaguaaaaagacaauucucagcauuugucagcaaucauucauccgcaggcagaaucccucucgaguucuuugcuuaggagaccugugcacccaucagcccacagcugcuuguuugccuggccuggccagcacacacaggccauuucuaccgccuuagccagcugaaaggccuucuuuuccaacucugcuguucuagaauaaauuaaaauacuguuuauagcaacaccaucguuuuguuuuuuuaacggaguuuuuaaaaagcaaaugguucaauaauugagcaagaacugacuccaguauaagcaugauuuaugcccugguguucuuccaccucuggaacauucucgcagaaguucuuuggguacaaguguaccucacuuuucaucuuuucugcuuuuuuuucccaaguuuuccugacauuugugguagcagagacacaaaacaaaaauuuucaauugguauggccuuuuggagaaaauggauuccaaaacguguauaaacaaauccugauugggaaugaguuuaauuggccgcagauggucagacauacagagcucucuuuacacaaaccuuucaaguauggcugucaccuggaugcuuaacugaugaccuuaaaguuuacuguugggcuaguuaacaguuugugcugagucuuagguaaauaaauaugaguugauucacuguuguuguuuuuauuuuauuuuuuaaaacagauguacauuggaauaauuuaaaguguauagcucaauacauuuuaguuaagagugacguaacccuuaccaccagcuaguuuuugauucccucucacuaucugccaccugagugaucccugacuuguuaugaggaaaucuaugucccuaugcccacccagucaccacucguccccuuucuugauuuauaaguuugacuucuuucugagccuucuacacaaaauaacuuacgguguccaguuucccuccuguguguuuggucauuuguugcaaugcagcacauaucaaugcuuuguucuucuugguuguggaauagugucacauccggugggggcgucccacauucugcucaucuguguuucccuuuccaaacacucaugccucuggcugcuucucuguaguucuuccucucacaguaggacagauaccgaagucugaagucgccaguucauaugccacuuguuuauguuuaacuuuuaaaguugauauauacgaauuguaugcuacugugugauguuuuagcacauguauauuguguagugaccaaauucaguaugcuucauauaguuuuguuuugcuggguuuuggugguaagaacaucggaaucuucugugaagauggucaguaaauucaaggcugcagcuagaugguagaauagcuucuaguauucuguagcacaguauacuagugaugcuugccgauaauuaacugaauauuucaaaguugcugguaaagagauuuugaaugaugcuagcacaaagaaguggacuaaagugauaccuguggauuagcguuaccugaucacuaaauucucucuauguguuuugagcccuguauuccucaaauguauaugaauaaaaauuauaaauuuuauaauuucgggcuucccucuaacaucagccuacugugcaacaggucacucggacuuauugcuuuuaucuaaauguggugcccagagacacgcugaguaacuuucacaaugcaaaggcaaauaaugugcaaaggggcccacaccauauuacguuccuaucauuagugugugcaguuucugcaucuucgugaccucuccuucccgcccacauuuuccaucaugcugaugcuaguggcuguggaucgauggcuuaagauuccuuguuuuccuaaugacaugugaucuugaccaccuuuuccugugcuuauucauaucuauuauuugguagaguauguacauaacuauuuuguugauuuuuaaaauuuaguuuucuuauugaauuuugagaguuucuugguuuugauggaagucccguauuggacaugaauauuauucacacucugagacuuguucuguuuguugcuuuuaauguaauaauucuuaaauuauaaaauaguuacuucacucuuugacaguuucauacauaucuaguacauuuuaauuguuuucaaccccuguuacaaucuguucucauccucauuccccuuucccuggagcucugcucaacauguuccccuccuguuuccaguuuuuugugugccugcaugugcgcauguguauguguucauguguaguauuuguguguguauguguggugugugcacaugugcaguguguauguaaguauaguguguguguauguguggugugugcacaugugcaguguguauguaaguauaguguguguguauguguggugugugcacauguguacuguguauguaaguauagugugugugcauguguggugugugcaugagugguauguauguguguaguguguaugugugacucacugagcuuagugcuguuugcacgaucauaggugggggcucuuuauuggaguaugggguacaguacugaggaaagugauaccuccucucccagcaaccauuaacugccacaagucccucagggaaguucuccaguaucacugugguuuuguuuguauguuuguuuguuuugccaucuagguuccucuacauuuccuuauuuauaaaaucuugcuucauuuuucaacuugugaaaaucauucuuuuggaggcauuuuuaccuggagucauugccuuacuagaucuauaaggaaguaccacauuagcaauuccuuucccauucuguagagaugggauuucauaucgcguauuuaaaggcucuucgauuuuucucagaaauuuuagggugcaguucuugacauuuuucugaacuuuauccuguauaaauuuuauugcuuuugaugucacuggaaguagaauuuuauuucaaacuuuuuauuguuaguauauaaaaugauugauuuuuaaauacuuauaauuguauccuguaacuuugauggauuauuuauuaauugauuuuauacuguaggauuguuuuaucugagaauuguacaugcacaucuaacuuccuaauccguauacugugauuuuuuucauuaucccacaggcuagaaccucaaacgugguggucagucacaguggcacaggucagcauccccgcugacccucagucuuagcccuuucgauuuccccaugaugugugacacugaagcccccuuuugucacaucacguuagcuucucuguacucauuguugagaaguuagucauaaauggacacugggcuuugccgcgugcuuugucugcaucugucaggauagugacauuuuucuugccguccacucauggcggacacuauaacgguugcucuuaaggugcuaaaccagccuugaauuccuauaaugagucuugccugguaugacaaauaauucuucuaaugucuuguucuuuacuuaguuguguuguguucaggguccuugugucucuguucacaggaugugaauuuuaguuuuucuuucacugucuuccucugauuuucacaauaagauaauacuagcucauagacaaguagggaggugagucagcuguuuuuccaugguuccaauuagagggaggaaggacuguguuguuggcgaaauuccauuaaaauaauuuccaauuucuugugaacugguauccuuauaaaauucaauaaaaaugaaucacuugaagaaucauacaaacagacacaaauagagcuuguagagguuucccuucauaagcuagauuuuagcauguuugaaacuacugggaccaauugauacaaauacaaagacuuauuuugugugugucuguuuaguugcuugucuuuugguauugugagcucaucccucauauaguccaagcugaucuugaacuugcuauguaggggagaauggucuugaacuccuaauucuccugguucuauuucccaacuguugagaauuauguguguguaucaccaugcugccuucugaagauuuagccuuaauuuuuguacauacuuccucauagacaggaaauaauucucaaaaaccugugaaccaacuugacauuggauggauauagacuugggcuuuuuaaacauggauguacacagaaaccauccaagcaauugugaauaugucuaggaucuggccugagccucagcuggucuaucacucucuaggugcugccguccuugccaguggccauacuuagguccaugggcaugaaauauaaugcaaacaguaaaauaaauauguauacaaaugcaaucauauauaugauuaugugcaugcaucugugugggguuugugcacacacgguugggugccuguggaggccauuaguuacaaaugccccuggagguggaaauaaagguguuagugaacugccugcugugagugcugggaagugaauucaggucuucuagaauaacacugcgugcucuuaaccugcuaagccuccacacuuggauuuuauauugcuacucaaccauuauaauucucuaaauaucaguuguuucucuugguuccuagccuuccugggccuccaacugugaauuuauagauuaugagguuugaacagcgcaggucucucaaaucccuuccaaaucgugugacugugaucugaagcacgcgugccaaggcggcugaauucaugcuuccuuucuuauaaacauacaaaguuuucuauugcaacagucacaaauacaagcuaacaugcuuuaccaaagucagcacaacacagaaagaucaaucagggcauaagaauuauuccauguuugaugucuggaagaagcaggugggaucuugcucaaccuuacaguugggaaucugauuaaaacaucauuaacugcacuuaaacuucagggaaacaaguaguugucuguauuaugaaauucaaguugacagaaaacaccgaaaggauucuggucaaugugcaacgaugucauuuuccuuuacauucuguuucguuuacugagacacggggaagauccccccucacugccauacaggcaauggaauggaacaaaugccgaaucacuguguuguucaaaccucuggggccugugcacccagccuucacgugugugagugugaccuugcucuugcugcaggcucugcacggauggguggggacccuuggcagacuccagagaaagugacuaggaauugacaauggacagagcacaugaauacacauucuuuggguaauagaacagaauucuguuuuacccacuguaggagcguccauacucccuuucucagcccuuccaauaagauuuaaaauacucagccacccucuuucugacucacauacaaaucagcuauuacaugccgcuauccaucuuaacugaaaagcagacauuggcagaguucauacugagcauagacaaggcccugggguuaauccucagcacaaaugagcaaaauaaaaaucucguuucuuuaaaaauuucucaaaaaaaauuaggacuuugaagagaaauauccaugugucauuauuuuaucuggguuaccuggucaauguaagacacauuuuugauuuaacacaccauuagcauuucuaucuugguacagagauaugaagacauaaaauuguaaaguagaaagauagcauucucauuuuuaaaauuuaauguguugaacacuuacuuaaaugauaaagauauuguauuucuuuuauucuugccuuuucugcaagacauuuuauaugauaggguuuguuuauucauuuaguaauaagaucauuaugacagaccuuuuaauuuuuauuuaaacauuucuauuauuaauauuuaauuuuauaugcacagguguuuugcuuacauauaugucuguguaccacauaugugcuugcuguguauggaggccaagagagggcaacagaugcucuggaacugaaguuacagauggaagccuccuugugggugcuuggaauugaaccuagauuuucugaaaaagcggucagugcucuuaaccacugagccaccucuccaggcccagaccauuuuauuuuuuaucaauaacacugcauuguauccugugcuaauggaauccauuaauguuagggcaaacauggcucaaaaugucucaagugguucuuccuggcaauggaagaaauguauauguucuagaaaggacuuguguauuuuuaacuaaaaggcuuuauuuguaagacuuucaaacucuaagaauuguagguucauuuugcucugggaauuuuccacauaccugcuuaucguacgucgugugccuacaguuugccuggggaucugcuugaguuuagggagaaacgucacuuagagacagcuauuucccaugagcucgggcugcgguucaucaucacagugaaaucugcucaguggggaacaugcuacgcccaauaacaugcuauucccaauaaaauauuacugucugaaguaauaguucugugccucccaccuggaagggugauugaguuguggauguagagaccucggccugguacuuggugcaugggaagugucacaacuguggcaugcauuauugcagucaguguuggacagccuggccacaaugcaugauggucaccuaggcagucucugagaagucucugcauaccugcagcuacucugcccugguucaggauucuaaaugccagugaccagaaguuugucaagcuaaguuucuuuagggacuuugugagugcauuucuaguuuuaacguaagggcuagugagaaguuagggcuuguuuuguaguugcauaaguauuauuuuuauuuuguagauauuuaucuuauaaccaugugaaggucaguuagacuuaacuauuuuuaugcuacuaauagauaguaagcauuuggggggaagcaaaucaauaacuaggaaagaacacauccggggucaucugaaccguucagaugaaggcauggagucaaaaagcaucucuccgugaugucacagcaaaucacacuucaaaccccuccaccuuuguauugcaaguagguucugugacccaggagaugauuucaguaagcuugccuuauugaucugcuugcccaggaugcuguccagccacuaauuguguuccauaaauagccuucuuaguugcucacugaguggcaggguggagcuggcgucugugaugaggaugaggauggguggggaaagucggccugauggagaguuucagguuccacaucgaagcaguuacagcaccagccuguagcauucugcauuccgccucccagaccaaaaguuauuaccuuccccuagaauuuccagaccacccaccgauacgcuauagcauauaaagggauccagaugcuuagaaagaguaagggcaaguuagaguguucauggcacucucccacuggccgcucuagauuuggagcacuguuaacauagcuggcauacuagagaagccaagugccauuucacaguccuccuugcugacuauuccuuaagagaaauauaucagaauuaauccguaucaugaaguauaugugauuuaagaauaugcuugauucuaaggucuaaggucucuuucuugcucucucucucucucucucucucucucucucucucucucucuccuucccuuccucccucccucccucccuccaauaguccuuugcaagcagaggagacauggauuaucugauguucauauuaaccucugcagacaagaaggggagagagggugaaaggacagagugugucauaugcaugaaagacagcugaagagaaggaggugucauauacaugucacaaggagagagcaucaaaucugggugaagcaugcauuugcagccuaguagaagucagauuacuaaauauagacaacauacaguguaaggcccacuuucuuggaaauuaaaaaauguuuaauuuuauacauguuuuaggaaugaguagguaguuggaacuugagccauuuggcagcuuuaccacgguuuaacuaguggaauaugguuuugaaauaguucguucaaaaccaacuuuacagaagccgccuccuuacucucucuccaggauagcagguuuaugggaaguaauuaauccuccucacaagacacucauucauuaauuuagguaucauaagcccuucauuucucucaucaucauuuuuaauguugucccccaguccaaggucaccacauaaccuuauugcaaaaauauuucucccaaauuaguuuucucuuuaaaaugagaaaagcaggagguagccuggaucaauggcuaccugcuuccugcucaagccuucugaacugaacccucccaaaagccagacacuguagcucaugucugauaguagugcauugccaugaagagguggcaggcagagagaaugucugaagguuugggucagcuagccuaguacacacagaagcaaacacugagacccuguuccaaacaaggugaauggacaucauccaagguugucuucugacuuccgaaggcaccauggcauagcuacacuuacauucauaggggagggaauggaagaggaagaggaggaggaagaggcggaggaagaggaagagggaaagagcuaguuacccgaugcuuuuguuuguaaaguauuuucagugccuaaaauagcucuuggcagaaagcagaaaagcagacccugagaauaugugacccaugagugcuuaguccuaaacaugacauuuacgcuguuuccuccauguucagggaacauuguagaagagggggcagaaugauggucauagcuggaagaaagggaggagggcuggguagugcccuucuucugggcaagauagccauugcaucaggaaugcacaguacugggucugcagucaggcacggaugggggagggguucaggggcccuaccccuacugcugagccauuuucuacugauggaucuaggguaagaaggagugguugccucaaguugaguacccaugugugaccccaccaggcuccgacggaucauuccaauccaauggucacacagagggcccugguuagagcaagugggucauaaaacaaaaucaaagucguggauguaggaaagguagaggaggaagggagagaagauaagagagauaagaggaaggaaaaauggaucggggagugaacagacuacauuauugacauguaucaaacugucaaggacuaacuguaaaaaaagaaaauugaaaacaaaccagacaaaaccagaaaugucugguucauaacaaguucuugacaagaacaugaggaguaaauauuuucuugguucacccacauuuguccuuucguucgucugucccucaaguuguuauugagagucuuguuugugcuauaaacugcaaagcuggguacugaguuccggaguuuaaauguuucguuaaaaacuccaguuuccaugacagggugaaguggaaacuuaagaguucucuggaaaguccguuguguuggaugguguuuugcugggacaaacacaugaaggaguguuugacugaggcagacgcaggagaaaggaugcucugcugaagcaagcacgugaaaagacacaggaugaaggauucuuugcuaacaauacuaauguauugguccgccuuacacuguauaguugagcucuauuuguugggacuccuuagagagaaacaggccaaaaaauuucugguggugugccuuggauuuuugcugcuucuguggacuuggcagagugauguaggcugagacagccccacgugcaagacacaagcugagcaggacuuguggaggacaugugauguuuggagggcauauaaaaaggacucaguggccagugauggaggcugagcagacagugauggaggcuaagcuagacuugcuuauugagcuagcugugcgaugcuucacuucacuuagagaggcacagccgagaacuucuccuggcguuccuccuggucccuccugcugacuccugccaaggcugaggccuggcugucucugcuagauauuaccaccucugcugauugguguuugcuaucccagcucuaccaaaucggacugcugguguaucugugaaguguuugagaguggaucgagcugccacugcuaaccugugaacugaacugccaauuuccagaugacacagaagggaguugcuccaaagaaacuuucuaaucagguccacuuucacucugccaugccggcauaaccccacauacucaauacgguugaaaagcaauagaaaagucauccagcauguauaaaauuaaacauuuuuuaauuuccaagaaagugggccuuacacuguauguugucuauauuuaguaaucugacuucuacuaggcugcacuagagucuugggugaccuuggaaaaaaauccuugaauucuuuccagauauaguucuccaggcugugggcacucccugcccuucuguugcagucuguugugaacacacuguauuaagugacccucaaagcagcucugggagugggcagugugcggucaucucccuuguugggaugaagagguguggucaggagggcaacaugguuuaagacagcucacacaaggguaggaugucuagcuuccugaggucuuucuacugugacacgcaggacauggucuuuagggcuccuuccagaauuacagucuuagucuacagauauuugggacucagccauguuccaugcccuuuacagaaauuccaaagaaguggaagcacaaagccuugaaguuaggaaauuguauuguauaagaacagcaucccauaaagcuaggaaauacauacaaaucuuacaugcuaaaguaugcaaauaugucagaucuuauaucacauagcacaaauucuguacuuagcuacaaagaagcuuggaagucccuauuuuccccagaaugucauuugccuauuuuaucugucucccaauaauaaugguggcuuuuguucuguuuuguuuuuucaagacaggguuucucuguguaacagucuccuggcuguccuggacucacucuguagaccaggcuaacuuugaagucacagggaucuuccugucucugcuuucugaaugcugggauuaaaggcauguaccagcaugcccagcccuaauaguaacuuuuguuugaaacucuugcuuacugauaguacccuuugaugggaaaaagacccuaaaaaacgaaguucauugcuguaccccuguaugguccuucucacaccuuggaacugccgaucauggagugucugaaggcuagugguagcagcugcuauauaugacuacaccuaaccccuacaaccuaaccccuaugaugccuucugaggaagacacuauuugacuuauagguggcagaguugggucauuaaggaggagaauguacuggguuggggcaugucacaugugcucccacuccugucuuaucuucaugcuugagaagacaugggcaugacagaagaaaacuuugcuggucccuguaaaucuccgaggcaguuuuaauuucccacaggggcaaauugaguccccauuaucaaagccaucucucugcauucaggcuccaaaauuuaccuucacuauguaguauaguaaguagagcuagacacacuuuguucuuacagggaaaggugacugaaaacaucuacuggacauucuaaaccuucugacagccuuugucuguaaaaggaggcuuuauggggauagcauccguuggugcuccuccuucaguacaugcuauucauuuccugauacuuagauaugaaauuuccccuaucaucuucauuugcuauucuauuauuguuucauccccgucuccauugccagaggcaagccauucugcccuugaaggcugcagaaaccuccuggcagcagaggcucagcauuuacuccauugcucugggaagccagaggaauuugcuuuucuuccuuauucacauggacacagugaggugcgcagcuuggccgcauuggcagaauucacacagauuguaaaauugugcuuugcuugggacccuggcugcguucugagucugucugcuuguccuccgccuguguccucggcaggccuuucacuggaggcagacgcuucuaaugagaguucuuggguuucagucuggggagagcccagccuccagcagccagacuuucuggagugcucccugcuccugcucaaaagugcccagagccuggaagacugcauccagcucccuuucaaaggggucucagaauuccucaggccuaauauaguugugacuucaauuguuaagaaaggagcaagacuguugccuguggaagaaauaccagagagagagagagagagagagagagagagagagagagagagagagagagagagagagagagaagagagagagagagggagagagagaagagagaagagaagagaagagaagagaagagaagagaagagaagagaagagaagagaagagaagagaagagaagagaagagaagagagagagagagagagagagagagagagagcgggugugaaauacccagcacuccacugccucuccugcagcuccacguuugguauuuaguaacuuaaagcagauagcaggaggcuucggcuccuuacacucacagagcauguguuggugcggcauggugaggugguuuuauuuaccugcuucagaaaagguagcauugcuuguuucagaaaagguauggauguaaauaucccucaaacagcugccucuggggaaauugggcaacugagauuucuugauaaggauacuguacuaguuccuuuucuggcugcuuugaagaaauaccugagaaaagggacucaaagaaggaaugguuuauguaacaaacaguuggaggguguagcucaucccugagaggaugccgugaccaugaagucggcucuagcugcugcagaacucugagguguuggucacaucgcaucaauagucaggaugcagcgaggugcuuagaaggaauucaccuuuacauucugcccgggaccccagccuuuggggacuuagcccagauccauggaggauacucuuugcucuguaaaaccuuucuaaagucagccucggagccacggucugaaguguguuuccaugaugcgucugaauccagucggccugacagugaagcugucaaucgcccgugcacacaugaauguccacggacuucucugaggcucacuguuucuucacuaaggcagaguccccugacaacugcaggucuccugcacuacuccaaggaugcgaauggcaggaacuaacuccugggaaacagacucagccuucucaaccccacaggcucugcugcugugaauacacaucugauaucccuucccauugauccuucucucugaggcugauaagcgugcuacuccuguauuuaugguuuuguauuagcauauacuguagccagguauuuuccugguuuauuugauuuuuucuaaccuuuucauaaugcuacucaacuucuuagguagagaauaucugaagcaauagucagugugccaaaagagccuucacuuuaacaaaagucaucucaugcuuuacuugacugggcugugagaggauguagcugacuucuauugcucuucaucacacugaaggggguaucuguucaggaagguuuguuuguuuguuuguuuguuuuuuccucugcuuggaauauaacuaaucauuuaaguguuucuucugggaauuucuaugaucugagauuaagcccugugcuaauagugcugaaguugaauugauguucagaaugguaccuauguaucaauggcucuuuacaucccaaacgcccuuguucagauaaacugauagaagaacaggaaauaguugaaggaacagaaaaugugugaacaggagagucugcaauggcaucagaucaaagauuuaacagcucuuguggagcaaaaauucaagaaggcuaugaggugcuaauuauuauuugcauccagcuugauuaagaauucucuuuuauaggauaucauauguaaguggcuuagccacuauaugagaagccuguuuauuuagacuguggagccuuaauuuuggcaaauucaauucucgcuggugacgaguauauuuuaaacaggcuacuuaaaucgagggcuauguguucucuuuagaugugaaaaucucacaaguacauacauaucaagagauagcacguauccugggggugcugcagaagcaguaugugugcucagugcagccccaggcugggagagaugcuuuagaagaacccagucaacuacugccuucucuuugcccuucaccuacuucuugucccuucuugucccuagccuggaccuaucucucccagucuccucaaugaauucuuggcuuaagcaccauuagcucagcucuguuggugacacacccaucguacugacggaauccuggcuggaacggcaauugcucagcugcgcuauagacaaacccugcuggcugaccugguuuaaaccuggauuucuugacgccaucucuggugugugccaaggugaaaaaaacaccuccguugccccuucccuugcuccucuggaggggaaacaaguugccaccuggcaggagaguuccucgggcucccauccaaaguaguaacacgaguuagugagagcaguccugggcagggaaguaaggaagucagguucagugucggcucugacuuucaauggccauguugaccuugagcaaaucauuucacugcucagcuuaggguuuuucuucuguagggauaauuugggccagauguucccuguggggcuuucagauccugaaagcaagggauucauuuaagguuagcaaacucuugaaugaauagauauuuguguuccacacacuggauauucuuucugcgugacuccugccucuuccuacagagcauggcuacuucuguguagucuccuagucuguguacagcccccuugcccuguagucuugggcuuaguugucucagagccuuugcuucucugaaguccacacugaagaggagcaucuuaaacucuguaggauagggccggugacuaugccucuccguuugccucucaugggugggugguccauacugagcuacuuuguugucugcuuuuuccuguggaaaacuuagucaggcuucacugaaaucuugugcuugagaauagguguuuuaugugucacguccuuccucaaucuggacaaccugagaaggaacaucugugauauacacuugucccuauugugacccaguagcacauugcuaauagagauaggacuguguucuggucccauccauccacccauccaucuaucuacagccuaagcacugcccacaguaaaucuggugcucuguacagaggugucaguuagccuugugaaggucucagagaacauggcuucuugaggauucuuagagggucugaaucuggguugagccagcacucuuccacuuauuuuaaacccagccucucagggggaacuuaacucacaugcuucugaccgacuuguacaucacucaucaaagagagcugcuuaauaaacauagucucagccuaugaaagcuuuccugcucauauuuggcugucacuggcuggaauuugcagcugacguaguugaagcuccccuuuaagucccuuccucuaggcauugcuucauguuggcuucaccuuaugaauggauggucaucgaaagggagucucagaggucucuucuagagcaucuuagaaagacaggcauagucucugaugcuuacugcacuugccuuggucuccugucuuaagugauggaauugugcacugaugugauccaugaaaggagaacuacauucacagauaacagcucacccucugcuguugcauugagcaaaacugucuuagagauggaaggaaacuguguaggagagacauguuaguacuuuacaaaagcuguuaaauguagaauuuucuuacuccccagaucagagcacaaagcuuccuccagaaacccucauuaaacacguagaaggcaaagcuuguuuaccuuugcccucaggagcacuggggacauucaguucuaauaaccugcugggcuggagacuuaacuaacuugucuaauuaacuucacaugaacucaucuauggaauguguguaguuguugguaguuauaaauggaccaaauggaugcaagaauuaauucugcaucucguuaauaauaucucauuaauaaauguuugauucagcaaacauuuauugaaugucucuuguuccuggcagauggagagcaaggaaaagagauagacaauaggcucucucucuuuagggaguuugguacccaggaggcugugaccuauagccuugucuuuguaccacaagggaaaauguuauggcucugugcauagguucaugugcauuggacaacauggaagcuaagaaaaugaaagcuucaucucccuggagcaucagguuaaacagguugcucccaaaauguaauguuuaaauuuagucuugaaggauaaaaaggauuuggaagagagaagggaauucuggaaugaggcaagccagauauauucauaggugauauaaacaaugcccgagccagacucugcuggcccggauagcugcccuguguggucguggccgagugaguuuguagguguagauuaucacucuagaagcuaugacugaguuguguuccucaguaacaagcaacccaguugacaaagacuuugcaguguggcauuucagucuuggaucaaggagagaacaugagagaaggggaaaggagaauaaaggcuuacagauacaguguacaaauuuuguacauccuuauuacuuaccauguuuuaguagguuaugcuacauacuuuuuaaucugacuuuauaguagaacaguauguuaguuaaccaguucuaucugaugucucagaaaucaaucaagugagaugucuuaggcaaaggauucuguucauaguaugauggugugcaagagcaagaccuacauuuaacauuucaguacauugccucauauaauucugacagauaucccacugucauccuuauuuaagaaaaccuguggucagggaggaaaggguuugcccacagucacacagguacaaaagauguuucuguuuccaucgcuggcggcacacagauguguuucucuguguguugcuuauguuuuguguuugcauguauguuucuuacuauuuuuguuuguguuacaguacgugguaugacauuaaaauauacuccauauauuagaaauacaauaauaauaagaugaaccaacuuaagcucuaaaacauuagggcuugcacuugcgcuucuccaaugcauccccagcuguccccucugucacauguuucaacacaaaccauuuuuagaugacauccgaagugauucuguguucucauggcucaaggucaauacaucuaauaaagcaaaauugggauaguuuacacgucauaaagacaacagcugucacugcacuaggaguuuaaauguagcugaacauuuagguuaugaccgagcugccugauuuacauagcauugcuuuaguuccgagaucugcuguucaauccugguacuuacucucuguauagccuugggcagguucuucaguguaacuccugagccucaguuuccucuuuuguaaaauuggguaagucucccuccauggauugugagagcuaagugagcagccagcaccauaaacauuguguguccguuuucuucuccuucuucugugcugcuccaauucuaaagugacaggauccaaaacucauuuuauacauaaacauuggaagcacacacagcucguaauuauggcauuuccugucuuaaaggccucaggaauucucuccagucagacuucucaucagaaggucuucagagaucuggaugaagcuuucaaauuaauaacagcaucugggauccaaggggaauugguccucucacacucagagugaagagaagaaauggagagaaaauccaacagcacacacgugcgcgugcacacacacacacacacacacacacacacacacacacacacacacacuccaccaccauagcuaagaguuuggauuuuguauguuuguuucaugaguuaucugugcuuaugugaaguaucugucacccuauuuaaugacuaaauauuucuccauguuccugcaaugguaacggguaccuuuuggugacaugacuucccagcacaugaaugucugaagacauuuacauagucauuuguucucuucuuaauccauuccugcugauggacagcuugaacuugggcacuggggaauagcucuggugcuucaguauuuucaguaucuccucuguauuuguucauguccuugugauugaaugguaccaaguuaugugcauaauauuuggaaacccaauguuuacuuuaaaauuuuuuucaacugagggcaguuuaaagguauaucacacucaaauaucuaaacuauuuuagaaaauagaauaaacaaaugugauuaucuuccuaagauauuacaauguuuauuuucaaaaacagaaugguacuuagacagaaauguaguggaggaaggaggaaggggaaggaggagaaaagggggagagagagagagaaagagagagauagaaaggaagggaggagggagagggaaaagaggaggagagggagagaaagggagaagaaaaggagaaggagagaaguaaugagggaaaggaagaagagugagggacagagggagagagggagggaagaggaggaguaccaggagaugaagggcagcuggggguggucuaggucuucagaaaugccaucaaggaccuggaugcuucuuucuguucaccggccaaguaugugaacauuugugcucaugccugcaaguuggcaguguacccccaggcaucguaucuucuagaaagaugagagagaugagggcaggggauacagaccgacuuaucucacuuuaucagagagugaaaaacauuccucaguugucucuucuuagacuucugcuugcaucuuauuggccuguucugggaaaaguccauuccuaacuggaaggcagccagggagaaaggguuguuugcguguggagcaucuaucuccuugcucacugaaaaaggcugagggugcucuuugucugugagaaucaauguaaauguuuaguagguuguuugauacuaagucauauuaacuaaaugacaguguuccaguuucccuggggaugggguaugugugaccuuuaccaguguguuuuuugaucagauuuacagugcuggguguggguugccuccuguggagucagucuugaauccaaucagaaucagugguacuuuuauuuuuacucuauuucaaaauuuucaacuguuucagacaugagaggaccaagcaagaguggaaggguugcuuacaaccauucuuguagaauagagcagagggugugagucuccuuggaguuugaguuggugucaucaucuagucauaagacugacagggucuguggaugaugaauuuggggagaaagaagguggaugagccaggaagugugucaguuuuuuauauauauagugucacuuacuagcucaggaggcagaggcaacgaugugaagacuaguuuuguucccagccucagugaugcugagugauaaccaggauggaucauggauuguuaguuguacccugacuaaaggaagagaauaaugcacaaaauugggugauuuagacuaaauuaaaaauagaucuuuaguccuuugcuuuuguuugcuagguuguucacuugugucuuuugugagcgugaaaacuacucuuggcacugaagauacauaguuuaguaagacaggguacuuauucucaaggcucauggcuugguaaaaggcaauuuuauucccgaaugauucccauaguuuuaucagugccacagagcauggagaagaaaguagucaaagaaaucccccaggagaaggaauuuucuagaaaauggagaguagaaaggagaggaggcaugugcaaagacccauggguagaaagaaauggccacaugaguugaggaaucacuguuuacccaguaucucuggacaguggcugcaaauuagggaagaagccagagcugaagugggaggagcuuccagcagguaccucagacuccgaugccagcuacauccuucugcaggugacagaaaagggcuaccuggccaucacuaguaguuuacaaaagagggagggugagugggccaccaaguuuggaauacggaggauacugugaccucccccaagucuguggccagaaaagcuaggcuaugaugaaugaaugauaugugggaagucaaacauacgacacacacucccgucagccauuuuccuacccaccauccccugucccuucuguaagacaaaaugauucagcuucuccccaaaauccaguccacugcccucuuuggggugcucaguccacuguggggugcucagacacacagaaggguccacagcacccacccacagcucaccucuuugcuucucugaucccagcagaucuguggggugucuaacucaagcugaccugagacuggcacacagaccuccuaaaguggcuaccacuucuugcuuuucuuauggcauccguuggcuaagugaaacccccagaacucaccugcuacccuugaaaaaccagucaguguacauuucugaggucagcaguugaguugccugugguaacacucaaguaaguuuguuucugucuguguggccuccuuugguuauaaaucagagaaacagagugcauauguuccuaacugagagacuuauuuguuuaauuaauuaauuaauuaacuaauuaauuaauaucuuacauuuucuuugagacugaagaaaaagaaacuucucuccaauaaaccugggcaucuaccuagguggucccuucucuuaacugcuuuuuauuaaauacuggggaguuguauuuaucccacuguugaacuguggggaacugagagucugauuaaacuguacucaacccaaaagaguacccacugucuuaggucacauuuugccagcugcaaguaaggaaacaagcuuaagcagaaagaauuuguauccagaaaugcgggaugcacuguuuccuauguaauucaaaagcagguguacagcaggacauugcuugggacuggacuaaggugggagggaaugcacuuguaggcugucugagcugugggugcccuguccccuccccuccuucacaccugccacaccuucccuuucaucauacagaggcguugccaccccacacaacggaugcugucugacucccaaagucccagaacaccugcagggaugaacagcaguugacacuaacccuaaaguucuagaaagagcauguggcuguccaccuguccucagagcuaucaaacuugugcaugauuuuauggcuuacuccagaucccagaauucccgcuuaugaucuuugaguaacagcuccgugacugcacaaaauugaugcugauagcccaauaguacuacuuuuuacccauaaaacguguaaugaagacugaagguagagcuuaggacagaguguuugcacagacauauaccaugaaaguacuugcugccuccagaagcugugaauucugagcauaagaaggcugagcuguggagacccugacuagaauaccucaagagagagggaugucccaggacagcaaaugggaagcucauggaauuauaauugcaauguacacaaugguacacuucuaacuguagagcuuuggaacuuucaauguuagcuauugaugugcuucacaauuauccaaaagguauucaguguagacccauuaauauaccagaaagccaaacucucccauaagcagaguuauggucuuccaccuguuccuugguguacauuagaccacuuucaauagggucucccauuacuuucuaaccauauucacuuuucuccuguggugucacuuccagaaguuucucagcuacacgccauggccuaucugucuuugucauuuauugucacugccuucugauuauuugccuguggugucugugacacagugacccauucuaaagggcaggguacauuguguagcuuuuguguuaaaauagcagucccuuacagcuaagucaaaauuuguuuguuucuaaugaggucucacagagaccgugacacagcaccagcuuuuaaauguggagcaacaccagcaccaacuucggggcuuccagugcacccagaacaugcauguaucaaauuuuaauaccugagcauaagcagaucucuauucagaucagauuuucaguguuugggcaguggagauuuuucuuuucagcuacuuggaucuguaucucuggaugcagucgcuuccagucaagccuguugcuugucccuucccuucuacagccaaucccuccuccccggagguuacucagggguccugagugcugcaguaguuuuuucagacuugucuuucucccacuuucagcaccagacccugagcuggaaacagugucaggaacuuuucuucaucugacauugacuucccaagaaaaguucugagaugaaugaagcugcuuugagaguuacuugauaguauauuuaugagagagagaggaggagggagggagugagagggaagaaaggaaggagagagugagugugagggagggaggacgagauaggagagagacagagagagagacacagagagagagacagagagagagacagagagagacaaagagacacacagagagagacagagagagagggagagagagagacaaagagacacacagagagagacagagagagagagagagagauuuauaaacuccacaagcaagugcauauuugguaaaaggccagcucaagaacuauuacuugccaacugguauauguaaacgaucucacagccguuggucuggcucgauauuacagaaaguccggauugaugugagacauuucucagauacaguuggcaauggcugaacauucauccuugcuucccguuuucuaugagaccucucaggauugaugacaucaugggaauguguuauguauccauuuaccauggaaugagcaccaggcuggccgcucacacacuaguggucuuggauucccgugccugucaugcugaaagcggcaguggaauugcucaggaagcagccacccccccucccccccuccaggauuccaucccccccccccacgccaggaucccaucacauaacguuggucuauacuuaauacucagguuucggugagaaauggccaaaugcauuuuaagaaugccucaaccacucaaacauuuaucuaugauaugagcaaaugcuuauuuacaaaaaaggaaaagaugaaaaguaaauuaaaguauaugggucaagcuaggauuuaagaagguuguauuuaggauuuacauacuucguccuuucacuugggcccggccuucucagcuauaaucaccuguccuacaauagcuccuuuguugcaaaagugcacaacuuuuaauacuugcguuuagcagagcccagcgucccaguuccuccauuuuaauaaaugagcuggaaggccggggucucugacuuugguuucucucauccuucacuuccaauccacgugcagccuugcuggucccgcucaccaagaccaucugccauccauagccuucccuccuucuuacaugucaguggccaagcuacugcagacuucuaccccaaguccuuuaauaggcaccuugaaaagccuccugucuccccaggggagcccacucgguagcccuccuuuaaaggaaugccugauggugacuuucugcuaacuuagagauaagucuaaacuccugacuguggccuggggccuccugugaaauucagucccuaccaaggugccagcacagugucuccuuagcauguguccuuggcaaacagccucuuaucacgugugaagccaggcaaccucccagcucagaccgccacucuccuuguugccagugcccgggaugccugugcuacacuguguccaucuuguugucaaccaccaaccuguuccuuugucauuuugucucagucuucuuccaucaucuugccaugccuguaggaguuauuuguagacuaaaucacaacuucauauaugaaguuuuauuuaauguuuaauguuuagauuuauuuuguucacuguuguuuuguaugugcacauguacgugcacauauaauauguacguguauguguguggaggggugcgugugccgugguacgcaugaggaaguugagggacaagcucauggaguugauuuuccuccaccuuuaugugugcuccaggaguugaacucuggucacuagguauacacaauaagucuuuuuuuuuuaccagucuuacuggcucugacauuauuuuaauuaauuaauuuauuuauuuauuuauugaccaucuccuauaguagauuguaaacuccaugugugcagggauuuugcugcacuccucauugauacagcauagcuacuccuuaaagguuguugaaugaagaacuaagcccccgauucuuagguugacuccuuagaacuaagcacugagauuaaaagaugcuuuuguguauacaguacaauuguuuuucuuauucuaauaugcacauaaaauaaaacuuaucacugugacuauuuuagacaggccauuugguggcuuucaguaaauuccccuugugaggcaaccaucuccagaaauccuguuuuaaguuaaauguauuuuugacaguccuauacaugcguguagugcauucugcuugcaucaucuguccacccucgauuaucucucucucaacacugucaaccccucucuuaaaagucuuucuuucauuuuuuuauguccuuuuuuuaaaauuuuguuaugugggcuggucaugagggugugguguugagccaaccacuggagcauggugaacuugccaguggcuucaccacugaagacaaugauucuacucccucaggaacugucagugugcgugguuucucagagagcggcuagguuccaugaaacccuccccuagugauaggccuaguccucugcaggcccagagcaagcaauugcaguugccgugagaacaagauugcacuggccacauccuucccagacaaugguguuucacaauccuccccucuaucaucuggcccuuacauucuuuccagacccucuuuccagauguuucugagccuugaaggggugacacagauauucuuggaaccgagaacacucauuuguucucagcaccuugaccagcuguggaccucugcagucauugcugcagaaaagcagccucucugaucaagguuuccuaaggauauaaacagaaauguuuagaggacaguuugacaacaugaugguuuugaaaaggaaagcagcagauucauccccuuaggccugugaccuccuuugaccugguccauagcucuaggcaugagaucccuccuguggagugggccucagauccaaucagaaagcacuugguugucaccaccacagucaagcagcuauugcaccagugaacacaucuuaccuggcagguuagugucagagcgggggcgugcacaccugggcaagauuguuggugauucccccucaccccugguagccuuguguguaacaucauaguaaggcagccacagccauuagugaggacguuucuaguucaguuucagccugauuucccucugucuucuaagcaagcuguguggugucuucagcaauaagaucuuaccauuaaguucuaguggucaaccaagaacaauuccagugccaaauaugggauacuuccuuaggacuuguuggucagagagauccaaaaggcucgcagaagaauguuucguuuuaauauugaucuacuacugaacaucuguugaaugauagaauauugcaugacacaccuguagaaugaguccauggcgaggcugguugggauaggggcagggcucuagucaccaguauuucacagaagcccaggguaagugacaggaacaagacauagcaaaagcagccacaaggcugcuucugcuuacaguccugagaauucccccuuuugguuuccuuucgaagcuuucugaacuccucccucugaggaugaauuaaaauucuauuggucagcuuucuugggaagaacaugacuggucugacuuucucugacaugaauaaauugauaucuuaaucuucuauauguaauuguaugaaaggaaggguuuuaaauaauuggagucuaguacccaaaauuacaucccucugaaucucugcagcuugcgguucaguggcugggcaagagcgacaagaauuuacugaccgcaggagcacucugccuguaagugaugagucugugucagggugaagucugguuaugaaggcaagagaaccaacucuacaguccaagcggucugagcugcagaugugggagugagcucagcauccaggaccacagcuguauggccugaacuucagccuagaugagguggcuucauaggaaaaggugcuugucaccaagucugaugagcugaguucagucucuaggaaccacaugguaguugaagagaaacaguucccauaauauguccccuaccucuacuugugugcauggugacacacacacaccauaucccccuucuucaauaaaucuaauacaguuuaaaauuauuuuuaaguguagguuuguguaugugugugggugggggguauaugcccacgagugcaggcaucugcugagacccaagguaucagaugccccuggagcuggcguugcagauuauuugagcaugugacuugggugcugggaagugaacuuagguccucugcaagagcgguacgugcuuuuaaccucuggaccuucuuucuagugggacaaaauuaaagcaacagaacaaaagccucucaaucuuagagggcaaacuaacggucaagcagcccuuguguuacccacucacaaaggaccgcagagaggcaagaugucccagaagugagggaaaccaguugauacaaacgaaucuugcauuuuaacuuaaaaaaaaaaaaaacaaagcaaacccaacuuuggaagaguuggccaggugcccuaguuguugaagcucuuauaaggaaguaguuuuagagagauuugcaaauagaaaaucuuucuaauaccaugcucuacuucauuacgaauaauaacuucuguugaauccaacagcguccgugagacagucucuuccuaccacuggccuauaugugaagaaauauuaaaagaguuguaaauuuagcuuaguaucacauaggagccauggaaagaguuauacauaauuagauuguugguaaagaauugggaguguagguaaaguucuucugugguuggaauauugaguaggaacaggguuaacuuuuaaaacuuacuaaagaacacagcuaagcuaaacuuacuaaacagaacuuacuaaaaaccacaagcugccaaaucagaaugacauuuuaaagcccugcuaauacaucauuugccuuucaagagauuucuauuugcaauugcauuucccccagauuacgcuaccuucucuguagucauccauuuucccagaaaguauggaucucaaguacgcuugccaacaggcgcugucaagcaaacaacuucuaaguugauuccaaaauuacuucaucuguggcugucaguuucuaguguagacgugugugaagucuauagauucuauucugugcacucgagcuauuugccaaguauccacuauaauacugaagauaagucccuguguucuauaguugccuaauggguauuguggaaauuaacaaguguccucucugcuccauggguuucaauguuucauuuugacccuggaaaaguugugaaguuucuggguuuuuggauguguguguguguguguguguguguguguguguguguguguguaugugugugaagagauucuagccaggcauucacaccccagguccagagucaguguuaugcauaguugaauuggccuuucuuggcaucaugugauauuccugauguuugcugguucuacccacaaacaccauguucauguuacucugaauucuuccaccacucaugcauaugauacuccauaggauauuauuaaaaugagcacagauccaagcagugauaaagggaaacucauugguuaaaauccacauuccuuuaugcuuuucaaacaauauugagaauggcaugcuaaagcauuuguacuugccuuaguaaauuagcagaaaagagacgaggcuauauucugccuuguuccauugcauaggaauauuguaugacucuggccuugguuuaagauacugaaagugagacaaaucuugaugguuguugcaugagcugaacacauugaaugauaugcauaauaaugaagaauuggaagugaguucgaugauacacaguaaaaaaaugauugaauaaauuacaucauagcuugaugaaaacuaggcaacacuaaaacucauauuuuggaauaguauuuaauuacuugggggaauauuuuggguaacauuugcugaaagaaaccaagauucuaucuugcaaacaagauuauaaucauguuaucauuauguugugguuuaagugacacacacauggucgauuauguauaauguaaucauauauaauaguuuguauacaguuagauuuauuuaugucucauugccuuuuccugauugucuaaaguacuuucuucaucuugaauaaaaguacaugauaaaauauugaauaauaaaagaaaaauuagucgagucaagagacagccugcaggaaauugauauccauaauauauaaagaauuaaaagaacuaaaugucaaaaaugccaagucaugcaauugauaaaaagaugaagucaaaauaucacuuuuugcaggugauaugauaguauauauaagugaagaaauacauauucuuuagccaccagcaaaaagcaguucuaaacuacaaugcugaaauucugucucaacccagucagaauaggaaacagaaagccacaaauaccuggugaggauggggagggaagggauguuuuuucacugcuggcgggaaugucagugaaugcagucacuauggaaaugguugugcugcugccuugucaaacucagcauagagcauccagcccugccacuccugggcacauauccccaaaggucuaagugagcacacugagagacaccugcacaucuugcuuguuggggcaccaaaauggccuguuauagaagcagcuuaggaaucgacaaaugugauaucuaugaacaguaaggugucauucagccauaagaacaaaauuaugucauuuucaggaaaaugaauggagcuggagaucuuaugacagcaaaauaacguagacucaacuauugcauacuuucucucagauguagaauguggauuuuucaacauauacauacauauauucaaauauaugcauauauguauauuucauuuacuuauauaugaauaagaacaaaaaugguaauggaauaaaggggaaauacaauaugaauguauggaaauccugcuaugaaacccauuaauuuguaugcuaauguuuaaaaugauaaauaaaauagauaaguacuuauuaaauguucauggggccauguuuguaaagaugacuuccauuucccauuuugucuccauaguuauuguauaugagugauauuguggcauucaaccccagaguucagugacuucuuuuuuuugggagaacaaaaugaaggcugagauuuuagucaguagauaauuguuacuuuuuaaucccuuguaaaacuuagaaccuauugauugaagauggcaagcuuugaaacaauccagcacauuauauaaaguaucauggucugccuaaaauccaacuauaggcaaaauuauuuuuaaauuauuuuaaaucuuuuuuuaauuuaaaaaaugaaaagccaguagaguacaauauguacucacagugaaguggugugccugcuuagaccggggauguggggucucagucacaaagguaccugccgccaagccuagguuugaccagggaugggcaugguggaagaugcccacaacucugaccucuacaugcaugccguggcaugagaguguccccuuaaaagcgcgagcacgcacacacacacacacaugcagaugcacacacaugaaucaaauauuaaaucagucuaaacaugucugcuucauuuagcauuuuucuuugacagaacuuucaguguacucuucucuagcuuuggaaacgcacguuccauuagugcuaucugcagucaaccauugugcugacuaacagguacucagcgauaaccucuccccagcccuuccuucgcccuguuugcuuuuaggaaccacuguucuuucuacucgcaacuucugccugguaacguuuaaaaccccaccuuggaaugacaggcuguggcacuugccucucugugcuucccuaauuaauuuaucguuaaucaaaaaccccgcugauuucaaauggugggauucuaucuuuuucaugacugacuaauacuuaguggaacauaccuaccacaguucauucauuagcugacagacacacggguagcuuccauucuuagcaauuauggacaauagcaaugaccauggaguucauauguuccuuugacacaugaauuucaugccacugaaauacaaugguacaugaaagucuggugcaauacagauaccuagguguuuucuagaccaacugauuggauaguaaugccaggaugcuguguuucccucaacauucaggcuuauaaggaauuucccuaaauuuaucugauccuaacaagggcaucuuugaauggacaggaaccaauguuuuccccuccuuuguaggugaggaaaauggaaguuagggguggaaaggucuauucagacuuuacacagagccaaggaugugggagcugcuggaaguucuugucugaacuuggaccugcaggauggggcacagcugccggcccuuucuccucugagauuugacgaaucucuuauucuuuacuuucagauuacagaacaggcccauguuuuacugugguaagcaaccagaugugccagggacagcucagcgggauugucugcaccaaaacacuuugcugugccaccgugggccgagccuggggccaccccugugagauguguccugcccagccucaccccugccgccgcggcuucauucccaacauccgcacuggagcuugucaagguaaagccgcaguauuaacaaggaacaguccuguucaauagagggccacgcccgggcugcugaaaaugccuuagucccugcuggagggggacagcucagcugcugagaacucccauccccugccuccggguacagcugaaaccucaguagccagauucuuggaguccggaagguuugcuaagucugucuggccagcgggccccucuggcccaggagugguuccgugugcucuggcucaggcguagcaacuguguuggggcuacgcuguaccuaacggcgcugccuuguagaaacacagcgaacaagguagugguuguuguuuucucuucaucugaaacucuuagaggccugagcuccagguugcacuuaacugaccuaaagaaaauugcuccucuggacauuugacaugcuacauuagggcuuguuuguuuguuuguuuguuuguuuuuaacaagucagaaauaaguuagaacugacuucacuguuuuaaaugcccccagauguugucuuaguacucuucugcccuccccuagaauucugguuuuggcuuugccucugcucccccagcuguguaaauucuuccauugucuggaugucuggcaggaaagaggaggaagugagcagaggccacuccacucuaaacugaugggccugaaaacucgcaggcuaucucugcuuccuuuagauggcugcggugcuuuuuuuagacaacugcaguauuuucauaaaacucacaaaauaugcuuuuucugaggcaacuagguaguaguuuggcucaguuccuuguguucauucuaaagauuaggauucaggacagcaggauucgaguugcucucaucugugugugcggugggcagcacuagauugauugugccuggcuuccagacacgacuccucugcgugcccuuggaugugccccucuaaauguccgggagcagccaaaagacucuguuuuaaaauccuagaguuggucgccaucuugguccgggacccgccgaacuuaggaaauuagucugaacaggugagagggugcgccagagaaccugacagccucuggaacaggcagaagcacagaggggcugaggcagcacccugugugggccggggacagccggccaccuuccggaccggaggacaggugcccgcccggcuggggaggcgaccuaagccacagcagcagcggucgccaucuugguccgggacccgccgaacuuaggaaauuagucugaacaggugagagggugcgccagagaaccugacagccucuggaacaggcagaagcacagaggcgcugaggcagcacccugugugggccggggacagccggccaccuuccggaccggaggacaggugcccaccccgcuggagaggcggccuaagccacagcagcagcggucgccaucuuggucccgggacuccaaggaacuuaggaauuuagucugcuuaggugagagucuguaccaccugggaacugccaaagcaacacggugucugagaaagguccuguuuugggccuucuucuucggccaggaggagguccaaauacaagauaucugcgcaccuucccuguaagagagcuugccagcagagagugcucugagcacugaaacucagaggagagaaucugucucccaggucugcugauagacgguaacagaaucaccagaagaacaaucucuaaacagagucaacuauaacuacuaacuccagagauuaccagauggcgaaagguaaacggaggaaucuuacuaacaggaaccaagaccacucaccaucaccagaacccagcacacccacuucgcccaguccagggaaccccaacacaccugagaaccuagaccuagauuuaaaagcauaucucaugaugaugguagaggacaucaagaaggacuuuaauaaaucacuuaaagaaauacaggagaacacugcuaaagaguuacaaguccuuaaagaaaaacaggaaaacacaaucaaacagguagaaauccuuacagaaaaagaggaaaaaacauacaaacaggugauggaaaugaacaaaaccauacuagaccuaaaaagggaaguagacacaauaaagaaaacucaaagcgaggcaacacuagagauagaaacccuaggaaagaaaucuggaaccauagauuugagcaucagcaacagaauacaagagauggaagagagaaucucaggugcagaagauuccauagagaacaucggcacaacaaucaaagaaaauggaaaaugcaaaaagauccuaacucaaaauauccaggaaauccaggacacaauaagaagaccaaacguacggauaauaggaguggaugagaaugaagauuuucaacucaaagguccagcaaacaucuucaacaaaauuauugaagaaaacuucccaaaucuaaagaaugagaugcauaugaacauacaagaagccuacagaacuccaaauagacuggaccagaaaagaaauuccccccgacacauaauaaucagaacaucaaaugcacuaaauaaagauagaauacuaaaagcaguaagggaaaaaggucaaguaacauauaaaggcaagccuaucagaauuacaccagauuuuucaccagagacuaugaaagccagaagagccuggacagauguuauacagacacuaagagaacacaaacugcagcccaggcuacuauacccagccaaacucucaauuaucauagagggagaaaccaaaguauuccacgacaaaaccaaauucacgcauuaucucuccacgaauccagcccuucaaaggauaauaacagaaaaaaaccaauacaagaacgggaacaacgcccuagaaaaaacaagaagguaaucccucaacaaaccuaaaagaagacagccacaagaacagaaugccaccuuuaacaacuaaaauaacaggaagcaacaauuacuuuuccuuaauaucucuuaacaucaauggucucaacucgccaauaaaaagacauagacuaacaaacuggcuacacaaacaagacccaacauuuugcugcuuacaggaaacucaucucagagaaaaagauagacacuaccucagaaugaaaggcuggaaaacaauuuuccaagcaaaugguaugaagaaacaagcaggaguagccauccuaauaucugauaagauugacuuccaacccaaagucaucaaaaaagacaaggagggacacuucauucucaucaaagguaaaauccuccaagaggaacucucaauucugaauaucuaugcuccaaauacaagagcagccacauucacuaaagaaacuuuaguaaagcucaaagcacacauugcgccucacacaauaauagugggagacuucaacacaccacuuucaccaauggacagaucauggaaacagaaacuaaacagggacacacugaaacuaacagaagugaugaaacaaauggaucugacagauaucuacagaacauuuuauccuaaaacaaaaggauauaccuucuucucagcaccucaugguaccuucuccaaaauugaccacauaauaggucacaaaucaggccucaacagauucaaaaauauugaaauugucccauguauccuaucagaucaccaugcacuaaggcugaucuucaauaacaaaauaaauaacagaaagccaacauucacauggaaacugaacaacacucuucucaaugauaccuuggucaaggaaggaauaaagaaagaaauuaaagacuuuuuagaguuuaaugaaaaugaagccacaacguacccaaaccuuugggacacaaugaaagcauuucuaagagggaaacucauagcuaugagugccuucaagaaaaaacgggagagagcacauacuagcagcuugacaacacaucuaaaagcucuagaaaaaaaggaagcaaauucacccaagaggaguagacggcaggaaauaaucaaacucaggggugaaaucaaccaaguggaaacaagaagaacuauucaaagaauuaaccaaacgaggaguugguucuuugagaaaaucaacaagauagauaaacccuuagcuagacucacuaaaggacacagggacaaaauccuaauuaacaaaaucagaaaugaaaagggagacauaacaacagauccugaagaaauccaaaacaccaucagauccuucuacaaaaggcuauacucaacaaaacuggaaaaccuggacgaaauggacaaauuucuggacagauaccagguaccaaaguugaaucaggaucaaguugaccuucuaaacagucccauauccccuaaagaaauagaagcaguuauuaauagucucccagccaaaaagagcccaggaccagacggguuuagugcagaguucuaucagaccuucaaagaagaucuaacuccaguucugcacaaacuuuuucacaagauagaaguagaagguauucuacccaacucauuuuaugaagccacuauuacucugauaccuaaaccacagaaagauccaacaaagauagagaacuucagaccaauuucucuuaugaacaucgaugcaaaaauucuuaauaaaauucucgcuaaccgaauccaagaacacauuaaagcaaucauccauccugaccaaguagguuuuauuccagggaugcagggaugguuuaauauacgaaaauccaucaauguaauccauuauauaaacaaacucaaagacaaaaaccacaugaucaucucguuagaugcagaaaaagcauuugacaagauccaacacccauucaugauaaaaguucuggaaagaucaggaauucaaggccaauaccuaaacaugauaaaagcaaucuacagcaaaccaguagccaacaucaaaguaaauggagagaagcuggaagcaaucccacuaaaaucagggacuagacaaggcugcccacuuucucccuaccuuuucaacauaguacuugaaguauuagccagagcaauucgacaacaaaaggagaucaaggggauacaaauuggaaaagaggaagucaaaauaucacuuuuugcagaugauaugauaguauauauaagugacccuaaaaauuccaacagagaacuccuaaaccugauaaacagcuucggugaaguagcuggauauaaaauuaacucaaacaagucaauggccuuucucuacacaaagaauaaacaggcugagaaagaaauuagggaaacaacacccuucucaauagccacaaauaauauaaaauaucucggcgugacucuaacgaaggaagugaaagaucuguaugauaaaaacuucaagucccugaagaaagaaauuaaagaagaucucagaagauggaaagaucucccaugcucauggauuggcaggaccaacauuguaaaaauggcuaucuugccaaaagcaaucuacagauucaaugcaauccccauuaaaauuccaacucaauucuucaacgaauuagaaggaacaauuugcaaauucaucuggaauaacaaaaaaccgaggauagcaaaaacucuucucaaggauaaaagaaccucugguggaaucaccaugccugaccuaaagcuuuacuacagagcaauugugauaaaaacugcaugguacugguauagagacagacaaguggaccaauggaauagaauugaagacccagaaaugaacccacacaccuauggucacuugaucuucgacaagggagccaaaaccauccaguggaagaaagacagcauuuucaacaauuggugcuggcacaacugguuguuaucauguagaagaaugcgaaucgauccauacuuaucuccuuguacuaaggucaaaucuaaguggaucaaggaacuucacauaaaaccagagacacugaaacuuauagaggagaaaguggggaaaagccuugaagauaugggcacaggggaaaaauuccugaacagaacagcaauggcuugugcuguaagaucgagaauugacaaaugggaccuaaugaaacuccaaaguuucugcaaggcaaaagacacugucuauaagacaaaaagaccaccaacagacugggaaaggaucuuuaccuauccuaaaucagauaggggacuaauauccaacauauauaaagaacucaagaagguggaccucagaaaaucaaauaacccccuuaaaaaauggggcucagaacugaacaaagaauucucaccugaggaauaccgaauggcagagaagcaccugaaaaaauguucaacauccuuaaucaucagggaaaugcaaaucaaaacaacccugagauuccaccucacaccagugagaauggcuaagaucaaaaauucaggugacagcagaugcuggcgaggauguggagaaagaggaacacuccuccauuguuggugggauugcaggcuuguacaaccacucuggaaaucagucuggcgguuccucagaaaauuggacauaguacuaccggaggauccagcaauaccucuccugggcauauauccagaagaagccccaacugguaagaaggacacaugcuccacuauguucauagcagccuuauuuauaauagccagaaacuggaaagaacccagaugccccucaacagaggaauggauacagaaaaugugguacaucuacacaauggaguacuacucagcuauuaaaaagaaugaauuuaugaaauuccuagccaaauggauggaccuggagagcaucauccugagugagguaacacaaucacaaaggaacucacacaauauguacucacugauaaguggauacuagcccaaaaccuaggauacccacgauauaagauacaauuuccuaaacacaugaaacucaagaaaaaugaagacugaaguguggacacuaugccccuccuuagaagugggaacaaaacacccauggaaggaguuacagaaacaaaguauggagcugagaugaaaggauggaccauguagagacugccauauccagggauccaccccauaaucagcuuccaaaugcugacaccauugcauacacuagcaagauuuuacugaaaggacccagauguagcugucucuugugagacuaugccggggccuagcaaacacagaaguggaugcucacagucagcuaauggauggaucacagggcucccaauggaggagcuagagaaaguacccaaggagcuaaagggaucuucaacccuauagguggaacaacauuaugaacuaaccaguaccccugagcucuugacucuagcugcauauguaucaaaagauggccuagucggccaucacuggaaagagaggcccauuggacacgcagacuuugugugccccgguacaggggaaugccagggccaaagggggggaguggguggguaggggaguggggguggguggguaagggggacuuuugguauagcauuggaaauguaaaugagcuaaauaccgaauuaaaaaaaaaaaaaaaaaaaaaauaaaauccuagaguugcaaaggaccgaucugagcaggcgucucuuuugaugucguuuuuuucccccuccuucuuagaaagucuccuugaguuuugaggaauuuguuggucauuguauuuugaaguugcuaauagccaugagcuguuggcagugacuagggagacagacccucacuuccugucagugagcuuccugucagugagcuuccggucagaggucugggaaccagcagaagaaagagacauggaaggagaagagagggaaggcagauagauucuccucagcucgauaguccucucguacagucuggacuucccccagauuuacuuccugucccuucuugacuguccaucaacaccuagguggggaagacuaaacauuuguuuggcaaaaacucauggcuucaaaauagcagcuuauauggucacuugcaaaaaggacuuuuuucuuuugcuggaggagguucucgaaguguuauauguagccaggguguccucucacugguguuuuuagcccuugggccagaugcaggcugugggcaaauguguuguuagacacagauguacaggcauagucugggaguucauggucaauggggaacugccuucauauuggcuaaaacucaugaucaacaagacuaucuagaguugccucucugacuuuaaaauugugauuucaagucauguuuuaauaaacauucagaaaaacccugaucuaaaauaaaaaugaaacuggcuguagaauauaaucacaauuguuuuaguauagucauuggugggucagaacauucuauuaaaacggugacacuucuauuccgaaacaaauauuucuccucugguucuccuuuaauuguggggugacuuuucccagcagcauaggguaagagccuggaaaugucacucgcucuguugcuucucauaccaucagggccuagggaggguacugugcucacuuaugucuacaagacagucuaagauaaagauccuuaacuccuguuggggaucuuuauugaaucaguauuuuccaaaugaagaaacugagagaauacacuuguauacauugucuucacaauggaauccaggcagccaacaccauggaggaggaggagguuucuguuggaaagguuaauuuaggacuauauauagaaccagaggcuagucucuagguccuuagaaagggcauugagcgugguggauugagucugcuucggggaagcccauguuguugaagaauaaaacacauucauuacuaggaugguugguggugaguaccaggggcuggauguugcuaucacaguagccauagacuagugaacagucauaggcuuucucugaauuaguggugauggggagggacaugauccuagcuuucaaaggucaucccugguacgaguucuuguggguggaucuaccgcugaacccucacauucuccagcacagaucucguuucuggcccugaugaacuuuuccugcacaagacgauuuuccagaggguauaagggaaauacauuaugaagacacuagcugucacauggcaaucucagccaucucaaauaaauuuugugugacugaaacacuucaagauagcuuuaucuuuaucuuuaaacgugcaucacauuuugccuuugaaggaugucuuagauaauuuugauuauuauuggcaaucugaaggugaaaaggacacaguaaaaguugucauuuuaaucauuguauauucuacucggcuguguaugaugaagccccacauuuaguagaaugaccuccucugccuaugguaagacagggcuucuccuugagcauuauugacuaagcuauguuaacaacuuaguuauuuacauaauguauuauaacaguugcugucauauccugaaagcuguggugggucccuuugacauaaacauggugauauaauuguggaucaacuauuacauuuucuucuucaacgaaucuuucucucuucccaaauuugacagauguggaugaaugucaggccaucccagggaugugucaaggaggaaauugcauuaauaccguuggaucuuuugagugcaaaugcccugcuggacacaaauuuaaugaagugucacaaaaaugugaagguaagcaaccucaugguuugcagcucaagagaaugaggaagacagacaggguggcaucagcagcaagcuuguuagcacauuaaacccuagaccuucuggguuugucauucccaggaggcugaaaauaugacagucugacagaaauuaugcaucuuccguucacggaaccagaaaagccucugcagcuuguucugcuuuuaaagaaacaaaauaagaggcgcaucugaaucaaauaaguaguaagacaugaaauauuuucagcugaaauuuggcuuaaaguguucaagacguguguuuuguauaguuuuggaggcacgacuuuaaaguugacuauuagauaccauuaaaaacuauacuacugauauuuucuaguuaaauguagaauuuugaggggugugugugacuuacuaacauaaauaguugugcucuuaguuagaguuuaggauuuucuuuucugggccuugauaucuacuggaugaaaagccaagcaaaaaagcaagcugaugugauuuuucuauuucuguuucauuuguagagcaggcuucuaaaauguauacacaggggacauguuuacaucuagcucugcuguuauaugcagaagcaggcugccuuccagggaagugauuuguuuuugagaugcaagcauccugggaauauguauagcucucaguucuccuugcugaauugauggaguguguucugauagccuuggagcaacaagcaaaacuccaucuugggucaagcucagacaaggccauuccuuuguugucauccauccuccggcuguggccugaguuucaauuaaaagucugugguuuuuguugaacaagucuauccuuggguucuuaaccuccaugaguucccagucuaucaaagcaacagaagacagcuucugaugugaaguacuaucaauaaaccauagucagacauuuaauaugacuugcccagaauggaauaaucuaguugucauagaauugccuuugcggguuucaaugguuuuuaaaauuauuaauuggcauaauuuauaauugcuguugcaaucgagaauguauuuuuauuuauaucauauauguacauauauacaauauaucauauauaaauauaucuacauaaaauaucauuuauaauauauaugaaauuuguauaacauauauaaaauauaucauauauaauauauaaaauaucaguuauuucaacuauagaaccaugagacaguuuuacuuccuuccugaagcugggcuucauaaaaacaucucauguuuuaaagaacaauaagacugguuuucuccagggggacugaucuuaggaacuguugacaucaggaugaaguagagaguauugguacugacaggggcagaggucggucugcuuuuccacauuguaaaugaugggagugucuugaggccuuuagguagcugcaaaggguucauuuugacucucuuaugcugaugcuaaucgacuauauuguauugaucucucucucucucucucucucucucucucucucucucucucucucuccccaccaccaccaccccugcucucuuguaguccuggcuagcuugaaacauguuauauagaccaggcugucucauucuccacucucuuugucuuccuggcuggcuugaaacuugcuauauagaccaggcuggccucuaauugacagaggccugccugccuccauguuugaaguucugagaauaaaggcaaggcccucaugcccagcauuuauuccaauuccuaaugcuuggaacuauuuaacaauauucugguauggauauucagccauuauuaaagguaucuuuuguguugauguaaugagguuuccugcaugcagaauccacaucaacaacagucugugugucacauuuuuaagcuuuucucuacuuacuauauugagcaacaaaagauauagucagcuucaagacuuagggcaauggagaccauauggccugucuagccuguguuuugucuuuuaaaaucagaguacuuccugccugaacaaaaauugauuuucugccuuuugcuuuuugcuugauuaggcuagcuaacagaaacagucaugguuguguaucacacagaauauucagauauaaugcucacacagaaaaaauagggaacucaaucuuuuauuuuuauuaauccuaagaaaccuacuuugugauauaucuaauaaaucaaaaauucaaccugagaauuaauauuuuuuaacaauaaaaacaaauucucagcugcgcauuggaaucuauagcaagauagagaacagaccucuuuggugagagcucaucuuuccucugcugccuacaguuauauuaaauuuagguggugguuuuuccugucucuauuuuucuaugcaaauugacaucagauaugauauuuccuuguuacuacuauauuugcucuagccugggacugguuggaauaaaguuggccuguuuugcccugguagaaaugucauaagaaagucucccacaaccuucugcagguuggagaauggcaccauuugaacacaggcuguccuauguggucaagggagggaugcuagcagauugagcacacaaaugcaaagagaacagcaaauccuauguguagccaggaauagagucuggcauaacaggguccucauuguuagcaugcuuugugaaagcugcaugagaguuagcuuuucaauacuauaacaaaauaccugggguagucaacuuaagaagaggaaagguuugugugccuguauguguccugcacacauaucacucaugugcaggucugaggacagcuugcaggagcaggcucuuuucuuucacugcguggguccuggggaucaaccucagguggccaggcuuggcagccagagccauuaccugccgagcugugucacuggcacuguggcuggcuuuuaaagugugcuuucccuugaguuugaaaggaagaaacuauguaguuuucuuuuuuuuuugguuugguuugguuugguuuuucgagacaccguuucucuguguagcccuggcuguccuggaacucacuuuguagaccaggcuggccucgaacucagaaauccgccugccucugccucccgagugcugggauuaaaggugugcgccaccacgcccggcuucuauguaguucuuauauuaucuuaaaaacaaaaaauccacuucaguccagugaguacuagcaaauuccugaggugacagcugccacagcuccaucacaggcugcucuacugaagugcuugucauuugagcuuccucuucagaauucucccugucauuuacuaaaaccucaauaaaacauauuaacuaugauuuaauacauauauacaguuuagaacaguugaaauguaaaugaauaaaccaaagcgauucaauauuagauuuuaaauauuuuaaaagacaaagauggaaguuuauagcugggauuggagaaagaggaucagagcucgcaggcugauucucagcaaaaccucuuugcugguuuuucugaggacugcaaagcuccucuacugaaggagcagaggugcccucgccuucuggaaaccaagcuuacugugcgaggaaauuaagaaauuaaaaauauguaguuaagggauuacauuuuauaucuggaagaacucauuugaauuaaugguuaacuuuuaauguuuggggauuuagauuaucaucagccuagccuccaggaaucuuaagagcagaguacaaggcaaaguaauuuuuaccauguggucccuacauccaugcacucccugauaugugaguuagagugcuugggacuucucuuuaccacaauaaugucauacuuauaucuguauauauuauauguauauaauguaauauauuacuauacacacauauacauauagacauauaugugugugcauauguauguauguauauguguguguauauauguauguguguguauauauauauauauauauauauauauauauauauauauauauauauaucccacuguacccagcaggccugucaaacugauauguuuuuaugaguggcaucugauacagacugauuuauggaaaccuugcucaagucaccauuuugggaugccugaaguucuaguaaaaugagauaaccauagaguuguaggagccuguaagaugaugaaccaggaggaagaagucuagccugugacucugguggaaccccuuaguacauagcccaucccacaaggcauuuccaccacugucuacugaugagagcagaccaccggggaggaaauauuagggaauucaaaccuccacaugcgacaauuucucucauccuguuuuaccuuaaugagcccuagcagccaaucgccuuugacuucuguggcaguuaagauauucguuaaggcauuucuuuaggaucagugugugugugagagagggagaaguggcaggaguggaggagagaucaugugaccucaucgauugaccacagugggcaguguggcauaagugaccuagguggugcagagucaagucaccguuagaaauacucaucuuucaugacuuccuagugaccucaggcaaggcaguugugugcagcuccaugaugccuuacaggaccaaaagucaagcgcagucuguugaccacaucuccaacaguaggagcaggcaguccuucuguuggaaagcugacuagaacaucccauugucuggaguucacucaccaagugcacacuccccagcccaggagcacuacugugguuauuuggaugugccuuuggaaaaccacguugguacuuccuaccccuagucuggucaccacaggucagcaacucccaaccagugcucaggccauuaggucuucucugagggauuacaguaucugccuugugggaaauuugauuagaacaaauacagaagaugauggagcauauagaauaauuaucggaggaguuuaaucuaguacaaaauaugcagagaaagagagagcaagcuuucaagauaaaugcacuugaaauauuagcaggcuauuagucugcuaguuucgauucuagagacauaaguuuauuuggcucccuuccuugaaucugguaaaucccucgggaaugucugucuacaucggcucuucucuggucagcugcuaucuggugcagacagcugcuuucugggggcuugacuucaaaagcaauccuuguggccaugaaauuucauauugcggcccccagaugacaagaacuccauuuucuauuucagauauugacgagugcagcaccauuccuggagucugcgauggcggggaauguacaaacacugucagcagcuacuucugcaaaugucccccugguuuuuacaccucuccugauggcaccagaugcguaggugggucuaauuacagauggugggcacaguuuuuauucauagaccacaaugaacaucucucugaauaaguuuguuaaugggaccagucauuucaggaaaugcauucaagaguagagagccuguuaccuacagagguucuguguccucguuuauggauuuguagaugcugucagucugugaguuaaggugcggucacucuuugucuagccauguugucucuccaugacuacauuuagcuguuuuccagaaucuauguuaaucuaagucuaagguuuugcaauaaucuuuacugggucuggcuucuacacaucugcuuugucaggcuuaccuuccuaaaauagugauuugcguaaguaacauucuugcuuaagcaucucagguacuuuucaccaggacauggaaauuaguggcuuucaaucuguaucuaaagcuuccacgcaaacugcaggcaugucaguacuugcauauauacacauuccagguaagacaacacacacacacaaauauaccacaugcacacacacacaaauauaccacaugcacacacacacacacacacacacaaauauaccacaugcacacacacacacaaauauaccacaugcacacacacacaaauauaccacaugcacacacauacacacacgcacacgcgugcacacacacacacauuuauacacacacuuguacacacacaugcacacauacacacacuucccaugugcacacacacaugcauccuacaugcacacacacacuuguacacauacacacacacacacacacacacacacacacacacacacacacccucuacuccacacacagaaggucuguucuuauccguugugguguuuuacuugccuaaagacagaaaauuaaaugaagguguaauuuauucuuuuuaaaacuaauuuacauuauuuuuaauuauauguguaugugacuuugugugcuugugagcacagguacaaaagaggguguuggauucccugaagcuggaguuaacaggaaguugugagccuucuaacacaggugcugggagccaaacucaaguccucugaugaugcuauuuguaaaucaagggcugccaauaaccugauggcagcuuguaacuucagccccggcaguccccauuuuaccacaaggaucaagagucucugacucauugauaacaugcuagccaucuaaaacuguaaccacaugguaucaguuaauuugcaaaauaauagucauuagccuguuaaaaguuugccauuggcaacuguaggucccagcuuugcucugaaggagaaaccauccaucugcuaauuauauguacacauuucauaauguggucaaguguuuacaacuggguuuugacuacccagcugggacacaacucaugcuugggguccucugcccauucuuaauagccuuuggguucugugcccaaaauauuuaauagcauaauauauaaacauuauuaacuuugaaaccuuucgaguuagaauguagaacucccauuucuccaucauguucacagagaggugucccacuguggacuucccagagaaggcuugucuacacccccuguguagguacucuuccuagaucuagcuggcauacgacccauucuugcugagaugucugcccagagguaccugaaccagaauuaacauuuucugggaauugcaucuguacuuggugguggucauaaguaccacucagaaacugucuugugugugugaugcugacccuuagucuuuuucugugguaugucuagguucgucuuauccuucuuugcuuaaaguaaacaauguaaauguuccuaaauuaugaguguuuaucuuuaagcauuucaacaguaaaaccaucaaaggcuuuguguuuuuaaggaugccucagagaaguguauacagacgacccucuauggcaaagcuugaugcugaauauucagacuuagggcacauagggauaggguuuuggcugccaaaaaauuuucauguuacaaaguccauucaugcaccuuacauuaagugagaagcauauuucagauaagacuugcuuuucucaacuugauuauauacuugauuauguacggagauguauuuuccuuggugagccaugguguguagauagaaauagguguuuaccccuugcuauggucuccuuuucccaggaacaccucaggagcuuuuccugugcgcugagcucuuuuuuuuugguagcugagaguuguaccauaguguguaagcuguugucaugacagucagacaugauguaauccaauaaaagugaucuauaggagagugccccaccgggcugcugugagaagauacuuucccgccaaaaagaaaagaacucaucuagaacuguugggucccuauaggacuaagaauuugcagucggugauguuuuggaauuuauuaauaauuaacccuuugaaaaaauuccugagagccucaggacaagagggaaccugauuaauaagcauuaaaucuugcugaaaauugacuccacccuuaaaaacacaaccucacaagucugaggaacaauuucagacuaaaaacuaaugcccaugucacaguugaauguuuuuuuaaaugaauuuaugcaaauguuugccuaaaguaguuugaauuauguaauuuaaaccaaaaacgacccaggcugucuuuaaucagagaugcgucuuuaugaauaauugucugucaccacuggugauugucuuagucuuuuuuccuauggcacauugguuuaaaccauuucaucucacccuggguauggaauguggaguuuuggcaaggugucccagugugcagaggcaagguaugagacaaggcauuucugauugaauacugggccaguggaaugcuuaagggcucaaagcuuccuuuccagaguauacacucaugggucacccugucauagccccagggugaggcauuggagguauugagacagaggaauguugucccuagcaugaucacaaagucuacauguguucuuguuguuucucucucagauguucgcccugguuacugcuacacagcucuggcaaacgggcgcugcucuaaccagcugccacaguccauaaccaaaaugcagugcuguugcgaucuuggccggugcuggucuccagggguuacuguugcucccgagaugugucccaucaggucaacugguaagaguccaucuauacagcaucuauagcauagcccaugcaacccugccaaacccauggcuuguuucuagaucugccggugaauucguucucucauugccauagaguagcauggagucucuguuuucucguauuccucaacagggaccuggugucucuccugugauguuuaccagcucagaacgauaaagcccagcugcccuaccacauacuucuucccuuucccuagcagucaucacuuuccucuuccuucugccaagucccauuuuuguuuuuuguuuuuguuuuuauuuuguuuuuguuuuccuuuguagcuuuccaauuaucugucauauuuccuuuguuuccauggaaagcugaucaauccaaaugguugggguggccucccacguguccagugggggaucugccacauacauuucccaaaguauagcuuaccugacaaucgcuggagagguuguauagaaagaugucuggaauauugucauuaguguggccacaggugauauuugcugguucaaaugaugccuuuuccugcaaagaaauauuuaugauuuggcuuagcauccggaguccccaaagcugaacuaaguucuuuuaguuguuaauguuugagaguuuuauuuucuauuuaaacuauauggugguguuucccuugaauagucucaacauuucuaaaagaaaugaguuauuuuuuccuaaaauaucugcacaguucauacuuuaccuuuuacucccuucuuccacagucccugcugucuacauaucugcuagaguaguguuucucaaacuguaggucauggccccucugggguuugcaugaccaguucacaggggccaccuaagaccaucagaaagccagauauuugcaucuuaauucauaacaauauuaaaauuacaguuaugaaguaguaauuaaaauaauuuuaugguuggggggucaccacaugagcugcagcauugggaagguugagagccacuccucuagagggcuaaggaucugugcaaacauaaccugauccauggagaugccaagccaaccacagcuggaggugagguuacauccucaugguccagugguuuguaacuucuuugugcucaaggucuacacugcccuguguugugccuaccuguguccaugugcugcaaugacacuaguuaauaaaucuuaugaagaggucuuaguccucacugcaaucuuauauuucucaugcucucugcacugccguaguauuuagcauacucuugcuccugggaggcauucagguagaacauacagcucaugaagaaugacuuuuccccacaaauuccagugaaaaccugaccuuuuagcccuguuuaauuugauuccugaaaggcacauucgaaucggagagucgaggggagguggugaaccucaggguggaggagugcagggauggugugaugcuuuugagaugcugaccauaggaugugcaguucucaucaucgcuauagagccauugauggugucaguauaagaugcugcucaccacugagaacuguaggugugaacuguagaaguaaugcaaucauuuuggguguccauacauauaugcaugcauacauaauacauacauauacauacauauacauacauacauacauacauacauacauacauacauacauacgauucaacaggucaaauguccuaaaaaguaacccuuccucuugauuugcugcagaacuauccccuagaucauggucuggaagugcaugacuucuaucaagaugcauaacuuggguaccagaagaauugcuucuuaaaugcacacaucaauuugagaaucuauaucauugauuggauuccuuguacuugagugaggagggaaggcaguagauguagaggccagcaggaagaucuaguucaggaagauaugguucuuguguguggcuugugugugcagggagcugaaagacuuaagcaugacacggcacagagcaaagcagaugggucaugcagacucacgugcuggucggcuuuugcuuguucaaaucuuccaagacaguaccgcugagcucugggccucgccuguacaaagcggugauguaaaagggacuuaguccuuuuuaucuuucuuuuucuuuucuucuuuucuuaaacuguguuucaucucugaguugaauggagacagaaaagauaauuaagaaacuuuaucucuggcugcugaucccuagaggcucaucgauaaaaucuauagaaaagaaggaguuuagggcccaguuagacacguguccuacaggguuaagaugaaguuaauggugaucuuaaaguaaucuacccaccuaauuagcagaaauacuaauaagccauucagcugcuuucacaaauccaaaaggaauuuuaaaacuauaggacuaacaagugcuugaaaacaaaauguuuccuuuaauacaucaaaauucaguuaaauccaacauagacugaaauccucuuuauguaauuuacaggcuaggcugagagugagaauuaguuacugcucauauaugguccagauuuaaagugggucauagcaauguggugggaaggguccucagaauggucgauguggaguaucuagaugauaauucugugggaaaagucacugugguguaguggaaggaacuuuagcacccugagucaggaaaacacagacaagggaaaaaucccuuccaaguacgaugagauaccaagaauuugugggucaaaauuccagauaaguaauggaguauagcaauggaacucucuggaagcuugaacuaggucugaguuauaggugaggagcaagacugaagaauguccagaaauggacucguuaguaacagcacagcguguggagcuugguguguuuagucaaauguaaaauggcaggaugugccacgaggcugaguuaugagugcuuuccagaauuccaccgguaaagauaaacauuaaccuaauuugugcuaaugguuaacgcucuguaaaaaacaaaacaaaacaaaacaaaaaaaucuauauaagaaucauuuugugacugugaguaaaguuaucgacauucuagccccaaaguaaagaaguaaacugcuguggucugccuguagaaggggacugugaccacccgcuguugucacagaugcacuagcuacugccuaaagaaccauucuggaaauuaaaagaugucaugaaccuauggaagauuuagucuuauagaggccugguauuguuuaaaaagacauaaguacucaagcccgaaaugggcgaacacagggaaaugcaugaucaagucagggugccccagcucacagagucacugugcgacauccacaagcugugcaucccugcccuuccugcuccuugugucuaguuguuuugaccagacaacuccucagagcucugcucuggacuuccugccuucugcauuucuuagaauucuuccaucccauugcuuuaaauauuaccucucuucugauaacaggaaagaaaaugacuucaucucugggcuccaaacucucuucaccaauuguugugugcuaucaccauuugacucaacuguucaaaguaacuuuugguuuccgcuccccacaccagucugcagcucgugaugguuuuccucugacuguaaaggacagcagcauguaccuaucugaacagccaaaacacuaguaacuauuccucauuucuuaguucuggggcucucacauuguucccauuaccaaacauuaccauuugccugugaguuauccugggacaauugugcacucugucaggucuacccccaccucucuuguguguucaucaguaucuuguccuuggauuuccacacaaaccuuucuucccuauagaauuuauauaucagcaagaaucaucugaaaagacucaugugaucacacgcuaccuguuggagacugcuguggcuuccccgugcacauaaaauaaaccaaaaucuuacagaaacaaaacaacaacaaaaaccaagaacaaacaacaguaggcugucauguagcacaagcuggccuuauacuuggugugagaaguucaaaggugacuuugaacuucuacugcugcuaugcuuuuuguguugucuugcuagcccuuauuuuguaagucugugaacuuugaagugauugagauucaguguaaugggucucauuacagcgccaucaucuaccuaugucauguacuucucucuaauaaggacacacgccuucugaugaacuuuuuaaaucccgugacagcuacauuggggccagaggagaaaauaacgccuaacauuuuuccugcuggguuucaacguguaaacaaauaucuuucuagauuuuggaaggagcacaugguaccugcucuggagacauuaauuuuuucuuuuuuuuuuuuuuuugcuuaaauuugucauuauugucucaauguguauauuauugucucaacugugcacauauuaaaaauaugagugauauugcuuaucccgauuggcuagugcacugcgauucauaaaggcuugucuucuccagccuccuggcaguuauggcucuacugauuguguccuguuguguuguauucuuccagaggauuucaacaagcugugcucugucccucugguaauucccgggagaccagaauauccucccccacccauuggcccccuuccuccaguucagcccguuccuccuggcuauccuccugggccugugauuccagccccucggccaccgccagaauauccauauccaucuccgucucgggaaccaccaaguaagaguugcgaagccaucuacgcacuuccucuugcauuaauagguccuauuuuuggcuuaugccacuuucaucuuuaaauauauuuucaccaauugcuaaauaaaaauuuuuugcauaguuuuaugaguuucuuaguuuuccuguuuugaaaauaagaauggaagccugguauguuccagaguugaauguccuuuuguuauugauauucucaaucagaugugggagugguaugggaaagacuaaaaucgcauucagagaaugaaguaauggcagaagauagaugauauuauaaagcaguuaguuaacugccagcacccugcugcccuaguuauuuccccaaacuggaggcuuaagcauaaggagguggguggggugaggagaggcaggcagagaagucucugggccacagcaccuccccuccuguggcaagguacaaugugcucucugaaggcucagccuuggugguaccuacuuuaggacuugguaucuuguucauuauugacagauuaagagcugaugucauggaugugaauaauuuugaugggguucaaugcuguucuucuaggggugcugccuuucaacguuacugacuacugucaacugguccgcuaucucugucaaaaugggcgcugcauuccaacucccgguagcuaccgcugcgagugcaacaagggcuuccagcuggauauccguggcgaaugcaucgguaagcaacuuaccacuugauugacacugagagacaugucucagacaguguucuaucgaugugaagagucaccaggaccacugcaagagguuuagccuaugaucgucauggcggagaucaugacaacaggcaggcagacauggugcuggaccguaguggggagaucuacagccagauccucaggcagagggcgacacugggcgugacuugagcauuugaaaccccaaaacccaccacuagugacacacguccucuaacaaggccacuccuacuccaacaaggccauaucuucuaacccuugacaaguagcuccaugcucuaaugaccaagcauucaaaucuaugagccuaugggggccauuccuuuucaaaccuccacagucugcauugguugucuauuucuguuguaacaaucauacagccucauacaguggcuccgaagcccucucaauccagggguuaaaagguaggugcagguagggcuggaucuucagaaccucuuggagagaaagaauuuccugaccucaaauuucucagacucuagaggcaaggagggcagugucuucagcauagcacaaggacaacgaacgggacuucugggcccuacagcacucugcugaugugugcucucuugccuuaaaauucauguguuucugagcucagucgguucuugcuuucucaaguucauuuccugcucauauagggaugcuucuagaguuauccagagugaaaugggagagggagcgaggaauguguggcucgaggucagacuugacucuucucccaagauaccuggacaccaauaaggcuuugcugaaucuuaguuuauucauaaauagcaguguagaccagugggcugcgcuacagaguauuuaaagcaaccacaguauuuuaguacuaaggcuauggagaccaccugaguaggugguaauugagaaccucccuuuaaacaaccaccugucuccauauauuuuguucuuacauuuuuaauaaaacagcaggagaugcuuagacaugaaacagaccuucuuuguauuaaaaaacaaaaacaaaacaauaacaauaacaaaaaaccccaaaaccuuagugucuuuaauuuuuuccuaguucugguaguugaagguagaguuucauacaugccaggccagugcccuccccuuaccaacacccuagugcacgucucuuuuuauuuguucacuacucuuuuuuuuuuuuuuuuugagacagcgucuuacuaaguugucuaggcaggucucgaacuugcaguugucaugccucagacuucuagcagcuggauuaagagcccugugcuuucgcgucuguccguccguucgauuuucuuaggccagaaucacauaagaaagcaguauuuguuaucucagaguauauucauauucucugaaaaugacacaaagaacaaguucaggcgaacugcuuuaccagucuuaaaaugggugaauccgguggcauacuguagugggaaggaaaaagauaugucacuaugcaaucuccuuucuuuucugaguuuuucuuuguugagaaaggguuccacuacacaguguugacugaccuggaacucaguugguacuccagacuguccuguaauucagagggccaucugccugggccucccaaguccugggauuagaagugggccccuccaccaccuggcuucgacauuuucuuaucuuaaaggaaaauguuuuuuuaauuugugaagaaaccuaugaagcccuagacuugugagcuauugugcacacuuccacugacaugcuguguuuuacagacguggaugagugugagaagaacccaugcacugguggcgagugcaucaacaaccagggcuccuacaccugucacugcagagcuggcuaccagagcacacucaccagaacugagugcagagguaaggcucuuggggacuggggugugucugucccagaugaaggcuuggcuuguaaggaauccagugaaacauaaaugcgagaggcuaauccccucacccccaccccuccuccacucccagccucaugcccccacaccaccugauggguguuuuguuuuguuuuguuuugccuuauucuaagccucacuucuuugaagguguugcuacaaaaucuagcaaacauccagauauuuugaaagcugucugugugccaggagaauagcuuauuuucacuucuuuugaguuauuuuuucuggugguucaucuuccagccaggacauagggaaugugguuucucuguguggcagaaacuggggaaagccucuuuuaggauuacaugucauucgucucuccauagaaaggaggauucggagcucugcuccuaguagacgcagcagccaacagcaauaucaccugaagguugacugaaauggugaaucucuaguccucccugaggcccgcugcugagagccagcccuuggcaggcucccccagccgucuguguacacacugacauuucaggagcacuguaaaugucuucucaucaagguugccccucagguuuauuucuuuuuguuuuacuaaaauauaaaaaauuagcaauaauuuuuugagaauuuuggacaucaguacaguguuuauauaauuuccaccucucccucuuccccuucaaaauucuccuaugcccccucaauccccucucaaacucaccacuucuuuaauuauuguuuacaugcacacacacacacacacacacacacacacacacaguccaugugguguugcccgcuuguaaguguuuagggcuggcugcuggggaggcuugucccugaaaaaauguccccaucucaggugccauugauucccuauagcucuucauguaggugugggaucuugggagguuucccgacuguccauguuggcaggucauggguuuauuccuuaaauaauuuauuaugcuguucaauaugccuuugguuagauggcauucauguauuaaguuucuguggugaaaaugaguaagauauacguccaauucuuuaagaacugagagcuucuuuaaucccagcacuugggaggcagaggcaggcggauuucugaguucgaggccagcuuguucuacaaagugaguuccaggacagccagggcuauacagagaaacccugucuaaaacaaaacaaaaacaaaacaaaaaaaaaaccaaccaaacaaacaaacaaaaaaauaacugagagcuuuaucuagauauucagcacagaaugaauugugucauuuauccugaaaaacuagauuaaaauaaauaaguagcuaagcgagcacuuaguuuuuaaacacagggcagguagggagaugucugccacuuaaaaaugugaaucuacuaauacaagaugauuauuuaccuccuuuagcaaaagcccuuugugugaauugagcaggauugguauucaucccugaaagacuuucauaaucuuugaguuuggucagauuuggagacauaucaccaucacuguaguuugguacccuggccaaaaaugucaauauggacagaaaacaaaaacaaaaaacuuggaagcacagucuuucuacacaauucuauuagcagccuacaaucugaaccauaaaucugaauagguagauaggcccuugaugccccaauguaagggaaugccagggaagugagguaggagugggaggguacccucauagaagcaggggaaugggggaugggagagaggguuugaggaggggaaauugggaaaggggauaacauuugaaauguaaauaaagaaaauauccaauaaagaaaucugaauagguugaguauuuagcugauuuaagaaucuucuuaaugcuuuagcuguuaguuaacguaaugugagugccaguggugucuuggacauuucucaguagaaaagacuacuguuaagggcuuggcugcuuauaagcuaugacaaauuguagagcagggauuggcuggagcaagggccugccaggguuagggccaugcuguuacccucaacguggggcuugguuagagaugagcaugacugcagcuucccuaccaucuccuucaugcugcgaaacuuaccaaggguaagggcacaccuguggugcuuggaggacaagagucucagcagggaaauccaggaggcuggguuuucagcucaggcgcuaugcuggggucaaaggggacagaagagaaagaaacaccagaaggcaaguuugagugaugcgcuuuuaugcugucuagauuucuagaaauguacuggaucccccauggcauucugaaaguagggagaagaaaagaugaacucuuuuucuuguuuauuuuaaccucagaaaaaauuauagaauguuaaaaucgauucaagaauauguggauuuuugcuauuuuucuuuguagagcaggacagguuuuagugaguauuaagaauaaagggggaaaaaaaaaaaagaagaacucagagggguuuggcacaaagaucagacagaagaaaagcccagacugcuucagcuaguccaauggcucacacagaaaccgcugugggaucagccuggaaagagaaugcguaggagggucagccacagacaccgugcagacgcugggcagacaggauaacuggacaggccauaacugcacauuccucgcuagggugugcaggaugcucgcacucagggccuccacucaacauggaaggguugcucugaaccaacuccacauaguccuguguguucugggaacagaaagcaggaaugauuguaugcugcagggacaagaguguuuuagccauccucugugauguucauccauuugcaguccuuaggacaggagggacagagccaggcuacccugaugucuaccaggugugggguuuuaauaaugaaauaaaaaauauuuuaugucauuuuuaacauuccugucauaucaucaucaccaucauuaagugggagaggggacacccuccacaggagcuuuguuugguagcuagaauagucauaaaguuuaaguuaaaaauuauaugccugcucaaugaaaguauauuugguccagaacugcugugaggcagguggacaucuuguaguuauguggaguguuguuaggaagaacugagaaauuucucaaaaauaaaauaauguuucuguuauuauuucugauauuguuauaagauuuacuuugaaucauguuugaagugaugucagccaaaguucaauauaaauaaauucucuagaaaaauggugaaaaauugauucucuucauauaguugagaucuaaacagucuuaauaaaaagucagaguaaaugugaccucuaaguucuuuucugccucuuaucuuucugacauugauaauccuguaugcauagaugaugauguauguuaucaaacaguugaaauccuagauuaagguuauaccuuuagaaauggagggagaaagagaguaauuccaaguuuuccaaauuaacuuuuauacuuuuuaaauuuuaaccuuagacauagaugagugucuucagaauggccggaucugcaacaauggucgcuguaucaacacagacggcagcuuccacugcguaugcaaugcgggcuuucaugucacgcgggacggaaagaacugugaagguaauggcaggccuacaaggcugcuucccucacacugcaaguuccacauccagagucuugaauaagacagagucaagugcugugugaaagguugaacugucaaaaguguuucacaaauuucuuucuggaaggcaaaccuaagucuccacguugucgugacuacaaucagucacacauacuagcagcagugcauguuugaagguaccuuacagugaugacgcucuuuuggaaugugccauuacuucugaguucuaugcaaucagaauuugcaggaguuuuauauaauagcgacaacaaaacaaccacaaaacaauguuuaugccuauaucuucuuuggucaccuauaaaucuuuugugcaaagugccugccgggcaauaagcccccuaaccaugggugggcauggagaauugcuuugagaagaacuagggguguggagaaccagccucuuaucuugacuucugaagucauccugugacaggcuuuccccuguggaauauguaugagugcugugggugagguuccacauugugggcccucagcagaaacuaaagaauguucuuuaucguguuuuccaaccucuuuaggaaagaucccaagaaucuguuaauauguugaaagaauuucaaaauuguucuuaggaacauguuuggcagaauauuaucucggugauucaauccacagacuuaaggccaaaauucccaguuagggucaaaucuauuauuuuuuaaauaaaagaaauaaagagaaaccauaaauuguuuuaguuugacuaaaagccuguaagcgaaggcaggucauguccagaggugcaggccucucgggagagcuucaauugcucacagaccagcaugcccaugaaauuaagaacugucuuugugaucaaagggacaaaauauuaguagcucagcuggaucccaaagccgagucuagcacugaccauauccagcucugcaauaucuacuucaaacugcucgaaauggcaagcuuucuucuacuuucuauuauucuuuagaugacuguuuuuaagaaguucacacaauauauuuugaccacacuuucccuuccucaagccccucccagguccucccuccccucccuccccacccaacuucauauuaguucucucuaugguuuuuuuuuuuuuuuuuaacgaaccaagauuuagccuaaauacauuuucauucccaguagccuuaauuuuuguuucaguuucaguuucucagaaacaagucuaggaacuaaggagcuaacuaagucguuagugcuccuuuugguuuggggaccagugaccuucgaaaggaucccacuauccccugccaaaagagucaaccugaauuugcgacaccuguuucacgugacuucucuuuuuguauuuaucauauggaugaaaauuagccuuagguuauacuaacaaaaacugagacagaagugugaaaagcuagcguuguauccauccaggccugccuuccucuucucaaggcaaugccuaucucucuuucuagauauggaugagugcagcauccgaaacaugugccuaaacggaauguguauuaaugaagauggcaguuucaaguguauuugcaaaccuggguuccaacuggcaucagauggccgcuacugcaaaggugggugcuacgaaacccccaaaguaugcucgcugcccacuuuuccuucucccuacagcuucuggaagauucuccccauguagaguuccccggggccugcuuuggagaccugacugguauuccuucucauguuccgcuguccaaacagccaccguuagugaaacaaggcuagucuuauuucagagaaagcauuuggguucuucuggaggggcccgaaaucagcugagguguggugauuuaaggagcugaagcgauaaucuguuucaauggcucugacgaguuuucugauaaagcugaguucugccuuuuccuuccagcuggggaugaugcuucuugaucauucccuucacccaacucaucccaucuuccccugcggggggggggggggggcugacuuauuuguggugcuguaucccuuccugguucaucuagcuaucauaagaaacaacaaugaauuuaggcuuuaccaaguuauguaagucaagggcgaggaggaggaggaggagaggaagauaaaggacaaagcagaaaaauaaaccaggagucaggguagccugauaacuuuuaaaauaaucucauugcuucaaguauuguaagcaaaacuuggaaguuccauuugugcuguaugggguucuaacaagaguugcuggagacaauuuuguuccuauucgcugcuguauagcgucaggagugaguagcuguuacauguagaugcaagauaccaacuggagucauucuucucagauccuuauaugcagugucaguccagggugucuacuaaguggccaagagccucuguuuacagcaucugcugcagaaauguagcccaggacacugcaaaggcaggaugaagucacagggcaccucugcugacuguccccagucuccagcucuggugaagguaccguggaagaaagccuuguauaucuucaguucuuggcaaggugugcacuuucuccaaccuuuaaagagcuuccagcucuuggcuguugaccugcauccccugugaccuucacacugguggcuuguaauauugugaaaauccaucuucaguagagaacaaacaguugacucuuuucaaaguuugaaguaggaaaaugguuucuguacacauugaacucugugccaggaggagcugacauggagaagagaguuuugugacauucugcaguaagauaaagugucagggugugcaaauuaaauacuguacaugggggaaagaaaugggaagggcgugacugauuacugggcuauuuggaaagcugagguguggugaccgagguggcagccucuuggcauuaaauuaugcuguuucagaggacguuaugaccucaaagaugaauguaggcucugaagccguuggugaucauggaaauugugucuuuuauguaaauaguguuguugacucaaucguguggaagaacugauaguugcucaccuggacucagcauuuuguagagagggaaggaagaagagaggaggaaaaggagaagagggaaggaggaagagagggggaagggagaagagggaaggaggaagagagggggaagggagaagagggaaggaggaagagagggggaagggagaggagggagaucaguuuguaucauuggccucaucguuuuccccuaguguacagagcucaaauaaacacacuucggagagggggagaagggagccaccauaugcugcuuuuccuugugucauguuucucuugcugugggaugagauuuuucucuucaucugucauccugaagccacaaacacaggauggcugagagccuuguuaucagagccucugccaguugaaagacuucauguuccacuaugaagccuuucaggcugcuuuuuagaauagagucuucacugucauacuguuggucucugcuugaccaaaaagaugcgugaaacaaaugaaccaaucugaguucacauucuuaaauauaacugcuguuuuuaauacagucugaacaugaagucuuggaccaccaggaugcauuuuaugccaaauaacacaagcuaaguaaaacacagaggugcuucacucucaauuugccuuuuuaaggccaggggaaaggaaauaauugcauacucuauuguauauuguaaaagaacuguuggaaagugacuugguucugagcauccuuguuuuuucaaaacucaguuuggguacccuuucuacucuuaaugggggaauucucuacuauuguuaauaugaacccagugacaguacuuaaggauaugcauaugauacuaaaauuacucagcagugcuuuaaaaagauuuuuuccaaacuucuagugucguugaguguuguacugaccaagggaugucaucaaagucacccuguauuucucuccguucucucucuguagugcucccucuggcauuuaauuaaugucugccucuugcuaauugucccagaggucucaggagaggcugguacuagcaguggugccaaccuggguguugacugcagaaaggaaaagcuucccugcacagucaaagaugcaguguguaucaagcuagauccaggcauggcuacagugggauguguugccuagaauccuuugccuucuaguggucauuuuccucccuacaccaauucugcuugccuuuuguguucuuguauuuucuagcagcuaucucgggaggguucuauuaagauggcuuuuaauagaaaagucccaagcuuggcugaccucucucuuuccugucucuggaagaacacugagcgagcaucccacuagcaugccacugugguuguagaguaucauuuuccacgguauccauguuccaguguuaccauaaugaacuguucaaugguguuaaugaaaugcuuccucaugcugcagauaucaaugagugugagacaccugggaucugcaugaacggacgcugugugaacacggauggcuccuacagaugcgaaugcuuccccggauuggcugugggucuagacggacguguguguguugguaagaaaaaaagccacagccugguuuauuaucaauacucccagaaucaucaaugcuuaucaauuacaaaugugucuuacccuagcaggugagauacagugauuucuagugaacaaugauuuaacaaauccauuucucaucuugaauaaguuggacacucauguuaggaauagaaagauaauguuaaguaaaggagaggcuggggaggccccaccuucucuucucucuuuucugccccaacuauauagcugucuuugauuuucugccaccuucuuuuguggauaaaagucuuuagaacugguuuguacauguauaccauuuuauggugugcauuuuaauagagaauuaaauguccaagggaagugaaugaugccacagaaauguggauaauucauaagcaugcaaugacaguuuuucacggcuuugagauuuguuaaauaacaagacuuuuauccaaauuauuuuuuaaaaagauacucaguaagcccuuugauuuaggagaggauugggugaagcuggaaauuccuccucuagagauaaagauaacacagcucgguugaccaacaucugcagguuuauauaaugaaccuuuuacagauuaaacuuucucccuuuuggaaaguagacccaauuuagacauucaauaacugccuguuuauuuuugaguaagccccauuucuaauaaaggucuuauuuaucaccauguaagauccugccuucaugcaguguuuauaaaguuccugcucugugcaugccuaaggaagacaaaaaugaaugaaaaauaaucgcagcacuuaagggccucacaguuugcucuacuacgaucaccagaggaaacugguugacgcuggccauugguccccacugcucuggacccuaauggguuuuuggagguuuauuuuuuuuauuaguuuugauuuuuuucucauugucaagcacugaaaacacaggcguucucuguggcuuagaacagggcaguggagaaauaaaggcagcguuggcuucaguguggggguuuuuaucuguuuaaaacgacaguccaacgauggcuccuuccucccacuuagacacacacaugcggagcacaugcuauggaggauacaggagaggccagugcgugaagccguuguuuggugcuguuaccaaaucggaaugcuguugugccagcacugaguaugccuuuggggaacccugccagccguguccugcacagaauucagguaaguggcagcauggaugugccucauccugccagccuucugccaccauccaagggccuugcuuuccuauguuaccaggaaaggcuguguuauggucccagggauaucuuguagacccugcuggggucuuggcagaggcuagucagggucuaggcacacguuacucucccuguccucacuauuauuugccauaagcaguucauuugccucuguaggaaccaccccaccucaguccuggucacacuccuggaaacacaugcuguuucaggacgcuugcuuuuugcaggagaugacuauuagaaaagcagaauuuuacacaguguaaaaguaaauaacuuucagaugaccugaauauucccaacagcuccccagaaggccauuuguaaauuguguucacaacccacauguugauucuggugcacuuuucuuaaauggcuuucuuuauucaacuuuagggaaaaagucuuuuucuacaguuuagguggcaugccuagugaaaaacaaccagccaagugagucaaaacucugcugcccaguucacaggcagaaagauuugggagagauuaguuaugugugcauagcuuugcccauuuaaguauuugaaaaagacuuagaauaauaauaauaaaguaauuauaaaaugagauuauauggacaaggaauucuuaguguucugaccuacaaaauaaauuucccuagguaaacuagacgguccuaugcagauauaauuauuuagauucauaaagaaaaaauaguuuauugaaauaugucgagcugccucccauaugcaaauuguguguguguguuugugugugugugugauauacaacaguagaaagggcuagugagaugggaggaaagagaaagucaugaaaugcuugugucaugaaggcagaagaggggcccuuugggagaaagaagagagccagcaggagggaggaggaagggcauuagagugaagcuggcauacauuuaggaagaaaacaauguaacuuauugacaugaaggugguugauuuuuacuuucacuauuaucguaagguagcuuggcaguugacuucuguuguccuaagauaaagcuagggcuaaaacaaacaaacaacccaagcaguuagugagcguccacacaagauucaguuauuucaucuccuuccuaaguaaaauucauuaaaaauuauccuaaguaugauuuuucagugcuuaguaaauaaaaauaaccuuugaaaugacaguguuugaagugaauaucauaagaagcuaaagggaaggcucuaaaggccauaaaggaugccacuggaaagagaagguugcuuuggcuggggauaacucacagacuaucuguaugucgucaaaaaaaacaguuaaauacaccucuaguucacuucaaauagucauuggaacaaaaugacugcauaaaacucuacagucguauauucuguccuugguuacacaaauuuuucaaagugcuuuucucacaaacuuugaauuuauaagacagaugugugucaguaaagcuguaaaagaugacagugcacacauacugugagcagaaacacacugcauacaguucuuggcuuuaacaguuuccccucugcacuaagagcaucuccagugaguguuuguacucaggggaaugacauggguuuaggagaaggucacuaaagaaacacaguuucuugaagcagugaggcuaaaccggaagcccccggucgcuaacuucuggcucaugucugugcuuuagugccugaggguauuugcauggaaaagguccacagaagaaagcucuucugucgccucggugauugacaggaaugucaaaccauggaagauccucuuagggucucccucaucucaggagagggugaucuaacagguacugacaaucucuagaaucuagucagcugagggaggaacugccaccaugugaauuuccaaggucaccaugugcugugcaagccaagcaggcugugaaaagucgcaccacuggcuccuaacccaauguaugugguucagcaagccuucuugcccccucgaccuccaacuaguucccucucuuagaaagcagucagccuugagugcaacucugggugcuucgaugcugccugccacgcugcugccugaggcacuaccuugggauagcuuaggaagugguuguuaagagugugaccugccuguguuuagguuaucgcauuaaacccagagagcaucagcauggaauggggaagagcacccagaggggagggauuugcuucuagccauaaguacguuagcauucagaccccuuaauuacacagaggaguugggccuuggccgguggcaagcacaaugaccacgcugugccucuguguaggccaaguaguggcuaaucugaauuagccgugagaacacuguccacagaaucgccauggucuugucuucuugcauuauuauucaguuccgugaccacgcuaauaguugagagugugagaagauaccuaagauacauuuuucuucugguuuuguugucaucauucagucucuggcuuuuaaauacacaguggcugacauucuccuccuugucccauuuuggccuccuuuuaaaugcuuaaaaaaaaaacaaaaacaaacaaacaaaaagaacauuuuacugcuuauuacaaaacauacacuuugaaggauuacuuuuuaaugcugcuuucuugguuuugguugguugguucauugguuaguguguguguguguguguguguguguguuugugugugugugcagcuuuucuuuuugagacagggucucacuauguagccuugucuguccuggaacuuacucaccaggcugucuucgaacuuagagagcuccuccuaccuccgugucuugagugcugggauuaaaggcacaugccaccauaccuggcuaaaggauucuuuuuuuuuuuuaaauuuuauguuguccaaacauauuugucuaccaucaucagaaauagagcaaguguuuauucccuauaauaaaguccccuccaccaugugcagucuccguaugugacucugauucuggcugccagaaaccaugggcuggcaaaggucugucucaugucugggccuuguauaaagucugguuccaggugcuugcauuucucaccguucaccauuacaucccucuggaugcugugagagcugucuguaacgcuucauaaguacuagagagcugauucugucacggguuuggggagcaagucugcacaccucaguugauaagaaagagagaacgaucuaaacauguaucaagaguuucucuguguacucgccguggaaagugagcaguguccacaugauucacagcuguacuugcacuugagcuuggaugcucugcuguguucuugugaggagggcccagagagucuguggaggacagaggacaugggagaaccugauuguacuggaaaagacagcuagaauggagaaacagagcuauucccaggauggcagggaaaaguuuuauuaacagcgaaaaaaccacauuuuaacaggcacauuucacuguacguguaaaguguucccuggugaacaaaaugaguuguaggaaaaagcacccuuuccaaaagagcuuugcccaagaaauugcuauguguucccuguauccuucaaagucacuuuccucaguggugcggaacgcuuaaaacgcuucaaaugaaagccccgucuaaagggaacccccaggaguuccuccuguucgguuaccacuuuagcuucuccuugcucuggaggaaaugauggugugagccaagggcagaauugaccuauucugcaaacaaggcacucauuuauuaucugauaauuuauuacagcggaauaucaggcacucugcagcaguggaccgggaaugacaucagcaggcacugguaaggagccacucugaaguuuccugacuuaagcauauguaaaggcagaacugagccuuuuguggguaucuaguuacuguugugacacagucuggccugacaccuugcugaccgucacaggugaugcccccccacccaccguggcagagcuucuguggcaccuugauggcuguggguguggggcuuucucacuggccuuuccuggggacaauuuguggagggcuauagcugagauacaauggcuggugucgcucagucuagagaagcagcagccugaaucuuuacgaguuuccauuaccaaauacagcugaggauuuuagauuggacaaacaguuauccauucagacuaaaagauuucuuaacucuaaaagguucagucauaagauaccacuuagauuuucuaucaagaaaucauaucagccagcugaguuggaagaaaauaaauuguauguagaaauagcagaaauguagggggucacuaaaaagaauagaaucaaaggagaccacugagaugaggguaaagauggugacaagaagaagggacuuccucacucaugaaacuaagcaauuugauuaggggguucugggggaaaaccagacuggcugauucacucauuuuauauguggaugaagaugaggagggaguagugaugaaaagggggagugagaagggugauaauggaggaaucagugggggagucaaaagagcuguggcaaaggcauggggaugaagcagauuacaaccuugacugauaaagaccauccauccauguaccgccacuuugucucccucucugguauuagagaggucugcucaguaugugugaacacagaggaggcagugcguagccuccucggggccaaagaagaggcucuguccugugaggagaccuacugaaugaauuccccacacaguggagaggggggcuugcuugaacaccgaauuuggagccaggaaacacaugauucauacuuuaauuugaugauauuguugaacuuaagaacuuaaagcaagggcaugauguaaucaccuugcuggcagaaugggaggcaggagcaagagggaagagguggugacaugccagggacuugggcccugugcauccucugccuucauccuggugcuuggaccauccagcacaucuucuccugccuaauucagggaugaugggugaucuauggucacagcucagaugccaguuucccuacagggucuugagugggggaagaugugacucaucuuacagugggcaaacagaggggaguuuccucauccaagugagcccauugaaaagcccuaaggucacucacugugugugcuguacucuuuuguguuguugucauuuaauguuuguuuuagaaugugauugacuuugaacuuuuugguggugcagauauaaacgaaugugcauuagauccugauauuugcccaaauggaauuugugaaaaucuccgugggaccuacaaauguauaugcaacucgggauaugaaguagacauaacugggaaaaacugugucgguaaggaguucagcucacuuucugugacguuucuggugaagaaucacaugacagauucacuugguaaaagagagccuugcuaaguguaggaaacgcaaguguugggagccuuucccgcauggcuacagagccauuccacugaaacaguucucccaacuacucauuagauuuaaucagagaaaguacagcuuguuuucaguaaugaugacucuacauugguuuuaacaagcacccuuuuccaugugauaacaaccuuuaaugaaggaagaauccagaaacuaaguaaaucauuugguugggaauaaaacagucagccuagggcauuaguuuuuuuucuccagcauucuuuaguugccuagaacaguauuuucugagaacaucuucugucuggagcaacacacagccuuguguuuccugaaguugggcuuuuaaaaccaagauaugugugcucuuggguaaaggaugcacauauguaaaguggugcauuuuuuuuauuugaagaacaaauacaccuuuauggaauaugaugcaaauugauaaguuuuaagauaaacuagaaacaucucagauuauauauuuuuauuuccauucagagcuuugggguuaggcaucccacuuuuacuuuggugggauuuuuagagccagagcuaggaaggagcucccuguccaaggagcugaucuaacuuugaagcaaguaauugauuauucagggauaauucagauugguauaaaagucuguucacuguuccagccuggcacauagccuaucaaguaucaguaacuuguauguacacugaacucuacugcugcucacacagcaucugacucuccauggacucggacccaggagaagaaaaucccuguuuucauaugucccugggccuuuugaagcuuccugguauuuggaacucuuggaaaauaguuguguuccuuauaguauucugauagacuuuccauuuccauaugcucaauagaaacauuacuucuugucugauuauucucauauuuuaagcaauauauaugcauauuauauacauauauaauaugaacauauaagcacauauauaaaaauauauugucuauuaaaguauauucacucugugguuggaguaauuuuacauggccuucuccuccuaguacuggauuacagauguauacuaucauauugaggaugcuuucuauuuguuuaauuucuuaaagcagaaagauuaguccuuuugauucuaaugcuacaaaucauuuacagaaguaaagauaacuaauuuucagagaauccaagaagugaauuaaauagcauccaaaagcuuggggcuuuguagacacuuaguuuggacaagaaaaauaagcuccuguguaggguaagccaauggaacaagagucuugccucuuugguggacuugauauaccauuaggaauuuaaaggccugaccuaaauggcauuggcugcgagggacaagcucuuucuaacauucccguuuguucuuucuagauauuaaugagugugugcugaacagucuacuuugugacaauggacaaugucgaaacacaccuggaaguuuugucugcaccugccccaaaggauuuguguacaaaccugaccuaaaaaccugugaagguauuugugcuuuuuuguucucccaccacacaccccacucucugggaaagccauuagaccaccauagaaguaaguuagaaucuauguuagaugaucaagccaguucuguugagauucucugcuucuaaaugacacuguacaaacucuagccacagauggcacuuacuugcauuuagcauuuugccccuucauccguggugguuucaggguguucauuucuauuugacucuagcuggcauuuucacuugccaucacuuaauagaugaagaaaguguugugcauguauaauuugagucuauaauuuuauccagauuuuucugaauacaaagacucacucaugugccagcuucuauaauaaagaaauaugcucaauaaguauuuugacaucccuucuaguuuggcaaaaccuguuuaggccagcuuuacuaucuaaugaaggccaaagucgagguaugcauuuuaugcuuaagaccaacuuucaguaguaauggggaucugguuuuguuucagacauugaugaaugugaaucgaguccuugcauuaauggagucugcaagaacagcccuggcuccuucauuugugaauguucuccugaaaguacucuggacccaacaaaaaccaucugcauagguaucuauccuucugagaaugauuuuucaguguuuaucaauaauacaguugucuugcauuuaacaguugcuuugacugccacagaaguucagauauaagagauuaaaugauuauuauucccuguuucauaaugccacucuagccauaauucuaguguauacaaugaguuuuuuauaagauucuguuaaaugucugucacccccucuuucugcagaaaccaucaagggcacuugcuggcagacugucaucgacgggcgcugugagaucaacaucaacggagccaccuugaaguccgagugcugcuccucccuuggugcugcgugggggagcccgugcaccaucugucaacuugguaagagaaccggugcauggcucugcagccauuucauuggucaguccacugacuuagguccauguggaaaaauuuaaagaugaccuugauaaaaaaaaaaucccugaauaggaaaccaacaaaauaucaaggacaucuauuuucuguuauucuggucaggguaccauuuucucuuccuauguggucaugugauuagcuuguggugcuuccccugaagcaccaguuccugcaggcugggcuucgcuagcagagaacucucauugguucucugcuuuuaucucugcgguccugugcuuauucguggcagcaaaguccaaccgcugucccaagcccucccuccaauugcuucgauuugucaugacugagaguucuagauagaugccguuaauacuguuuuguuucuccacagaucccauuugugguaaaggguucucaagaauuaaaggcacgcaaugugaagguauuucuuauuacuucuaaaccgugcgucuuuguguguaugaagaguguuuguguuaacguggccucaauaaaggaguaaaggagcuucccugugagggauaugaugccgaggaaaacauuacgcagagccacagaacagaaccgagguuaaaugcgcaagccgccuucaguguuagaucacuaagggccagaggacaguguggcuggauaagcuucagaacaacugugcaucuuuggaguggccacguuugcaaaaggcuaucugcaaaucaggagcaaaaaaugcaagacauuucuuucuuuuugcaaagacuguaaaguuugcauucguggcuagaaccccaccccuuuuauuaugguugcuuguuuauuugucucacauuccugggugacuuagaggggugaacucaauugccucuguuuucaagguccauguggacccucuccaguucacugagguucuuucucauggaguccugaguagauauaggucacggugacuaacauagccugacaugacacagcagcugaaguauuuucaaaaacaacagucccauaugugggauaaaauggaagguuuuuuuuuuuccuguuaaaacaaagaggaauccuacaacccccacccaagggcucgcuuuccaaaugaugacugaaucccuuggcuuuuuucugguucagaccagccguucauaacuuaucugagcuuaacagcacauuuugguuuacaaauggccaaggaaaaacucagaggaacaacccccuccaaaaguagguuagacuccauuucuguuuaguuuucuuucaagaaaacauugagacuuuuucucaacacucuuggcuuagagagagaccucuuuaaaauagacgugugugugugugugugugugugugugugugugugugugugugugugugugucugugugucugugugucugugugucuguguguguguuaacuaaggcucucaaggcucccuccuuuuggcauuuagauugccuuucuuugaauuaauucaauguugucuguuuuuccaaauuaagugcagagaacacauugccccaugaggcaaacugggaaggcucaguaggcuggggcagcacugguggaugacaaauggauggucaugcauguuggcgcucccucacccaaccgaccacaugggcucaguacgccuucacuggcccacaugucccacagcaggauuugaguuucauacacucaagugcaagacuuucccucuuuuauaauuuuugucuaugucuagucaucuugucuccuaaugcuagcuauaacucucagacccuuacuuaccagagcugucccccaagcccuuggccucugucucuacaacucaaauacaauucccaaggaccagugaaaagacuccuggcuuuaguaaacacacccacugcuugccauuaagacacaccagacgauaauaugaacuguuguuaauauguuguuaauaugaacuguuggaggcaagcuaggguuuugaacuuauccgguucagaaaaggcccuuucuuuuguaagaaucauugugaaucuaugagucggauaagccaggauuaacuuagacagauauaccgacuuaaugcuuccuuccuuuucuuucuuagauaucaaugagugugaaguguucccgggaguaugcaagaacggccugugugucaacuccagggguucauucaagugcgagugucccaauggaaugacuuuggaugcuacaggaagaaucugucuugguaaagauaaauaaaauucaguuagauauuuggacacaggcacacacacacacacacacacacgugcacauacaugugcacacaugccccugcagauucagcucaucugcuaggaucuagggugguuuucuugacaaacugucuuccuaacucugcuaaggaaaggcuuucuucugagcuagucguuucauuccucagcucagugccaucccaguugcuacugugcugcugcccauaugcccugggcuguaggauacaggcugaguugcagagggaagaauauuugcauguuauggggagcuguaccccauuucuauuagccuugaucuauaacugacagauagacccuuauaggaaacccccauugaugucaggagcagaaaucuuccuaggaaagggaguuggggguggggaaagcuaggaaauagggauauauaucaucucuaccaguuguaugggaaucuucgugccaacugcuagaacccaggggacaggacacauccagucaucuagucaucccaucccagugacauggaagagacuugaaguccucagaaggaugccccaugacucuuagcuguuguaucugucugacuccuaguauuaugacugucagugucuugaugcuuagccuuugacucuauaaaugaugucacauauaguacaucuuugaugcugaaucagacugaauaauaucccugaugaagacuacuuuauguacuuauaaggcugucaauacagcugaggaaauuugaucauuuacaaaugagaaccaaccuucagacauagaauuuggaaguguuuacaauauggaacagaagggaaguucagagcucugagucuuugguauuuaaggauaucagcaaauccaaacccaaaucuuuauuuauuuaugagggaccuuguuuagaagcaucccucuagagucucgacugaaagacggaguuuaccuuaaauuaccugccucagucugugaaacuuggacauagagcaauucaaaugcuacagagagaucuuuuuuaaaaaaagacacuggguaacuugaacacuuaaguaaauagucacagccacauugugaaggcaaaugggaagaaaaacacacgugaaugauacuuugcaguucuugaguacauaaucuuagcagagcaucgagaugcuuccugagacaugggcauucagcaagcgugaagauuugggaucaggcauaaugauuuugcuaagaaacaguaaguugaagaauagucccagaacccaggccuucuguccccuggucugccagccuccuucacaguagcuuaaaauuggggcagggauuaggcgugcacacacacacauugaaguaaaacaucuuagaagaauggaugacuuucguuugccauuuccucuuuuaucuuaacaagggaagcccucuuuccagauuaguggucugccucuccagaaauguaguaaguccaaggccauguuugagcaauagguacauuccagcaacagagugaguuugcuccuaggaaggagaugccaagauaccguggaaugcacacauuggugaugaacauggcuuuacaaggagaagaugcccacacucagcaaaguggcacuuuucggucauuggcugccuauguagaacuaucaggaaauaccaaaaguuggaagggagccuuccuuaaacaggacauuuaaacauguccgaggaggaagaggauaaagucuucauuagcuggaauaccuaccacauaauccugguuuccaacuggagaaaaauguagucauggaauauagcaaacugggauguguuguauuuuccccaagaaaaguugguagcuuuggacagugaagagcagcucuccucagucuccugcccucucugacagacauccgccuggagaccugcuuccucaaguaugacgaugaagagugcaccuugcccaucgcuggccgccaccgaauggaugccugcugcugcucuguuggggcagccuggggaacggaagagugugaggaguguccauugagaaacagccgggaguaugaggaacucuguccccgaggaccuggguuugccacaaaagacauuacaaaugggaaaccuuucuucaaagguauguacggugcuccauguggcugcugcuacugaugaugauggugguggugguagugguggugguggugguauuugugugugugugugugugugugugugugugucugugucugugucugugucuguuugcaagaucugcuuacuccuaugugugcacaugaaagugagaggcuaaaaugugagucuuccucuaccuuauuuccugagacaguaucucuaucucuuacugagcuugaagcucaucauuuuuggccaguuggccaucaggcccccaaggucuuccuaucuccacccuauguccccagcacagcgguuacagguagguucacagggccaucccuggcuauuuuauguggaugcugagaauucaaagugaggucuuugugaaugugcaucaagugcuuuccccagcugagcuguuucccgggcuccuguucaccaagcauucugaucaggcagaggccaggccacuguuccuaguggaggauuugacagcucaguuuuucgugcugccucucacguaaggcuuuggagaucugaaaccucauucucacauucuucaagacugaaucgagucaggaaaaugggaacucaguacauaaacacugccagauugucuuuauacauaaagcaagggauuuuuccuuugucuucucucuguuccuuccuucucuuauucuuuuugucaguuguuauucagugagacuguaaucacucaaacuauccuguccagaaaggcaguuucuagaagaccacuuaaauuucucuuaaguaaauucaaaacaaugugacccacagguugugugugugugugugugugugugugugugugugugugugugugcagcccuuuuguauucaagaagcucucuaaauuauauuagugacauauaauguugagaaaauaaaaguagcauggauuauuuguaagcuaaaccucaagugacaucuuuaaauuuucaaagucauuuuaagauguaaccaagaaagcaucaaagagcacuaaaugagggccucauucuguugccaugaugguugugagugggugagaggguggguggcagggugagaggguagcugaguggcagggugggaagguggcuggguggcagggugggaaggcggcuggguggcagggugggaggguggcuguguggcugggugaguggcugucugggugaauguuguauuugucauuguccaugugcuuuaaguagcauuuggaguucagacaaucauuggucaauggugaucacauccuugccacaugucaggaagugagcagcgagcucccuuaacaguguucucuuaaaauguagaggucagaauaacuagggauguuugugaaguccuagcccuggauuaucauacauuuuuugagauggauauugacaagaccugaaaugaaggcucuccaaccuucuggguuuaaggugagagauccuaaccauuuacccacaugcuuuucuucccugcauuuucauuuuccugaagauaucaaugagugcaagaugauacccagccucuguacccacggcaagugcaggaacaccauuggcagcuucaaguguaggugugacaguggcuuugcucuggauucugaagagaggaacuguacaggucagugucugcaggggcagaaaggguggagucuucacauuuuuccucuuuuucuguguuguuucaccuuguaagguugugccagcccucaugucacugcuuccugcuguuuuucacacagacauugaugagugccgcauaucuccugaccucuguggccgaggccagugugugaacaccccgggggacuuugaaugcaagugugaugaaggcuaugaaaguggcuucaugaugaugaagaacugcaugggugaguaugggaagccaaggacugugagaagccugcauuccucacaggucaugucccaggcaguuccugcuguccagucuucugaccagggagggcagucuguggccgaaggagacucauauaggaaggcacugaggggcuaacaaucauaggugacuacauaggcaagcugugagacccugagagauuucaacuuucaacaccugacacaguugaauugaaaacacuucagauguaagccauagcaggagccccaucucggggugucugcaucucaguucuagaagacaguggugacuaccuuacccuaccuuagcuuggguucccugugaauauucugagaagagauuccugcacacaagcggugaacuuagguucauuuguuuggauuuugguuuguuugugcuuuguuuugcuguggguuuggaagaaguguuuugagggaggaaucccucagaguggcagagagaauaguauggagucuggcuguacugcagcauacucggacccuacagggagcucuggaggggagaagggcacugggagcuguccuguguugauacaaggucaggguuuuuuauuuccaagucggucaauuaggauucacuguggauugcuucuaauguaggaaaguguuguggccucucaccucccaagcucuugagugagauggacagaagggaacugauaagccaucaguagccaggauucccagcaacugggggcuggaaagggggacugccugguaaagaagaucaagguaccaucuugaagaacagcaucuucaacauggggcauuucuguuuuccagauauugaugaaugucagagagauccucuccugugucgaggaggcauuugccacaacacagagggaagcuaucgcugcgaauguccuccuggucaccaauuguccccaaacaucucugcaugcauugguaaguagcucuuuuagaacacuugcgcagggucaguuguuugauucagacacuuacaucucuauguuguucuuugucucuaaacagacaucaacgagugugagcugagugcgaaucucuguccccaugggcguugugugaaccucauagggaaguaccagugugccugcaacccuggcuaccaccccacucaugacaggcucuucugugucgguaaguuccagccuucuuucuauuucaccaugcauuuuauuucaucucuuuguaaaagcaaugcauucugaguuccggcuucauugcuggaucccuuugcuuaaucuuucuugcaaguaggauucuccuagcggcccacaauauuugcaccucacuuuccucuucagagaagcagaugaaugaaagauucauaaucugauguaugcucuuugagaaugaacauaaaaaaaugcaugccaaagccgagcagccagugauaauuaacccugggaugaacuaaguauagcaagugccguggaaaaugcaggaaggcaugaggugaggucucugccuggcuuaguagagaugauuuaaaaacuucgaagagugaucaccgacaagaagaacauggaauuguugauaucuuacccugaaauugaggccauguuuggcacucccuaaguauggguuuuugugggacgagaauuuugcuuugugguugguccuccguaggucuaguuucccccaugaagagugacacgggaggcccuguggcuuuaucaugcccaaaguccaagugagauuguguaaaugcugccagugugggccuggcuugggguguacaccauguagaacugccaagucuuagacgguuuccacccacaaccauaaaucagcccaaauucuuuugaaaucuagccaaggucaacucaaaacuucaauucagguucuugcaaaggaucagaaccucagcccaucaagccuuaauucauguuucuaauugaaucagugaccaagaagauugcuccaaguguaaacacaaaagaaggugccucugucaguuuuuaugugcuauacuggacuacccggcacuggcuaauuuauaaugauagaaauucauugccucauagcucuagaggcugggaagcaauggcaaagugcuggcauuuggaaugggccuuuuugcugcaccaaaauguguaagaggcaagagagaaaauaagaauggccauauucauccauuuacaguugucacuaaugcuacccaacaaugugcgguccucauagcuuaauaaccucucaaagcaccacuccuuaauacuuguauggugguaauuaagguucaacaacaguuugggagaggacaaauguuaacauuguucucacuucucuuagauauugaugaaugcagcauaaugaacggugguugugagaccuucugcacaaacucugacgggagcuaugaauguagcugucagccaggcuucgcgcuaaugccagaccagcgaucgugcacaggugagcagcuucacacucuucacacuucacagucccccaaguagagugauucagaggccugggcuucagaguauaacaaccucgggcucaaguccuugucuauugcauauuuuagcugugugucuucaagcaagacauuuaacaccagaucuuuguuuauuaaauguaguugagauugugggaaagaggaaggaaguuuaccuauagcacuuguguaauaauuggacuacaagacauuuucuugguuaaacggaauuuggaaaguugcaucaugaacuuaauuuggugcaauucugaguguguuuucugcaucagcccuaugaccugaggauuugugagccugcaaaacuucagccucuauccaaaucuacugaguuaagaagcccugggcaauccuggugauccguguguuuggauagaugcugaaguuugagagccucucuccuaacuuguacugucuuacuaccugacacuggcugagccaggcagccaacaagggguaaaaaguagaaugcgugacucagacuuugauuuugccucugguuaagaagagaauuugacccuaagaaacacacugauuuuauuugaccuuuaauccccacccccacccacacauacaaagcccaccucaguguaaucugacuauccaaacaaauguugaaaguagccauuucuaacuggaaaaugauaaaauaugguucauaaucauuuugaauugugaauucaggccagacacugagaauuuugugauuggcugccuccucugucccuaggauaaccugauagaguaaucuuuacaaagcuucguuuagauuuaggguuaggagaugcucauguuauacaagugggcugaauuuuguuacauugggucaguuuauacuuccucacugaauaauggagccaacaucaauaucuauauaacaugcagcuguugauuuucuucuccucagacauugaugagugugaagacaaccccaauaucugugaugguggccagugcacaaacauaccuggggaguacaggugccugugcuaugauggguucauggcaucugaagacaugaagacuuguguggguaagaaagaaggcaguguugucuaacugcucagucacaguauugagaaacugacaauagagaucaacuaggucauauuuccugcuuccucuccugccugauaacuuucuuauuguaagcuggcuguuuuaaauuucaccuugauuaaacgcuggcuaucucuguguucuggaaguauuguugaacuuugaggaugugguuuggucaucuggaaccaggcugauccuuuuuacaagucguacuuuuaagcagcaguuagcugagaacaguuuuugcuguauuguugaggcaagacccuucuggugggcugcuccauucccugugaaguauaaggcuuucuaguucagcuguggggaaaggguaccacuguuagucuucugugaauguggaggagugcugcacuggacagcgcguccccaggccuggguaguuuguuucugugcaugagcaagcucaccacugcucugaauaucugcagaagccuuccucucaugacuuacccaggccagugaugucaucugguucuaugcagugaucucuuccaaaguccuuucaguuuauuucuggugagaaggacauucccucuuggccagaaauaagagccuaggguggguuaugagcacaucuauuauaugggcagauguuugccuacaaguaugccugggcaccucaugcaugacuagugccaguggaggccaggaggggacaucaagucacuuaggauuggaguuacagacaauugugaguggccaugcguguacugagaauugaacagccaaugcucuuaaccacugauccuucucuuccaauaaauuguaggcaucacacagucagacucacaguuaucuucccacagagaaugaugucuccuagagaaaccaccccauaaaugagcuucuauucagcaagaguuagugaguuuacucaccacccgaguaacaggcagcucacacgaguagucagcacuaagacaugccaguaugaauggagucccuuauauuuuuuuucugagagaaagcaucuaaauauaauauuuuauaauguuuacuuuccaauauuauuuuuuagugaaagugucuuaccuuuucuuaguuuuuaucauaguucuuuuucucagggagaaaauauccauuacaacagaaacuuggacauaugaauuguaucucuaucuuacagaugucaaugagugugaccugaauccaaacaucugccuuagugggaccugugaaaauacuaaaggcucguucaucugccacugugauaugggauauucagggaagaaaggaaaaacgggcuguacagguauucuuucuguuucauacugaucgaaaacaugccaaguaacuaagaaacugcccuaauaauuguaauuuaacaccuuuuuaaacuuacauuuuuaacuguauuguggcuauuucaugugccauauuuccucaauuuagccucuaucccuuugaaacuuuccaugcuuuauuaaaaccaacauaagcaaagccuauucuucuaucugugaaaauaacugugcacuguguuggauaagugaacaugaugaauggcguaaucuuuauagguuaagaaucaugcuuucggaucacauuagugagcaugcugguuccugaagauucauaacccuuugucagagcaaccuucuuuugccaacacuucauuuugcaacuaagauuacuuuucaaguaaacgcccuggauuuuauccguccuuaccaguccucaaguuagagugcuuuggauacacuaacuuuuuagccuaaacaagucuuuauccaugugacuuagcuaauggcauaaagaaauugaacuauucacaguuuucuuauuuguuaucaauagcacuuaaguaacccuuacgcaacauuuucaggcuaucauauuaaauaccaaguggaagaagccacucugugccaugacguuguuucauaaguauuuagauguagucuucaaacaugaaauaaugaaauuaaacacaugcaaugguagacaguaacauuuuacuauaauaacuuauauuaaagauacagauuguggcauaugacauaauuuaaaacaucauggugaccuugaauggcaacuuuacuuuaaaaacauugaaaaaguaauagguuagguuugaauuccaaaaguugcuuggcaaggcccugugacuuaaacauuaaaacugucauaguggcaacuugauaauguauggcucccccucuuaauuguaucaguguauuucaagaaagcaucaaaauauauuuaugaguuauaaagugacuguguuaauuaucaaacuuacuaauacauggcaguaauguuauuggugauucaaaaaugacaggauguccaagccauugaaugaggcauaauacugaaauucuuuuaugcucccuuguugcuucucacagaaauccuggcuaggggucccuucugguaaacaggagcucauccacauagaugcugagguacaaaugacucucagguucaacacuuaucaucagcuuccagugucaguauaaggcuugcuaagggaugguggucuggccucgugaagaggaggguagacuaacucugcugcauuguaaugaauaaaauaaaacaaaacaacaaagcucacugaaguucagagggcugugaugaucaugaagagacagagucucugggagagucuucauuggcuggaggcagagucuguagagcuccacuuuccaaaguccauuuaacuggugaacaugcagcugguuauuuuaggucuuucaccaugacgacagguuaugucuaugcuauuguugugucauuacagguagauaugauagauaugauguacaggagcuuacugcuauuucagauaacaugccuagaggcaacgugaagucuacugagaccucaauauaacuguuugccacacaugcguggaaauccaucuuuaaagggaaauuuuuuauaauugaaucugcagagaugcaaagacuggggggacaggacauacucauugugggcuggcugagucagugccaaugugacagcacagaagucaccuauuaguaagcccaaugaacagaaguauacccagagaaacucuguuuuguuuuguuuuguuuuguuuuguuuuuguuuuguuuuguuuuguuuucagaagggccaauaccuuccuauuuuuuucaacugcaguuuaaaauuacuuuucaguuugacaauauccagccagcacuguaggaagaugccccacauuuugugagcaauaucacaguagaauaguuuaugauauucaugucuggaagagaagacuccucgauuguguucuggguucucccacuggucugugaucauaaacaaaucagagucaucugacuuuaaccagacaacccccuugggcaaagaacucugcaguaaccuaugggaggaggggcugcauuagggugagaagaaaagauccccugggaauaacccuguuaguagcagccaaagguaucacacuggaccggaaaugacuuacacagacaggaacuggcaagccucacacacuugaaaacacauuuuuaaaaaucagccaaaaugucuuuuuauuucauguaacuaggucucuuucagacugguuucaagucaguauuacucauagcuucgagcaccgucaggucaccuuggugauggucccguuaaggaggaguguuuauaaugucccagacaacuaguguaaacugagauacuuaucuugccuaaguggauaagcaagacacacuacaaguaacagcaaaaagaaaugucgcaacugugucauagcacacacacucucacacacacacucauacacucacacgcacacacacucacacaugcucacacacacaucacauacaugcacacacaccacauacacacacaugcucacacauguacgcacacacuuacacaugcauauacauaccacauacacacacacacauacauguacacacccgcaugcacacacaccacauacaugcacacccugcuuauuuggauagauuuuuaaaugaguacccugggaagcaauuauuaagaacacauaugcuguuuccuaaggagggacuuuguuucaugagaacuaaaaucacccucugggcucuauuacagcucugucuaaauauuucagcucccuugucauuacugauuguuuccauuuuaacaaauaaacauguuuucuucucccaaucacaucagcagcguuaagaauccacccacugacucgcauucccagcccacacagaugcuaagcauuucauuuuuuuuuucuuguuaagcuuuguccaaacuguggauacugcugaagggaaugucugauuuaauggagagagaauguguguuugcuuggaaccuaggacgcggauccucugucuuuggcuuaaguggguggggucacagcuuuccugugaccucugcugcucauucuaaguaacuguaaugggaagaagauaaagucauugccgggugccacccaagugggucuucacuuucacaagcuaauuuuuagaaccuaccuggcaucacaugaucacauaaccaguggauaaaaaucagaauuguugaaaaaagcaagauuuccuuucacaugagaacuguuucuggcuggucucagaguccuacuauuccaugccgcagccgggcaguuccuccugcuuuucuuaucaccacuaauuuuccugcucuggcugucagccuguggaaacuccauggguguucucuucgguuaauagucuuggcucaaauuuugaccuaaauuaagaaauccaaguagcacuugcauuuaagcugucaugcccucuuccucagccccuaauucuagagauugcuuaugugccagcacacgggcucaggauccauggggcggaugcuaucuaggggcagaaagacaggcguuuguagguggcaagcucucucucuguaugguggcuguggaggcuacagaaguucaauaugcaucucggaccuguguggcagauuugugcgcguaggcgaaguccugccacggagucugcuugccgcucacccugacccuucaggggggccauguccagaggaccugugugagccuuugugacagaggaccugugggguuaagaagguugcagugucagccugaauuugaauuucuuugcuuugcuuggcuuccacuuauucugaaaaaugaauuuucugucuggagcaaacuuguggagaaaagggaacauuuguacagaaagagacguucuuggcagaccugugcuguuucccucaugcuauugaagagcguuucagugcugugcuuuuguuugcuuguuuuccuuauggcucaguuuccccuccacgugcccaagucugccauggaaacaguuaauuagcaagaguuguaugccugagucugugugugugugugugugugugugugugugugugugugugugugugugcgugcacacgcauacgugcauccauacucacgcugacgcuguuaacuccgaaauguguuugcacuguaucacccgcucucuuucucaccugcgucuuacucacugaaaacagaagcuagcuaauaugcuccauuguauugacaacgugagacuugacuaugacccuugaaucacuguucucaggucucccaaagcucacaacacacacccucuugcaacuagaauuucuuucaccuugaaaacagggcaaaauuuaaaauauuuucuuggauuuuaauuuuauauuaaaucuuaguaauagugacuaaaggagauuccucuaucaaaagaaguacucaucuuaaaugcaagauuaagggaaaagguaaaggcauaugaaaauagugguaucuuugaccacuagacaacuagacaaaggagaaaaaaaggagauaauuagggguugaauaugguccaaggacaugauauacauguaugaaacuauaaccagauccauuuuauacagugaauauaugcuaauaaagagaagacuggagaggauuauauugcagauuaacugugaaauuauacuuaguaaaagagauuuauggauguuuaucugagucgcaucaacauuuaagucuuuaaaagaaaguuuaaaauaaaacugaaauuacuaaacuaaggaucuuaguuacacaucccugucccaagggaagugucugucgccagagaaaccaaguccaggcuaacccuagcuuugccuuuuacuggcuguggggucuaaucucugccuucucugaacauuuaaaaaucccaagacagaauucuaguccuuucuacuuaaagucugucuuaguucuauauccauuacuuuucuuuuuucuuuuuguuuuuuguuuuguuuuguuuuguuuugggguuuuuuguuuuguuuuuugagacaggguuucucuguguagcccuagcuguccuggaacucacuuuguagaccaggcuggccucgaacucagaaauccgccugccucugccucccaagugcugggauuaaaggcgugcgccaccacugccgggcuuccauuacuuuucuuguggggauggaacacccaauagaaacaacugaggaggaagaggauuuauuuugacuugugacuucaagggacauucugucauaauggggagggacgacagcugagcagccauaccugugguggugguuugcaggauggcaggucuucauugaccaggaagcaggugucauccucaagccuggcuugagugcucacaucugcugccuaugccaugguaccaaagccuuuugaccuucccaaacaacaccacagccggggagccagggcugcacacaggagcccguguggggcacuucacacucaggcccuagccauucuggaguaucuggagcagcuccuucauuccaccaacaauuauuugccaaauauuaugacaaauaaaagaaggaaauuaaaacagaacuccacaaaaguuaugauuaguguauuaccuucugcggugugggacuaccaugccuguggacaucucuguuggugcuauggagucuuagacaagccuagagaggcuugcuuuuauaaacaccuaugugacauuaagcucaauuaucccuacacuggccuucuuuauuucuggggaugugauggacucucuuguccaguuacuuaaggcucccagucaugaguucaaagcuacgagucuauguuggucugcccuaugaccucugucaguucauguaacuguugagaccacauuaaaauuuaccuaaacaacuugcugugaucauuaaaaauaauucuuuccuauguguuuucaugucaugauuaucagugacaucacaaaagaaugucacaaaaccugucaucauuguauuuuguucuuguuccuaagaauggagaauuuugaaauugcuuuugaucuuuuacuaacuugaccuaaucuugaguuucuuaauucugaugagaguucucucuagguugacuugaguuuuacaugaaauauucaagacuacaguaugcugcggacucuuaggaggccagagaggagugacugcuguagugccuuaagcaacauauucugcguguguuugagaugauaauaccuaaaauaagaaucuucuaaaaguaaaacauaaugaaacagaaauaauuuaaauuuaagaauaaaaauaccuuauaucauuccaaaguuuucugauaugucaacacauuuauuugcauaugaagaugugauaaaugcauauuaccuauaaaguugucuaaauaaauauauuaccaauaaaacauaaccaugaaggguuuugggugacucacuuugucagguggagagggggucacucuucugagauguggcugggugcucacauuagacuuacagaggaggauaggcacaaccaaccacaaaugcaaugaccaugucauucugccuuuggaaauuaaaaggcaaaacuguucaguagggagcuuagcaucuguguggauacuaaguuuucuguuacgccauagugaggaugaguauuugaauauuucuaggucauuaaaaagucccccccuccccuaaagcuuuugugccaaacauuuuccuaaagcacugguuacuuuucagauaucaaugaaugugagaucggagcacacaacuguggcagacaugcuguaugcacaaauacagccgggagcuucaagugcagcugcagucccggcuggauuggagacggcauuaagugcacagguaaacuggaaaaauagcacaaguuuuauucaugagcuacauggaucagaaacacgaaaguauucauuuuagaaaguaaaauauaauuuuuacguuacucaauguaaauaucaugauguugauaaugauuuaaacuuuguucuuuaagaucuggaugaaugcucuaauggaacccacaugugcagccaacacgcggacugcaagaacaccauggggucauaucgcugucucuguaaggauggcuauacaggggauggcuucaccuguacagguaggcuuacuuuggaaacagccauguaacucuuguuggaaaagcacacuaacccauaucagaccaacaauucuucuugaagacuggggcaugccggucaaguaacagaaaauauuacuuaucugaauuuagauucccguggaaucuaaaaccuuggaggcaagucaccaaggagagagaccucaaaagccaacacacacacacacacacacacacacacacacacacacacauauauauauauuuauauauacauguacauacauacaucuacucauauacauuuguaugcacauaugucaauucauauaauggcaucacuauucuaaagcaggucaugucaccuuuuauauguguucuccuuuguguauccauaccuguuucucacugcugccuugccaucccuaaccaacccaaggauaagcuugcucuaggaagauacauaaggccagcaaugugguguucuguaugaggaaacaauacaggcucucaccacaucauucccaucacuguauuagcagaacaacaguucagaacugcucuguaaggcuuucucucacuuuaugauauacucacaaaauuaucugucuuccuacuucuaacuaaaagucacagaauaagccuaaacuugcaaugggaacuuaaauauguaugauugcauggcuaugcgacugcauugugcacgugcauauccacaaagacaguacuucuugugucaaggacauuggccauaaaguaguaugacuacgucacccaugcuuuuaagucacccaugugacuuggaucaucgaccuaaauuaauuaaaugaaucaacaagcacuaauuucucucuggcauuaugaaauuaauaauaagcuguccuuauucccauggaaaaaauauuugaauuacacucauuaggcaucagugcuucauaugcucagaauuuaauguuugugacuuagugcuccauuuccucuguuaccucuuugagcugagcgugaagccugagauaugggcacacucugugacauguucuuucaggucucaaacauguccccucugugggugaaaagaucugucugaauaaugaguuugacuuaauauucacauugcagcacuagaagcgauuuagcauucagaguucugaaucuguacccaaauacugcugcauauucaauauuggccaaaaagaaaaccaguggguuuaaauuuaucaaacggggauuaugaugcagugcagauggacuuggcaguuagaaaaauuacagcaccuggggcauuggaaaucgcuugacugcaaaagcauagccuguguuucugucugcagaccucgacgagugcuccgagaaccugaaccucuguggcaauggccagugccucaacgccccuggcggguaccgcugugaaugcgacaugggcuucgugcccagugcugacgggaaggccugugaagguaagcauggggaagccgugagacuugguuguucacacaucacuggauuuuuccuacuuuaaaccugaagugugucuugucuucacauuuaagcguugguuaaguuggcagagcuguaugaugguauugucaacuacagaggaucuagaaacaccuagagucaagccuccaggcgugccuugagggagcaucuaaauuagguuaacugaacuagagucauccuaacucugcauagcaccuuauuauaugcucagcuccuggauucgauaaaauaagagaaaccaagcugaacguuagcauucaccauugucugcuucccaacuguggacauaauacauaaagcugccucauguuccugcugcagccuggcagggcuuuccugccgggagcaugcaugaucuaaaagaaacacucuugacuuugcuacuguugggggaauuuugucacaccaggacaaggaacuaguauaagguuacaauaccuuuaggcagaccacuccuguuuaugcagagaaaaucugggccaagugauuugcacuguuacaccauaggacaaaagagacaacaagugaccauguauacuucaucuaaugcaauucgguuacuccuacuucuggagggcgggggaucucaaaggacagauccccuggugcucuguuugaggguugucuauaaauacagaagcacggcuguuaauuucugccaggcuuugguuucuagaagucaaggauuccagauaauagccgcagagaguuugcuccuuguguggaguaacguccuaaguauaucuuagaacauucucuaaauaucucacacauguagacacagagcgggauuugccaugucccuggaggagaauucccuggaaugguuccacuugcuuuggucucucagcuucaaguucugucuuucugggaaguacuggucagacaggaagcguccugggaacccggugacucaggauggauccaguuaggaaacaccagauucuucuccuuacucacacuugucaacucuaaguacacugucuucauugaaaguaauuggggauuucagugagcugagaugauuucaggagagauaaacaaaugaugagggcugacagaaguugaggcaaggccccaauuugugcauuagccaauagcaguuccuuauuaaauggauaugaacucagacuccucuuccgcuaugcccuacauacucauuucuguauuuuccucacuuauggagcccuuggggguccuuuauccuguucauguuagaaaugcagcacugacgcaaaacuucugaggccuugcucaugagccuagugccuuguuugcuucuguacccuaaacccaggggaaacagguacugugucaccuauggugacagucauggggcaaauguugcuucucuuaaaauuuacaggaagguuuuguuuguuuguuuguucuuaguauaaacuaucaccgacagaguggucaugccuaguuaaagcagucuccagucugaaaauaaaacgugucuauucaucacacaagcagaacacuucgcucugcgguguguaggucucuuguggaccucagcaggcaugcaucguagaacuaggacagaagauauuagugaacuuuaaagcugcucccaaaggaucuaaaaauguuaguucuccaccaaaauuggagaauauacagauaagagcaacacaagaguuuagccuaucuuguucuguuuggcuccugauuacaacaguaagguaaaccuauaucaaauaccacaaagaagauugauggccgccuagaaaauguccagccuauggcuuagcaugugaugggccccaggaaacagagccugucacuagcaaggcuucuguguacagacaaauccccugaaagucuaagaagcugccuacguugaugucaggcauacugaauuuucuuaaugcugauauccauugccuaauuuuauuggguggcuuauucaguagaaauuuaauaaaauaaaauaaaauugucucuuuuuguaauccuuccccaagauaucgaugagugcucccuuccaaacaucugugucuuuggaacuugccacaaccucccgggccucuuccguugcgagugugagauuggcuaugaacuggaccgaagugguggaaacugcacagguaagguaucacggauguuaagaugggcucccagguaucccuagggaugcuguugcuugggcaucaccaggaucacacaagcuacagaggaaagcaaaggaagaguaaggcauuaagagucaaggguucauuucucaggccuggaacugaggagaggugaguauacaaaggcaggggacaugucuguguguuugggcuugagcuugucgcuccagagagaaguuucuggggugcucuagcuguauggcuuccuuccauuuccuucucugcuuaaauacauccucagaaccuccuuucaaaggcccugcccuggaaccuccaguuugcuccuuguacccuuccgaugcaguacccacaccuuuccauccaugcucagguucugaccugaguaucagagugcuugauacauaggggcugcccgugcauuuauuuuguguguggcagugguuggggguacaaguagauguuaggugucugugcuaauguauguagaggccaagagucaaguuucuagugucuuccucugcugcuguucacuucauuugcugagacucgguguuuccuugaaccuggagcucacugauuggcuggguuggcuggcaagaguucugagaucuuccuguuucuccuuccuccuacuccuaggauuauaugggugcagaagaucucaaguugugcccucauguuugcaaauauuuugccccacugacccaucuucuuaguuccauuuaauacaggagucuauuuuuuguagcgaaaaggacucccagggaacacaagaaaaaaaauuagaaaaauuauagcucccagcagacugccacauagcucucuuuggcaccaagaaaaggcugacagucauggcaaguuucucucuuagaccacccuccuacucaagauacagagaaaguaggucucauccuggaggauaucggcauuuucagaccauagggaacaccccaggacaagcaucccaauucccuaggcuggcuacuccaaagccauuuaucuaguuugggguauuucuuaagcauuaaaaauagaguagaggguuguacaggguuagaauuugucaaaaaauccauguccuaaaccucuggaauguuguacaucguuuuggaauggaugccaaaagagaaauaacuguugagcccagcaucugggcagggagggacucuuuaugagcuugaagaaacacuaagccucccacaugugugugcagaaaagacagcagagaccaucugcucccaaguguucuguggggcaucuuacucuaauuugacaaaauagcaugccacacauauuaaauuguucuuauaaaccuauaucugaaauuuugguugaccaaggucaaaacaauguuuugccauuaguuaccuggccuggaauaucuuucuuagcuucaaaguuacauuuuauucugaugacaaauucaaaggguaaacguguucagggguggggguuggagcaaaggcuauaugacacaguucccugcuggggaggugccuuucagagguggaagguugcaucacuaggcauaauggaggaauugauuaguucuuguuaggaacccugaacuagcugcuacugccauuggugaugucauuccacgcgggaugcuggguaauucugcccauuuuuuuuuuuuuggcuguagauguuaaugagugucuggaucccaccaccugcaucaguggaaacugugucaacacucccgguaguuacacaugcgauuguccuccggauuuugagcugaauccaacucgugucggcugugucgguaagauccuucaaaguuucgccagacaccuacuguuuguuauuuuaaaaccaucacugaauauuccauuucuuaugcuuucaaaaguaauagcauaaaaauguaaauauuucucagacacauuguaugcuuugagcuuucuuuucugaaggaaaaugaucaauauauauucuuagacacuuucagcuucuuaaguacauuuaaauuaagauuuaaaaaaaauacuuugagaaacaaguuugacucuuagccccucuuaucccucuaacaggaagaauuugccugacacuuuuuuauuuguguaugauagauacucgcucuggaaacugcuaucuggauauccgaccccggggagacaauggagauacagccugcagcaaugaaauuggaguuggugucucuaaggcuuccugcuguuguucacuggguaaagcuuggggaaccccaugugagcuguguccuucugugaacacauguaaguagacauccuccaucuuacuacuacuacaacuacuacuacauauaucuacugcucuguuucaguccaguucucucuagauccauaaaggugaagccacuacugucuucauguguaggauaggaaaggcagauuaauccugucaguccaguaugugugaguccaaaagguucucugacuugcccugaaaguuuauguacaucaggaagugucuucuguccuaguaagaaguuagaauacuucacuauuuccagggcaagguuuucaaguguaugugaaugggauuuccagaauucaacuugaaggauguaaagaacacaccuccuuuaaaaaagggcuuuugucuuguacacuuugauuuaagccaggaguggccagucuggccgaagucagugccugcugcuuauaggguauauugggaugaacguugguucguuucuuggaggauggucauuuauuuacuucucgaaauauuugucaaauaaguugagaguagaaagccagcguucugcccucuaagaaugcacagccauuagguagaauggagcacagacaaaagaacucuaacucagcacaggccucaccacagaggaagaagaggaggcuuggagucacauuugacagaaaauggaucaaggauccaucgacacuagguucaaguugggacucuuugaguggugguugugugaucuuggccagacgagugucuuagaauauuucacccagcacagccuggcuggcacaagcuucucuuuccucuucagagagagagaggguuuaguuacagguaaaggugggggcugaccacuuugcgaacuuuugagcuaugcauugaagaagaacaugauguaaguaagaagacacccgagggaggagcaaaauagaaguaaggaagaagacacccagugccauugauaucaagagggcaaacccagauuaggauuuggaaauauggaauucagcuuuauagaauaauaaugauuagcaagaagucaucauuucaaacuagaaugggaauuugaacauaucugaauccacgugcuuuuauaaagccagggcaagggccaggcacagcaaggcuuugauaaucaugaaagaacaagucucaugcucuucaggaugauauuaugggugggucacuucauuugcauucugaggcauaacacuggaagaaauuauuauguaaauccuuauugcuugauggagaaguuauaagaugcuggaaaaaaauuagacuuggagggaaaucaagauauuagcaucacaugugugacacagaggaguaaaaaauaucuaaacauuaagaauagcagaagguugaaaacaagagcaaagaaucuccugcacucuuuggaaagagcuuuagagacacgcugauggucauuauuagggcagauggggacacccaggaaagaauacuaaauacaacuaaaauggagugaaguuggcaggaaacaaaaauggagaagaauuauuucuuaauaggcagugauagauaauagagaauaaaauauuuuacaagaauacacgaccagaauagcuguggguuucugagaucagugcaguggccuuauguuuggggaauggcccaugcaugcuaagauagauagauguuugauugcuuuaaauggguaaauaagagcugaagauucuggaaaguuaacacuuucagucauaugugucagcauuucuucugaagauauuauuuuagaaguucuagauucaaaggaacucacguggaacuucuuguuucaauagcugaguauaaaauucuuugcccuggaggagaagguuuucguccaaaucccaucaccguuauauuggaagguaagggcuucuccuuugucuuaacacgaacaccuuuuggaugcccucaguuucauucaaguccugaaggcaugcguuguuuucauucuuacagacaucgaugagugccaggagcuuccagggcugugccaaggggggaagugcaucaauaccuuuggcagcuuccagugucgcuguccaacugguuacuaccugaaugaagacacucgagugugugaugguaagagauugcacgcaagauauguuaccucaaauacugaggucugagcagcuccccugcccccccaguuaccaacugagcucaacaacauggcuucauaggccaaacaagcuaaaccauguucuucaaaaaaauccguguucacuggacuagcaugcauccucucucuguguccaggguaguucuagguguuuccucuuguccuuagccgcuugucaccuguacaaguguguucagaugagcaucucuuagagccucccuuugucuuuaugauauagccaauggccucauuugccuuucuuaaagauggagaauuuuggaccauuuuucaauuugaggacaauuagcccaaggacugugguaggggauagggagugaggagacuccaucuacauccaggauucgaaggaccaguuagggaagagaccucuuccauaagaauuauuugaacauuaugguguauaagacuuagcgcucagacucaugguuaacaaauauuccugugaucugucuuguugccgguugcugcuggcugcagucuagauuauaucuaugaacauaugaacuaugucauuaucuuucugagguauauuugacagcuaugauuuuaccccauuuccaucucucaguguuuuggggaacacugaggacuuuuuuuaagcguucauaucagaaggcaugagcugcuuugaaaaccuucuugaaauuuaaccuagagaagagauguccacaggcugaggaccugcuguucauaucuggguuuuagguccucuggguagaagcuuugcuucuugcugucaacauuagcacuaacacagaauguccuccuguuccagaacacuguuuccauggucguguaacacuuucuccuuuggauuauagaugugaacgaaugugagacuccuggaaucugugguccggggaccuguuacaacaccguuggcaacuauaccugcauuuguccuccagacuacaugcaagugaacgggggaaauaauugcaugggugaguccgagugucccucaagcaugugggcguggcucucgccugcaaaggccagucaaacaacugguguuugcuguucugcagagugauugccuccuuugaacuguuguagugagauacagcccgccuccaacaugcucauguaaccuguagauuuggcauuuuuaucgcugcguguguggcacggggcaguugaggguguucuuuaaaaugugagguuggaagaugccaguuuaauaguacuucuuucguuugacuuauaggugugucuuuuuacaauuauauuacagcacugaccuacagcauuaaaauauccugaaucagaaauaagagacucccugccaaauagcaguggaggauuguuacgaggagagcggguggagggccguguaaaguuugcuaaugcugcacuucguaaugaccucauccuguggcacagaacggcgggaguccuuuucuccaagugccucgcuuguauggcacuuauagcggcauggguagcugagaaguugggugcacgacaguuuucuacucuuaucauagcuggauuacccuugccuuuugagucuccuauugugcucugcugggcuguggagaucccaugggaucaccagguccuuugcucuccucucuucuagacaugagaagaagucuaugcuacagaaacuauuacgcugacaaccagaccugcgauggagaacuccuguucaacaugaccaagaagaugugcuguugcuccuacaacaucggcagagccuggaacaaacccugugaacagugccccaucccaagcacaggugacaguucgcuuccugccuaccaugguagaucuaucagcuagaaaaaauugcuagagaaaaaugaguccuaauaaaaagagaaaagguguguucuuuaguuucagagagaaaacuugaccuaccaaggugagcauuuaccuuucaguugccuuugguccuuccugcuggaaaaccaagugacaagaguaguauauuuccuaauuuauauccaaaguuguaaccagaccaguaaauucaacaugucacaaaagaauaaacauugcuagcauuacuucagaguucccaccacauaauuaaaacacuggaaacaucagagaagugaauaugauaaauagaugaacuuuuuuaaaaaaaauuuaaaucuagucuugggccagggagaaggcucuguguucaaaaucguuugccacgcagcugcaaagaucugagugggcaaguuggauccacaugaaagucagacacagccaccaggguggaggacagggaaaccuggcucucccucguugucagcuggaaggccauuuuccuucagugucuguguuacaggcaauguuacaucugcaguguuuucuaauggauacauuuuaauaaauguuuuagucaguuuuuuccucugugggugcauucucgcucauuccugacccuuaugccgucuuuguuuaacucuugcagaugaguuugcuacccucugugggagccagaggcccggcuucgugauugacauuuauacggguuuacccgugggugaguuggagccuguguccucgugagcaugguuagggggaguccucugcuucugcaucuguguuaaaaguggggugcacacacaccaugguuuuccuugguuugcuuuuuccuuuucugagaaggaaagaaugcuaaugaggccucaagcuguuuucaaguagugagucuucauuugaaacagugugaagcccuuuguagcaccacccaacggacagauagaugucuuuacugcucaugacuaaggggucugggaagcuuuucaagaaguaaccaucaagcuuagagaauccggcccuagguguccacaaagggaggccagggccagcugacauugcauuugauguuaauuaccugauuuuuaaguguaacaugacuuuucaguucuuuuaugaagauugguuaaccaaagcccccuugcuuauuaacucuaucucucuuggccucucuuugggucccuugcuuagagaauuucauggcuauaaaagccuuuucaguaugaggucucauguggagcuuaagccgacccuguggugggguaguagcuuguacuagauucagaagugccauggauugaggagcguugcacaaaaguuagccagcauagacagugcccuugugguuuagaagcaaauaccaccaaaguccguggaagcugaugcggucucaaaguauccuccuuguggugugauuuauagccauccuuagaugcccccuaagccucugagacugugucugguagcagacaccacggcuugcuuugucuugcuuuauuccuaguaaguaaaacugaaauccacaucagccuuuccagugaccuuguuuaagaaaacaagggccugguccagcaaucagcaggcuuucuuagugccaaauccauacggcuccacaggccagucaacauccaaagaaacuucauggucuggaaagaaaaacugcuaaaugacauuggcauggaacaccuggccuuugcugcucuguuuuucuccuucccaaacaucuuuuaaucugucuagaaucugugauugggaguuaaguggccucuaaugguaaugggucuccaugggcaguccaggcauguaacccagcgagaccuggcccccacaguuggcaaucagcaaagacuugaaauggcauuagcgccauccaccagcagaccugggaagaccuccagccuccccguccaacuuccuugcuuuccaguggaggagacagaggcccagaaaagggaagggacucacccaaggccaccuagcuaaucaguaccagagcuggaaccagaacccaguccugacucacaguuuucuuggcuucuaguucugggcaacuagaaacaugguauucaccaauguacuuaguguuaccaaauucugucaugacaaaauaaaggcuuauucuauuugagcuuauagccuuccucugaaaagucuuagaacuguuggcaucuagagcccauuccugugugacuaaaaccauauagcauguuuauuaaucucacccuaaaauaugaacgucuccaaguggaaaucaaaucaagacaggaaaagaaaaagaaaacauuuaauaauaucccuuugucauguuguccuagaagugacuggggauuugacucagucuguuuuugcuaagcuggguaauaacacaucauuucuauuuagaacuaacaaauguguguggcccuguuucaugcuuuacucuauacuaaaagagugauucuaaauugauuuucguuugcagauaaaauguaauugugauuuaccucacauggcuauuuaacauuagugccaaaagucaaaauuaccuguauucaaaauagugauguuaugaaaguauacccuuagagauuuuuuaauuguuuuuuuuuuuuuagguuaacauguaaagccaugggcuuuaucauaacauuucccauacacaaguacaauggugccucuugcccuuuccccuccccuacaccccacccccgcugccccuuggcuaguucccuuccuccuccagucagccucacuccugcuuucuuaccucccuccucccuugagcuccuucucuccugugauccccuuuccaguuucaccgccuguaucucccuugcagaaacuaagcuguguuuuccauuaaggugaucaguuugcuuucaaacaaaaucaaacucuuggaaaugggccuuggacagacagguuguuguuucagggugugcucuucugcaguuucugcugaucuuauaaacccuaccuuagcccagagcuacaucauaggcaagaaaauauccugcagagccuccugauuguaaggaaacaagugcuucuguagaaaggcagaagccucagggcuagacacucgugaguguagcccauacuguacaugucugcccaauggacauggucuggcaagcaaguagaggggccauccaagagaagcaggcaagcccaacccucuggcccuaggaaacagucuauuacaacagccuuccucugagcagaccauauuuucagucagcucguauucaucugguguauauguuguucuguagauucaaaaguggucccuaccuuacuaauuggauguuucgcaauaaaacucaacccaaaagauauggacuccacauagacacaugagugcccaucuuucuaauccugucucagccugcaugggaucauggaccacacugccgcucacaaggggcuucucugucuuuagauauugaugaaugccgggagaucccuggggucugugaaaauggagugugcaucaacaugguuggcagcuuccggugugagugucccgugggauucuucuauaacgacaaguuacugguuugugaagguaagugugacuguaccccagcuacaaaugaagcaacucgcaagcugcuuaacacccuugacacauucucccacaauucuacaacacuggaaccccagcucaagagucagaacagaaaaauacacugugggaaagccuacuggaguugacaaaaaaauaucauuuuaaaaauuaacugauuaagagaagcacgugguagagacccacaugaguuuucucuuuuuuccuuuucauggauucccagugggaaagccacacuguucauucuagaacgucuuccccaacacaagauauauaucagauucccagcugauagggaagaccuuugagguucuggguguaucaaauagagugcuuuugcuucauccucuccuaaacaaacacaagaggacagucauuuuuaacuaaaugucaaagucgguguucucuuccagagacucugcuucuccccaauggaaacaaugguaaaaccaauauuccaaaugcacgagagaauucuaaauggcaagaaccaaccgauuugauaugggaaacauuggcuugcauacacauggacuuccaauggccucccguugccgugugugcagccugugaggcccaguguuugcugugacacuccacacuuuucccguauggggaagauagcauccuuuuacauuuuaguggaagaggcauugcugcaaacuaaauacggcauguucucuagaacaacuggagucaguuucugcuuacugcuugaguggugggccucuagccaaauuuuacacauuauagaaagggcugucaccccccuuggagcauggguuauggcacacaugucaauauuuugacauuaacaaaccuucuuuuucuaaauuagggacuguuuaugauccacauguagaguuauguuccauuaguaaccacguacuugcugggcucucuugccagcuuucaaccacuguggccaacugggcacgcaccacuugccuugcuuguuguguggguugugggcaggggugauagccaguccaagacucuuuaaagagauagccaguucagaccacagcccagcugugggguuuccaggaaccaucaagaaucgguuccugcagaaaaggcacugcuucaggaagaacaggggacagcagaacuuagcaugcuagagguggcugucuuccuugugacuauacucuuccccuucugguacaugucucagaaugccugcuacuuuuuuuccuuguauuuucccuucuauuugucagccccuuggauaccuacccaaauaccccuuugcuacuuauaguugccaaaaaugcugcccuuggccaggacacauaggcaaggccacccaugaguacaaagucaucccagaccuugcagcauacaugggacugaaagccuguugggccaggcaaggugcccugcugucggggaagacccagcaggcuccgcccacucuaucugcucauaaaggugucgagaaacagucauacucagagaacauuaagaagacuaagugcuccgauuuuugguuuccauuucacaaauuacuccucuucaaggugaguguuuaaauacacucagcugcuucccaacacauucuuagcugucaaaauaaaucagaaaaugaagguagacuucaugcguggcucagcuauucugaaauuggaguggauuccaggaauguuucgggggacuuccauauuuaugcuuuccacaaggaagugcaugagcagauguuaguugcucgugucacagaagugccugccugucacaccacuuggcuucuaauguggcaugguuggcucuguuucuuuacaguuuacaagcagggcagaacuggugggugaguugaggcugugucuuucacgacacuggcaugcugcucaugaaucuacugcacagaaagguguaguccaccccgucucagacagacacucccgguccuggaagcuccaccaagcugcguucagguuuucucaucacacaagcacaggccugauguaauucuguuguggcuuuuccuggggaacucugaacaaacaucucuucacuccggauagggcacugacagcggaccaaggaugcaguucuucuguaguccuguuuaguggaccaggaagucuacugaguuauguauaggaguaugggugagugguuccauacaggagcauggauggccaugggcagcuaugucaccaaaagccuaccauaccccaacauggcagacaguucaugaaagcugcuuccugaacaacuugccggcagcuuggcuggccguuagccagagucuccucuucccaggcacuguuugugccuuucuaccuugagacuuucugagucuuccaagcucuucccuuccugagccguaugugccucaucuccuagggaauaggauccaccacugguauugcacuucccagugaugggacaaauuuauagugacaaauauaucuacuaugacuuuauagugauguauaucuacuaugauuguaucauaguuucucugccuuaaagcuucucuggguuuaucuaccugcccuuccccaccaucuccagacccgaucugagcccuggagaucaugaaucucuuuacuggucccauaguuuugccuguuccagaaauucagauauugaaaucagaauauuauagagccuuuucagauggcuucuuucgcauaugaauccacauguggguuucucccaugucuuccuguagcuagccagcucacuagaauauugaucuauauucuuccaucuuaauauaccacagugcauucaugaugcgcucaccuacugaggauuagcuuggcuucuuucgagaucuugccacugugaguaaaucugguauaaauacccauugcugucuuuucaaaugauugagccaucauaagaacauuauguaucgccaacucaacaccagacucuauucuuccuugaaauaaacucucuucugcuugcagauaucgacgagugucagaauggcccugugugccagcgaaaugcggaaugcaucaacacugcaggcagcuaccgcugugacuguaagcccggcuaccgccuuaccuccacaggucaaugcaacgguauguagcacccacucagaggccauugcugucacgauccugacucugcacguuuuuauagauucuaaggcuaaggaauagaagugaggauguagguugaaaaacuagauguauuuaaagaggaaaaaggaggaaaauuguuaaaauagcuaaaugcuuagcuuuuugccuuccuuauaaaugaaauauccacaaagcaaaaaagaagucauuuacacaaaugagucucucuaucccuacccuaccaagaaauucccauuacccacauguacaagcccacaguccucuaaucgguauucaugaggaggaggaggaggaggaggaggaggaggaggaggaggaggaggaagaagaaggggaggaggaggaggagaaggaggaagaggaggaggaaaaagaaggggaggaagaggaucauuauuauuagcuucugcauaauguagacagggaaggcuuucaucauaucuucuauugugcuagaugccuuuacuugaguuggagcagaucuuccugcauaaaugaauuuaaaagauacacacacacacacacacaccacccuugucuucccaaacaucuuacugaugagaaugacccccgggaagacaguaaauaagcaaaucuugaccgucucauuaccucugcacuaccuacagcaagcagagguuagggaugucugcugcccacuuugucaggaugugguauaaagaagagaguacauuguccacucacauuggccauacauuuggucaacaucuaaggguuucucuagcuaguggcaugaaaauaaagucccuuguguuagagcucagaggcaaacuaauacuucggaugggcccucaccuacacuucaguacaguuacauuguacauuuaagagugugucacccugcucaggguucacuuucaagugaguuuccuggguuuuugugcacuugugaaugaaacaacacgagaggaaccgugcucggguuugccuuggcucuguuggccaacugugauuaagugguaggaagugugcugcccucugcaggauauuuuccauuguuuaaugaaaccuugguaggaagaggguauaagaacagaacaaaaaaaaaaucacuuugccaaccaagauuuguuuuguugaguuuaagggagcaugugugaguauuuagcauuccaucaacagagcugagauuaucccaaagguaaggauauagaacaggaaaaaugagucccuggcagauaugaagcacaaucucccccggugacauuggccuugaacgccacuucccugcauuuuauuuucaaguuuuauuucuuuggagcugggugaaagguggccaguuaaaauaaagucuggcuggucgcccugggugugccauuguagaccauuugcucuggccacuaaguugggccauuuauagaucagcaaaaggcaaucagcuacaaccugcuacagcucagguccuucugcguuuucuuauagaauguuaaccuaagcugcaucugguacggucagggaaaaccugguauuuuauccuagaaaucacuuuguucccaucucacuuuuguugcugauuuuugagacaggaucuuuuuccucuuuagcucaggcuggcucaaguucacacuccccugucucagcucccgagugcugagauaacaguugguggcuaccaugccaggcugccauccuaccuuagaacuauuuuaaaccauuuuaagcacuugucuuauccugguaguuuucaaacagauugcaaagcauuccucucugccuguauuuaaaacgaaaauaucguccuaugagauuugaauuuaaauucauacaaaacuccaaaucacagugguccuagcuccacauugcuguugaugguggugcucaaguugccagucugaccucaguagcaaauccuaucccuguagaaaugccuuucccagcuacauccccagccgcugucugaugaucgccccucucucuguuugggauccugucccuauucaaaaccucccaggaaaccucagacaugcucuccugggaacuaaaaaccugucucuuagacaguuagauggugacugaccuuucucaagggaagcucccuuuuaugaucauaaaaaauaaaaaucccuuuucuuugcccacccauucuucauuuuaaauauuuucucaaacgagaauagugguauuuguuaacuguuuucuauauagacuagccacaguuuaggggcaguguaaccccaaccccuccuacacuugagacuuauaaacaaugucucaauugauggcuucugacuggagauagccaucaucucugccacaguuaggccauguugcucugagguaacaguucuguagacccagaaaauaagcagccugacuuuccaacuaaacuagguggaaugaaagcugaaguaaugaggcaaaggaguaaggccaacucugagcaucuaugcauuuacgguagugucccacugugagcaucuaugcauuuacgguagugucccacugugagcaucuaugcauuuacgguagugucccacugugagcaucuaugcauuuaugguagugucccauuucaguauacucaugauagguuugacuuuacuaucaauuuuuccaaagaagccccaaagucuuugcccauaaucuuugguaccaaaaccuagagauaucaauuccaugugaagcuguuuaggcgcuguagaaaguacuucuccauauucugaguuuuacuuuccucuuucaagauaccuuuggcagaaggagcugucuccuuuugguucgccugguacuaaugcuccgagaguaagaucuggccaauuucaaaggaaaaacuagagagaaugccagugucuacuucacuaccucaguuucggguuaggauuaucucugagagcaaggccuggagauaauuuguucagucguuuuaugcucuaagucuccaucuaagaaaacaugcaaaugugcagugucccaccuaagacacuucugguuuacagaucgaaacgagugccaagaaaucccgaacauaugcagucauggccagugcaucgacaccgugggaagcuucuacugccuuugucacacuggcuucaaaacaaauguggaucagaccaugugcuuaggugaguauguggucaucaguccaugggugagugugugugcaucaguccaugggugagugugugugcaucaguccaugggugggugggugugcauugguccaugagugaaagugugcacauccaguccgggguucagagugugcacauugauccacuuuuugguacuauuggagugcuucacaaacaucuaacaguccuuucuuucugacuuaagguugcaugcauuaggccuuugagggucuuuaagcccaugaaucaaacauaucagaagaacaguguccagagccugcuuaaagcccuugccuuuggcuauaacuagguccucccaugaacgaugcuuaaucuccuccuuaaucauccuggcucaucccaggguggcucgcccuuccuugcaucgccacaagaaucugccucauuguuucucaaucucccucucuuggcucuggaugagcacgacagacucgcuugccuuccuaacucucaaguggccugaagagugacagugacucauuauuuggaugugaugcuuacuccgcauucaaggcacuggagagcuagcaauaacuuuuccaucugaaucacaaaucaugucccaaaguugaaagaggcaaucuugacuuuggccacuacauuuugagcuccccaggugucucuuuccauucguucucuccccuuguccuuggcccaucugcccucccucuucaagccaaugguaccaauguucucuuuucuacucccccauaauauagcauguaagaaaggugcuaacugcuuugguaaaaugcaaaacuauguaaguugccagaauaagcaucauaaugcaaaagccaaaagucaugggccaguaaauaaaaaggcaagcaaugccagggcgucugagccaagccaaauugaguaccaucuuuuuuguuuugguuugguuugguguuugguuuuucgagacagaguuucucuguguagcccuggcuguccuggaacucacuuuguagaccagacuggccucgaacccagaaauccgccugccccugccucccaagugcugggauuaaaggcgugucccacgacugccuggcuugaguaccaucuuaucccuuggguguguucagaaggguagcugaguuaucacuggugggaggaaggagccgugucccaaguggcagcuuagcuggggaggggagcucuguuguuguuugcagagauccugcugacucgcgaccuugggguaaaauggaacaugaauccuguaagccaaagugugccaacauccgccaagggaagguccagaugcacacugaaguuuuuccauuuucaagugaaaauauuugagcaaaguggcaaggguggagaauuugagaagcaaauagaauaaaagucuuguccaguccuuguguccucgucucgccuccucucacacgccaacugaggaaacuugggacuuccaagauguagguccucaccucagcuuccccaggcuggugacaucaggcagaacauuccagccuccuggaagagucugugcagccacaacugcccuucagcaucagugaccacguaaccacuuuccuguuuagucauugugucucccucucuggccuuucuuccuccuagacauaaaugagugugagagagacgccugugggaacgggacuugcagaaacacgauuggcuccuucaacugucgcuguaaccauggcuucauacugucucacaacaaugacugcauaggugaguaugcaggaggucgccacgucacgcaucugcaucauggccagcauccaaucuucugccuauggccagcauccaaucuucugccuaacaguuggucacgugacuaucaaguauaccauguugauuaaaagucaauuuuaguaacucuguuaacuuuauugaucuguguaucagcagcuaugauuucuauaucuauuuuaaguuaaauaaauuucaagauagguuaaaauauacaaaagcaagucuuuguaaauuguacaauccagaaggaguguaggagccuugcuuagaucuuucgcuacacccucucuucaaacaaacaaguuauuaaguguauagcaucccccuuauaagacacgauaggcauuuucucucaggugcagaaucuagauuagcuuuuuguauguacuauauaagacauacauacgugugacauguauguacuauauaaguacacauacaugugacauguauguacuauauaagacauacauacgugugaagcagaaggaagaauguuugggaugaagaagggaccacugggaggguaggauacuaggaaugugaaugugagcaagaugcaaggguguaugcaugaaaacccgugacuuuaaacgaagaaauaauauagagaaggaauccuaagaaguaauaacgaaucaaauaccacauagaauuagaagcuaauuuuaaauacuucuaguugcaauacuauaguaugacuucaucugaauuauguauccaguaaaucaguuuuaucuuuuaaaauucaaaucuaguugggcagugguggcucaugccuuuaaucccagcacuugggaggcagaggcaggcggauuucugaguucgaggccagccuagucuacagaguggguugcaggacagccagggcuauacagagaaacccuaucucaaaaaaacaaaaacaaaacaaaacaaaucuaaaauuaagagaccaaaaagaugggggugaagaagcauggagaugguagaggaauguauuagcaauaaaagcaaacagaggucugggggugaacagaggcuacagggagccaggggguagagcaaaaaaaaucuacauaaaaucaauuuuguuugaaaauuccaugaugaaacuuaauccuguguauacuaauuaaauuuuuugaguaauaaaugcaaaaaggaaaaaaauuuacaaagucuaagcaaaacugcuacaaauuuaucaugcaaauuaccagcguuaauaugauaauauaaucuuuucauuauauuuggaugggugccuccagcugggucuguggcugaaaccagaccuucauugcaguuucuuguauuuggccaaggccacaaaggccaccgaagaucagaaggauggcagggaguuugacauuuucuuuggaccguaauggagauguuguuuuucagauguugaugagugugcaacuggaaacgggaaccuuugcagaaauggccagugugucaauaccgugggcuccuuucagugcaggugcaaugaaggcuaugagguggcuccggacggcaggaccugugugggugagugaggagcucagaaagacccuaacaucuugagagggacgggccaauccuaaggggucugcuguaacucgugcacguuagcuuagggguguguguguguguguuuguguguguguguguguguguguguguguguguguguguagcguaaaaauaaauauagaagucaugaauucaagagggguguuggggagacauggggaggaguuggagggaggacggugaaauguaugcaaacgcaguguacuuaugaaaguccucaaauuaaagaaaaaggaaggaaaacgggcccugagaaaauguccccagaggccuagcacagaaucacacagaaugcauucuaaccucacuguuauuuuuuuuuaauguauacagauagucauuuuccuucuuaguuuaaaaauuagguuauacucauagaaaacauuuuaacuguuaaauguuaaacuuaauagcucugauuuauuauauuuugcucaaaacaccccuccaaaggugacuuuguuuaaucuuuuaagugucuuuagaaccccuguccugcagaacacuuuucuuggaauacucuauuuauggcagguagacuaagaugugguugcauugcguccuuugggaagcuuuuacaguaaugccuuugcuuuccucuuuggaagacuugugacuuuuagcaagcccugugggcuucuacgguuugauuccagugccuuugauugaguuugcacugcucgauggcgaccaugccaacagggaccucucucucauuuccuugucccugcagauaucaacgaguguguucuggauccugggaaaugugcaccuggaaccugucagaaccuggauggcuccuacagaugcauuugcccgccuggguauagucuacagaaugacaagugugaaggugagggcugccgguggggcugagcauugacuagaagcucugaaaucagacauuuuuuguuuguuuguuuguuuguuuacaauuaacucacagaauauggcuuaugaccucacacucugucgaggcaggaaaagccagucccuguccuggucacugggagcuuugguuuucucugugcacaggcugcucugguggcccuagcucuuuccauggcgcucugauucagcacaauuuccagucccacugauggucuuccuggacuacaugguuuuaaauggccauuguugacagcuaaaaacagcucccauguccacuuaaggucuuuaagugcccguguucaagguugggugaaagggguuauauagcuugucuaugguguccucagcaauagagagguagaaauauguugugagguauagagcauuccauuccuuugaucucagcacagauuccuuuucuauuucuaugugaagaauagccguuguaagggcuucauaaauaauuagucgguggauuccuaagaagucacauaguucacacugcuaucuuuaaacaggucuuucagucaucacacuggacuugaguuuucucuacuuuuuaauacaugauuaccacagaagcucccccaaauaaauagaaucaaaauacaaagaaauaaaaauaacuccacagaugaucaauaaaaugugcccauucuguaauaucuguaccuguuauuuagaacaugacgccuacaggcuaaauuuuaauauaagaaagagaagugggggcugagagguggcucgguuggccugaguguaagaaccugaguugagaucucuagcgcccacaucagcaccaggugaguuugguggcccuccuauaacgccagcauuugggagguagagacaggggauccuuggaacaagcuagcaagcuagacuagccaaaccagcaugcuuuaaguucaacugagaggacaugucucaauaaauaagauggaaaauaaucuaggaagccauccaauguuaaccucuggccuugauauacacacacaugcucacacuuacaaacacacacauacaccugcaaauauauguauauaauaacaaaagauugauaauaaccauaaaagcagucuccaaaaggaaauauuugagcauuaaaggaaaggugagauguagugguagaaggagucuaagaaugaaauaauucaaugaagagaaguucaaacucacugauaaacgcccccaaaaaaggcaacuaaaaaauacacuacccaagauauaagauacaauuuccuaaacacaugaaacucaagaaaaaugaagacugaaguguggacacuauaccccuccuuagaagugggaacaaaacacccuuggaaggaguuacagagacaaaguuuggagcugagaugaaaggauggaccauguagagacugccuuauccagggauccaccccauaaucagcauccaaacgcugacaccauugcauacacuagcaagauuuuaucgaaaggacccagauguagcugucucuugugagacuaugccggggccuagcaaacacagaaguggaugcucacagucagcuauuggauggaucacagggcccccaauggaggagcuagagaaaguacccaaggagcuaaagggaucugcaacccuauagguggaacaacauuaugaacuaaccaguaccccggagcucuugacucuagcugcauauguaucaaaagauggccuagucggccaucacuggaaagagaggcccauuggacacacaaacuuuauaugccccagaacaggggaacgccagggccaaaaagggggaguggguggguaggggaguggggguggguggguaugggggacuuuugguauagcauuggaaauguaaaugagcuaaauaccuaauaaaaaauggaaagaaaaaaaaaauacacuacaaauacacuacaaguucacagaugaggaggcugagcuugcauuguaugagaaaauaaccacuuugauugcuuauuucuagauuaucuguugcaugauaguuacaacgguaaggcaagauacuggcguugguuucuugucuuccccuuaagugggaacaaagucauguaaaugaacuuuguaggcagagcuacacaaaugugaagcaaaagaguuacaugacccaagaggcaguuaguacauaacuuugaaaauuuuaacuaagacaauacagcccagauuuaagacuauaaagaccuuucuucacuauaaauuuuagcugaaagucacaggaaaugagugaguuuguuacaguugaguggcuguuuuucacaaaaguagaacgaucauguuuuauucccuaaacagauaauuuggaacgagaaagggaauacuuaauuauacagucaggccaacauacacaagcugggaaucucuagggaaaacccuuauggcacaauacuuugguuaaccaaacuacucugaauucucaguaggucaguccuuacaggcaauaugauauauugauguucugaagacagcaggucuuaaaucacauguauccaguuccuauuagcucugugauggaagugaagcccuggucuauacaagaaagggauuuucaucucuucagaagcacugacuugaagaguagaaucaucuucugggaugggauugugcuuaguaaggccuuuacagccgccgcaguaggguauugggaaugcuacugcauggggugcugggaaggcuccaucagccagugcagggagaucaccuuucauugaggucagcacuggacucggguugugcaauggugaggugcggggcuggaguucuggccucucucccaguucagugugguguggaggucauacagcuucucugauuggcccuguaccuucucaaguaaggggcucauuucugugacugcccugcaccuccaugugugagugguucaucauuauaacucguaggaggcucuaagagauuccauuuuuacaucgagacuuguuaaaaguaacuuuuaaaacuucacuucaaaauucuaucacgggcagucgcuucucuguugcaaaggcacugaaacaacuccccacugaagcuguaugucuccgugcagugaccgaugcugucuggaugacauucugacucugauguguauaauucuuucagauauugaugaguguguugaagagccagaaaucugugccuuggggaccugcagcaacacugaggguagcuucaaaugucuguguccagagggguucucccuguccuccacuggaagaaggugccaagguaaaugccucuggaagcuuuggacuuucaugauucuguguuuauuuguuauggucuuauguuuuaaacauggcgaagcucugagucuuugugaacgggaagauguuucauucacccacaggucuaaugauuaccauaugcccuaagguucauuuugacuuuugagguuaaaaacucauccaucaaguuucaguugcuuauacaacuuucuuggcacuuacaccucuaucacucugacaagcacagaugcugagaggcuccgggggggggggggggagggcgggcauccccaagagucacugauacugcagaaccuggagcagaccagauauagguucguuccugccucagaagcugcagcuuaaaugcaugugggugcaaaccaaaaucuucagacagagaaaaugcaaacugauaaucuguuuccccccccacccacuuuacuguacauauccuuuggagaaaccgaauaccugucaauggugaaaauauucaagggcuugccagguuaacuuuaaaauaaaagaaaaaaaaacuuuaaaagacucagaagguaagcacaaaauaauguuuggauaaagcccagaaacauguuuagacauucccaagcagugcaauuguuauuuggcuauacuuauacaaacgaguuuaaugaauuacaggguagggaaggcccauaaauauuuaguuuaggauuucuguccgugucuauuuguugcuuugugcuuuuaguuguuuguuuacauugugugugugauuugcuucauauuaccaaauaauagguguagaauacaauuuaagauucuaaaauauggcuuuggaaucuaggccugccaaguuuuggccagagaagccauuuauggguauagaaauccuguuugcucaccccaaccacacuaauacccacccaggcaacugcaagacacaguucuauugucucugagucuccugugaacucuuguuacuauuauucugucugguuaugguuuuauuuuaucaguucaucagugcggaaguaugaagggaaagguugcaaauucucugguugguuugaucuuguaggggcuaucagaugaccacaaggguuucaggguagugauugaggcacagcuggauucaaguagcuaaucugccugugcgcuccaggucagccccauagagccugacuucauuugugucuuuggcuugcuuggccugcauucggaaagaaagcagugagaagccaggugcgaaucuguccauguggcaagccagaggaaacuccaaggcuauuaauucaauuugcacaggccugucacagggcaagcugacauugcaggaagaagcagcccagcugugagaacccugccacaucccucagccagagcugaggaaugcaagcagggaaaaugacugccauaguuccagagaaguuucagaggucaggaagggcuguucgcagaugaacuggugagcaggcauucuagugaacacuggcugaggugagcacugagcuaugugagcacugugcuguuucacaugacugaaagcaaaucuccuauugagugcagguucugcuggcaccugaaauuuugagacagagauuuuucuuauagggugucaaauugaaucaggcgucuauuggguauaaaguaaggaaguuacccagaagcccugauaugggguuuugaagcaccagaugccucugggacuuuuugcauuugagucucagucugaauccaagacauuuauuuucuuuugguguagagaguaguguggggaagauugaacauugaacuggaucgagaguaaggucagcaguuuaaggauggcuguaggaauaagugguaaaaaacaacucuguuuaugcaaaacaauggaugggacaaagaacuugaagaauaaagcaaaugaaaaaaaaagaugucacccaagaaaugagaauuacuuaagucuuggcauuucuccacagaguaaauauuuggguggcaagcacugcugugggagugugcuuucuggacuggaaaacugagaguagagaaugcagaagucagagguagucagaacccaggaagcaggaaggguacaaagcggaaguggaaucaaguccucagcucugcagagcuuagccacaggguaaugaaggagacguaaugccuggcucuggaagucagguuugaaaaaacacauuccagacccuacauuagcucacuucucagagucacccacucugcuccauaaggaugggaacaguuggcuuccaaaauuaugucaagcaacacuggagcauuuuauaagagagauaucaccuuuuccuuggaguuuccagagcaauaaugaauauaaagaaauacauauauucuuugaaagaaggguuauuuugcuuacacccaccauagcccugccuuccgucuucuuuuugcuuccucuuucuauugcacugaacagacucguuggaaacuuaauuugcuguagcugugugugcaugaguauaaagucugcagaaaaucccacuugaaguuuguccccacaauuccaugcauagcuacuucagggaaugccccugguggcucaguugacuaguccauacacuuaccacuccuucauuuguccuauguaguggugugggguugucuuuggucccagaguauauaggacacagaaugacgguaugucuuagaaccaggaggcucuccugucuuagucugcuugcugaaaguuguacaaaacccacacaagagaagccaucauacgggcguuucuuccugaaugacucuaucuggggauguuccaauccuggcauuguuaguggaagucuauuaaggcuggaaaguuuggaguuuacuauuccuaucagguugcuuugaaguagcagguaaacugaaggaaaaagauaaagcaaccugagucuguuccuccuaucuugccagcugucugugacuucagcagucucagcucuuucaugcuuccaauugcuuuuggaauauuguucuaguuaaugagggaacgcauugaucuacuaucagacaaugaggauucaguaggaaagcgacuagaauguacuguggauuuauguuguagauuugcgaaugagcuacugcuaugcgaaguuugaaggugggaaguguucaucacccaaauccagaaaccauuccaagcaggagugcugcugugcuuugaagggagaaggcuggggagauccuugugaguugugccccacugagccagaugguaagucuaacaucucuguuucucaucgcaugaucucguguacauaugaccauggaaccaugaacaguguaagccuuacagucaguagagucaucaaauucuaaguguaacuugaaugccauuuaaacauauuuuaccagaggagcaugguaguuauuuucucuuuuaauaauguuguaaaucagagucauccaaagagcaggcacgucguugagaaucuuggugaugucuccuuauuucugggcaucucucacugugugcagcacguggccacagccacacaguggaugggggcgugggaaggcugucauugucucugaucugcccacuaaugagucuaucucuccacuacagaggcuuuccgccagaucugccccuuuggaagugggaucauugugggcccugaugacucagcaguuggugagugcccagcuaggucuucccugccucuuuguccuuccucugggucuuauuucuccuuaucuaccugggagaaauaaucucuucuauuugacgucuuaucauguggauuuuaguuguauugugauauuagauauucacuuacugaaaacugacaugacaauaguuuaagaaaaauaccuugguuuuuuauuguuuuuucuuucuccacuuaagauauggacgaaugcaaagaaccugaugucuguagacaugggcagugcauuaacacagacggcuccuaucgaugcgaguguccuuuugguuauauucuggaagggaaugagugugugggugaguagugauucagucccuuccuuugaaauuguuuuaugcaaaaauugagcgauuuggcuuuuacugaaccaagguacgagucauguucuguuccuccacugagggcuucuucauuuagacuccuagccaguccccacccugugcuggguagggagcuacuacagugaaccaagcaaggauaguccuuccuugcauggcccuuguagucuaacuuggaaggcaguaucucuuaggacaagagauacuuguccuaagagauacugaaaaggacaacagaacagaagaguguccuaagagauacugaaaaggacaacagaacagaagucuuagugaaaauuaaaauauacuguuagugcccauaguuuauacuuucaguauguaaaaacaccaaguuuccuaugcaucuuguauauuugguaauauggaaggccaaccaccuuauucagugucuuauuuuagccuuuccauuaaaaugucuaaggauggcuucuauguggaccacuuacucuuaauucuuuucacuauaugcuagaauuaaauauguccaagaacucuaacaaaguauuccugugacagugugaucaacacugaauguccaugugugcagauuaaaaaguacugucuucauauaaagagagggggucugaggacuguagcacgagcuaagggugggauauaaguauauucaaccucucccaccuuggggguacuacuaugcaagugaaaugguuugugucuaauuacccuggcagcucuaaacugcaaugauaccauuguuuuuauuaaaucagagaagacgcaguauucuggacuaaaugugagauuuaguaaccuaacaggaacaaauuuuaucgauguuaguguuuuggaaucuucaguuugcggcuguguaugugcaaaaggauucuccucuccuagaaagagugaccguugaggagagccugcuguguuccucggcuucagauaucuaaaauagcaacguuaucucuaaaauuagaguucuuucuuucccaagggaaaauauucucccuaaggccgaggccggaaacaagaacaguggacgauccagauggauggguuaggaggcaucuauacuuuuuagggauuuuuuuuuuugguaaaauauuuucucucuccacaguuguuuagaaagaccaugaccuaaacauguuuucucucucucucucucucucucucucucucucucucucucucucucucuuuuuucccuagucuuuucuuuuucugccuaauguaaaccaccugguuuuaacagaaucaacaaaaucuacuugaauguuggguuuuuuuauccaguauauucuauuuaaucuuagguaauuuucuauuuuauaucuggcaaaacuccaucauauguaagccuuuuuguguagugaugugaagugggaccaacuggagacuuugucuuugagccagcagaaaccccuggcugcauauaggagccuuauuuuagcuauuaggacaucuacucccaggacagucugcagaaagccacuugggcgguguaagggcuagacauccaucucucucacugucucugccuuugagcaagugcaaacuccagcuagaaaccaguggucagcagguuucccuccuugcaagaacaggauaacugagcaagacaacacagauccaagaacucagacagaaugaaaagugauaucagagccuuagcuccauuuuaucugcacucauuuuaucuccacuuuggaucacuggcagauaccgaugaaugcucugugggcaauccuuguggaaaugggaccugcaagaaugugauuggagguuuugaauguaccugugaggagggguucgagccuggcccaaugaugacuugugaagguaaguaagggucucggauacagaagagacaguugccuauacugaccaugggagcagcuguuugauuguaguucuuaagaucaaauaccuuucagggcauggagaguuaagaacaucugagcauggcaggcuguugcaucauucuucucugugaccucauauggucaggaaauauaaagaaaacaauagaggugacuuguggcagaaguuauauuguauauaacggaaugcucacuagugugucuuucugcuuacaucucaauacaacuccucauuuacuaccuccugucuuauuacucucuauuuccuuuguuguuuuuguuuccaaggcucuucuccccucccccaccucuuuuguauucuccugcucuccucuuagaaacaucugcucacagagcuagauaaccacugacauccuguggucaucuggaggcaaucccaaaggagagguugccuaacccauagaggcaucugaaaaguauuugucagugugacugccuggaaggaaguauggaaaagaaagaaaaacuagggagugccaaagagugguuggucccucgacuauuugccucauauuccccugggaugcaagcuuucuggccucaucuucgaccacuaaaucacaaacucuaaaagcagagcccagcagcuguccagaugauccacaagcucuucaugauaggguucccugguguaggaaaagaaugggggaggggaagggaaagugguauuaaagggaucccuucaucagagauauggacuguugguaccuucagaguguugugagccuuuuaaggcugugguucaaagcuggccuggaugcucaguccuguccuucauacacauuguuguucuugggggacagcaugaucaucgaagagguuugguuucacccucucgcuuuugaaaacauguccugacauuucuaaaccaugcacucuagaaaagucauuuuucccaguagagggcaucuguguaaacugaguuucucuaaguauaaaaugaccagaacacucuguuugagcccagaaucccuguugucucauaggaaccucuuuguuuggggaaggagagguuacuaagaguauuagagagcuuggcuucuuuuugaccacaacuucuuuaguuaaaggaagcaaagaugaucuauaguucauguacaaaggaaacggcaacuggucaaccugagucuuccaacuaugcaaaguggaccuguuguuccucauucacguaaauccauaauuacaccaggacagcaagcuugagagauguacugggagauccggagcauacauccaccauauuuauaccagcuauaaaauaaucaacucauuuuuauaauuuucuggaucccucccaugccuaugauaaggaaggcuuuugacuuuuaguaaaagcacauuucucucuuuuugacauucuuggugcuguuggcucauucuuuuacguucucuuacuacagauauaaaugaaugugcccagaauccucugcucugcgccuuccgcuguguaaauaccuacggguccuaugaaugcaaaugcccuguuggauacguucuccgagaagacaggaggauguguaaaggugagggcccauuuuaguccauuuaguccucagaauuauaaaugcuucaacaagcaaguaugaaucauaaagcaaagaaguccaggaagggcucccauagcaucuuuguuucugauaaggucaucgguuuauuggaaagcaguuuucucaccaaguccaaaggcgguuagaagauucccuuccacguuuaauauaucaauuccccauacauacaaaaggaaauaagcucaacgcuaagaugacggagaugauaguuuaaaggacaagccugcaguggagcuuguuuuaaaguugugauuacacaucuuuccagaugaggaugagugugcagagggaaaacacgacuguacugagaagcaaauggaguguaagaaccucauugguaccuacaugugcaucugcggcccuggguaccagcgcagacccgauggagagggcugcauagguaagacugucucugguacagaccgcucagcauugaaauagccgagggcagaagugaccugagcucugagucagguuggugacgugcuccuuccucuuaaucaaaugucacaacucacuguggagaggccuuacuguucucuccucugggcuggccugucccuauucucuuggccuguauugcugccagggucacccaccuuuggcccuugcccguuguucauguagccguccaggagguagaucuucacacugacuucccucaccacucuauggacuccguugucuuacuaacguccugugcuagggcuauuuuuaagccagggcucuaacuucaagaaacccccgcuuuccuugagguagguccaagugcugcuuuuuugaauguccccaggugauccaaauguguaucaaauguugagaaccacaacccuaggccagggaauggcaagcuucagcuuccaaucaaauccaacccucuagccugccacuucuuuugugaauaaaguuuuauuaaaacaccucaugccccauagccucccgggcagcugggguuucuggccuggcccaucaaguucggcugaacagugggguuuuuaacuagucuucauguggcucuggguguuguuuccacauucucugccccucucagggagcucuguguucuagagacucaaagcuauucucaaaugagagagaaacuggggaaguuaguucgugauauucagaucuaaccaaucaccaaaaguaauccagauauuuuaauguuuuaaaaaccuguuaaauuaugguuuauuguuuccucaauaauauugcuuuguuacaaacaagucauguugaaucugaagaucaguccaaacuaauguuacugugucgacgcaacuuacuggcaucauucugaugaaguaauguaucucuuuaaaaugacagucaaccuucaguucucccuccaguaugugaucucaccuuucaggaaucuucuuuauauacagauggggcaaaauuuaaguaaaaaaaaugugugcccaaaaugcugccguuugcauuuagauauaucaaaauaugcucaagguugccuuagaagaacaaagaaagagagggagagggagagggagagagggagagagagaggggagggagagagagagagagacugcuuuuauugcacaaucccucucggaaggggacucagaaguugacucuggaagaguguuuugguggcugaggaauacagaugacagggagaccuugauuuuuuaauuccuggucguuccaggauuuccagcuuuucaccauguagauagauuacucguuugcaaagaaaacugagagagugcgugaaggaagaaaggaaggaaggaaagaggggaggaggaaaggagagaaggagaaagagaagaagggagggagggagggagagaucaaggggaaaaagucaaccuuuuaaacaaugucucaugaguccuguucacugucuccacagaugagaaugagugucagaccaagcccgggaucugugagaaugggcguugccucaacacccuggguagcuacacuugugaguguaacgauggcuucacagccagccccacucaggaugagugcuugggugaguaucugaaacuggcugcaaccuucccucacacuccaaagcauuguuucugguuugaaauaagagaauaugccaaaaaaugugaaggagcugaaagcagucauccuugggagaugacuuagugaccaaguguaucuugggcucaggaccucccuacagcaaaauucugccuuugcuaauugcacaugggauugcuagcuugggguuuccuucuugcugcccuuuaaggccuuugcgaccaggcccacuuccguauguuuuugcccccuuuucuauagcauggcuguugcaacuguucuuccacaugucuggggcacaaagaguuauaagcuugucugcaccaaugccuuucugccaacucacagauuucuugucuuguuuccgucagacgccuccuuucucucucccugcuguuuccagcuuucgcuucuugcuccucuucacccaggguaaaguguuacauccuuuugguuuuuauaucugacuaaauuccuaaugccccaugcacacagaacagucccucaauuccucuuuaccucggaaugucucuuccagacaaccgggaaggguacugcuuuucggaggucuugcaaaacaugugccagauuggcucaagcaacaggaaccccgucaccaaguccgagugcugcugugauggagggagaggcuggggaccccacugugagaucugcccuuucgagggcacaguggcuuacaagaagcucuguccccacggccgaggauucaugaccaacggagcagguacuucacuuuguucuguuguugacaaaaggugcgagcucguucuucauuaugaguuuuccauuauuggacaaaaguaguugcaaggaauguguguguuucacuacggaaaaugauggaaauguggaacugacaauauaggcuugcgcugucugacugagauggacggacauccuuccuuacagugcuguaaacauucaaggccauuugccaacaguccuugguccggaugauuacguuucuugugcuuggguccuugccucugccuggcaagggucuggcagaaaucugcuggaagauaguuuaugagcugugaaauaaauaacaaccaucuacuuccacuccacugauauucauuuuaacucaauguuagccaugauauauugcaucaaagaaguacaaagacugcuggugugcuaggaauuuacacaaucgugucugaagugcauugcaccagcugcuuuccgcuagacaucuagaugugagugagggucaacagagaugucugaggcagcugugaagaccugugagccucaugggauuucacuuuuaucaacacaguugggguguaguucauagaagggcugaggaagaggguccuguugguguuccauugugcuccuggggguggggugggaggggacuggaggaggcuagaagcaaaaacauaaaggagaauuagaagagaguugucuuccuguugggaaaaugugacuaaugacagaauaaaggcuguggguaaauggaggcgguggacaggaaagauccguccucugggaggaugcugagaugagaugauagaggacucauuuccugagaccagugaaaaggugcuuaccuguaccucagaguaaacugcagaaggucaggcacacccaucugcugauauuagacgaucauuuuggcagugaagguuuaauaacuuguacaaauugcuuguguugguguccagccuuacugccaccaguguacagucuucaagccuuucugucuguaauagagacacaaauacaggugucucugucuagcaaacugcauaaaguuagucccaucauuuacccaagaggccugguuaauucccauacagaagagggaaguugacugcauucuuccacccuuuguuaaguaauuugauauuuuucagaauuaacuucaaguaggacaaagaaaauguuaaagaaguuuccuucuuauuuugaacaugcaacaucagagagaaaaaaccuagacuuuccuuguccagaggguucucugcuaagacuugcucaugugaugcccauagguggcaagaaugaugacaagauggagcagaggaccuaacaugucuccuuaugauguuauucuagaaauccagaagagaaaaauaacacaguuuuaaaugaccaauuauuuuaaggcuuucccuuuguuugaacagcuucucauuaucaccucauacagucauucacuagcuguucaaugaguaaccaauugcauaugaaauccuuucugucuccuuuugguuuaauacuuugguccuuaauacaguaacacgguauauaaaauuuuacacucaagugaccccuguguaucaauguugcccauuguauguuuuaauguacuuauuauugugauuuauaucuauccuagauauugaugagugcaagguuauucaugauguuugccgaaauggggagugugucaacgacagaggguccuaucacugcaucuguaaaacuggcuacacuccggauauaacagggaccgccuguguagguagguacuucguuucuaaugcuuuauuccugaguagaaauuucagguuaugggagagaaaaccccacacuaaaaaucuaaaaugcaucucuacuuucaauuuuaaaaaaaaguaugaggcaaucaucaaauacuucacagaguuuguagguauagauauggaacauucagaaagucuuacaaauggacgucuauacuaucuuucuuuaaucacagaucugaaugaaugcaaccaggcucccaaacccugcaauuuuauaugcaaaaacacagaagggaguuaccaguguuccugcccgaagggcuacauucugcaagaggauggaaggagcugcaaagguagggggucauuggcuuaauccacucaccugccucugguuaugccugggaauaaucaggagacaaacugcaagaccugcucccugggcuuccugccugugcagagggugggucccugaggauaacccugagcccggggaggccacuuaaggcuaguaguagcaaccauccuugcuugauaccccaugggcauccauggauaacacccaugaagggcucauugguaccaacucuccaaggcucugcugaggcuaauucccaguuaauuccccaauuccauuucuucauuuauucacucucucuucaacaacaguguggucuaggaggucuucauaccaugaucuuagaggcgugucugauuaauuaaacuagucuaucuaucuaucuaucuaucuaucuaucuaucuauauuuuggguuugcaaaauaaagccaccaugcccucuaagaacuuaacagaaggaguuguggaaucgagaaacauucaaacugggcagaacucucuccucgacuagaaacuagcuuuugucaaaucugcucaguauagauucagccuuaaacaucuuacuagauaagaccgucagagguucuucuaugccgaccuggcccuagguccuagaucauccuguagcuggggaagaagucccugauaccaacaucugcccaugagcuuaaaaagugagcuucaccugggaucccugugaacucuggcaaguguaaggacuuggcaagagguaacucauguaagcaaagaaacauguucaggggaaacaucucuucugugugcaauuuguaaggaaacaaauuuacauuuuuguaaucuguggcagugggccacugcagaugcucaccucagcguaggcaauggcuuccccaaagauacacaucuguaaucaccgcccaccucagugaacccugcccacucucugucacucuggaaucaacaugcaacuugagcaggaggaggcauaggugagaaugacuggaguuucaggugaaggccuagugacccuuuccugaccuaggauugcuugcaaguagcaucaucuacgcugaugaagacggugaccaggcuguuagacucagagucuuuacuucacaugcccucucucugcuuacucucaugaaguccaaguuugucuaugccugacauguggaaauguucacauacaugucccgcucacucugagacgaaaacagguagaagagaggcucugggaggggugugggaccaguaccuucccccccacuggagaaagggugugggcagagaagagaagagaucaugguaagagucaugcaauuauggcuauaacgcagugaaacccacucccauuaauuuguacaauuuggguauguuauuugauuauaauaucaaaggaaauggguggaaggagauaggagaagauguucuugaggcugagaacagccaguugcggcugaaagguuccuauuaguggacuggacaacucugaaggaccacagcacuguuuucccaccagccgcaggggagagaaguuggccucucagcaguagagagcucaagaaggucuccaucugaggaugagcacagggacauccucucugguuaggacaggugaccucccaggcaggaaggccucuggggagcagaggcugccacuagcaaaucucacaccacuugugccucugugcaggggcugagucugugauaaagcacucuugaauuuccaggcguuuagacaccauccuucaaguccaacuuacuugguagcucuuaauaugucuuuauuaaaagugaguccggaagcuaaggcugcgaauacagacucuguuaaggugggagacugugcugagaugaaaaauaacuuugggucuauaguauaggaaaggauuuugggggggggguuguuuuuguuuuuguuuuuguuugguucaucaaaaucaacuagguagauugauugauugauuuuugucuuucugaguuguucaauuuuauuucauucaaagagaaacuacuaaccaaagaaguccaacugauggccucacuuaaguuuguucuagaugcaacagaaaagaaugaaggcggugguucucggucuucuuuucccuuuaccuagccuuccucagccuuccuguaauacgguuccucauguugggugacccccaaccauaacauuauuuuggugccacuucauaacugcaguuuuguuacuguuaagaaucauaauguaaacaucuguguuuucaucuguguuuaggugaccucugugaaaggguucucaccccacagguuuagaucaacugaauuaagggaacaaggagauuuucagacuugacaucucuuuugauaucuucacuuagaucuuucagugcuagggagaauuucagaaugaguuuuuacuucguuuuacaauucguuuaaacauuuagaauaucuuucaaaucgauucguugacaaaucccuacauuucuuuagcuaagaggaacugcuaggccuugggucccgcagagccacuuccuccuucuuucucagcccaccaccugccuucuugccagcgccuugcugugacuucugggcuggcccggugaagcuuccuacccaggccuguucagcaacuugaacuccaucuugcacuuucuuacagaucuugacgagugugcaaccaagcagcauaacugucaguuccuguguguuaacaccaucgguggcuucacaugcaaaugcccuccuggguuuacccagcaucacacugccugcauugguaaguaggaaggaaagccguguaugggacauagauguuccgguucugguuagagacucuuuucuaaccccucugcugccggauaacacuacaccauguucagcguaugggggugcacguguuggaccgugcacacacgauaggaaguuauugacccuauuuuggacuucucugggucaaccuucucccuuccuuucaagcguugggggugcaucacucuccucuuuucucccacugcuucucccagauaacaaugagugcacgucugauaucaaccuguguggguccaaggguguuugccagaacacuccaggaagcuucaccugugaaugccaacggggguucucacucgaucagaguggugccagcugugaagguagguauagcccucagcuggauccagcuagaagcuccuuguagagauagcguauguggcugucaacuucugugaguuacaggaacuaauaucuuuucugggugugcuggccuacaucuguaaucugagcacuugagaggcagaggcaggaggauugccacaaguuggaggucagccaaauguaaauaauaauuaggcaaacaaagaggcaagaaugaaggagacgaaaacaucucuaagcaaggaaaccauucaacuaacguccaggcuguuugcaugggccccaugucucagaaauguacuugcuguaccaacaacucacaccucuucuacguagaugaagauuguuuuguuuagguuaacaauuuaacuuaguaggaguaacucagccucaaugucugacauuuggggccagagcccuuagauucccccaacauggacaguacaugcagggaauaauucuuccacaaacguauaauucauguucaaauuuuaauucuuaagauuuuuacguccuuauugauaguccucaguuucuaauuccaguaccaauaaacacagauaguuuccagaguuauuccacagcauucugugacuuacgacauuuuuaucuguagacuuucugggaaaucucuggauauugguguagauauucuugauguuuugauaggauacauuuuuaggagaaggguuuacuucuagaaucgccuuugagcgucacagguugaggcuucagagagccugagaggcagcugcugugggacucacaggagccucugcuucuuuuacagauguggacgagugugaggguaaccaccgcugucaacauggcugccagaacaucaucggaggcuauagguguagcugcccccagggcuaccuccagcacuaccaauggaaccaguguguaggcaaguagcuccucguccuuaaaagcagccugguugcuggccccucgcagagccugaacuuccuucugauguaaaguuacugagccaacaacagcccccugaaaguuucucucucccacuugaaaccaaagggaagugauaaucuaacagcaugugauagaguaagugacuuuuggacguaauggggaugagaugcccuuagacuccuugacgccauuauaucuuccucuucugcugcacuguuugucaucagcgcacacuggggaucgcucuaugauaucaaguuccuugaagauuuacuuugguuucaggaggaucguggccaggucagaauaaggcaauuaagguucgggguuccuguugcccccaaucccaaacagggcucagaaggcucaagaaauaaaguuaucuagagugagcacugucauggacugaaacgguuccgccaguguggugcuauacagagccgaucucuuggaccagccucaccugugugcccacucuuagcuugucgaagguucacuuuccuggugguugaguuagaggucaggggccauuaacaccauuccuuucuagaagcaaauagcagauuucaacuuucagcuggauugggacccauuuggcccuaccauaaucaaaaaugguaucuauaacguacuucauuccuuauuuaaaauagagaaaagaauguagacauugauugauuguaucuuugauuuuucuaguuuaggaucccuguaaccuaagggaccuugaaugcagacuugaggucuuuggauuuagagaaucuucaaauagacaaagccaggcuaauggcuggauggaaggggagggaaagagagaaggauuuauauccacaaauaacacuacacacacacacacaaaugacacaaaguauuugaauuuaucagcaaaacuccuaggccuuccacuuuccccaccuauuuacuaacugcaaaugcauggcaugaacauagaagggagauugucuggggaaagaaagggaauggaggcagagaagaggagcguacaggaggggaaauauggucaaaguacacagcacacuugggugacaacgucuuacuuagacucaucacugugaacaacgaauauacaccaauguaaguaaguauuggugggcuggugaaucaguucggugcauagaggcagcugcugcucaucucacaagcuuggagaagccuccuaaugcucacaggacaguaggaagguuuguuuaaaugagugcaaacccugccccauguuacugccugaaaugagugcauggaaucucucccagccacauaggcuuuagucauggcucagacacuggagccacagcugguuuggauaggcauucagagagaaaacagacauaccaggagguaugacuuagccuaagacugggcaccugcaggcccuugcagagguuuugaaaaggaaguauaauuggggcagauaaaugggguggacuccccuguaggauagcaaccauccuuagaccugcacauucaagcccaagaggagccucugggguugugggucucugcuuuggggauauccauccugagggcacuugugacccaagcauacugauaacuguccagucucuuccaacccccucugaacuccaaacuauaacugugguucugacuccuauggagcaaaacauacuagcacuggcuuuuagugagaacuggagucugaggcuccucuuagugccauccuggguauuuugcugggagcaucuaaacucuuguacaauauuuagucagcauggaaagaggcuaccugccuucccugccucucuccuguacucuccaaacuggccacccugccugcuuucuuuucugagagccuacuuacauaccuauaggccagcuugucagucaugaggaacaugaccuaaauuccuccuuagaauucuauggcaaguaucauacauguaacguugucuuguuuucucugcagaugaaaacgagugccugagugcacaugucuguggaggagccuccugccacaacacccuggggaguuacaagugcaugugucccaccggcuuccaguacgaacaguucaguggaggcugccaagacaucaaugaguguggcucaucccaggcccccugcaguuacgguugcucuaauacugaggguggcuaccuguguggcuguccaccaggauacuuccggauaggccaaggguaaguauuauucuuccugcccucaguuaaugacucuguaaauauauuacacacacacacguauauguguauguguaugcauauguauaaucccagcaccacuugggaggcagaggcaggcauauauauauauauauauauauauauauauguauauauauauauauauauauauauacccuacuagagaacugcgcuuucuauaauccucagguucauuccaguuagcuuugaaaccauuugaaaggagcaucuguaaaggcguauccagauuucuagaaacuccuagaacacccaacaacauagugcagccacaugguucauaucucacugaacagcuucugucucauauccuucacaucuugcugagagcuaauugguuucuccaagaauccuccucaggaucagcccacgcagagcuggguguacucuacacagcugauggcucccauggagcaggcugggcucucuccacuuaggaugcuuucuuuccuggcucccaucagguuauggauaacuugcuggguguuucuuaccguuuuuaaggcaucuuuuguccuuugcucuugaauuuacauuagaaauaauuuuuaaaaagcacacuaaaugugaguuagaauaaucagcuguauuuuccaaguagaaaauuuuaugaaugaugugaauaugaauauguuuaugagaguugaggcagaaaaggaacacuguuuuuaucaauggcuuaaaauuuuaauaaguuuuuaaagccaaguucuucccuaaugacuugaguguauaucuaauuuaugaaacuuuguucuugauuuuguuuuugagacaggguuucucuguguaacagagcccuggcuguccuggauucacuuuguagaccagacuggccuugaauuuacagagaucugccugccucugccucucaggugcuaggguuauaggcaugcaucaccacgcucaaccuaguucaugaauauuaauuaauuagaagucucucuuaauuagaacucuaucugucuuucuuugucucucuguuuuucucugccccuacccaucauacacacacacacacaaucacauacacacuuaucccaaauaugaacucagagguccugaagucuaugacacacuggcuuucagacacuuauuccagucuguauaaacuucaagguagaagaauucuaugugggaagcucuuggaaugccagcgguagggcccaaauucccagaugucugucuggcucucaacugacucaguauuuuuuuuuacaguuuaaugccagaaccauuuuucccagaaaaaaaaaaaaaugugacacuccaaacuggcuucaugccagugggauuuuguagccacauuucuuauaaauggugcuccugggacaagaaaauacuggagaagaguucugagaagggagccaagccugcagauuugggcuuauuuccuggagccaucguacagcauuucccgucccccaucauuuccuuguucauucauguuccaugcugcuaggugaagagggacacaaaugugugcacuuagaagaccccaggaacuagaaacaagcucugaaguacagcaagacacaagagauaggcgguuccuugguguuguauuuugaauccuauggacaaauauaggaaggagcuguggcagacaagucaacucucauagaaaagucaacuaucauaaguuuggugcacauuuugugguagaaauccacccuuaaaagucaacuaucauaaguuuggugcacauuuugugguagaaauccacccuuuuauaacagcuuuggccucccugugaugucacuugggugcacccccccccccccccccgcaaaauaagagcuguuuuaggauaaucucuagguucccaacacguuuagaaaggaagucuaacaaaaacaaaucagauacuguguggggcucauuccauagcuuggcuccgacaacugcaaagcaaaggaacaaggauuaggucucucuagggcuuggguuuguuuaucugccuucagaugagucaacuccaguggccuuagugguuugaaacgacuugaaguuaaacuguuucccacaguugggcaagcucuccucugacccaugcugucuauaagaauguguuguacaucuucacagcauggacccauaucaacccacagacacugcguggacuucccuuccuaccucaguaucaucagccagaguaaacugucaaaucgaagugauugcugagaacagggauuagggagggaugauggcagcauuggagugaagugagccuuaaggaccugaggaagagcacuccacacuugagccagcagggggcagaagugauggagaaggcaaugguuaggcuauggacacagaacauaaaaaacaacaucaggauauaaaaaagagaagacugggguggagggguggcgggaacagagguggcagcaggaggguggaagacacagaaagaaagucaccaaaacauacugugcccaacuaugccauaaugcuagcugacauccuauaugcagaucuuaaaaauuaaaacauaaaaaucaaggccacagcagaggaagaaauauguuguccaagaaagaggucccagauaugggccaccugcccacucacugcugacuccuagagggacagcuggugggggaccuuccguacucccagguucauaaaagagauucauaaaaaagauucauaaaaaagaggaccuacuaagucacaugaucucacucaucuuuggucuucaguuuucaguaugucuguccccucccugcaugagcacugcagauguuuggcugggagaugaagggacaaagaaguaugcaaagugguauguugagagaaagaacuguacucagggcacuggguaucagaagcuaaauaccugggcacuggugugacuguuagaagcagaugacuguccagugggcagucuguuaucaguagggaggcugaacaucagagcugcuggaucugaccgaagcugccuugugcuccuuucugugguaggcauuguguuucuggaaugggcaugggccgaggcggcccagagccaccugccagcagcgagauggacgacaacucacuguccccagaggccugcuaugaguguaagaucaacggcuacccaaaacgaggccggaaacggagaagcacgaacgaaacggaugccuccgacauccagguauaucagggucuccuugucugcagauaccuaagggcccugaggcuucuaugcuuuccuccaaggacaccuccaagagugaacagucuccccagacagaaagcccagucauucuccuggcuuuagcaguauuuuacaagaggccaugggguuugggguuuguuuuauuguauuuauuuauuuuggcugccucuugagagcggcaguuugacagguuucaugcucuugcucauuuccuccgucucaccaagaagaaagucaaacgccuacccggugucugcagacaggacaaggucugaagucaaggauagcaagugggcagaauggcaugcacaugugguguuccccacgcggaggccaagguguagaaaggaaagagccauaaggcgugguggcgggagaaggacuugacugacaggaacauaggaugcuauguaaagucaggaaugcauucauucacccagaucucuggcuccaggcugggagcaucuaguccacguggucccaaagaggcaagcagaaagcucagugagauguuagcagcucaucacagcagggauguguguccauagguguguccuuuagaagaguugguuucccgucagugaacaaacuugaauuagccguguucugagucugaguauucguccuacaacccaccugcugugguuugggaaaggagauaagucuuugaaaagaaaacaaaccuaugaagcaagcuuuaaaaaaaaaaaucacugcgucugagucaccugguaggcuuguuagaauggugugcugggaaaagccccaggaauucuaaucccaggggucugggaggugacaggaauuugcaugucuaaugguuuccaggcaugccaggcugcugguucagggaccacacuuugagaccuacugagagacucugcuccaguacaaccuggcuuccugccaucuauuuauauuuuugagaauacaucuguggcuuaggcaaagugccuacuagcuuugccuuuucaguuuaacauacugcaugagcagaaaacuguguuuggcuugagacuugaguggcuuuuucuuuagcaugagaauacuuagugggauuuaacccauuuccaugugucuuucuaggacgggucugagauggaagccaacgugagccucgccagcugggauguggagaagccggcuagcuuugcuuucaauauuucccaugucaauaacaagguccgaauccuagagcuccugccggcccucacaacucugaugaaccacaacagauacuugauugaaucuggaaaugaagauggcuucuuuaaaaucaaccagaaagaaggggucagcuaccuccacuucacgaagaagaagccgguggcugggaccuacuccuuacaaaucagcagcaccccacuuuauaaaaagaaagaacuuaaccaguuagaagacagauaugacaaagacuaccucaguggugaacugggcgauaaccugaagaugaaaauucagaucuugcugcauuaauucaccauccagagaccaaauaauuaaaugaaaaagcaaccuuaggcagguagaauuauauuuuccccaagccagaaccuucacaucaugguacaauuguucaccgagucgaucuguauaaaugagcaccacucuugaauggcaacacccagguacagugaugauccuaguucaaccaaccacuuucucaggcuucucgugaguagcucagcuacccugucaugcguauugauuccugaaaacugggacaugaauauccgcugagguuggccauucacgccgaugggcuaucuucccagccuccgcacaggaacgcgcuuccaucugauggacuguuccgcguuggucuucagaucuugaaacuuugcuucuccgagugcaagcaguagguuucuguugucuguuuggugcuaguaaauucucaaaauagauuuauugaugcacuguaauaaagacacgaguuaggaaccaaauugccaaguacucaguucaaauacuucauuucaaucaaccaaaguuaguucaguagcuuaucucacuuaugaguauggugcaguacauguaaauuaaguguguguacacuguaacgugcuauuuuuaucauugaaacauuuauaaacuacaauaauaaagcccuuaaugugaggguuuguaauggugcuuauuaagaccaaagacuuguuaaacaucuacaccaaaugguaguggauucucugagacuggcccacuugugcacugagguuggggaggacaaggaagcagccucagccaccagaggaucaccaccgcauccuccaucacacagcaugugcaauacgccaaaaucacucucagucauuccugucaacaagggguuaaugucaugaugucacaauaaagugauccuccccucccuccccauuuuaguuuacaccuugguuuuauguucuuguguggauuaaggcuggaggggccuuucuggaggugaaauaaagucuccuggguuuaaaguaucccugcuuuguuaucuguggcuucuguguaugugugauguaagcaccaggagaagaaaucacaucuucaguuagucccuucacggugguaccgauugcugauguuuguuaucugacuuuccuaggaaaacacuuagauuacagcaucauuucuaaaaugugaccuaguuaguccuggggcuuuuaaacucccagauuuaagaacucccagauauaaaauccagucauucucuucgagcugaacuucaugcuccuuccccucacguacacagcauuggcaagguguuccauccuuuccccugaacaucuguuguuggucagugcuagacuaauuacagagagcugauugaauugaauccaacugaauguugcaucucuugguuuucaaauguccuaacuugaaaaauggugguuuauuuuaaaugcaacauucaauauuuaacuguuaagcucauuuaguuaauagaagaaaaaaaaaaaaaaaaaaaaaaaaacaacucccccaggccagcaaaacugugguagugaaaauaagaugaauuaauuuuguuacaugaagggaggucgagaguggaauuuuccaagacaugggaaaguccucucaaagccaugggagcuguaugcuagagccaguggaguaggcuaugagcgaugcuuucccagaagacacaacuagugucaagugcuguaaggcucaguuuaacacauaccuccuuaaugagaaggcuaccuauggugaggaugggcuuccuugcagucugcugaguucagcuagguuagacagggcaccgguauccauuuaaugccuguggauacccuaaagagucucuuguuuuuguuuguugguugguuugucuggguuuugauuucug

SEQ ID NO: 1051 - RNA, 2742 nt, Mus musculus
ugguguagagaguaguguggggaagauugaacauugaacuggaucgagaguaaggucagcaguuuaaggauggcuguaggaauaagugguaaaaaacaacucuguuuaugcaaaacaauggaugggacaaagaacuugaagaauaaagcaaaugaaaaaaaaagaugucacccaagaaaugagaauuacuuaagucuuggcauuucuccacagaguaaauauuuggguggcaagcacugcugugggagugugcuuucuggacuggaaaacugagaguagagaaugcagaagucagagguagucagaacccaggaagcaggaaggguacaaagcggaaguggaaucaaguccucagcucugcagagcuuagccacaggguaaugaaggagacguaaugccuggcucuggaagucagguuugaaaaaacacauuccagacccuacauuagcucacuucucagagucacccacucugcuccauaaggaugggaacaguuggcuuccaaaauuaugucaagcaacacuggagcauuuuauaagagagauaucaccuuuuccuuggaguuuccagagcaauaaugaauauaaagaaauacauauauucuuugaaagaaggguuauuuugcuuacacccaccauagcccugccuuccgucuucuuuuugcuuccucuuucuauugcacugaacagacucguuggaaacuuaauuugcuguagcugugugugcaugaguauaaagucugcagaaaaucccacuugaaguuuguccccacaauuccaugcauagcuacuucagggaaugccccugguggcucaguugacuaguccauacacuuaccacuccuucauuuguccuauguaguggugugggguugucuuuggucccagaguauauaggacacagaaugacgguaugucuuagaaccaggaggcucuccugucuuagucugcuugcugaaaguuguacaaaacccacacaagagaagccaucauacgggcguuucuuccugaaugacucuaucuggggauguuccaauccuggcauuguuaguggaagucuauuaaggcuggaaaguuuggaguuuacuauuccuaucagguugcuuugaaguagcagguaaacugaaggaaaaagauaaagcaaccugagucuguuccuccuaucuugccagcugucugugacuucagcagucucagcucuuucaugcuuccaauugcuuuuggaauauuguucuaguuaaugagggaacgcauugaucuacuaucagacaaugaggauucaguaggaaagcgacuagaauguacuguggauuuauguuguagauuugcgaaugagcuacugcuaugcgaaguuugaaggugggaaguguucaucacccaaauccagaaaccauuccaagcaggagugcugcugugcuuugaagggagaaggcuggggagauccuugugaguugugccccacugagccagaugguaagucuaacaucucuguuucucaucgcaugaucucguguacauaugaccauggaaccaugaacaguguaagccuuacagucaguagagucaucaaauucuaaguguaacuugaaugccauuuaaacauauuuuaccagaggagcaugguaguuauuuucucuuuuaauaauguuguaaaucagagucauccaaagagcaggcacgucguugagaaucuuggugaugucuccuuauuucugggcaucucucacugugugcagcacguggccacagccacacaguggaugggggcgugggaaggcugucauugucucugaucugcccacuaaugagucuaucucuccacuacagaggcuuuccgccagaucugccccuuuggaagugggaucauugugggcccugaugacucagcaguuggugagugcccagcuaggucuucccugccucuuuguccuuccucugggucuuauuucuccuuaucuaccugggagaaauaaucucuucuauuugacgucuuaucauguggauuuuaguuguauugugauauuagauauucacuuacugaaaacugacaugacaauaguuuaagaaaaauaccuugguuuuuuauuguuuuuucuuucuccacuuaagauauggacgaaugcaaagaaccugaugucuguagacaugggcagugcauuaacacagacggcuccuaucgaugcgaguguccuuuugguuauauucuggaagggaaugagugugugggugaguagugauucagucccuuccuuugaaauuguuuuaugcaaaaauugagcgauuuggcuuuuacugaaccaagguacgagucauguucuguuccuccacugagggcuucuucauuuagacuccuagccaguccccacccugugcuggguagggagcuacuacagugaaccaagcaaggauaguccuuccuugcauggcccuuguagucuaacuuggaaggcaguaucucuuaggacaagagauacuuguccuaagagauacugaaaaggacaacagaacagaagaguguccuaagagauacugaaaaggacaacagaacagaagucuuagugaaaauuaaaauauacuguuagugcccauaguuuauacuuucaguauguaaaaacaccaaguuuccuaugcaucuuguauauuugguaauauggaaggccaaccaccuuauucagugucuuauuuuagccuuuccauuaaaaugucuaaggauggcuucuauguggaccacuuacucuuaauu

SEQ ID NO: 1052 - RNA, 62030 nt, Mus musculus
cgcgggcuaggguguaaccgggaaggugcucgcggcuggaagucagggcagcggguugcggguugcgggaggugacugcggucucccggccaggcuggcggcugcgggaucgggacccgcguucgagucuccuacaccggggcugugcuugcuggcucccuucucgaucuucagccugggcgucccaucggcagaccugugcgcgcccgugguucuuggaccccgggcccaguucuuugguaagggcgcugcgugaguacacccagucgagggggcuuccuguauuuugggguuacugucuucugcucaccuugguuuuccaugcugcuaucgguacuaccgagcucaagagauugucauugcccccucccuccguacucuuuguaguaggaacaggauuuggaaagugucuaaaauagacuguugcguucuggcuguuuccacccuguaagagaaguuaguguguaagcuagugcgugcaguuuucuaacucccagggcaauuacauuuaguccaucuuguagucaugcauuuuucagugugauuuaagcugaauuucacuucguagcuucacaauucuugauuguuugcauguaaauaaaggcugaaguuugaagccacaagcaaaggauauaagccaugcgcucuggaaguggccagaaugcacuuuggauggagcaggcaucuagaggagggcggaguccuuauccgggaguuguaagguuucccacaccuaugauguuuucaccguuucauuacuaaagaaacggaagcaguuacgauugcacagcugccagagcugaggaucuucaguucuuaauugcuuacagccauauuacauccuuugggaugcaaacaaacaaacaaacaaacaauuuggaauguaaacaaauaaaaagagaucugccuaaagacccuaucuacuccggugggaguagauaauaguuucagcaguuaagagauugucaaugcucuugcaagaggcugugaguucauuucuugcacccaaauuguauaggucacaacuacgugugacuccggcuccaggggaauccuaaggccugugacccaauggauauauucacucauaaugaugaugaugaugauaaauauuuuuggaaaggaaaauauacacuaaaguuugcucacaaaacaaguaaauauuuuucccucuaugugaggggguggaagggggugaccaaaaacuaccagggacagugcugacaaguauugucagacaaguauugacaagcugggucagagguguaagagaagacagcugugcuucuuguauucuuguagugggguuaggaaaaguuucccggcuagagugagacuauuaaccagggagcuguauuuuagggagcacacugcccacguugaucccuugguuuauguuuuaaguggucagcucucuggucaagcauaggaguaggccacuguuccuacuaauggcauaauuuugccauauucaccaagauacaguuuuacuauggcaaaugcacauugcuaucgauuguuuucaugaugaucugucagcacacaucucaccagcaauuuauuuauuaaagccacaaaaaaacauagaguuguggccauuuucaauguaguaguugaagguagcacggugcuacuuagaguacacuuccugaauucuucauggacuuaaccucugugugugugugugugugcgcgcgcgcgcgcgcgcgaguggauauuuguauggcuccacccuguuagagacugguaucuguggcuguucaguguuuaggccaugcuagcuggcguugcccaggacguuccagacagccucucaccugugccuccccgucccguagaaguguuccuuacagaugccugggcucucugucuggccuuaaugugguuucugaagauuugaacucaggucugcacacuugcauggccacuugcacugagcgaucuccugagccugaugaacucagacuguaauaauauucaaugaacauuuauauuucuuucuaaaauggauuuuuaugcuauuuucucaucuuaaguugucauuuucuuagaaaaaaauguuuacugauacuuuuuauuaagugauuuguaaguaguuuuacaguuuuguaauuucaucucuugacuuuguaaauguguucugugauauauacuauuugauugauggaaguggccagaauggacuuaggauggagcaggcaucuagaggagggcggaguccuuauccgggaguuguaagguuucccacacuuaugcuguuuuuuuacuguuuuaaaaggcugauaucuuuugcuugaaacaguuuaaaaauuuuauuuuuacuuuguaugccugagucuuuuaccugcaaguuuaucugugcaccacuugugugccuggugccuguggaggacagaaaugggccucuggucuccugaaacugaaguuauagacauugugagcugccaugauacugggaauugaaucuugguccucugcugaagagacaagcacucuugaccucugagccaacuuuccagucccgggaaggaucuuugugucuucuggaagauugggugccuuuggcuuggcuuugucucacaucuuuagggucauagguuaaaguguaucccgguuuccaucaucugagacucuguaagucugaugucugucuggagcuaugaacuaaaccccgauaugagagaaauguuuucuccucaccuuacagcggucuuagauuguuguauucucaccuuucucugaugaucuguguaugagaauuccaguaggcuuugaggagagacaaagcguacaucccagugagugugcaugugcuucaugccaugucugguuaagagcacacaucuucuauucacauuuuaacagcuauaaaacacucaguauuuuaauagugguguuguuucauaauugguuucuucuucuuaauguacaaaugggccuacaaccaugcagucacaggugucuuagaucuguuaaaguguguguguguguguguguguguguguguguguguauguacgcagggcucaugguuacaaaguuuaugaugcaguucacaacugucaacaacagggaauuauaagcuuuaugguaaaaugcauuuguguugcugggguccuuauacuucuuaugugacacaguuuaaugacauuuuacagccuggaaauuguggugaaugaguuguggcucagaccacacacaaaaguacauuucccaggugugaggagccuggauugaagaacaauguuagccaggccacugguagcacauacuuuuuuuuuuuuuuuuuuuuuuuuuuagauauuuucuucauuuacauuucaaaugcuauccagaaaguccccuauccucucccccaccggccugguagcacauacuuacuacuacuaugucaaagacgaccacauuguugucaucauugucgucauccuccucuuuccucuuccucuucuuccuccuccucuucuuccuccuccuccucuucuuucuccuccucuuccucuuccucuuccucuuccucuuccucuuccucuuccucuuccucucaggacuggggaguucccuuuugggaugcaugaacuugguauuuguggaauucagagcauggagcagacucuguaggacccucacugugcccuguacauaaaauugaggcuuugcuugagcuauucuuaaguuuuuuaugucuuucaaguuuuaaguuuuuuguuuguagauaucuuacuguugaaaauauccuuuagccacuuggggacccugguuacuguuuuguugacuguuugcauuuuuuucuuugccaugaauugcugucauauggcugcuuuuucaugagucccaauucuucccaggaggaccaugucauuggaguuuggcaguguagcacugcagacacaaaaugaagaugaagaauuugacaaagaagacuuugaaagggaaaaagaggugaguuuauuggaaaaaaagcucccgagcccaguguucagcagcacauuauaauucuaucaucgugugucauuuugaaaugauuuauaauucaccuaaugucaacaaacaaaacuuauaaccugauugagacuggacuuuuaaacaguagaggaacuggggcuggcaaaauggcuguguggguucuagggaccccuauuauuauuauuauuauuauuauuauuauugcauagagauguuugguuguuucaguguaugccuuugugucuucugagcgcagaguaucacguagcgcuucguccugggcuuagaugauugccucuaauuauucacucccuagaggcucucgggugcuuuacccgagcuuaagggggcccuggacaucugugcugcugcugcucccaccaccugggcagaugucacucccccaaggucggguuacuggugaagcgggauccugagaggcaggucucucuguggaaccugacaccguggacgaguaccgugauuuaugguuggccgggcuuccauaaagaagcuuucaguugugaugugcgcgcauaaaccggacaccucuguagaacaaguaaagccugcugcucauuaauccuggcgucuugcuuuccccuucccucaagugaaauuguggacgugaugcacaugcaguuuaagaaacucauuaagaaaucucuuuguguccauucacucauuggcuucagggcagcuugggcagugccuuguguuucaggccgugugacacugaugugacugcccuuacucaguugcagcagcuacucacagaccucccucacgacaugcuggacgaugagcucuccucuccugagcgccacgauucugacugcaguauggacggcagagcggcagaguaaggaccucaagucacuuccucuuguauuuuugcacuccguaaaccuucccuugagucucugcugacaauaacguaaacuaaaacuucagacugauuucuaaaacuuuuggguuaaggucaagggaaaaacaaauacuagaaucuuggguuucuuuuguguuauuucugaccaaauaugcuagaguauggaccuaaaguauugauuuuucucaagaccgcauccuucugagcaucuggaaaggaaguggauugagcgggauauacugcccaagccucacagcaugaacguaagugucgugaccacagugcugacgcgcuuggguagaucuuagggcuuuuguuuuacucuugcugacuaaugggacuguauugaacuuauauuuuggagaacaguguggcaauggcugggaagaaaaucgaaguaaaaccgaagaccagcaucuuggguaccacccuggagaagguggggaugaaggcggaaguggcuauagcccuccagguaaacgggagcaggcagauuuguaucgccuuccugaagacuuuaggccauacaccggcgguucgaagcaggcagccagcgugauuacguuuucagauccucagagggacaauuuucagguaugguaagaguuugacugugaagaauuugugugugugcaaguacaugcauguuguuuguguguuuaaggaagugcaugaacgcaguguacaaaugauuuaauaacuguuucuccaaaucuacucacucggguuccugcuaaaucagcuaggcuggauucuguuuauaauuuaaugcaauugcagugccaagccuagcguuuaaaauggaagcuuuuuggaaguaguuauuuaacccugaagguugggucugucagggaguagccccucaguuacuguugcuucuggcuucugugggccugcuucccccgagaagcauacagugccuuguagcagcaacuucauguagaucacaguuccuuccuuuccgugcucuccaguuucaugaugaauuuaagucuaaugccucagaccccaucccugcacuguguggugucagagcugggggugggguaaugggcacugugcacugacuguggggaguucuaaaaaggcaucaggagacaguauguauuagaauuucucaaugacaagcagugccucauuuucccaaucgcuauucuguaucacucauuggcauuauuauuauuauuaauuauuauuauuauugauugguccacugguaguuauuuucucuaucucuggagaauguuauucacugacaaacaauagaauuuauuauacauaagaugguaucagauauucucauuuauugaccaugugcaucuuuuaugcucccaagguaguaacauuaucuugaucauuugugauacaauaguuauauacaaucucauugcaauuccuaaguuuuauuuuugaaauugacuccacugugugcucuaaaggacugugaaacaauucauaguguucaauaugguguguacuguuuuugagcacaagcugucuaugagacguugguugagccgggaguguaggucaguugguagaaugcuugccuagcacccauggugcccuggaaucgauccccaguaccacagaaccaggagugguggugcucauguguaaucccagcacuuagaaggcaaagggaagugucuaguaagauuauuuuggaagaaaagaccaaaucuuaauuguuaauuuuauuugucaucuuuuaauagcaauuugguuuaucucgaggacccagcuguggagcuuuggagccguauaaagcuguauauaagccuuaccguaacuccucugugcagaagaacagcucgccagcccaggagguagcagcaagugacauguuugaaggcuugcagcaacaguuuuuaggagcuaaugaaaguagguguucugugucuauuuauucacuuagcuguucuugcuguuuuguuuugagcuagggccuugcuguguugcucaggcuggccucacacucauggcaauccuccugcuccaagcucccaauuagaggcacauguugcuacacccagcuauuuuauuuuuuuauuaagguaauuggggaauuuuaguagauaguuguauacacuuucaagaauuaauauuuuuaaaguuacuuucaaaaagccccuguuuccuauuuuaaauguauauacugagguauuuaugaacaaacuaauacacucuuggauguucauuucaaaauacuauauugaacucuaaaguggugguucacuuauaguccuagcucuuaggaggagggucaggaggaucugacaccaguuagggucagcuugaguauacaguggcagcacucaaggucagcccgaguacacggugggagcacucaagguccgugugaguacacagugggagcacucaaggucccugugaguacacagggggagcacucaaggucagugugaguacauggugggagcacuuaaggucagugugaguacacgguggcagcacucaaggucagcccgaguacacgguggcagcacucaaggucagcccgaguacacaguggcagcacucaaggucagcccgaguacacaguggcagcacucaaggucagcccgaguacacaguggcagcacucaaggucagcccgaguacacaguggcagcacucaaggucagcccgaguacacaguggcagcacucaaggucagcccgaguacacaguggcagcacucaaggucagcccgaguacacaguggcagcacucaaggucagcccgaguacacaguggcagcacucaaggucaguguguguacaccgaacacucuaggccaaccagaguugacuggugccugaauugucuggugagacggcuguacuuugucucaaaaaagccaaggguugcagcugugacugcugcucaaugguaggggcaugugucucauuuguaaggcccucauuuucauucccagccccucacgagaaaauguugguagggagcuuugcuggugggauaaagagaacauaaaacugaauccuaacugcuucuuugggaaucauuguguugugcucccuaauguagcaauauuugacaccaaagugucugaggaaagcuuuuguccugcguauuucaguacacuaagugcacccugagcuuagugcuuuucuugucugcuuuggaacaugaauuccuuaucuccccgggcuuagguuucucacucugaaacguguaauuaacacuucagccaugaguuucuucauuuuuccuuuacuuuuacauuuuuuagcgugaugauuguacaaacuugcuguucagaaucgaugcugcucucagguuuaguuauguguuacuugcccccuguccauggucacuguuugguugcuaugacgaggcauaaugacgaaggcagcuuuguaaaaggaagcuuuuaauugagccucaccuagaguuucagagguguaaucccaugguguggagcaugucuguauccuugcugcuauuggagcagucgccgagagcuacaucaugaucuguaggcagagagcgacagacagacagacagagacagacagagacagagacagagagaggcacacacacugggcuuggcaugggcuuuugaaaccccuaacccccagugacacauaccacuuaaggccuccuaauccuuuaaauuagugccauucccuggagacgaaguauucagaguuuagggggccauucuuacucaaaccaccauacuccccagcccuuuucuuugauguagaguauguauaaauauguccauaaggaaaacacuugaagcagcuggagaaauuugagcugaaauguuaaagaaagaaagaaagaaacaaagaaaggaaggaaggaaggaagcaagcaagcaagcuguacagugacuaucguuaguguuuucauggacagaaacucuuaucaccaagcuccuggugaaugauugugagcauugaagcgccaguguggcucgagagugauuggguaagcuguccuuaauacuguaggacuccagggcuaggccagagagaacccuggacuacuuugucuggacacaguguugcucuaagcuuguuugggccacaggauagcuguagaguacaagagcuccuuugccuugaggcaucaacauccagugugaagaggcuucuccguauuugaagcacagugaaguacagggagcaugugguggagguggaguggggugacagucacucccgaucugcuccuucgggucccugcagucacaugcuuuaugucuuucguaacuguuccuaaaagucugcauuuuaccaaguuaauguauugcuaaggcgauugauuagacaucuuuuuaaaguugacauuuagaaguuaaugaauaacugaugguagugcccaauuuuccagcaauagcaguuaaagaaugagugcaaccagggccacagaaccucaugaagaaaaccaugcauguucuccuucauacgggaacucaagcauaagcguaauauauggccuaugugcaguauagcauauauguaaacagauauguaaacaugaagaaagaccaagaaaggcuaauguuggggaagaagaaagacgggcuaggcaaugaguccaagcuccgaagggaggccugaccucaucccuugucuguuccuggcucggacucuguuuuugaugguggauaaguacacgcggcauuugauagugaacuguacacuccaauguucuacagcuucuguuugaaugacuacugcuuagaaguuuauuguaaagacuugggacuggcuaguuuuaguauaugacuuuuucuagugucauuuuuuuuuuuaauaauaaaguuuaaaauuaaaaaaaaaaaggagugaauucggcaugaugaagcuuugagacaguuuauuuauacucccuucuguaaggcagagggaugcuuuuaauguucagauuuuuuuccuucuucauuuuuaaagaccaggucuuaguacauaaagccuugguuuggaacuugcucuguagaccaggauggccucacagacgccuaccuucgaccugagugcugggauuaaaggcauguaccaccaugccuggccugacauuuugguuuuuaaauuuaaaaaagaguacaaauugcuuuguuaauaaguauuuacaauuuucuauauguauuuauugauguaagcuuacagaagcauuagacaaaugaagagugucauuauggaguugaaguguuagucuucugauaccugucauuuggcuuucuccucugaucuaaguguuuuuucuacaaugacuuuguuucugaagaaggcgucagaggucgcuccucucuucauugguuaauuaacaugguuaauuacuauuuuauuacuauauuggccauuuugugccaauauaaacauaaaagacugcauuuccuuucuacuaaagagagccuuuggcagggcuaucggguguugucccuuucagguaacgugagagcagguuccgugcuuguuucaccccuccuguggcgauggcacauugcuguauugcagcuguguguuaguuguccacauuuagauagugagucaggcuuuaacccagagauguucugccuauccuggcgguaacccaugguaaagcguguaguauguccugcaguaguucucacguaaguggaaccaaagcuucacaaguccucacuauacaauguucugauguauucuagauaacuugucuucauagucaaaaggaugcuagucacaauccacugaauugguuucaugauauucuaccaaguuguuuaaaaagcuugaaauacauuacccuagcugaucacagaucuuaguauguuuuuaucuaauaaauugucucuaauuccaaagcagacucugcagaaaauauacauauuauucaacuccagguucuuaacaaagcaaaggagagacaacuggacagcuugguugaaaagcugaaggacagcgaacgccagguucgguaucugagccaccagcugcugauaguccaaggugaggugacgugggccaggcagcuggugucugaaacucgcuuuguucugcuuuagcuuccugggauuuucauuuccaggacccucauuugaccgaggcagagaacucacaugggucagaacagaucccaagcccaggacuucugugccugguguuuggagacauuuuucuuuucuccuuuucuucuauuucccucuucuucccagguauuagacucagugagcuagugagcagugcccacugugcggauggccuuccacacuaacagcugugcauguugucauuaccuucauaaaguaguccacuccuaggugacauauuucauucauaacgcagcagaaguuaggggcccucauugccauuucuguguaaccauauggaggacgugcaucggguccuggcugcuuauucuucugugcugucgcuuuagucaguguugaguguccauuuguagaauaauuuugugacagcucauuucaaauugaauugauagugaagcaauagcucuuuuuuuuuuuuuuuuuuuuuuuuuuugguuuuuccagacaggguuucucuguauagcccuggcuguccuggaacucacuuuguagaccaggcuggccucaaacucagaaaucugccugccuuugccuccugagugcuggcauuaaaggugugcgccaccacgcccggcuaugcaauagcucuuucuguaauguucacaagcucuuuugggagagaugaauaguguauuuggaaggaccaaggacuggggauuucaagaguuccuuccaguuuaugaaggggugauuggcccuagguaccugguuuugggaguuagggccuuacuguguggccucgugaucuucaaccccucaacccgaguacugggaucacugguguguacagcuaugaccugcucuaggacaccguuuugguugacaugagcguguaccuguggagcuccucaagugaacagaugcagaggcauuggggauccuuugccacgaagguuacaauagggauuuacaggcugugccucugguucuuuaagguuuuuuuggcaucaaauauuuuuuaaauaauuauuuugguuuuucuuuuuuucaaaagccacuaaaauucauuugucugaauugaauuucauucagauauagaucucauagcaguugugacaauuauugucucacaauggggacagcauuuauguaauaucuuucacgcuccagaugaaaaggauggcuuggcccucagccuucgggaaucccagcagcucuuucagaauggcaaggagagggagaugcagcuugaagcucagauugcagcacuggaggcgcaggucgaggccuuccgaguuagugaagagaagguaagcuuuagcucagucaucagaaccucaggcuggggcuggggcuggggcucagggcuuaagaacacaggcugcucuucggaggaccuggguucaauucucagcacccacguggcagcugguaacagccuguaacuucaaccccaggggaucccaugcccucuucuggucucugugggcaccaggcacauguggagcacagggcaaaacauucacagauuaaauaauuaaauaaaaaauuaaauuuaguuuguauaaggccaaauugaguggagcucuaucacagguguccugucccucaccugggaucaccugugggugccagaaagagauggcagcucuucccuguugacacccgcauuuccugcaucuccauccuuucuggguuuuaugcucucuaaagucucaacuacucuagcuauacccuuucugcaaauucucuucuugccgcccaaauaauccuuccagaauauggugcuaacuuuguuauucucuuacuuaaaggcuuugcaggaugugguuuacugugggauaaggggaccuuccguccaaggucaucucuuccuccucucuuaguuuuguaugccucuccuugggagugccuguuccauagccacugccaucugacuaacuagcuccgcuucccuuguuuuacugccaacacucucguaacagaguuccuagaaggugccauggggcuagucucaugcuuguagcucugccauccaggccaguauuuggcuaauagucgguggccaguaugugcugcauguugcuuaaauuaacuuguauguauguauucuuauguauuuuucuguuccuaugugaaauuugucaugauguaguuaguuaugguguauuuuuaaauugacaaacaaggguugucccuguucaaaauucuuuuaauuucccccucauuuuuucuuuagauuuuuguacaucaauauauguuuuauaaaacaaaaaucugcuuggaauucugauugcaaaggcacugggcuguaucauuuuauccgugugccaugcaggucuuagcaggccaguuaccugcucaagagcaugaagucaauuacugacaaauucugagagcauaaagaucuugagccaaguaguucccuuccgagucuccuuauuuuaagguuauaugauuagcagauuuaaucccaucugcaacuuaauuuucucuugcuguaaagcuuacauaauugcagauuuggggcaucaggaagccauccguggcuaaucacccacaauaccagcaauguuuucagaacucuuagugcuggggaguaguggcaugagccuguacuccguagcuacucagaggauucaggugagagaugaucacuugagcgugggaauuugaagccagccuuggcagacaauggugcccuguuucaaaaaagaaaaccagaaaacauuauuuaguaagugaccauucagagguccgcagucuugggaggagcaacacauuuuucugugacccugcaguuggguugccccucacuuugcucaaagaacgaugcaaacaaugucagggccaauauugccccagcaccaccuugcucuucagaauccucauucucccgcagcauggaacugugcagcccagcuucucagugaguggcuguucccagcaacugugggcuugagaauagcaaccgggggagggucaaggagcagagagguaagaugcuaucagugugguacccuguguguguuugcuagcucaccaagaagcucagaacaaccgagaucacccuggaaagccugaaacagcaacugguggagcuccaucauucugagucacuucagcgagccagagagcaccaugaaagcaucguugccagccucacacagaagcacgaagagcaggugucauccuuacagaagaauuuggacgcuaccauaacggcccuucaggaacaggucaggcgauuccuaaugagcaacugucaguugaguaaaguuggauauuuugugguccucgagguagaaauuuuuuugguaaugauagguauaaaauuguaagugagccugagugugucuccaacccuguuuuuggauacugucuuagucaggguuucuauuccugcauaaacaucaugaccaagaagcaaguuggggaggaaaggguuuauucagcuuacauuucuauacugcuguucaucaccaaggaagucaggacuggaacucaagcaggucaggaagcaggagcugaugcagaagccauggagggauguucuuuacuggcuugcuuccccuggcuugcucagccugcucucuuauagaaccaagacucccagcccagagaugguuccacccacaaggggccuuucccccuuaaucacuaauugagaaaaugccuuacagcuggaucucauggaggcauuuccucaacugagacuccuuucucugugauaacuccagcugugucaaguugacacaaaaccagacagugcagauaccuuucuuguaggauccacuaguaccuucucagaccucacaguguaauauauguguguguguguguguguguguguguguguguguguguguguguguguguguauguguauguauauauguauguauuggccuugucgucauagaguaaaugccagcugagaggaauggguauacuggcacuggucagaaccugagcuugacccgggagcuugaucuuuuguaggugucugaguuuccagcucucaguaaggaguguugagaaaugguucuuuugagaauagaaguuggauaucuugaauccaguauucuaauggcugaccauagaaauuugcacccuagaacucuugcggacagguuguagucaguauuauauaagaaaaaucuuugaacuaaguguauuauguauauacauguccuggcuaguuuucaugucaacuugacacaauaagcuagagucacuugagaagggggagucucaauugagaaaaugcuuccauaagaugggcuguggucaggcuuguagggcauuuuuaaaauuagugauugaugaaggagggcccagcccauugugggugggguuaccccugggcuguugguccugguuucuauaaccaugccaugaggagcaagccaguaagcagcaccccucuguggccucugcacuagcuccugccuucaaguuccucccugcugaaguuccuguccugacuuccuuugaugauggacagugauguggaaguguaagccaaauaaacccuuuccuccucaacuugcuuuuggucaugguguuucaacacagcaauaguaacccuaacuaagauaauaauaacauuaaguaaauuucauguuuaaucucgaguguccucccuaacauaacuguauguuuucaaauuuuccaaaagugaagggucucccuggauacucaggcuguauaauguacaaaacagggaagaaagcccgauacagaugggcugcuugagcauauuguacaacugacuuuuguguuugugucuaagaaggagucaguguugaaggcucugcaucaaguagcagcuuaccugccuuguguccagagcccuagguugaaugaauacaguuucagguugaguuuugaauuuggguugaauuuaagaacuaauuuagcccuagagacgaagggaagaaacuaagacaggaggguggaacaaaccucccaagauucccucugauuggggcugccaucucugucuucguggccaacucuaccuuuucccggguucaguagacccauaaugacagaguaauuguuuguguaacauuuuauucugcuuuuuuuauguuauauguuuuauuuuauuuaugacucaagucucacauagcucaagcuguccuuaaacuugcccuguagccaacggugacuuugaacuucucaucuuccugccuuugcuuucugagugcugggcuaugacaugcacacccuuguuccaguuacaugcugcugcugugugccccggguuuggugcaugccaggcaagccagcauucucccuacucauucccaguuuauuuuauuuauguguuuuauucaguuuguuaauuuuuuucuuuuacauagaaaauauugugaauuuggugauagugggggguuucuagggugggaaaagauaaagguaugcccaguugaagagucugcuguauagaaacacaacuagaacaaacuagaauuuauuguuauuuuacuuuuuucugccaauugucuaaggaauuuuuuauuuauuuaauuuuaaaguaggcuuuauuauaaaaagacauaaaauauacugaaauuaagcaaaucuaaagucuauacaguucaaugaccuauauauagguagaaaucaguuguuauuuuauuuuuuaaaauguuguuuauucauauuacuuuugauuagcacagugguauugcacagccaucagugguccuuggccaguuuaggacgguggagucugucagcuccugugugguguuugaaaagagcguugucucugcugacuugacgaucucacugggaugugggggaggguucccaguggguuuggaaaccuuccuuguaggaaugguugguacaaauguuggcaaagcccacauggcucucaggacaaccccuggcuuugucuacucuaggacaaccacuuccguccagucuuuggucauugcaggacaggucaugaucaaagcugugccucuuuaucuguucccaugcuugccaucaccacuucaggagagggacuuagaccagaagguagaauagaaucuuggaucugugcaaaaugagcuuccgguuccaaaccaugagcuauauuuacugugacuccuccccauacucuggagugucugucuaccuggcaguguuuauauggcauccccuuuguaaacuugugaucaauuggcucagcaauauuuguaauaaggagucaaauacuuguacccaaucuguauuauuuuauaauccaauugcuauuucuaauuggaagagugcaacaaaagacagguucacagcaaaagugagagagcaacaaagaauuucccaugaucccaccuccuaccccugggcuuaguucccuuguucucacagcuugacuuucacaugcucaugggauguguauaaacuauaacuucguauaaacuuaaggcacucaguuuguugacacccacaggguaacuugcugggaugucaagaguacauggacuauguaggucucacugggagcgagcagcaucucuacgauauugagcguuccuaccacaaagauagaguaucuguccaguuauuuaguucuuuauugauuuugccagaguuuuguaguuuuauauuucuacuaaaggcccucauuuuuggagugguauuguaaaggacaugacgguuuuuaaauuucauauucuauuugcuccuuccucccuugggagacagcgacuuuuuuuuuuaaagauuuguuuauauauuuuauguguaugaguacaccauugcuuucuucagacacaccagaagcucccauuacagaugguugugagccaccaugugguugcugggaauugaacucaggaccucuggaagagcacucagugcucuuaaccacagagccaucucuccagccuagacagugacauucuguaguagcuuccuugcacuccugcaauugcacacucguuuagugguuucccuccugguguucuguguagcagagcagagcauucauggacaaagcuuuagugucucuuugcugucuguguuccuuuuauuuuccuuucuuaccauagugcauuggugagaacuuguaacaugaugcuccaaggcaaggaagggcaucacuucccugguccucacccuugugggaaaguuccagguuuuccuguuaaguaugccagucucagaaaguuuauaaggcuuaguuuucuuuuaaaucacaaauggaugcuagcuguauuuugaaagauagaguucaacacagagacugcccaguugcauguaaugggaggugugacagucugacacagcugaguuuuugaaggucugugugugccuggugccauuugagaacuacaugguaauaaccuauuauaaccuagagcuauauagguuauaaccuauuauagaccuagagcuuuccuuaaacaccaggucuuucuauguagaaaagacuguauauacaacuuauuguaacaacucaaaacugccgugaccucuagaccgugagucugagugucucgccgucccucacgacaggcguuugugugcauucccauuagcucaucgugcugcaggcauguuaugcuggcuuguuagaaccgugcuucccaagcuggcuggggagcagcagcagcgugccaagaacuuugcagcacuaaauaaacaggcacugccuuccagaagcuucauuuugcuaaaacucugguagaaaaaauuucaagcaaacacagcugcauugugacauagaauacaaaaugcccaggaguuucaaagcaaagcgagagcccucagagccccuugccuucacacaaggacacuccuguauuauuuacguuugggguggguaucacagcauucaugcugagagcauuacugagguugaggacguggaagggaaucugguaccaaaggcccaugugcucucccgucagagcucuugcuaaugguucgcuuagggcuucucuggucgcugaagacuugcuacacuguucuaccucuuccaugcuuugauugacagucaccccgagcagcuuuuaggcgagaagcaaugguugcuacaaugauggguucuucuaccugggcuucaaacucccauagcucuuuacuuccaaauauguuuccuuauuggagaaaaguuuucuguaugcacaguuucucuccacaucuacauguaggggacacugaucuugccccauaguguguauuguuuauauacccuauugucacacacaacagcuaccaugucuuuuugucauuaauuuuucaaguaucauuauaaugcuuguuaugcauaacauauugcagagaugccaucggacagaaauaagauguguaacugguagaaggaggaauaucggugaaacagauuagauuuaaaagaaacccagaggaggguaauguuauuuuggcugcccuggacagagugagcagaauagaguucccgaguguucuucuguuuccuggucugaggauucggauuccauggcucaaagugguuugccuacauuuguaucgauacguuaacacagcauaaaaugcaaacaggauuguaccguguuuccuuuggcaugaguagacucugguuuuagaauaacaguaucuuacaggugcccuguuagcugggccucccucucaggucacaaguguucuuuucccauccugcgcacaggcuaaccugugaaggagaucauacuaccaggugaugauuuugcaucugaugguuuuaauuucuaccaaaacugauggugaaaaugacuugccgccuuuucuucuguucaggaaaguauuugcacgcguuugaaggaccacgugcaacaacuggagcggaaccaggaagcagucagauuagagaagacggagcucauuaauaggcugacgaggagucuagaggacagucagaagcaaugugcccaccugcugcaaucaggugcgugucuugucggguguccccagggcuacugugaaacaggcuggaucccugaacuacagcuguacuuguuauugucauguacgagggggcgugggcuugcaugugcuugucaugguucacauguagacacuagaggacaucuuccauaguugguucucucuuuugcccuguguucuggagcugagacucagguugucuugcauccuucccaacugacuuguauugcaagugccuuuacccacagagccaucucaccagcccaggucccugagguauagaagagcuagaagacacagaaaaguccacuaguggucaguuucuuuuuagaaaggauuauaugugcaguucauauuaaaggugcgguucauuucuguuauguaaucuggaauacaggcguguguaauauucuaaauaaacaucagcugcaguccucugagaaacuagugcuguggugccugaaacugcuucccacugaggaaggggaguacucgccagguggcgcucugcuuccacagaugcagaaauccuguccucagccaccuuugacuaugagagcucacuguauuugccuguuuuagacccaauauuugauuaaguauuuccgucuuuuuguuuaacuucagauuguuuauccacucacggugaucaguggacacugaguuacauuuuugucgcuaugaauauuugaguguggccucugugguaucugagacgagcuuccuauacuuuuuguggcccugguaccuuuaauuauuuuuauaaaaugacauuaaaggcacuaaaaugucaaguugauacacaggcuguggacuagauaaaagucaaccucauuucugguugacaaaaucagucaucagugcuuuuuuaauuaacucauagacguacaagucacauuuuggcauaugagguagugagccaguuuggcauaugaggcagugagccaguuuggcauaugaggcagugagccaguuuggcauauggggcagugagccaguuuggcauaugagguagugagccaguuuggcauaugaggcagugagccaguugggcauaugagguagugagccaguugggcauaugagguagugagccaguuuggcauaugagguagugagccaguugggcauaugagguagugagccaguuuggcauaugaggcagugagccaguugggcauaugaggcagugagccaguugggcauaugagguagugagccaguuuggcauaugaggcagugagccaguuuggcauaugaaguagugagccaguugggcauaugaggcagugagccaguuuggcauaugagguagugagccaguuuggcauaugagguagugagccaguugggcauaugagguagugagccaguuggacauaugagguagugagccaguuuagcauaugagguagugagccaguuuagcauaugagguagugagccaguugggcauaugagguaguuggaacagggacugugguuugaucagggagaaagcacuaaaguuaacggcugugugugcucugcugaggaccagauuuggacccuguucccuuuaggcucuccuggcccugcuuccccuugccaugacuuagugagucguuccuugacuguuaaagacucugaacugugaauacuucccccagcuguuucugagaggccuguuuucauuuaaagaaacccucaaaccacccuuucaacuagagucucuacuaguacauuucagauaugaguuugcuggggauggggagguagcucagaaguaaagggcacuucugcuauugcagacgacuagagucccauucauaguacccauggagugcacaacugccugcaaauccagccccagggaaccugacagccccuucuggccucuguggguggguguguacacagaagaacucacucugucugucugucugucugucucucucucugucucucugucucucucucucucucacauacacacacacacacacacacacacacacacacuaauacaaaucuuucagagaguaguaguuuuaugugugaguugggccuguugaaaauaaaagcaguuuacaaggcagcaaaauucaguuuaauugcagggcagaaaugguagggugggacuuucuuggcuccuguaacuggaaccuuauguccccacuagaugacuccugggcugcuguguucuguagaugcagcagcgguaaccaggcuuacaggguccagggccuugggcuccugcaggacuggaucucagauacacagggcuuugauggcucccauggcucccuauccguauggcccugaaucauaauagugaagcagacuccacgccaaacugugguggcucccaggccuguagacaugcaccuucuuucagcgacauacccuaugucucucucgcaggcucugugcaggagguggcucagcuacagcuacaguugcagcaagcacagaaggcccacguccuaagugagagcaugaauaaggcuuugcaagugaguacugucucaggagagacuuaggcaaugcugucuaucguaccuuuuuugaaccuuagguuucucugugguaaaaguggcuuagaccaucuucagaccagccagggaaguuuuucaggaucucgcugacaccacuguuaguuagaccuagguguucuagcccaguucugaugagcugcagagccaggccucugccuccuccugccagucuguccacugucccuccuggcucugcagguguauccuggagaccagagucucuacagguauguggcauauuuaacugggcccuguuucucacagauccucugucacuguaauuuuccugaaagguaacgaaggugcuggagaggagcucuaguguuucuuccacugaaggaggugcuaggccugcugauccugcaggcagagcauagcacacuccuuuagauagaguauaguacacuccugcaggcagagcauagcacacuccuuuagauagaguauagcacacuccugcagacagagcauagcacacuccuuuagauagaguauagcacacuccugcagacagaacauagcacacuccuuuagauagaguauagcacacuccugcagacagagcauagcacacuccugcaggcagagcauagcacacuccugcaggcagagcuuagcacacuccugcagacagagcaaagcacacuccugcaggcagagcuuagcacacuccuuuagauagaguauagcacacuccugcaggcagagcauagcacacuccugcaggcagagcaaagcacacuccuuuagauagaguauagcacacuccuuuagauagaguauagcacacuccugcagacagagcauagcacacuccugcaggcagagcauagcacacuccugcagacagagcauagcacacuccugcaggcagagcuuagcacacuccuuuagauagaguauagcaugcuccugcaggcagagcauaguacacuccugcaggcagagcuuagcacacuccuuuagauagaguauagcacacuccugcaggcagagcuuagcacacuccuuuagauagaguauagcaugcuccugcaggcagagcuuagcacacuccuuuagauagagcauagcacacuccucaggcagagcuuagcacacuccuuuagauagaguauagcaugcuccugcaggcagagcauagaaugcuuuuggcagguagagcauagcaugcucuuggcugagcugucuguuuugucuucuucuauagugaggccggaacaucagaggcaucucagcuaagggguuuuguaaauaagagagccacagagagaaccgccugccuuucuuccucguucauuugaaaauauauucauuugaaagcacagcaggagcugaccuuuaugaacuuauuuagaaugaauguuaagaauguauuucaagaggcuuuucugcauucuuacugaucaucaaaaugagguuugaaaagaaugacugauuuuguauuuaggaaaacagugaaaguuacuuuugauauuuuguucuaggaggaauuaacagagcuuaaagaugagauuucgcucuaugaaucugcugcagaacucggaguccuuccaggugacuccgaaggagaccugaguauagagcucacugaaucauguguggacuugggcauuaaaaaagucaauuggaaacaauccaaagcuaacagguacugugugacuaguuuacuauagaugaguuuauguuaauaaagcuggugauggagguauaggacacugguggcaccauccauaagauaaagaccccaauuaaggggacagugugucuuagacauucuuaaugaaauauaaaugccugaaauccaaaugaauagaaaucugaaguauuaauacugugcuuguagcccucgucaugcagauaggugccgguuauagaaagcuaggaaggaguuuauguaacuaaaauacagguuauggggucagggagguggcuuaguagggaagagagguugcuaugcaggcauaaggacccgaguucaaauccccagcaccuauguuaaaaagguaggcauggcugagugcaccuauacucucagcauugugggaagcugagacaggagaacagcugaggauugcuggccaccagcguagcuccagguucagggagaggcuuuguuucugggacugaaguagagugugccagaagagggcaccugaugcacaagugugggcacacaccuguauccauacacguguacacaccacgcauauuacacacauacacauucacacacacacucgcacaaacuauguauguguuugaaccauugaggugaaugccuguuuuuaauguuagccuuaugggcuaaaaguaguuaucuugcacaugugacuuuaggaaucuugcguaugugacuuggggaagucuguguuuuaacacugccauuacagauuagagcaguaaggugggauuuuguugguuggaaucuaaagucaugagauaauccugcaagggaagcugcucuuacuuagccuugugaggcuccauuugcccgagugucugccuccuggggcuccuguugcuacagauaacagcuaugucuggaagagagcaaggaagaagguagcggggcuagauggaggauuucuggugggagcgauccucaggcucuuaucuagggccgugucgacccagguuucuuuucaucccauaauuaccugguugacaaauguaggccacugugccugagaugaaguggaggggaccccugucagcucagccuuagcgagcugagagcugagagagaaguguggaaggccaggcaaugggaaagugacucucagugugaguguuuuaauccagccacaugguaucgaacaaaggcuuucacuaugauuggugaauaaaaaaaaaaauucuauuguuuuuaugccuagguacucacaguuuacaguuuaugugacuauuugaaaacagacuugguugggaaugccuccuguuuuuggucacugccaaaugacuucucagagccuagagaaagaacacagacuucagauacaaaccauuugucauggcuuugccucucagugcuaggcaccugcccuugcagcagugucguacguuuuauaaagcauuuugguccucagucuugugacagauguuggcuuuacuggagcuuaggaaggugaaccacuuggcucagguguuacuggugccacaaaacucucuaggcccagccuauuuuucuguuuguucacauuacaugacagucaagccuuuuuacuucaaacuucauucuucuuaugucgaagauuaaagacauaguucauuuaaaaaacaaguuuuucuccaguuauuuuauuuuaguuuguacuguggguggcuuuagagcagagugaugaguguguucauguugaucucuuucaauagacacccuucgugugcauccauuaaagcgcauccuacgucuugugcuuuuuggggguugguuuguuccuugagguaagauauugcuguguagcccagguuggcuucaaaugaacagacuggacugccagucgcuaggauuauuggaugcaggcugugccuggcuacucuguucaucucucuugauaaagcauucauagcuacaguguagcaauccugaaguguguuccuguaccugcuagacuggaggcuucuuguuacuucagagugacugagccgcccagcugggagccggggcaucucugagucagaguggggaguugcuagagcucuggacaaaccgucugacaaaugcagccuccagaggacaaauguagcuuaaauccucacccaccugccaguguuaauaguuggucaucuauuuuugagaaguauucuuauaucaaguuuacaggacauaggaaagaagaaauuugugcuuucuuuuuuuauuuuccuugaguggacugauuuguugaagaaaaggaagcgaaaauucccagugugaguuaguguuuucuugacuugaacugcuuucaaaucacugacccagguaucaguggcucccagcuuuuacuaccaaccaccacgcccucaggcugcuuccuaguaacaugguuuagccucacuguucuauuuuacauuaaugggaguggaguagcuaaaucuguacacagcuuacagacagcuuccucucuguuauuauaguuggcugcuaagcucaaauaauaaacaucuaacaaguggaaugccuuuuuccuuuggucuucucagcaggcuucauaagggacuguaguuuauuuggguuucagggaaaggaucucuguagggugcugugauccucgggcagaguggucaccgcucugccuuucucucccgucaaggaagggagagauuauugcacaagcacgcucucugcucucugacuuggcuucucuaggaguacagagugugauuccaguggccugugugcaguggaagaggaauagggagggcucguuugcuagcugaguaaacacaguuuacucacacugagugcucacacuucagcacaucccauagcggaauacuuuguuagguauuuuguuucuuacauagcuauaccuguuauaguuaugauuucuauuucuguaaaaauggaacugauuuaaauaggugaggauuuauauaugcaaacauacacauagacuacaucuauauaguuaguuuuauauauauauauauauauauaaauauguauauaugaaauauauccauccuagggaguucuaauuauauuguuaaaacuaaauuuaccuaaugguuuguucauccuuucuucauacauuguacaauguccuaacacuucauuuauuuauugauuuaucuuaauuuuuaaugacaaaaccaaaaauauaccuaaaagugaagcuucuggaaaaaccaguugcucuucccuguuuuguauugcuccucugacuugaccuuggccucccgccuggccuugcguuucagagcugagucucugaacacauccucacuggcgacagucuuguccgaggggcuauccagaguaccugugggcacgggguggauguaaacauucacaaagggcuugaucuuggguggcuugcccauggcagcugucagucaauuccagccacgaggacaccgcuauaagggccuuccgaggugccaucgucaauguucuucacgauggcuuuguguccagucaggaccagcaccacuuucccagguuucaugaacuugcccauuucaacagcaagcagcgggcacccagcagaaaggaaagaaggaccuaacauuucauuuaaaaucaucuaaaaucuuucaauuccaggaguaaaaacuuuaacccagauaucguuauuucuuucuuagauagauuuucuccuuuggagagauuauauuuuacacaguucuagaugcucagcucucgugcucccugauaacauuuuguauuaauucuuacaauuaaugaaccaauaaauuuacauuaucgcucaugucugaggucucccugacugucuuuaguuuuuaccuaauguuuaugacuuuaacauacauauuagccacuaggaaaguguuguuuagaaacguaugugacuguuuucaaugaagaaaaaaagagaggcuuuuauugagaguuucccacuugcauggaauguauugugacccuguuugucucccggacucuuccuuuagugcuuccuagcucuacuccaacuugauguccuguguuguguguguguacacgaguguguuuguuuuaaauauugagucccauuuguauuggcaaucuauucaaggguguagggcuguccacugaagcaugggccuaccagcauccaugcccuuaaagaaaacugacucuucccccagcagccagcagcuccuuagcugagaguggggaccucagaagcacccaguauucucccugcuguaauggugacucauuugauccugagcaagucuuuucuuuuuuuccuuuauaauauacuuaucuuuuuuuuguuguuguugagaauuucacauaugcauacaaaguauuuugauuguaugaauccucacuccuucccuaucucuuuccugaucuacccuuacuucauauccaccuaacuuuccgccuuuuuucuuuuuucuuauucuuuucuuauaugucaugucugcaguuuacccuccccccccccccaagucucuuacucuaccucuccucucuccuagguaucccccucccccuucucucagaaaagaccaggccucccagggaugccagccaagcaugguauaacaagccacaauaagaccaggcacauaccaucacaucaagacuagaccaggcaacucaguaacagaagggucccacagucagagacagcuguggcucccacuguuaggaaucccacaagagcagcaaacuacuuagccauaacauauaugaagaggaucuaggucagacuccugcaggcucccugaucucugcaaggcccuuuggguccugaucaguugauucugugagccauguucuugcaguguuucugacccuucuaguuccuucaauccuuccucccacuccgcaggaccccccccccccccaauucugccuaauguuuggcuaugggacagcaucugcucacaucaguugcuagauggagucucucuggucucucugaugauaaugcuaggcuccacuccuaagauacucugcaggcaggacaaacuguaggucgaaggcuuuguggcuggguugugcaggucuuuucaggcagccauagcugcuaagaguuuauaagggcagaggucuuaucauaucacacacacacacacacacacacacacacacacacacuaauaaaaugacuuuaaaaaaauuagaaucuuauucuaagccuuaaguuuauugaaacuagaguugaguuucgagacugggacccagcucagcaggagagcaccuggguagcaugcacaggccacuagguccagugcuuacuacugcagagaaaggcaauggacaaggagagaggagaacgcggagucuagagaagcuugguuuuguuucaguuuucuggagguugccgggguccacccaggcucuugggucggucagcuggaagagagaagagcaguugcugguuaggauagcugauguugcuacuuuuuucuuccuaauaucuguaucaccuugcucaauauuaguaugacacauaccaaaaaucacaagugugagcugugucaggcagaaagaccaagggggagcaugccaccaaggggagcaugccaccaaggggagcaugccaccaaggggagcaugccaccaagggggaacaugccaugugugggggggugagcuugcuuuugcaaaggugauauccuuguguaugaccgaguucuaacuuauuuauuuuuguuuuauguguauuaguguucugccuguauguuuguaugugcuuuguaugagugucuggugaccuugguggccagaagagggcaucagauccccuggagcuacugaugguugugagcccccucguggguacugagaauugaauccaggccuuccgaaagagcagcacaugcucuucauuaccaaguuaucucuccaauccccaaguuccaaacccuuuagcagcguuuagcucaguguuagaaugcuugccuagcguguaugaagcauaggaaacaaagaaacaaaauguucagaaagaaaguucaaaaugcugugacuguaagggauagaaaccaugaccacauguggcuagggcuuuaugggucuuugauuuguuucuugcuuuuaugcuaaacgggcaguuuccccaucagggucacacagcaggaguccccagaugaagacccuucgaaggaugagcuuauccugaagcugaaaacgcaaguccagcgcuugcugacuagcaacuccgugaagcgacaucuggugucucagcugcagagcgaucucagagagugccgggagacaauggaagcuuuccagcaauccaaggauggugacagcggcauggaggugagacccugcaaccuguacacguaagaagcccccuugagacaugcgccuuauagauggaaguuacguuuuugguuucuuaggguuuauuugacucuuagauguaaagcuuacaggaaaaaaagccaccugauagauaggcuguuuauuggcuuguuuuaggcaccuaguaaaugagaugccaguuaggcuaaauucuuuguucacaaaugaaaggaggacuuuguagaggggaugcgccuuuugucaggcaccuccugugaggccccuuagcagcucugcuccugagcgcguucuguucuguucuguucuuacaacgguuggucucugaggaaaugagguagagagcacuggucgauacuuacuucugagaugugucuuuuagauuuagugaugguuuuacucuguaauccuggcuagccuucagguuguaaucuuccggcccugagcacugagauugugggagugugcuuccaugccggugucugauauccaccucagugcucuuuagcugacaucuucgaggaaaaugaagguaggggagucuguggcgcucugagguuucacauuuccuacauuucuuaggaaaugaaguuacacuucaugacugauaggggucagaguuacugcuggaagcuccugcagucagagcuugagagcagccuuuuucuuccucauuuugacaaacugaacauuuguacugucaagaaaaauaaugcagaaaugaauugauaauuaagaaaagaaagcggaaguuugaaaggcaugcagggaguguaauccguuucuccagaaggaaggaaggaaguuuuaaucugacugcugcuuuuuuauccccugguucuuaugugagaguccuguucauuaacaaauccugucaaaauaugugagauguucugagggaccaauuuuuugugauauuaaaagaaaacuugguuacacccaugacauuugugccacaugugggcaucuaucucuuggcauaugaaucaguaucuuaguucccagcguucccagcugagugagacuguugacuuccucucacccccauacccccaccuccgaccccccagcauucugcauagcaucuucugguaguguagaagcuagaagguugguuuguuuuuauuaaacauucuaauuuggacuguauuauauaaugagugaucgacuuucaaauacugcguggacucuucuuucccagaucuuuauaauagaacuuggaauuagucuguaaaguuagaaagcauguuugggaugccuugggaggucuauggagagagagagagaaugguuauucauuuuuguuuuugaaaagaugcguaagauuuugugggauuuacugguaauagaacuaugaggcauacaugaauauuuaaaaguuugauuauguggagccacauauaacuguaguacuuuggagcaucaucuacauuuaaacauuuguuucuauuaaaaauuaagcuggcuguggugguacacaccuuuaaucccagcgcuugagaggcagagacagguuucugccaagaggcagaaacugaguuucaggccagcuugcuccagaacuacauagugagacgcugucucaaacaaaacaaacaaucaaagcacauuguuuugugguauuuccaggcuacuacaugguagagaucaggagacugcucauauacugcguuaggcaguguuuggguguagaucagauaugccuuucauuccaguugaccaacugggugguuaaggaagauuguagugccauugcauacacuagcaagauuuuacugaaaggacccagauagagcugucucgagugaggcuaugccagugccugacaaauacagauguggaugcucaccaucaucuauaggauagaacacagggcccccaauggaggagcuagagaaaguacccaaggagcuaaagggaucugcaacccuauagguggaacaacauuaugaacuaaccaguaccccggagcucuuguuucuagcugcauaugcaucaaaagauggccuagucggccaucacugcaaagagaggcccauuggacuugcaaacuuuauaugccccaguacaggggaacgccagggccaaaaagugggaguggguggguaggggaguuggggggguggguaugggggacuuuugggauagcauuggaaauguaaaugaggaagauaccuaauaaaaaauuaaaaaaagaaaaaagaaagauuggagugggguuagagagguggcucagcggccaaggaugugcagcugcuuuugcagaggaucugaguuugguucccagcacucuuguugggcagcuucauggacuauggugcccuccuguggacacacacacacacacacacacacacacacacacacacacauacugugugugugucuauuauagacuauguaaagaucuuaggaaaacuauacugacccccaacagucagaguccauauacugaauucuuuuuaaacauaaaacacagaaagcuuuuugugucugaucccuaguaaauuucuuuuguauguguuugugugguuguguacauuugucagugugcugaaaauaagugccuguugagggaucagccauaauauacaacauaucuacgccacccucaacaagaagcaaccgaagaaaguguaauuuuaccuccugguaaaggguuuggcuuauugugguggggaaggaagcagagaaagauggcugcuggcccucacccaccuuccuuuuccuuaacucacucccaggcugcaguucaccaaauguugccacauagguggcccuucccgucauccuuaguuacacuccauaaaaaaugcucucacaggcucgccacucacugaagugugacuccuaggugauucuaaaugcucagaaguugaugaucuagacuagcaauccuccuucugcccuuucucaacuuuacacccaaacauagcagcuuuaaucauaacauccaucucugaugcccagguaaacucuaacucagauacauucagucaggaacaugaggccccucugcaguaaucucuaauguuaguguuguuuucuccaggcuugccaugucuguaaguuuaaauguauucacauucauuccuuuuccuuacaaacugcacauuuuuaguaucuuucugcuucaccugcucucucuuaccugaucccuaacugagagcagcccagagcaguaagaaguagccaugucucagccgagaugcugugaugucauaacuuuucuuuuccagaauggauuaucccauuacuuucaccuuuagccucacucacauucucaggaugcggcagaaugcagguagauucuuuucuagaauguuacgcaauggccuuguaguccaguugccugcugaaacccagaaagccagacgucacugucugcaugucuguuauccucccacgaucccagcagaauagcccacugcgcucugccuauagccauucagcauuucucuagcuuacagauccaaagucucuggaauuccuuuggcaaaucaguuuaaaaagccaauuagccacauguuuauguggucagcgcaacaggcccccuccccccuuuaaagcaaucugugacaguuuucuuaugacuuugaccagauaaaaucauggaauagauuacagguauugucguaaacuaaguagauguauuaauucccauacagagaguaaggaacuuauagauaugggagcauucgaauggaagggaacacacacagucuuguaaacaaagaggugccacucuggggccagcacagaauucagucgaaagaacuguuagcuuccccuuucccauccagcucagucccugagaauaauugcugauguuagcggucagucgagaggauggaggcuguuccugcacccccuggcaggaugcucguguucaugacuugccuggaaagcagugggccagcguacaucauguaccuuaaaacgguaucuacugaauuagguacagaaugaggcagugcugguacaaaggggcacagagcagaguaugugguaauccuauggaguaacuauucucaaaguagccuucuccugaggucugagguauaccuuacuaauuagugugugagacagcgaguggcaggcgugaugccugggaggcucugcuuucagcugguccucacuaguggucagacauguuuuugucccaugauucuuaaaaggaacauauaucauuuuuuagcauuugugcuagagaugccuauccugaauuuaauaacaguagaaaagaaaagaaaaaaaaaaagaaacccagcaaggaaacagcuuacaaagcuuagcacgccuagaaagugccauggguuuggaaacagacugaagaacuauuucagcaggaggagacauggcaaccaaacaccauguggcauagauuuagucuuggugcagaacgggauguucgagugcuagugggcauuuggauagagccuguagagcaggggucacacagcagcgcuaacuucugccuugaggacaaagaagaagacagggaaauuaucugguaaacaccuuuuccuaaagaaauuguuucaaauuguguguguguguguguguguguguguguguguguguguauaguuuuguuuuuuguuuguuuuaaacuuaaaaccauuuuaaacuuucagacuaaaacagacaccucugaaaaaacaacuaagcaguuauggcucgaaucuucugaggcaauuaacagagaagauauucugcaacugaaaaaugaaguucaaguuuuacaaaaacagaaucaggugaacgaccuggcauuuuaugagcauuuucauggccuuauugaauaugaagguaacuuagauguauguaacagacacaggcaauguuaguugggggacgugugugggaagcccuuaugggcuccagccguucucccuuacuagugccuggguagugcuuuuauuagaagguuaacuguuucaugugguagccuagccaauagauuugcuccucuucuuagccaguucuugaccaagauguaaaaccuuguuugcuuagaugaugguuauugaauucuaaggcuuauuucaagguaucagucaacuaauaugucucugguuaaauauuucuguuuaauacauuucaaaacaaaaacaagauuuuguuuacuccuguuuaggaugcuguuuacacagaaauaugucugucuuacuaggaagacacuuggucuuguguagaauuaugagauuguaucagaugcuguugugaggcccagggugucgagcggucagacagaugagugcgggugaguuucuuuucuguaauccauuauucuuugccuaggaacugaaagaggcugaagaaaaacugagaaguacaaaucaagacuuguguaaucagaugagacagauggugcaggaguuugaccacgauaagcaggaagcuguggcuaggugaguucucguccucgccauuccuuccuccuggaguauaacgucgagcacggagacagcguugguggggggcugacucuagcucuucucaacugcuucccagaaauacugcagccgcuuccaaaagcucaaccgggacucaggagggguuuuuacuuccaaauacugaguuauaaauuuguaaacagcacauuggaagaugacuuguaagauggagucugcugaugucuguguauuagauauauaugauuugaauuugggaacuauuucucaguuaguucaauuaaagaaucauuucuuuaucaacaacaauccuuggcauagacaaacuagucuguguugcaguaaauauuuuuauuuaaagaauuacuuauuuuauguauuugaguugcugucuuuagacacaccaaaagagggcaucagaucccauuacagaugguugugagccaccaugucguugcugggaaaugaacuuaggaccucuggaagagcagucagugcucugaaccacugagccaucucgccagccccugcaguaaauauuauuuggggauuuuuaccccaccuuagauaauuuaauucccaaauaaaagacauaaaagccuucauauuuaucuuaaagcacuagagcugggcagauaucaacccucuaugcuauuuugucuacuucccugucaauaguccuaacauaucacuugcuguguuucaccugggccaccccuauccaucuggcccucauggccaugcacucacaauccuccuacccuaugucuccucuuccuccuucccuuuccuccuggucgucucucccugagaccccaagccugggaaccuucagcucugccuaccucucuucugcccaccucuaggcuacaggcaucuuuauugaccagucaucgauaacuugaggggcaagguuuacagagcugguauacaugaggaccugcucaucuuggaacagccagaucuugggguacagaauuuagcauuugaauacacacagcaccaggcugacccauuaugauucuguuugaaguacugggaucuucucacacucaaggauccaguuuucucuaaaaaacaugaagaaaagauuccuguaagacaaugggguuuaaauucuuguuuugguugugggaaagcagacugaccuaauuauaauuuguauuaaugaaaagccacggaaggcaggcaggccgggcaggcaggcagggaggcagggcagggaggcagggcaggcaggcagggaggcagggcaggcaggcaggcaggcagggcaggcagggcaggcaggcagggcaggcaggcaggcagggcaggcaggcaggcagggcaggcagggcaggcagggcagggcaggcagggcagggcagggcaguugccaguucacucugucccuggugcuucauugcucuagugccucucucuggcuaggugugagaggacuuaccagcagcaccacgaagccaugaaggcgcagauccgagagagccuucuagcaaagcacgcuguggagaagcagcaucucuuggaggucuaugaggggacccagucacagcucagguaagaggggccucugcugccuguuugcuuuguaacuuggaggaaguggcugugacgcagaaguuguauacauguucgagugugugugugugugugugugugugugugugugugugcuugcgcaugagcacccaaucccuuacuugccauuucugugucgucaaggucugaccuggauaagaugaacaaggagauggcugcugugcaggaguguuaccuggagguaugcagagagaaggaugggcuggaguccacucucaggaagaccauggaaaaggcucaggagcagaagguaggcugcucccaccauccccucucaugccucaucauuuauacuaaggcaucugccccagggaacaguggcagagguguucguagaugccuuuuuuuuuuuugguuuugucauguuaauacagcucacacaguuaaaaaguagugaaacagguucacucccuucagccucguggcaucuccauuuucaucuauuugcuaccugugcuugcccaggagacccuacauagcuuacuagugcugcacagagugugucagcagcugugagcgcugcacagugagccgucaguggcucugaccacugcauggggugcuguuaguggcuuuccccugacacaugucacacuccaaguagauagacuacuggcucucaggggagcuggagaaagcaguguguucuuugucucacccgucugccagggguauaugcauaauaaacaguggucagcuuuguccucuggagguggagggcucacuccuugcuuggaccagccugcagaccacaguuugaaagcuaccugcuucaaagcuagaaacuaggugcaaaguccuaaguaaauauucuguccagauguuuugaguacggagucuuacaaagcaguguauugccaugagccaagggcggggaugagcaaaugaggaguucaggucacagaauauuuuggccauauuucaguagaugagccugauggaaagcaugcuauguggguacaugccucucugcggaagaugaacaguaaaaggagcaguuuuagucagcgucggcuaccaaggaguuacaaaggauuuaaaauuacuuucaaaaugaggccuuagcuuuuagugacuguauaaaaauuaaaacugggagagagucauugaucugaguguuaggcaaggaacucagccuggaugcagaauuuaugaaacgugcaggaccgaggcucaugcuguguucaggaccaaggcccaugcuaugugcuguuuuguuuuuuacaaaggcagucuuacacugaagcccagguuggguuugaaccugcuguggagcugauagugaccuugaacucaucuuccugccgcuaccacugaaacauuuuaacuuggugacugcuggagcugcacagacgcuuacuugaguuuauucacagagacagcuuuuggaagccagagaagaauacgugcgcaagcugaaguuagaacuggaagagaaguaccaagaaacucugaagacggaaaggcagagcuggcugcaggagcaagcugcuggagcuacacagcaggcugagaaggaggugauguuagcccggagcacaugugauaccuggaaggaaggggcugcucacagucuccuugucagugcuuauuuuuccagccuuggcuggccuggaacucgccauguagaccagucuggccuuaaacucagagaucugccugccucugccucuugaaugcagggauuaagggaaugagacagcacaccuggcuucuggucacuaaauacauuaauaacugcagaccauucuuucugaacauaugacuuaaaauuaauuaacaaguauauaaaugguugucugucugucugucucagaaucuagcuguugguacccuuuaugccacuuugacuuuucaaaauuacccaugauauuuauccaaauucacgauuuuuuuuuuuggauauuucuaugauuccuagaaaugaaacuauagucuaaauuucuuauuaugaaaugacuaauaagucugugccagagucucuaacuauguaaguauagacauaaauaauuauuuaugggauuaaaagaaaagugaugggcaggcuuagcagcaaaaauuaauuaauuacaauuaauuuguuuaauaaaaaauguagcacaugguuucaugcaacucugagaaugugcguagcaucucguccaggcacugcccgggcucggcuuccccucuuuccuuccccagcccaugguuccuuuuauucucugcguuuuuacuuguaguccauguugccuguauauacuugaugucauguaucuuuaugaaaucuaagacagaugauagauguguuuucuaagacugacuguguuuucucggucuaaguaccuucaguugcaucugcuuuuuugcaagugcugguaacuuggugguucuuuaugacuggggcggggggcgggggcacacucuguuguguguaaauugcauucccuguugguuacccugcugccgacauguggguuaagccuacaugguagcugucauaugcagcaaggcagugagugucgugcgaguguaucaugugagugucucugccaucugccgccuugggugagcacccaggagugaugcuccagggccuuuuuguagcuuuaguuuuugaggauccuccaugcuggcuuccccaguggcuggacugggcuuaacauuccugccagcgguguccaaggcuucccugucaucuauguccucaccagcaugugcugucugucuuuccucccucuucucugccuucuguuugacacaaggucauacuuuguagccuggaaccugcuauguagaccaggcuggcuguggacuaugggcugucugccucugccuuccacuuccacgugugccaccacugcacuaggcuaguuucauaaaaauuuaaggaccaauguaugaucguaaacacuuagaaaugaaacaaaacaaaaaaccagaauucuagcuuguuuaagcuggauucugccuaugagcuugcuauucuguuaguuugguagucaagaaguacuuuuagaacuccagauauucaguagacgggaauaggcaaaaaggaaaggccauuuuugccacuuuauaguuuugccuaagacuaauuggagucccccacuccccucuccagcauugcugagaguggggcaaucacgaggagguuuucuguguaaugccuccuuccugggugcugucaaauugguaaaccuuagauucuagcaagugugguuccgggguauucaggugagugagccuucccuuacaccgcuuccuucuuacaccgcuuccuugcccuuguugauggauuuacucagugcuugcucuguggaaaggguuauugaugugaaacucuguagaaaaggauuucguuaguuuuugucaugacaucucuaugguggcagaaucaguuucuagggcccauacugacugacccugagguaguccacccuuaaugcuauaauuaagucuuuauguaaauucuguucuguaagugaagccaaagaggaacuuucaguuguugcuuggaaauuucugugggcuaaauuuuuaacccucauaaaauuacuguacaguauuuaucagguccguccauuggcuguggcacacaugugcccagugugcaaagcucuaaacucaccuaaaaaugugggauuauggacacaaacuuuaucagugacaacuuuuguaccacaguguuagcagagucuccacaccuccaagguuuuuaagugcaccuguaguugcuuuugaguaaccuguaauucuaguuuuuacuuuauucagaauuuuucuucucauugcuucuaaaaacagagcagacaaaaacucauucaacagcuggaaaaggaguggcaguccaaacuggaugacagucuugcggcuuggagaaagaccaccucagaccgcggcagccagaccgagcagguggccuguccugcugccgugucuaaggcagaggcagcagcaguccuggcagaggagcaggcucgccaaguccagcaggagaaggagcuugcuaccaaggaggcucugaggaagcccgaaguugaguuggagcucaaguacugugagauuauugcacaaaaggugacagaagccaccaguagaguuugggacugccgauuuaagaaaaucugggaaacacugccuuugaacuggauuauaaccuuauacauuuuuaauguuuuaguauuucuagacuagaaaagcuacugcaguuaucucuaaagcuuuuuuuuuuuuuaauuucuguuauaaaacucucuuucuguguuauuugaguuuucaaaguacuuguucccugagaucuguguguguaugggugugugugucugugugggguguuuuuaacauucaaauuaagaauuuuucacaucuaguuuuauugaaaauauuccacuaauguauuuuuuaaauaguaauuuuagauuaaacuauuuaacagcauuuguguugaaaucuaugcggaauugaaucugcaggugugccccagagcagagcuuuguuauucccuucagcggccaaaagugggcaguugccuuccccucaaacacucacagccucacuuuaaacacagacgaaacauuuucaaagcaaaccuguauuaggaaagugcagcccauguuaauggaauagagaugauucuuuucuuauaucuagguuaguuagugcagugagucuccugagagcugcacuguuuauccaugacagagaugagugcaaaaggcagguaaugucuuaaaaaucugccauguauuuauuauuuuagaucuuuuauuuuaaaaauaaagagccuaccugggaccuauguagugaguccuaggccagacugcucuacauagugagucccccaagccagccuggucuacuuagugagucccaggccaaccuggucuacuuagugagucccuaagccagccuagaauacauagugaguccccaagucagccuggacuacauagugaguccccggcuaaccugcucuacauagugaguuccaggccaaccugcucuacguagugaguucccaagccagcagucuucugaaaucuuuaccaagguuaagaaaauguugcuuagagaaguguuuagagugucugucuggaguauaugaaauucuaggucaugugaagaaaucuaagaaagccaacagucuggaggaaaugucuccagagggacuuauauuucaguaggaacucuaucuucuugccauagaccaccuagaguuuauacgcaugugcaauuaguacuuucauuguaaaguguuuguguuagcucugcauugguauguguauaucgguuuuaaaagaaagagagagagagagagagagagagagaaagaaaggaaggaagaaggaaaggaaggaagaaagaaagaaagaagaaagagagaggggggggaaggaaggaaggaaggaaggaagaaaggaagaaaggaaaaggagaaaaaaagauuuaauaagcuauguccacguaauugguugauuauuaugaccaggucauccucagaguucaucauacucagaguuuuggucuggaccuaaugggccaaguguauucuuauguccacauucauucuugacacuagcaaugugugcuagauaugcagcucuuaaaaacaaacccccaaaaaaccaaaaaagcaaaaacccccuuccugcucauggcagugguuugcauaugugcaugcguccacaugguguguugggugaagaggagauggugggcacagugguugauucagcuggcacuaggugauacuccggaauucuuucuuuuuuucucccaagauaaauagaacuugguuggaaauggcagauagcacuguaugaagcuuuugaucaccguaucacucaucagauucggauucccucuuccuguuuugcuguuugcaggggacagaauauauauuuagaaagaagcauugaugcuuacuguuuguauaaagucaguguaguuguaacauagggagagacaauguaaaauacguaagaggacaugcccugugaaaauugacccuugcugugccucucuccugucaucuccuguagguggaaacagcugugcagaaugcccgaagucgcuggauacaggagcugcccaugcuugcagaguacaaggcucugcucagagcccagcagcaggagugggcaaagcagcaggagcuggcuguggcccauaggguaagugcuaugcaguuuugucacugugcuccaccuccaccgugcucccaccucaacugugcucccucuuccacuguguucccaucuccaccgugcuccaccucuacuauucucccaucuccacuguccuuccaccuccacuguguuucaccucuacugugcuuucaccuucaccauccucaccauccuccccgcuccacuguccuucccccucuaccgucuucccaccuccaccauccuccccccuccacugugaacccaccuccuccauccuacccccucuacuguccuucuaccuucucuguccucccaucuucauagcccucccaccccugcucugagacgugcaccagcuccugggguugacuuaucacacugcacauugagccuuagcaguggaaucuucuuaucuuacuauagggaagacaguacaucucagcaccuuaaaccucuccuugucagggacugcuguacucagacguuaucucugcucuaucagcagcuguugguugggacugaggacaggucucugcuccucgucauccuuucauacaugugaagacuuccuggguugucuguaguccuagagcacagugcguucacuguguaaauacccagcuaucugcucuuuacaaagauaaacccagauuugcagccaucugccauguccccaacucaauuuauggggcuuaaacuaauuccaaccaaaagacaagcaagcugaaaauaacuuuaaaguucgacccaguaauucuaaaauucauuuugaaaaauaaaggacuagaccuuuuuuacuguucuggaaaagguauuguaguccacacaacagaaugcauuugcaagcaaaaccugccuugagucacagcaacacaguucauaaggacaggcguuagggacuggccaggaggaguaaauguucaacaaaugguuugaaagccugagaaugaccagugcuuugcuccauggucggggccuugugauugauagccugcuaacacguugggaaaaguaguuuuuaccaccuguguaucauggugaacuuuaggucugaaaaaugaagcugugcggcaguguaugcuuuaaguccagcaggucugucgcucagguugucaucggccacagagaaugaagccacuguacgccaguaaauaaaugucaguguuguuugcuagguaacacgcagaccaugagugugugucacacauacacuacucucacacagaacauguuugugugucugaaauaucucaaaggaaaucuuucagagggaaaggggucacagaaacaguauggugcugagacccccaaggccaggggaaggaauaaagcugguuaggcaggagaacacaggagccugaagguccucacgaauucagaaggcacucauaccccagcaccgaggaggcugaggcugggagauugcugcacacacacacacacacauacacacacacacacacacaucagaggagauccuuaagucuaguauaagcaucuuuucacagccagauuuauuuuucucuuuguauuugaaauugcucauucauuugugagguuagcccagacacuuaggaguugcugauaguaaagacugucagagacuuccagcuaugugcugcuguaccacggguacugcuauaccuuucaaaugugugcugcugugucuuuuagcugucacucgcacucucugaagcuaaagagaaguggaaaagugagcuggaaaauaugaagccaaaugucaugucugucaaggagcuggaggagaaaguccacucucugcagaaggagcuggaguugaaggaugaggaagucccagugauugucagagcugagguggcuaaggccagaacugaguggaacaaagaaaaacaggaagaaauccacaagauucaagaacaaaacgaggaggauuaucggcaguuuuuagaggaucaucgaaauaaaauuaaugaggugcuugcagcagcuaaagaggacuuugugaagcaaaaagcugaacuacuucuucagaaggagacagaauuccaggcauguuuggaccagagucgcaaggaguggacacugcaggaagcccagcagacacaaguggaaauccgucaguaugaggaagacacccucacuguacuugccuaucuucuaaaggacacgcagcuggaguacgguggggacucacaggacaagcagcuuuuggaagccaugucagcuuguucuuccaaauggauaucuguacaguacuuugagaaaguaaaagccugcauacaaaaagcucuucacgauaugcuguccuugcuuacagacagugucgccucagagcaggagaagguauguucuuagagcuguugaaugccaagugugcuuaggacugcagaaggcaagguugucuggucuccauuuuaugaugagcacauucagauguguguuuucaccaaugauuuuaaaagcuuuauugcagcaggucuacuggauugacuacauuuguuguuagauuuuguuuuuuaaauuacuucauagcuccaucacuaugagggcagggcauuuagccucuagacaucuuuuacuuagacauguauauguuauuuuuuuguaagggcauaacauuuagaaaguaaguaauuguguucuuacuguuucauuauauuaagacagaggguuaguugcuuuuguuuugguuuucuuuuuuuuucuucucaggaagagguuagaagucaauuucuuguccuugugaauuuaugucuuacuuauacaaaaagugccauuaaggucccaaaauuguuaaaaagaaacaagcaagagguuugauucauuuacugaaauucccggaguccaguuucauagaugucucaugugugugcgcuuacagaaugaauucccuguguucuuuuagucacacaaauacugccugagaccaguuaaaacagucugaccaauuuacgaucacauggguggagcauucgugaagauuucagaauccuguuguaguauauggccagucuguuuuaguguuuaggaccagaagugggggagugucugauaauauccuuuggggaagcuuuagacauuagaguuugggucugggaagaugucaucauuaaaggcuuuucaaggccauuuuugagcaucuggugcuaaugccuacuagaaaugcuuauaagcuggggauggguguucagugugggagauaaauuagugaguugcuaugagcaagccuguguuauggguuggccauccagaaaaagagaaucuagcucccuggcccagcuccuaaccaugguaucuguuguccugucugcauccuacauaugaaaagaggacaggacuucagagucagaggaaccgauguggucagcccaccucaucuuaguauauacgcuuauucuuuauuuuuacaacaguguuacuauuacauaguucccagcaauaaaaaugacuggcgagaucacgucccaagagcauugcuuaauacuucauugagaauauugggggcaaagaauuaaaauaagaaaaauagcaguuuuaggaguagaggugaugaaggaaucaugccaauguuuuaaaaaagacucaaggagccuuuaaaaguaaaaaggaacaccacccucacuggcucgugguuauucuagauguuuauuacauucuuauuuagaugcucaggaauuugacuuuuccuauagugaaaaugcaaauuuucaaggccuucucauuuucugucaaugcaaaauucaucuggagcucuuucagggcuucgaauugcacaagcagugggagcucaucugugugaccuaucuggcucguggcuguggacaugagacaaucagcuaagaguuuagauguucacagcuguccuugggugggucaaauuccauuccugaggaagaugacuugaaacgccuaaucuccaguuugucauagaagcaguacgugauuugcuucuugaagccaauacagcucaggacacugagugccagucaaugauuccaccuuugcaauauacuuuccauaaauacaaaagacugauuuauagcuuauuaaacccacaggauuuagaauugcucauggaaauuaaguggaccaaaaaaaaaaaaaaaaaaaaaagccugcuaagauggaaaggaugcaggaaaugagaaagacaauuuuuaagaaaauauuuuaucagacgauacuaauaaaauaguucuuaauagauagaagaaaaaggaaauauucuugggagaauuucaagcaaacuugaggcagugcuuucugucccccuccagagacaaaugaaagauagauagugaccccacauguucuuuuucuuugguaguuauuaggugucugaaaucuggaacuggcgcuuuaauaaccauuuaacuuaguauaauaccugugagugaugggcacggagagccuucaguacuagcgaggaacgggcuugugccauagguucacuucuguaagcaucaucugucuguaaucuggcauccaaguggucuuuccuaccuaggaacagaauauguuaaaguacuuauuuugaauauguuaggaaguaaaauauuuauaucacagugacuagugaaagugugcuagauuuucaggauugauucugauaccauucacugucuccugucuugugguauagccagacagggaggcccgagcauuggcacauaggaugcuauucauaagagagaugucuccuaguuacugcuggcauucaagcaagguuguuaacaggcagugcuuucuuuuuguauuuuuaauauuggaauucuaugucuuuauucuuuaauguugggauuuuaaacaacuauuuguagcuauuuccccaggcauuaaguaugaagacaauuuauuucagagaaagguggucaagagcucugcagacacugucagcuggaccaguagcgaaggagacucugcggucccagugccccuuccugacuccaccucuguacgcugugcucaguccucggccuggcugaaagcagaagcagaaacugguacugauuuuguuuccugucuagauuacaguuuuauucaggggcagggcucacuuagacccucuuccagccugaugugcuuccuuccauucaacaaugauucuuacaaagugaagagagagcguugcauaaccagucagccgguccgagcuguugaggagcagagcuuuacauccgagaacugcuauaguaaauacuggggagugugcauucagcucacuucaguuuacuucaguguuucucucuuucuuaauuaaaauacaguuacaccauuuagcuucucccgcaccucccuucauucccuccuuccuuuuacuuuauuauuauuggcgcgcacauguguguguguguguguguguguguguguguuugugugugugugugugaacuaauagauaaauggaaccuguugagucuauuuaguguugcugauguguauuugacuuaagagcagaccauuuaguauuggauagucaaagcacucauuccugggaaagaccaauuuauucauucucuuucucccucccucccccaccccuuucuccuucccuuccucucuuuugcauuccuuaguggccuacaguucuugguuagguguggggcccugugaggcauaccuuaucuacuuugguaugucaccugguauuguaauguucaggccuuguggagauuuccuuaguguagcuucccugucauaucuagaaaacauaaucuuucagcagacuuccccauuucugugauguucccugagccgugggagcuguguugcagaugaaucauuuagaaaugggugccccacaagcagcuguucucugcguuuugagcaguuguggcuucuacaaaaggauauucuuugaggagaggcaagagcuucauuuaucuguggauguaaggaugggcauuuaccgguuaguaauuauccuggcuuaggaaagugguagugguagauuuucuaagauccacgaccucacuagucacagugguuggcuagguuacagcaccgggcauggcuuccuccugcugagugggccucagguccaguuccagagcucuuccuuacugccacauuguagcgcgcuguugcacuuuuaggaauaucucaccauguugcucaguauugugguuuguaggaugagcuggguaggagguuugacugcuguccucccuugacagcuuguguaucaacaucugguacuaagaaagcuaguuuucagggaggagacuugcaguuuggauccagcucaaauccccagaguguguguugucuucagcaucagggacuuaccuucaacuuuggggaggaagccaagggcaguguaaguagcuguauuguuuugggagucucuuggacuaacuugacaacuaaaacucaaaagaagauuucuucugccugguacugggcuuuugauagaucuaugacuugugggaggucauuaucuccccguguaucauaacuucacuuauauuguguauaugucugugauacguaugaguauguguguguguggcuaugugugugugcauacauacauguuuauaguauuagguaaauauacaauaugauuccuuaugguuauuucaaacaccuuuaguauuuuauuguuauuuauccauucucccuucuguauugucccucucuuccuccccauuuaucccauuucccccauuguuucuccuuuuauauuuuuauguuugccguguauaugugugcauauguacaugcagugguaggguagggacacauggaccguagugcgaguggaggucaaaggacaccuuuauagucugcucuccuuccaugguguccggggaugaaacucagguagucaggcaugugcagcaagugcuucacuacggggccauccugccagcguuuuaucauggcagucuuucugauagauuuuugacgguuguuuuaguugugcagaauuuaggacaggagugaugcugcucuaucugcuucuaacgcauagcaaaguucaggguaaugcguaaacauuugaugcaguaagauuuuaacguuuucaaauaacaucuuuuacauuuaaaaauuuuuaaauuuauaugugugaguauuuugccugcuuuuccaucugucuaccacagaagccagaagagggcaucagaucuccuggaacuggaguuccagacaguugugagccccauauaggugcugggaaucaagcccaugcccucuggaggaacagccagugugcuaaacugcagagucacauuaggaaagcccugcaaaguccuuuauaguacuacuuccagaaguuaccacaggggaucuuagauuuggauacacuuuccuaaucuuauuauucuuaaguaauuuuaacugauggugaaauauuuugauacauaccaagaccauaaauagcauguagguaaguaggcaagcuaacagccaggaacucaucauuugauaagcaauagaaggucugcaguccucuccuucagcuccucccacagcgccucccaggcugugcuaacaaaucugauuucaaaagccuuuuuguugcuuuucuugacgcacaugcgugcaugcgugcgugugcguguguauuuaaacaugauaaaauuaauugaugcacauuauauucuuguaaucugaguuuuucucuaccugauaucaugccacuaagacuuuuccacgugcugacauuccaguucauccauucuuaugcauauagacuguuguacuguucgcagauguuaccguuucuauauuucuugucaguagacauuuuugccugguuuuuaguuucuccaucagcauccuagguguggauuccacaugcugcaccagugugaugcuucugugacuguguuuaugaacagaaacugcaucauuggaaggaagcggggcagucaggagggcgacaagugacgucacugaaccucuggcucugaagugcuccccguguuuaccccgugcucaccccgagucugcuuucuccucuagcacagcauuuacaguuguagcuaccuaucuuuccuaacacuuuuguauaucauuuuaacuuuguaaauucuguguguuacugggagcaauauuuuuauauauuguguucuugcuguaugccagauacuaucucaaaggauuuuguuuauggcucccaaacauuuuaaauaaauuuucaaauuuggaaauaauuucaaacuugcaaaaagguuguuacaaaaauaaaaauaguuucacagaacacucauuuagcuagcuguagcuauugaggacuuuuuucacacacaacacacacacacacacacacacacacacacacacauucacucauucuagaacuaucugagggugugguacauuacauacauugugauauuuuauaccuacauuccucaguuuguguuuucuaagaauagggauuuccucuuccauacucuuuuuuuuuauaaugcaaaacacaagagggauuuauuguuuccaugcauuggggucaucccagacccaaaggagaggcagcagccccuagcagccuguuuggugaguuuuaauaugguuuccaggggcagaauagagcaucagcaacuaggcacaauaugauugguggagcagugcgcccuuuaaacugauuggucuuuagggaaugagguaguaggggcuuacucagccucucccuucuggccuaugugcucucugaccugucucuuccaggaggggguggguccaguggaauuuuggaaaacucuaaaggucugagcugaccucuucauuccccccuuuucuuuaugcagguuucaauccugaagcuauugcugguguucugauagcucauacuccuggucuuguguaucuaguucucuguaucuucugcuuuaagagcguuagcuguacuguaccuaugcauuccuuaacaaaagcgaccaagggguucaaaauguaggggccaaaagucaacaauagcaggagagcaguuagggauccuaacaagguggauaugagggugguuaaccaagggaggaguuaaaccaggacucgaaccagcccuggcucuguucacuuucucucuuccgcuuggcuagcccuucucuuaccugggccauugacucuuuaacaaccccugaauggucuauauaaaagcagcacuccucagcuaaggcagcacauagccugcaaggagcacguugaggaccgugcacacaggcucucauuaaagcuuucucguagguguggugcucacugcugacucuugccucaguccucagucucuuuacuguacucguugcaaaaugauaauucuuccaacuccagacaugucucuguauuuaccagucuuugcuuacuggaccauccauccuacuacuuaucuaucuacccaucugugucauuauuuguaugauucacagauuuuuauuguucaauaccuugcuuacaaaucacuaguguauuuaauugcugcucaaauugcccagauuccucuagggagacccuuccgauuauuaccucuguccuuguucugugcucauaauuuuugguucuuuucuuacuuucuggcuuagcaagauguuucuguuuuauuuuguauauaccaccuucuauuuuugagguuugcuauuucuugaaaaguucuaguucucuuuauuaagaucugggcauuaggcucuagagcaauuuuaaacuggaugcuauuaucgaguuuugugugucaaaacauuaagcuuuauggaggcuaagaaaccauccagcaaaucgugggacuggagcuagaccccuccucuuuccugagcacugcucuugcaauuaugcuguggccuuugucguguguucugccaucuggguuccuuuuuucuugcuugcccuuaacccaaacaguuuuauaaaaaggucuuguaucauuuaauuuuuuuuuauuuuacagauaaaaagaucugugaaauuaaagguuuacgcuguggacacugcuuucaagagcuugaaaaggaaaagcaggagugucaagaucugagaaggaaacuggagaagugccguaggcaccuucagcauuuagaaaggacacacagagccgcaguggagaaacuuggagguuagcuccaccguaggaggcuggcggauccuggcugaaaaguucagauggaguguuuuguugauaugggcaccaguucuuuuuuggggucaauauaguccaguguugaucuguauuuacuaauugaauuaagacauggaaggccuaaguuugugucagacagugcugugggcccuggaaauugagcuuugcucugggagguggaacaagcauaaaaaaaccguguagucugggccagcuucuauccagucuacuugagcaugcugucaggguuaucugcuaccguggcccaucgccugucugagcuguuggcuuuacacguuccuccaucuuccucuucaccgcuagcccuugccuguucucuugagucuacguuugaaauguucccaguugucuucuuugccucuggcucaucacucuugucguguggacuugacccugccuguuacuccuuggucuaacuuacaugcuuuaagauuaacucacaaaaugcuguuccugcaaaauccucuuugguuuucccaacugcgagaagugggcacagcugugugguccuguguuucugcuuggcuuucucuucucucuacugccuuucuguauucuacuugccggaggccauccaaacucuuucgugaagauaugggauaugccucaucuuauuuaucuucagaaucauaguacccacaauauacuacacaguaaauguuugaaugaauaauaauaauuaaaaacccaaaaccugaauaccagggucucaaauacuuuauuguuagaccccugcucaguaacuguaauucauguacaguaaucuuaauacuguaugcugcgaucacgaaauagcuuuauuuauuuauuuauuuauuuauuuauuuauuuagaaacagaaucucauuauauaguccuggcuagccuggaacugguuuguaggcuaaguuaaccuuggcuucacagagauccgcaugcuucagccccugagcucugagguggaagccaucagucaccacgccuauuauaaaguagucauuuugcaccagggcuuuugaagccuauguuuugaauaauucacagacuccagggaaaguggugcuucuuggaaaaccacuggcugaggaaagggccagggccagaauuuaaggcauuugauaacuguagcuacauguauaaaucuauuugucuaucagucuguuaugugaaaucuucaggucugcuuguuuguuuuaaguuccuuuuugauagcauuuacuggaaaguaacagggcaggugugaaauggcuugugucucaguuccuagagucugcugguggguagcuuugcucaguuacugagcauugauauugccaggucucgaagaggucuuuugugcuuguuguuuuacccaugguguaaucugaaagguaccuaacacuguccccauuuuacaugugggacaaacucaggcucagaaagaggaguuugcucaggcucgucuaacuagugcuuaaguaccugcacggcacgcuucauagcgccuaggcucuugucagccuccccugaacaccuuacacuauuuuuuaaaaaugauaccuacuuuagauuauuuucuuuuuauuuuauacugagggucuugcucaaaaaugguuuauaugggcauaaacucuaagcuaggagccaagcauauguaaaauuaggaaacccaguggggaaugcagcucagugguagagcucuugcaugcccugugcaaugcugaguucuagccauuguacagcaacaaacaaacaaacaaagcagacccguucuggagagcuuccauuagcugggaagcucgcacaugcacaccagacagcuagacgugagguucagguuguguacaguggagaugaagaugaaacagguuuuagaugcucagaaacccguguaaagggaagggugaguaccagucuaccugaggagcgagagcugggauggaggcaucuccucugaagcaccugcgugggaacuggaggaaggcggcagacuaaugcugacuuucuguugcagaggagaacagcagggugguugaagaauuaauagaggagaaccaugacaugaagaauaaacuggaggcacugagggcccuuugcagaacgccaccacgguaaaugcaugggucacgcaagccuuaauaguagaagaaaugucacccugaauaguuguucuuucacuuaaaauauagucacaggaaaggcugauauuguucuguuguuguacgucacuuaggacuuguacgauguuaaaaaaugggauuuggggauuauuauaaccuucacuagcaugauuagagaaacauuucccuguguuccuaggaaccuccuacaaugugcccuucaguagcucuguauauuuucaucauguggauuugcaaauauuuacugaggcagucauaauguugauuuccuuuguuguuguuuuugagacaaggcuuaaugucucccaaggcuagccucaaauguagcucaagauuaccuuguuucagccucaauccagugagugcugggauuauaggugugucuaccauacuugguuucuggggauggagcccagggcuuccugagugcuaagugagcacucucuuaaccgcuuccucccggccuuccucugacuugacauaaggcagcucccuugugugaaguccugggacagcucggcggucuuauagauuauauauuccaagugaagcugucuauucauagccucuguggucuacgauccuguguguuauuaggucacugucugcaggagccgcugagagugcugggccgucaugcaguaggcaggccuuggaagaacuccgcgggcaguacauuaaagcugugagaaaaauuaaacguaagucugaagagauccucaggauccuugcuggcgccggccuuugugcugucguggaguagaaacucaggguuugccuuuuucuucagccugagcagagauuguuaaugccaccucaaauuacacaguaauggauuaauuuaccuaacugacacaagcagguuuggauuuuuuuuuuaaacguuuauuuucauuuuauguaucucucaauguguaucuguguguaucuguggacgcagaagauggagucagauccucuggcucuagcguuugagaugguuaugggccacuguguaggugcugggaacagaagccugcucccuuggaagagcagccagugcucuuagccaucucucuagcucccacgaguaguuacuuuuauauuguugauuaucacuuuuuaguuuuuguuuagacauuagaaucaaacucucuuaaaauguaauguccuugcagcauaaguaaauuguaguagagaacaugccacaugaagacugggguaugcugagaggcagaacuucugcauccugugcagagggagggauggagccagggaagggggaaggagguggcaccugagucagaucagcaguaccuccuacuguaggcucaggagcugggaagaggaauccagucaguaucuuuuuuccuuauuucaaacagcugugaauuugccagggcuuugccaguucuguccaccuuguaagagcaucucuggggcgucuccagaguaaacacuccuguguucuaacuguaaaagugcaugacacugguguucucauacaguagucagggcuuacauacagaaacacacuuuucuccuaaaauugcuuucauuuuuaacaagaggcaggagaggucucagauaguuucuacguuguugcguuuucgaguugcuuguagaugugaaaggccugcgagcucuauuucucaguuguccuucgucccagcaaaggguguaguuaaaagaaaccaagauucuuuucuguuuucuuucuuuuuuuguuaguuaaugaauuaacuaauuaguuaacuuuacaucccaaccacagugcccccucccuccuuuucuccccauccuuccucccccuccccauuccccauccacuccuguuucucuucagaaaagaggggaccucccgugaguaucaaccagccagccuuggcauauccaguugcaguaugaccaggcacaucuucuccuguugagguuauacagggcagcccaguaggaggaaagggucccaaagucaggcaagagucagagacagcccugcucacgcuaacaaaccacuuacaagcuuccagcgaaaccaagcagucuucguccugacacaguaggcaugccaugccuuaguuaccuuuuagaagcuaaaauaaaggccauguggcaaccucauuuucauuuucccgucuccaggaaggaaaaguggaaguggaccccaguuggcaucugcacauauaacauggaauuuucagaugcuugcuggcauugacaggcaguuccugugugagcugacauuccuagaauguagucauagauuuaguuuuuaaguuagcuuuaaccggaaguaguacaaacggaagccauguuggugaagagagagguacagguggugauuuucggugaguuucagaaaggaacgugauuccucucacucugcgggacaucuuguacccccucaaccccccgugaggggaucacuguccauuagugcugcugagcgcuggcuaaggauggacuagagccuuucaggcacaagcauaggucuucguccuuucccgugucaccucucugcucuccuucuggguauuucuuuucucuuaccugagucaugaggaacaauagaacacgugcuuucugcucgcugcguucuucucuucccugagccuuuuagaauaugacaaaagacauuguuuuucuuccccugugcagcugucacugucuuaggucuaacagugugcuuuucuuuugaguuuaccaaacugccauugugaaguguuccauucuaaagaacaugagacguacaacguuuaaacuaugcuuucuucaccuugucugccagaggacuggucugaaguuuucccugcugucuuuggagaaacagggaauuguggguuuuccaucccgcaggugacaugcuucgguauauucaggagagcaaggaaagagcugcagagaugguaaaagcggaaguguugcgggaacggcaggaaacugcacggaagaugcgcaauuauuaccugaguugucuucagcagaucuugcaggauaauggaaaagaggaggggugaguucagugcacaccucgagccccgacugcaccaggauggugugcugucauuucuguauccacagaacuguuuaugugaucaugagagaagcuuaggcugggcuucucucacuauuggcagagcuauuaggaaacagucccagggcugaggagucuuguguuuuuucauuuaaacuguuuuaauuuuauauccuggaauuacccacagagcugagaaaaagauuaugagugcugcuagcaaacucgcuacaauggcggaguugcuggggacgaucgcggagucagacugcagaguccggugugcccaggcaggccgcucaggugaguucucgguccgcuuuauuuggcuaccugauggucucuguauaacacgguuauggccaucccaggaaaugauggacaggauuauaaauaaugacgggugagaaaaggcaaaauuauaacuggguuuugaccagaaacuuaggaaaccucugaaaucagaaagguagcauuugaggaaauagggaaccucggcuccaaacuauccaggucagagcgacagcaggccuauuucacaugcggagcgugugucccaggagaagcaguggcucaugggugccugugggugaugagccggccaugcagaacagcgcugagguggaggcagguuuuauucccuccccuccuuuccaguuccuaccccucccuucuccccccuacucccacccaucucccuccccuuccuucccacuccugcuucuuuuuucucuucuguaguguugggcugaguggaaaagggcaguguugaguaccuggacaucagggaugcgcuguuagccucuauacccagggcaucagcugucaggucuuugugcuuccuugcaacauaccuguuccccucuagucgugcagcacagacaaacacugcauugaagauaucuaagagauaucaagaaucacuauauaguuaaagaacagugccaccaugaaagaaagaccacagaagaaagcuaagagaauauguacuuaaggcaaaagaauacucaaacaacagaaccugaagguguucagaaguauagugaauauucuuagaaauguguaaacuuuaggaacaccaacaaagaaguagaaaugaauauauaacguccaaacuaucagaagaaaucuuuucaagaaaaaauuuuagucuaauaaaaaaaaaaagaaagaaaaagcuagaaaacacacauaaacauauaaaaaguagauugcaauaucagcaagcacugaaugagguaaggcauuugcaaaauagagagacuucccguuuuuacaagaacucagaaacccucaguaauagagugauaauaagcagguggaauagggcuauugauuauaaaguuaaauacagaaguggaccauggagacuguacauuaaaggggcacaucucucaugagaccguauaacacagcuuuagagucugaaaaauaaacgcugauagaaauauaagaagaaacugcuaaauucuuaauuggacacacuuaacauguccguauggaauucagcuuuuaaccuuuuggucuccuggaagcagggauuguucaggcaccugaaaccuuucucacagaaucacaagcguuacuuguguaaguuuuggauuggugcacuuuagggacaaaagggcaguggcauguaacaagaaagcagucuuccuguuugggggggcaaggucgugaaaaucacauuuccagucugucaacucaggguuauaggaucacuacucugagacacaggucuucaaacuucacccuguggcuggcuuuccucugaucugguucaggacacugaagcagaaacuuccugcucgaccaucagacuuggagcaguguugcccugcagucagcucuugaaguguagaacccacuaagaaaguugauggaggagcugugacuccagcuugugucaagaugacauaaacuaacauuucagccacaaacccaccauuucuauggauaugaauaaaggaauauuuuuacuuguuauuuacuuuuauuuuuacacugaugcauuuucuuugauaaugcacaaaauuauaaauauauuguucccuuuagagcauuaauuuccccuuaauucuugugcuucuaacuuuauguuccuuugcacauaguagcacuuccuuuggcuucagagaugcugacgggcacugaaagaucagaaaggaguggugugaaucacaauauuccacauuacguugaaagcaaaccaaacaguggaaagacccuccccaggagugugugugagcagcugccugggaggaaggcugcgcccaggucacagaggcgguuagaggaaucgaagcacagagagaugagacccauggcuuccacagcuuugccuucagacugucgcuguggggaugcgaguugcaggcacucaggcgucuuggcaaaggauguugcuccugaauuuguuccgugccagggcgagggaggcuuugacuugcacgagaagagagaugcacuuggagcuggcucugagccgcugcucuauucagcugcucacuccuuccuuggaggugccgaaaagaacucuucuccuagaugcaucucagaguccaggcacacaacccugagaagucccagugaaaugccaagguuaaaggcauugaugugugguucuccuacagaaacugacaguauugcaucugagaagagucagggagugggcucucaggacuccccagugaaggauggcguggggcccagcagcucuccagccuggccuucugacaguaccuuacccuguggcaguccugcagugcuguuucuuggggaugggucacaaaggacucaggagaugcugggggacucuguucaguggaaacaauucucagcaaccaguugucauccagaugcccagaaaaguaauaugguuugucggaguagucacacucuagaucugcccaaagaaacccugcauucccaacaagggaagaugggugcaacucugggacacccaucuccacagagcacugauauguuaaagacagauuucaagagacucaguggcacaggaccaucuucauugugucagaagccuuugauaaaguuaacugcuccgaugcccagccaacaggauaguggcuuugacagcccgcuugaguaauuauuugccuuauuucagaauagucauuaauuacuauuuaaacaggaaacuggaugguaauacuugaugcuaacaaaccauugugaggucuuccugccaguucucauguuuuugauacccuuguaucugaguaaaguauucucaguuacuugaggcacuugcgcugccuuaauguuggaggccuaagugaugugcugugugcucugcuucugugugcugcuucauucaguuacucagcccucuaccuuuauauuuauaugcugacuuauuuuggaguguuaaaauauuuaauaaaauugugcauaauccgaagau

SEQ ID NO: 1053 - RNA, 4351 nt, Mus musculus
agaaucuuauucuaagccuuaaguuuauugaaacuagaguugaguuucgagacugggacccagcucagcaggagagcaccuggguagcaugcacaggccacuagguccagugcuuacuacugcagagaaaggcaauggacaaggagagaggagaacgcggagucuagagaagcuugguuuuguuucaguuuucuggagguugccgggguccacccaggcucuugggucggucagcuggaagagagaagagcaguugcugguuaggauagcugauguugcuacuuuuuucuuccuaauaucuguaucaccuugcucaauauuaguaugacacauaccaaaaaucacaagugugagcugugucaggcagaaagaccaagggggagcaugccaccaaggggagcaugccaccaaggggagcaugccaccaaggggagcaugccaccaagggggaacaugccaugugugggggggugagcuugcuuuugcaaaggugauauccuuguguaugaccgaguucuaacuuauuuauuuuuguuuuauguguauuaguguucugccuguauguuuguaugugcuuuguaugagugucuggugaccuugguggccagaagagggcaucagauccccuggagcuacugaugguugugagcccccucguggguacugagaauugaauccaggccuuccgaaagagcagcacaugcucuucauuaccaaguuaucucuccaauccccaaguuccaaacccuuuagcagcguuuagcucaguguuagaaugcuugccuagcguguaugaagcauaggaaacaaagaaacaaaauguucagaaagaaaguucaaaaugcugugacuguaagggauagaaaccaugaccacauguggcuagggcuuuaugggucuuugauuuguuucuugcuuuuaugcuaaacgggcaguuuccccaucagggucacacagcaggaguccccagaugaagacccuucgaaggaugagcuuauccugaagcugaaaacgcaaguccagcgcuugcugacuagcaacuccgugaagcgacaucuggugucucagcugcagagcgaucucagagagugccgggagacaauggaagcuuuccagcaauccaaggauggugacagcggcauggaggugagacccugcaaccuguacacguaagaagcccccuugagacaugcgccuuauagauggaaguuacguuuuugguuucuuaggguuuauuugacucuuagauguaaagcuuacaggaaaaaaagccaccugauagauaggcuguuuauuggcuuguuuuaggcaccuaguaaaugagaugccaguuaggcuaaauucuuuguucacaaaugaaaggaggacuuuguagaggggaugcgccuuuugucaggcaccuccugugaggccccuuagcagcucugcuccugagcgcguucuguucuguucuguucuuacaacgguuggucucugaggaaaugagguagagagcacuggucgauacuuacuucugagaugugucuuuuagauuuagugaugguuuuacucuguaauccuggcuagccuucagguuguaaucuuccggcccugagcacugagauugugggagugugcuuccaugccggugucugauauccaccucagugcucuuuagcugacaucuucgaggaaaaugaagguaggggagucuguggcgcucugagguuucacauuuccuacauuucuuaggaaaugaaguuacacuucaugacugauaggggucagaguuacugcuggaagcuccugcagucagagcuugagagcagccuuuuucuuccucauuuugacaaacugaacauuuguacugucaagaaaaauaaugcagaaaugaauugauaauuaagaaaagaaagcggaaguuugaaaggcaugcagggaguguaauccguuucuccagaaggaaggaaggaaguuuuaaucugacugcugcuuuuuuauccccugguucuuaugugagaguccuguucauuaacaaauccugucaaaauaugugagauguucugagggaccaauuuuuugugauauuaaaagaaaacuugguuacacccaugacauuugugccacaugugggcaucuaucucuuggcauaugaaucaguaucuuaguucccagcguucccagcugagugagacuguugacuuccucucacccccauacccccaccuccgaccccccagcauucugcauagcaucuucugguaguguagaagcuagaagguugguuuguuuuuauuaaacauucuaauuuggacuguauuauauaaugagugaucgacuuucaaauacugcguggacucuucuuucccagaucuuuauaauagaacuuggaauuagucuguaaaguuagaaagcauguuugggaugccuugggaggucuauggagagagagagagaaugguuauucauuuuuguuuuugaaaagaugcguaagauuuugugggauuuacugguaauagaacuaugaggcauacaugaauauuuaaaaguuugauuauguggagccacauauaacuguaguacuuuggagcaucaucuacauuuaaacauuuguuucuauuaaaaauuaagcuggcuguggugguacacaccuuuaaucccagcgcuugagaggcagagacagguuucugccaagaggcagaaacugaguuucaggccagcuugcuccagaacuacauagugagacgcugucucaaacaaaacaaacaaucaaagcacauuguuuugugguauuuccaggcuacuacaugguagagaucaggagacugcucauauacugcguuaggcaguguuuggguguagaucagauaugccuuucauuccaguugaccaacugggugguuaaggaagauuguagugccauugcauacacuagcaagauuuuacugaaaggacccagauagagcugucucgagugaggcuaugccagugccugacaaauacagauguggaugcucaccaucaucuauaggauagaacacagggcccccaauggaggagcuagagaaaguacccaaggagcuaaagggaucugcaacccuauagguggaacaacauuaugaacuaaccaguaccccggagcucuuguuucuagcugcauaugcaucaaaagauggccuagucggccaucacugcaaagagaggcccauuggacuugcaaacuuuauaugccccaguacaggggaacgccagggccaaaaagugggaguggguggguaggggaguuggggggguggguaugggggacuuuugggauagcauuggaaauguaaaugaggaagauaccuaauaaaaaauuaaaaaaagaaaaaagaaagauuggagugggguuagagagguggcucagcggccaaggaugugcagcugcuuuugcagaggaucugaguuugguucccagcacucuuguugggcagcuucauggacuauggugcccuccuguggacacacacacacacacacacacacacacacacacacacacauacugugugugugucuauuauagacuauguaaagaucuuaggaaaacuauacugacccccaacagucagaguccauauacugaauucuuuuuaaacauaaaacacagaaagcuuuuugugucugaucccuaguaaauuucuuuuguauguguuugugugguuguguacauuugucagugugcugaaaauaagugccuguugagggaucagccauaauauacaacauaucuacgccacccucaacaagaagcaaccgaagaaaguguaauuuuaccuccugguaaaggguuuggcuuauugugguggggaaggaagcagagaaagauggcugcuggcccucacccaccuuccuuuuccuuaacucacucccaggcugcaguucaccaaauguugccacauagguggcccuucccgucauccuuaguuacacuccauaaaaaaugcucucacaggcucgccacucacugaagugugacuccuaggugauucuaaaugcucagaaguugaugaucuagacuagcaauccuccuucugcccuuucucaacuuuacacccaaacauagcagcuuuaaucauaacauccaucucugaugcccagguaaacucuaacucagauacauucagucaggaacaugaggccccucugcaguaaucucuaauguuaguguuguuuucuccaggcuugccaugucuguaaguuuaaauguauucacauucauuccuuuuccuuacaaacugcacauuuuuaguaucuuucugcuucaccugcucucucuuaccugaucccuaacugagagcagcccagagcaguaagaaguagccaugucuca

SEQ ID NO: 1054 - RNA, 1333 nt, Mus musculus
gggaagcugugucuccgcagcacucaagaucaccuuugucuucugagucuaagucaaagaaagguuacagaaggagccugcaggcucuccucccuccgcaggggucugguccagagaaguagccaaguucuuucccaagaugcugggaauugagaugaaaauagaaaugugcuugccuggucgcugcgacaguggucaguuguguagaaggcacguccuuuggccagggcucccagugagugaaagccagaucaaaggaugggaacccgugguccggaaggggcccaagcacacgagauacacacgcagcaauaagaauucacccucguugggaaguggcggaaauccggagaugggcucgguuauccccagcagacucuaaacuagccagccauucacuugugucuacugucucuuucuaccaaagccgcaauuuuaggcugaccuaauggcugcaccccuuuggccaguagggagaggccaaugggacaaagguaaaggcaccauccuuacauuuggucuuugcauagucuccuggacuagggcaaacacuucugccugaaugcaccaagucaccccaguagcuugcagcagaaugagaaguugggauaaguaauaugaaccccuccuccccccaacacacacccacacacuaaaaugcacauccauuuucuaacccuacgauggggcaucuccacauccacucauucaucaacagccaacaaugacugcccgacuugaaggagccuauccuagcauaacugucucucuccugagagaggugucauccagcugcggauugagacagagacccacagccaaacaucaggcagagcuuggaaaguccuguggaaaagugguggguagaacugaacaagcuggaggaguccagaucaccacagaagaccuacggagucaacuaaccagggaccaugaaggcucacagagaguggacaaccaaccaaggagcaugcaggagcuggaccuagaucccuuauccauuuguagcaaaugugcagcuuccucuucauguaagaaaugggggguggggugggggguggucuccaucucuguugccugccauuggauccccucccccaugccuggacugccugguugggccucaguggaagaagauacaccuaguccugcuggaacuagaugccccagaguggggagguacacauggaagguucucugagaaggggagggagcaaauggggaaagggacuuguaagggugagacuggguggagaauagggaggggcugugauugggauguaagggaaauacacaaauuacuggagaaaaauaaacaguccuguuauuuaau

SEQ ID NO: 1055 - RNA, 14243 nt, Mus musculus
ugaaagcaaccccuucaaguaccuugucaaacuucucuguuaaaaaggcacacggcucuccuagcccagccaucaucggagaggcuuccuuggcagcugacuggagcagaugcagagacccacagccaaacacuaggcagagccagggagcccuuggaagauagggaggacuguaggagccagagaggcagaggacaucacggagaacaugacggggcucacagaaccugaaucaauaaucacagagccuacaugggucugagcuagauccucugcagguaugcuaucguguguaacucgguguucuucugggacucucaacaacaggagcaaggggcugccucugacuuucacugcccucgggacccuuuccuccuacugggcugccucuucaaaccuaguggaccugggggagagaggagguggagggggcaccugaaggaggggaggaaaaggagggaugggaagcugaggagggaaauuacacagcucacugacuuuacuuagcagccacugagagaacuggacagaacaccacagaccggugguuuuggacaggcagcagcagcaucaccugggagcaucuuuuguuuuuguuuugguugguugguugguugauuugguuugguuuuuuuuuauuuuuuguuuuuuuguuuuuuuguuuuccagacaggguuucucuguguagcccuggcuguccuggaacucacucuguagaccaggcuggccucgaacucagaaauccgccugccucugccucccgagugcugggauuaaaggcgugcgccacccccgcccggcccaccugggagcuucuuaacauaaagcccugacccacccccacccccccaccagacccagauucaaacgccguggggugggcucagcaaugugaguuuucauaagcccucccacugggucauacacaggcucaaaucugagaagggcuggcucagcauagcgcaauugccugugccuugaaaucaccugggggcauguuaacccuuuuagaaucuagugaguuuucaguggucuuccaaauugcuguauauuagcaucaccuggaguaccuaacacccccccccaaaagcccaaggccacccccauaacaaccagcccaguauuucugggaaaggaagucaggagucagucuucuuuuaagauuuauuucauuuuuaauuaucugucugucugugucuguuucugaguauguaaguucaugugucagaggaagccaggggcauuugguccccuggagcuuggguuauaagcgguuguagaccuccugacauggguacugggaauuaaacucuugucuucuacauugaaaguguguauccagccccacacuggaaucacugagccuuguugcuguuuuguuuuuuuaagaugccugaguaggcaguuuauaaaugacagcacuucugccucccucauaaagcuuuccaugagcacaguggaagccacagaguuacuugagaauugauacuuuaacaauacagacugcuggugucugcuuggaggcccaugccuuuaauuccagcacuugggagucugaggccagccuggucuacagagugaguuccaggccagccugggcuauaguaagccccugucucaaacagcaagcugcuuuccuugcuugcuaccaagggauccuucaauucuacuuucuuggaauuaaaauuuccaggggcuggagagauggcucagcaauuaagugcacuaaccacucuuccagagguccugaguucaauucccagcaaccacaugguggcucacaaccauuuguaauugggaucagaugcccucuucuggugugucugaagacagcuacagugucauguuuguuuguuuguuuguuuguuuguuuguguuuaaucuucagccuucugaaaagcaagacgggacacaggauugcaccucugacacaguaccugcuuugucaucaauguuuuguguuuuggcugucaauuaacacagacuaugcuuuauuuuagauauaagcacaauuuauuucuaaguuguuuuucacauuacaagcucaacagcacgccaccgucucagccccuucuaucacacaagcgccugcaaccucuggagcaugcccgcuuaaacuucccaguuacaaucuguuguggaucacgaagacccugugagguuaugaucaaaauaaugggcuugcuucccucaagaugcacacacacauaauaagcacacaaacugcacgcaauuucgagggguuccccaacucccugaagcacaggcacucuugcauucugauugaggacucuacaccauggccuccagggggcagcacgguagcuggcgagcacacugagaacugcauucaggaaagcuggggacgcuguagaacuugaucagcuuuuugaaggcaccuuucuucaucaucaucauuuguucugggaacccggaaaagauucuggcccggaaggagcccccauucuucagugaagcgucugcggggagugacuucugggcacucauaggcacacuguugcagcugagggaccgcguugucuuccuccuguucuggacggacaaguaacugaacagaaaggacgacagcuugugcuuggugguguugggggccucuuccgagaagcaaucaucaaagggauccggcaucguuuccagaucagagccgccuucccuucucgccagacuggcuccuggcugcuugaugaucuuccgggccugugcugggucaucuccucccucgcugacugacuccagggauagcccucuggucccuggcgguggcgggaugacguucuuggcccgagggcucggcugggaagugcagugcuggcucaggacaagguuagcagccucuuggaugaggugccaaucucucaggauguccuccuuggugguaaacugggaugucacagugaaacggaugaucagcuugucuuggauaguagccgggaugagaaagagcuggccagcuuuggcuauuuccuuuaacacacuuucugugagacaauuaggacccuauaagaagaacaaaaauaauuggauccuacauuacacugcuuguaagggcuccaugaagcccagcauuuacuggucugaaagacucaguacccccucaacucuggaguagaagcauccuucuccgggagccaugcaagagcacaguaccuucagacggaaaaccaccaaaccaaggugccucuuagcaggaauuucgaaggaagggucgcuucugaccagagauucaaaguauuuagccauuucugugcccuggaauuguaaacauaaagaacacugugguuaacaggccaaaaccaaauugcaucuuugauacuguucaacaacuuuagaccagagacacggacaaauucugagaccugugugccuucugccugccugucuucccuauuugaucucgcucauauucaagcugacaaaccucuacuucugucucgucucugucaccucacacccacccagagaccuugugucucaaaauccucuuucaacuuagcuccagaacucaaaagacgagugcuuuauaacucagcacucagucuccuguucugacuccucagcuuccgcaucggcaaagggagccagcaagggcccaacucagcgcccacagggaagcagaggaggcugugcagccggagccauaacugccucaccucauggagcucaucgcacuccguggcucacggggagccuguauucuagguagcacuaccaccugcgccacgguuaauagguucaggguuucuccuuggaauggugaaauguucugggaagagcaauacucacuuauucaauauaggcaaugucacauuacauuguacacuaaaacacagguuuuuaaaauauggccuguauauuuaucauggaaaaauuaaagauuucagacugaaauaaagaaaauaucagcugggcggugguggcgcacgccuuuaauccuagcacuugggaggcagaggcaggcggauuucugaguucgaggccagccuggucuacagagugaguuccaggacagucagggcuacacagagaaacccugucucgaaaaaccaaaaaaaaaaaaaaaaaaaaaacuggagugauggcucagcaaccaccaucugacaguuaagagcaccaacugcucuuccagagguccugaguucaauucccagcaaccacaugguggcucacaaccauuuguaauugaaucugguuccuucuucuggugugucuaagacagcuacaguguacucauauacauaaaauaaauaaauaaaucuuuuaaaaaauaaagauuucauagcauauugaucuuuuauaaaguuuuuaugaacuuuuaaauuuuccugugguucucuugaguuuuacauuuacauagaaugcuugaauauaggacagggcuguggcucaacuggcaauccacuagccuaccuugcacaaaaugcugacuucaaucaacaacugaauaaaguuagacauggggagguuucaguaggaggaucagaggaaguucaagguugccaggaaugaugauauuuaagucuuuaaugccagcacucgagaggggagccuugagcuccagacuagcaagaacaacaaaugagaccugggggcguggggaggggggaguaagugacagacacagcacaugauagggcuagagauuccagucugagacucacauacacucucugcuaagugaauuaauuuuuaaagauuuauuuaauguaugugagugcucugacugcauguacaccuacaugccagaagagggcaucagaucccauuacagaugguggugagccaccaugugguugcugggaauugaacucaggaccucuggaagagcagucagugcucuuaacugcugagucaucucuccugccccacuaagugauuuuuuuuuuaugggcuggaacucccacuugauauuucguuuuaaaagaagacagagcuucaggugucuuccuugaccaugaagaggcggugccauuugaaccaaccucuaucugcuccucuaucugcuccacucucucucucucuccagucaauuucaaacucuuaccaccgccucaugaacuuuuucuuuucuuugagaaaggcucucucucauggauccuagacuggcucaaaguuacaauguagccaaggacgaccugguaccauugauccuucugccuccaccccccacuguggaacuaccugcaagcgcugccaggagaagguuaagcaauacuagggggucaaacaguggcuuugugcauggggaguaaacaguguaccaauggagcuacguccccacuugaucccuaagaaguucuucaugugcaaguccaggccuuguccgggaaaagcauacuaacuguucuccuggccuuuauaugcccaugccccauuucuaaccugguuaugauucuccccuauaacuccuuuccucugggccuguuuucaccaccugcccugucaaaauucuccaugucucacucacaugccccacaauguccccucagagcccaccuuugucagcauccucacuuuuuaaaauccaagggagggugauucucccaaggcuugggcggcagaaaguaggucucccaguuaauaagacauucuccuccugcccuauucucuucccucccaugaggcaagcuguguaugagacagagcagaggccaggggagaggaggacacaauuacagguaguguguucacuacagaccucaccuagaaggugaagagcagguguggcuguguugacacaccauucaccagggagccaugacagccacuccuucuuaaagacucggcccuacuuugaccauagacccugcucuuugaccuacuuucacuuucucuuuccguaaacuaggcuuuugagugcucaguucucaaagacaacaacaggaaaggugagacucucaggaaaucggugaaacaagggaugucagaacagaggaaguugcacuuaguggugacuguuuagaaaauaaacagugugaacuacagaucacagacaguccacugggacuacauggagaucagcgcaccucuacauaaccaacauucaagucccucugcgcacccuaccacugagccacaaaccaaggauccccugggcagauuuguaaaaccgaggcaaagucuuccuucccauggaaaaugcaaagaaucaugggcuuagucccacggcucucgcgcaacauacgugucugacaugugcuugaagauucuucaccccgaaggaccgaaucacaaaccacagcuuaauggagcgaaagcgccggcucaaggggaucugccaaugcuagaaacaaauaacacagagcucaugguuagaagcaacgugcccacucccucgggcacuccuagcauucuguguugccugcagagcacuccugggauuucccuggugucaccaugacucccaaagcuguugcuaaggagcaaaccaagacaagcuuaucuggguaacacuaacaguuccaagccugugaccuggaaccgagcgugaccucucgaaaacugcuguuuuaaguauuucaucccagccuagaaacuccuagaaguuccuugaguagcagaaauuaaaguucuaugucuguucuucucaacauuaguguagcuuuaggauggugauuaagagcuuaaacccuggggccccacagaccuggguuucccuuuagcucugcccuggcuccuuacccugugugacuuucacagggccaccucacgggcacaucaauggcauaggacaaaaggugcuuuccaggaaaguggcuugaggacagugcaaaaccucagagaaaguuguccaggcaguguaggcuguuuagaugauaaacaggugagcuaggaaucacaugugugugucugucuggcaccaagauggucaguccuuacuuaaucuugcugccaccuacuggcuuuggcuuucaccugugagauuccuguggccucagaugcuccauccaagcuuuccgacugcacaggaaccccugccucagucugaacugaucccuguccugguaccaaauucaacagagcuuaaaguucaaagcugcaguuaccauagauucugaaaauucccaauccuagugcucaggucugaaaacagagcaaacgguuugcgggacacuugcaguuguucuaacaagcaaugugacuucuccuaagcuuuccccucaaaugucagaaaaccucugccacaauuucugcucucuaaaaauauccaucucguugaccauuccucugccucucuccauggaguugccaaaacuuuacugauguccccaucuuuaugcuucauuguagucucccagaguagacacggcuggcuuauuacuccaguaucaaggacaguauguuuccuugcacuaaacucucaggcaugauggugcaugccuuuaaucccagcacuggagaggcagaagcaggcagaccugcugaguucaaggacagccuggucuauauguguaguggaguuccaaccaggagggggaggguggaggggagagagagagagagagagagacuuuugucagccagaagagggcaucaaaaccuuaggaaaggacagaaccucugccgcagccugcuuagaguccccuauaaaaugucccgguuucuagaugauuaugguaaacugaccaccugguuggagaggggcaggaaguaucugagcugugcacuucucugauuucugcuuaaucuccaucccguucuucucacucugcuaaaaccaaaccauguggguccugagacugccuuaaccaaugucugcuguucgagcuccuaaagaccagcaugggacucccuucaccccagaugucuccuagcauccucugugucuuccccaaggcuuucugaaucucugcuguuggugcucucugccauuggagaaguauagaaugaaguggaggggagcuucgcugacaacagguccagauucuugaggcucccucccccaagcuaaguaccugggacacuguaaugcuuccagauccuuuggggggggaggggcuaggcuucuacucaaacuguagccccuugggggcaaagaagcuuggagcagcuacaaggaccuugguauuaggauaaagagagcagccucguugcucuagaagugucuucauacuccuggaaaugaaguccacuagauuccacagcggugucaugauggaagcuucccaaagcaucaaagaaagacauucccagagauccagcuguuucuuagaaaacaucauuaguggcucucagaccacacgggggcuuaacugagccaugaaucuacuuuaagauagacucucaggagcugcuagaaucgcaaacauaacagggcuuuaaggacacagcagugcucaauggguagaaugccuccuuagcaagaggaggcccugauuugauccacaacacuguauaaacugggcacaggcagcguacaccuaugauccuagcauugggaggcagaaucaggaucagaaguucugaguccaauuaacuccuagaaucuccucguaggcaucacuucacagucaggauugacuggcaguguuaaaauuuuuuuuuuuuaauuuuuugaauacccaugggaaaggcaagagagguauccaccuuuauucucccauagaaggucuccucccaccccaacacuauaagcuuacuauuugcaacuugaaagccuuccuaaaccuccagaaauugucuucaccggagaaucaucaguuuaaucaagcaauaacggcacuagugcuauagaacuaagugaaaggaaacuugguugucuagggagaaaggcaaaccaguucuccaccaagauggccgggcuacacuguccuuguaucacuguauuaauuauuccauucucacgacgggcuuagaaggcagaacugcucgugucucuguucacacagagaaaaagcuaggcagaauccaagcugcucgucuaggaccagucaggucauuccgaggagaagcauggcuucaagcuucugaccuuggcguuucuguuuggccaugucgcaauagcaagcuuaaaugacgacauuuuuagcacuuugugcaugcuauuuguugugcaauugccacccagacacggugcuaagggauugacguauguguucccaucaaaaccucagagccccugugaagucagugccauuuucccagggacuuucaaugguuucccagaugaccgcggaugaauggaauuccgagccaugcucauuguguucguccuucagaccuuucacuagccgugugaugugugacccgcucguggacaucccaaucucaccuaaaaggcucaucuucaacugaagagccaauaugaagagccugcugcugaaacccuaagcccggaggagccugagaugcacagccagagcucugcagagggugccagcaucucagccucacgacagagcuccugcauggccaugaugucccaacaucgcuccugcauggucuaugaugucaaggagagugauguaaaggcaauuuaauaaaagccucuuucccaccagaggaaaucaucuacacucuccugcugggcaguaagcgacagacagacagacagacagauaaaugauagaucuccaaagaugcuaaaaggaguuaacugaucuuucugugacagagagaacacuucuggaagaaaaacaagucaaaaagacucagggauugugauuuuucuaguuuucuuuguuuguuugguggugguuuuugguuuuuggguuuuuuguuuuguuuuguuuuuuguuuuuuguuuuuuacauuuucuggauuucauucugugugcucaugcacaacuugaaaucacguuuccagugggaaacuaugugaugaacacauagaaugcugcuucugaaggcagaagccaugcaaaaccucaggggccaguccacagacccugucuuagaagccaugggccacccacuccugggaacucaccaugaaguccguggcugcaccagaguuggcaugucggagguagaugggguucacacuaaaggucugcugcagcuuguacuuguccuugacccuguagauugccaagugggcauuaguggcugaggucucccuaaggaagcgaggcauuuccacauguggagagcucaacucaccagaauccaguacagucaaaguguaccaucauccacuuggaaggguuaaaggugaaggagucagcguacucgaugcccuccaggaacccccggagcucagggcacagaaaggccgugccugcauaagcagcaucgacguggagccacagucccucacuggcaccugagaaagcaaaugucaugugcuacaggggagccauggaagagcuacuaccagccagccaaaaggcacugcccuccuagccaacaccacagcaggcugcagugagaucugggaagaugacauacuuugcuaaaggagucagcaaggguucuggagacgaggugauaggguguugguauaaggaagugaaacugaagcagacauuguugccuccugauagguaggucuucucucacugggcagaagaccauuacauucuuggccucaaccuggaaaauccuagcacaaaauccaacugcuuuauagcccagaaagcgacaucagugcaccuaacacaguacuuagagagaugucuguccucggugggcgucucaccagggaguuaagcaauuacguacaggugucuuauccguccugugguuucccuugaucugccccuucccuuuccagaagcagaaguaaauaugucacugagugucacccguugcaacauuacgcgugagagaaugugaaagcuugaaacucuucuauagcauggcuaucccauguccucgaaaggcucauguguaauuuguuucacagggugaacugcaaaagguagagcccaucaagagguccaacacccacacugugccucacucggggccccgaaagugauggggucaagugauuauagacuggaagaagcuuccaaagugcgagccaaagugaagugugucucuuuccaguuucaucaucuaagguauguguuacagaauggagagcugacuggugcuuccaaggacguaguggaaaauacagaauuucuggcuuuuaucucaccacuaggaaaaguccaauggccucuacugcuggguagugacucucaugaccuuuggcauuuucccucccucccucgccaccaaauugaaugaagaaaauaauucagugaagcugguuccaaguucuuguucuggcaaauauuucaaauguuauuccuuaucuuccuagccuauaaugacagauacuuacagaugggccccaguucugacagccugucaaaugcacagacuccaguagucccuaacguugcacagaccuagagagaaauaaugaagguucacaugacacagcaaccuaugccaaacacacguacauuuaaaaugaaaguuucaucaggugaucgggugugguggugcccaucuuuaaucccagcacucaggaggcagaggcugauaggucucugugaguucaggccuacauagugagacccaaucucaagaagaagaagaagaaggaggaggaggaggaggaggaggaggaggaggaggaggaggaggaggaggagaaggagaaggagaaggagaagagaaggagaaggagaaggagaaggagaaggagaaggagaaggagaaggagaaggagaaggagaaggagaaggagaaggagaagaagaagaagaagaagaagaagaagaagaagaagaagaagaagaagaagaagaagaagaagaagaagaagaagaaaaggaagaaaggaaggaagaaagaaaggaagaggaaggcagguaggcaggaaggaaggaaagaaggcaggcaguaagucaggcuaccucauaaucuguaaaacacuaaauuuaaggcuuguucugcuuccauuugcagcacaucacuuaccaggauucugucaaaauuccuuaguuacuaauauucacuaaucuuuuguuuuguuuuguuuuuugagacaggauuucucuguguagcccuggcugucccagaacucacucuguagaccaggcuggccucaaacucgaaaauccgccugccucugccucccaagugcuaggauuaaaggcgugcaccaacaccguccagcuucuagcccacuaaucuuaaagaugcaaucugacuuacaaacacaggcaccaagcccuguugcuugucuuccucaauagcuuucuggagagcuucuccucggagugagaaguugucguccacagguagaaaucugaucuucacaagggaaaucaagccagccuucuccacugaagagugagccuacauggccaaggaaaacaguuggcaagggguggccgugagauaagcgugaccaggaacacccaaagacuaagacugaaggaaucuaauaccuuaauaaugaaacuaguauucauuaugguuucugaaaucaacccucaggcucaaacuucccagaaacccaggacucacagguacagaugagaauuacacaagugcuaagaccccuaaagccaagcccuggcaugaggguguggccucuaucaagcaacuuaccugaucagagguguaggcaacgagccgagcguucagggaggacucauuagcaucgggcucgcaugcuuucauugcuaggauuuuguucuuucuugcugccagcagggcaauuaaaguggauucgcugacagugcucuguaguggagagggauugccgauugauugugccagccucucuggguccuguucccugggauuggucccauguaugguauguguguguguguguguguguguguguguguguguguguguguguaucugugucuguaucugugugugucucccuguguguggucacuauuaguaaagaagugggacacuccuucccaaagggccuccuuccucccugacccacaugccuauucuguauucugaaaguaaguuuucaccaaugacaacaccucucagagugacuacagaaacaagaaaaggaauguuccggaagcaagcaagagaaauuccuauuucuuguggcuaugcuugcuuaccauguaaaauuuauugaaaagaaaaaacaaacuuggggccagaagcacaucuuaguaguagagcuccuauuuagcccccucgcaggccuguguucgaugcccagcacaaauagaaugaacaaggaaaagauggggagggagaagacaagagaagagaggaggagagaccuuugguuuuuccagggugaaaccaaguuugagcccacaagaacacucaagagagagugcuggcuugugcaaguggcuggugauuuagucugguuuuguuuucaauagcucuugucaacaugggcugauguugucccucuggaaacucauuucugucuaccaaacaaaaaagcauccacaguaagacaagauagaaugagguuauuuucuccagacauaauuguggagucuugaaagacaugccagcggugucucagaaaucucggacuucucuccacucacacagggauuacuucuggaaauauucaggugaacuagagcugacagaaucagcuagaaagccaggugaacacugccaugggcaguagaauagaccagacccccagaauagucaguggucgaacaucacuuaauaacaaggaagaaagauuaguaauaaucucaucuccccucuguaccaugauccauaguuuagagaauacuuccuguccugcucgauccucaaauaccugugagauggcugucuugucacuacagaugaggagaugauguucagaagguuguaggaauagcuuaaacucagauaaccaaugaaagcaggggaaagcaugauuuggauucagacacuccugaguuagacucuucuuuccccaccuagcaacuguuauuuaagcucucugagcuucaucgagaucuuaaggucacugagaugcuguugugugccuacaggggcauugagaagauccgauggugagcaagaucaccggccaggugugguggcauacaccuguaaccucaguacacagaaagaugaugaaggagauugcugugaguugggggagucaaccuaggcuacauagugaauccuggucuacaggaagagccccugauucaaaggacaacaaagagaaaaggugaagcaagauuguauauaauagauacuguguauuuuuccaacuauaucccaaguucugcucacaggaagacugcgacaugaacaaacucggcuucc

SEQ ID NO: 1056 - RNA, 9129 nt, Mus musculus
cacauccggugguaacagggcccuacacagacccgcacugaccuggaaaagcuucgggagcggcggcgggggagcagcgggaggaggugcggggaccgcggcgccucggagccgucagggcagacgcggccccgccacacacagagcgcuucgcugcacagggcgcuauuuuccgaaaaugccgcgucugcucggcgcccaaaauccccaccgaaaaguccccgucggcgcggagggacacggcggccgagcucccagcaugccugcggcggccucgccaacccgcgcccguuuccgccccacuggccccgggagcgagccugccgccgcccucccccagccccguuccggcgggagaaagggaugagagggucugcuucugacuuuaaacggggagaaaggaaauaagccauuucuagcguucggccacacaaaggcugcggcggaaugauccgcggggcgaccgcaagucccggcucgcccggcgccugcgcggcagcggggugagcgcugcgguggcccugugcgcggcuggguguuccgcgccgcgucgcggggcgggaugugugggaguuaggggugcgugugcuaaguucucccccggcgugacacggaaagugccggcauuucgggacgcuuggagcuuggacuugacuaugggguguucuagcagauucccggcaggcggaagggcagccggguaccuaagauuuaacuuaccgugguccuggaagguacccggaaucgcugguuguggggccugugcgggaacaaaggaugccuguccucuucaccugguguaaacuggucgugugugacguggauguuucuguggcuuuuuuuuuuuuuaauguuguaauagugacgcuuuucuccugucuguauugucaggauuuuuguugauuuguuuucgaggcaagguuucucuguaacagcccugccugaccuggaacuggcuuuguagaccaggguggccucaaacucaaaagaauccgccugccucugccucucaauuguugggauuaaaggcgcguaccaccaugccuagugacguauuuuacuuucaaugaaccaagaguugauugggagaugaugauuugugaaggaaaagccuuauaaauuuacuucacaugcgauuuucaaaguuccacuuugauauauuucaccgaaaaguccacuacccguggaacuuuuggcgucagguaucuaggaaugagaauaucggagacaaccgagaauaaccuaggagcaaaauggcuuaaaugagauccaaauuguuuacagacuucauuuguguuugugugugucuguccucagauaaggacacuugcccuuauuuuuugguuuuucgagaccggguuucucuguauagccccuggcuguccuggaacucacuuuguagaccaggcuggccucgaacucagaaaucugccugccucugccucccgagugcugggauuaaaggccaccacgcccggcugccuuucuuauuuauauagugaaaguuuguagccaguguaagacauagcaaaguaaacagaauggggagagcauaguucauguuuuuucuuuuuauuuaauauuuuauuucagggguuuuugguuagguuugguugguugguugguuuugagauagggucucgcuuugugaagcucugacugcucuggaauucacucuguagaccaggcugggcucaaacuuaaagaggucuaccugccucugccucccaggugcugggauuagagggguguaccaauacugccagcucuuaugaauuuuuuuaaauuguuauuccuuuccauaauauuuugaguaaauaguuaauugccuuaauugugcuauagcaucuagacgaguauacaucaucagugguuaugccagaaaagcugaauguggugugauugcaggaauauuccccugccacaaacagacacacacaguaaccuuacagaggaaucaaauagcuauauaaaaguuauauagaaaucagaaauuggugaaggccauccagucgaagggaacaguaaugcagaacuagagagaugauuucgaucauucccagaaauggaccuguagagguugagugaccuccuugaaugucuccuuaaugaguugguguuuuugacugguagcuauucaguaaaaacgccccaggcauggagaagcaguaguuuggaaaacugacuacacagguugagguagucacaaguaggaaucaaggaaaucacaacugcuuguuaggaauuuggagaaugcuugacuggaugugagaaugccugaaggagaugucaaggaaggugacucaaguuugucagaguacuugaggguuggcaguguguucacugaaaaaagcaaagggagaggacugcuagggaagaugaagcuucugugugaccauggaaagccuaugggccugucuaaucagcucuguucauuccuucagcagugcuggagugcccauucuuuuucucucuuuugagacaggguuucucuguguagcccugacuguuguccuggaacucacuuuguagaccaggcuggccucgaacucagaaaucugccugccucugccucccaaguacugggauuaaaggcgugcgccaccacugcucgguguggagugcccauucuuauaguccuguucugugagcuagagaagauaaaaguagcagcuaagaacauggcuucagcuacuguugcugguaaaaggaagaacaacuagaguuuuaaaauggaugaaggauaauauccuauaauaauuucacaaaaugaaaggguaacuggauaaaguaguucuccaagugggaaaaaaaaaaaaaaaaacagacaaaauacuggcacuugguuccaaguagucuccccugagguggugucugagcuaagcggucacuggaaagaaguggggcaguuugugaaguuuaaggguaccuccagaaggccaguaggcugaugucuaggggagcaaagggaaggugggaaggauuaaaagucugcagcuucgggaagaugaagucaccguugaaaguuucaagaauggagucacacagacaacaguagagauggagaaagcagaugguuccaugaaaguuauuaggcauaaucugucuuguucauuaaguguggagugagggaaaaggaaacaguagugcugucuaagcuuugagggugauugccugagcuacuaacgucagguaaaaguauaagcugcacagaauuuuguaguaaccucauuaaaaguaaacgugagccaggcgguagaggcgcgcacacacacacacaccuuuaaucccagcauuccagaagcaaaggccucuuguuggaucugaguucaaggccagucugaauacagaguuccaggacaggugaagcuauacagagaaguccugucucaaaaagccaaaaaagaaaggaaagaaagugaaauuaaugucuuugaucuauaugaaguacaguuuuauuccuuucucacuauuugaaaucuaguauauaaauaauuuuaaaagcauaucucaauacuugauuucauuaaauugaaaaguugguuuaccuauccaccuggcuccagacauuaaaaaguuuuguagugauuaagccaugcuuaauuuuaaacuaaaguuaauguuuuaaaaguaaauuucugagccgggcgugguggcacaugccuuuuuuuuuuuuuuuuuuaaauauuuauuuauuuauuauauguaaguacacuguagcugucuucagacacuccagaagagggcgucagaucuuguuacagaugguugugagccaccacgugguugcugggauuugaacuuuggaccuucugaagaacagucgggugcucuaacccacugagccaucucaccagcccggcacaugccuuuaaucccagcacuugggaggcagaggcagguggauuucugaguucaaggccagccuggucuacaaagugaauuccaggacagccagggcuuuacagagaaacccugucucgaaaaaccaaaaaagaauuucuggauuaagauuucaguuggauaauccuagcacuuggaaggcagaggcaggugagucuagauagauccuauaucaaaaaagaaagagaaagaaagaaagaaaagaaaaacaaaacacaaaagaagagggaaacgcagccuuggagugccugccugcccucucccugucauuagcagugccccugaguguccuagcacuagcccccuagaaaagucugcgaauagaccagcaaaccuugaaugcuaaacuaaaggauugugaauuugacccuagaagccagugguuuuugauccuagauuauguuuuaaggguagaaggaugccacuagauggcuguguggugugacaccuggccuaggggcagugcucccuuccaucccguugacuucaugagauucagcuuuaguuauucuacaaaaaugcaacuggaagucugguucauuggugcagucuucagacccuuugugacuagacaagacauuaagaaagaguaagaauuuagaagcauggaacaauuuuaacauuaauaucuauaaauauaccauccagagcuauauuauuguuuuuuuaauuuccacuuucuaguaauuuuuguuuuauaaaacaaucucuauuuguuugguucccccccccccuuuuaaggggcuuauguagccaaggcuagccucuauguaacuagaaugaccuucaauuccugaucuucuaguuuuuacccccaagcagauaacaaugguacuggggaucaaauccaagaccuggugugugccagacugggucuuuguuaaccaugccacauucccagccuuccagaucauuuuuguaaggcuacucuagaguuguaaagagucagaaggaucaaguuuucagaaaagaccacauuuaauuuuacuuuuuguacuuuacacuaagaauauuuauuaagaauaacaaaaaaaaagaauauuucauguucuacauggauucagaaaacuacauagaaacaaaaauuauauauagcugggaggguuguuuguuuuguuuuuuuuuaguuuaauauauguguguguuuugccugcaugugugugucuugcaugccuggugccugcaagacuagaggaugucaaaagaggguguguauccccuagaacuggaguuacagaugguuguaaguacuaugugggugcuagaaauugaaccuggguccucuggaagaauacacugcugcucuuaacuaccaagccuugacagccuagcccuuguuuauuaaaugccacccacugagcauaucuuguuaauaaugccucacucagugcucaaaauaauucucugacagguguuauuauauuagccuugucuuucccagugaggaauuguguugaauaacuuaucuccaauuaccaagaaccuuaaguguuagaggcaggauuccaaacaggccucuuaauucugaacuggcaucuaguggauuccuuggcacaaagacacaguacauuauuuuagagaguguguugaauuuuuuuucucaaaagagaacuuaggggaacaaauaguauucuauuuuuucauucagauauuagaauagcuacaacugcuugcuucuuggcaacauuuguuuggaaugcucuuucuggguuuuuuuguuuuuugguuuuuuuauccuaaggaggugucuguuauuguuagugagguauguuucugagaggcagcaaaacaauggauccuguuuucuaauccaggcuauccgucuauuagaaaauguuuguuugugguuuuuuuuaagauuuauuuauuauauuuaaguacacuguagcugucuucaggcacaccagaagagggcaucagaucucguuauggaugguugugaaccaucaugugguugcugggauuugaacucaagaccuucggaagaacagucagugcucuuaacugcugagcuaucucuacaaccccuauuagaaauuuuaaacauuaauaugaagucuuguuuaacaguuuauuaauuccuguuauuuuguugugacuaguauuuucuuaaacuuguguugguuagcuuuucuggaauugugugugguccccuuggauauguuuaaucuuuucuucagucugaacuauuccuucuaguauuauccuucauacaauuggcuuaauggauauaaauugcuuaaaucuguuuuucaucauagacauuuucuuucuccuucgauuaugccugauaguuuuacuugcauauuagucuuggcuggcaucuguaguccuaguacuuguagaaccaaggacuuucaaagcuuccauuuaagucaggcauuaaucugguaugccugccuuuauaugugacuuggucucucuuguuguuuucaauaucccuaguucuguauauuaaauguuuuuauuaugugacugguaauuucgucucugguucugguauucuguaugucucuugcaccuuaauaaaaaacuccuuagaucccauaauuuuguugaagauauuucugggucuuugaccugcauuucuucuuuuuuauauacuuauuauucauagauuuggccuguuuuguuuuuuguuuguuaguucauuuguuuucaagucaggguuucucuguguagcucuggcuguccuggaacucacucuguagaccaggcuggccucgaacuuggagauccugccuuuuccucuugaacacugggauuaaaggugagcgccacuacugccuagccauuggucuuuuuauauuucagauuuccuguauaaucgguuuugguuuuuugucuuuaacauuucccuugacuguuagauuuauuccucuuccuugucuguguauccucauagucucuuuuccacccuguccacucuguccagaauacuugcuucugagcuguuuguuugacuucccaaguucauuuccuuucagcuuuucuucagaaauucuguccuuuuuuuaaaauuuuuuuauuuucauaucuugaaauguuucauuuuuugugcaacuguuuauguuuaugggacccaacucccauaccccaguaacacaggaugcuaucugguagcauuuugcuugcaauagaaccuugcuucugcuuuagccaguguugagaugucaaaugcacccaacaaguucaaauguuugaacauuugguccucagcuguuuugaaaaauuguggaacguuuagaagacagggcuugccuagaggaaguacugguugaggggguggagaaagccuuaauauuuauagcccagcucugcuuccuguccuguccgcuuccuaaucugcuuagaaaugagccaguagccucacauuccugcugcagccaagagugguccccacuaccuugccuucccugccaagauguagccacaguaaaccccacucccauuaguuugccucuugucaccaucacaaugaccaaggaaagcaauaacagugaguuuauuuaauguuguaagucuuuggguaucauucucauaguauccauugcaccuucaucugaagcagaauccauuuuaagaaacuacuuucugggauuguguugugugacucuauuccuggggagagacgggaacaaaugucuucuaaccagauggggaacaugauagaccaaacaaaguaaggauaccaccaaagucugaguuggugaacaauagaguuuuaauagguuuauuuacagagaagagaugccauugccaaaaucccacuccaguauaagugacaguucacauaagcugggaaccuggggcuugcuguuggacucguuggcagcucaacagcuuagaagauaucuuuucuaggcaguugaaguguucugagcaucuuugaggcaacuuuccaagucucugcuucuuguaagcaacaugucuugugugauauucuucuagccuagcaguuuucagccugugagucaugaucauugaaaaacacacauuucucauggucuuaggaacucccaaccauaaguuuauuuuuguugcuacuucauaacugauuuugcugagaccuaagacugcuguucuaggcagcuugguuugucugagaguauauuucaaacagucuacugcuuaucuacacauuuggggagagaggaguauagugaaucuuuuuguugguuucagggacuuguugacgcuacuuugaguuguuuccuucccgagguucgugauugcugagcguccgucccugcuggauugguuguuucaccucccuaugaacauccugugucugaaugagcugccuccucugguggaagguuuuaaucuuggaggaaacuguuaaagagcagauuuugauaugguucagcugggaaaggcacuugccugaauuugauccucauguccgacaugguacaagaggagaacugacucuagugaguuguccucaggcugccauauguguaccauagcaugugcaugcccacccaccacccacccccaaaauguaauuuuuaaaguauuuuuugucccuacuguugaagauuauaaguguaauuguauagaaauaaacuacuuucuccacuaaucuauugguaguaauuguguccaauccucacacucugcugcuaucucccuuacuacuacugcuggguacagugaaauuuugaaacccucaaacugagacaugaagauuagaauuaguuucuuuugaaauuucccauaauaauauuuuuagcuucuccugagaauauugggguuuuuuguuuuguuuuguuggcuuuucaagacaggguuuccguguauagccugauuauccuaaaacucacucuguagcccagguuagccuuaaauucagacauuuggccaccuguaccuccuugaaugcuagaaguaaagguguuuguuaccacacccaauuuaaaacuucuuugggaggaaaaaaugaaugcugggcauggugguccaaggauuuaaucccagcauucaagaggcagaagcaggcaggucuuuuacaagccagcuagaaccauaccauaacacccugucucaggggguuuaaaaaaaaaaaaaagauuuauggcuuucuuuuccuauuacuauaaaaaacuucaugaaacugauaccauguugaaauguuaacuuugggguaauuugagucuguguucacaggccaugaucacuaugugacuccagaauaaauuguuucuuauuugagauaaaaag

SEQ ID NO: 1057 - RNA, 51989 nt, Mus musculus
cgugacguuucgagacgcgacccgucgccacgcaaugcgaaucgggaagaggggaugagcugcgcugccgugcgucugagagcgaaggcucguucuccuucugguggugggcgaugggcgucaggcgaggaggccgguguuagcggagcgcgggcgcugcggugagugcggccuggcuccggccccgguuccuggggaaggcguccuccagcugcuggucauccgggagacgagcccuguccgcggaggggugggacaaccccagacaacuggcugguccagggagggcccgacucuuggucgcucccgucccccuccuacggugcccagcgaguuugauguaguuugccggucucagaggguggccuugaccaguucuccuuucuguuggacacuagacccaacuuuggacuccuuccuuuugcuuccuuuuuucucauuuugugcuaccuacaaccccaggccuuaauacgaccauuugucauguuuucccuauuccccuuuacccgggucacgcauguuuucagugaaguacaaaaauugaguuaaguaaacucaccacacuuaaaacuucuucaaagagggcauuuucuuuucuuaaaaauguuucuucguuuguagacuuguggcacugacaaguucccuucacaucugauguaccgagagaguugucaaccccaaaucacaaugauauuccuuuacccacaaagcugcagacccuguuccuauguuuuguucuugcuuucugccuaugaccuugagucagucauucaagaaauauuuacgugacucacagagguguugcagaaucuaaggaguuucauauuuauuaaaaagcucuaggguuucggaucaaaacgaugccuagcuaaaggguguaauucuugguuguuccccgccaccacccacaaggucuuacuauguaaacaggacuugucucaaacucacugaaaccuuccucccuuggcuccagagauggauaaaacugcaucaagcaccacuccuggcaaggguauucuuuuuaaaucuuagaguauucuuaguuguguauauuauccuacuucauuaaaaauuccauguguuauuuuuugguuuugguggcuuuauucucuuucuuuuuuucuuacuuucuuucuuuuuuuucucgagacaguuugucugugcagccauagcuauuauggaacucacucuaaaccacgauugcccuugaucucaaaguucugccugccuuugccucccgagugcugcccaccacugccaggcucgguguauuguugguggugguaguuuuugguuuuuguuucuguuuuaaagauaucugcuuuuuuuuuaguauuucacucuuucuguuuaagacucccuggugaaagucaaucauguuggauuuagguaguuucucaucuauagagcacuggccuaauuaaggugcuguuggcuguauguaugcuuauuuaagaauaugaauuaguauauaacuuaauuaugccacuguaucacuguugauccuaaaauguauauuccugcucuuuugcccagauauugggcauugcacggaucuugcaguaguaauguaagccugugaggaaugaauaaugaauagcuugugacuuguaguuuuugagauaacaauggauaagauaaacuaacaaaaauauuuaagguuuucuuuuuauucuuuaacuuguugauuuauuuacuugagccuuauuaaucauccugaucuuuuguugauaagaauggaaccgaauccagauggcuuuguaaaccaguuguaauguaaagccaacacaucaaauuuuauucauuauauacuuagcauccugauuuucuuucuuuuuuuuuuuuuuuuuuuuuuuuuuuuggugguucugcaaacaucuuuacuaaacaguuccuuccaggguaacaggacuuagccacagggccacagccaggcaauacaccaacauccccaauagcucaguuugaacauagcacgacaggcugcccguggccagcaggagacagaggagggcaggcuccagcggucacuucucuaggggugcauaguucagcagcuucucaaucagguccacgugugcuagcagcaugcggcggcagcaguagcgcuuuaggcccagagcguccagggcaucccccuccguguacuuggccugcagcagacccagguaggcuucccauuuguugccgacgaucuucccgcaggugaagcagcgcaccgggaugaucauggcggcgucugacauccugauuuucuaaagggaagauuuauuuugccccacaguuucggagacuucugcccaagcuuaauuggcuccauuacuuugcaucugaggugaagugcaguccccuguuagcaaggguguguaaaggagacuguuugccucggagcggucaggaagcagggaggagucuugcauuuuaucuuguuauaaaauccaacuuuguucaccuggauaguugcugaugguugcagcuggaaaugauaacuggcauguccacauccagucucuuuguguggauuaaacuucucauggcauguguguugggcuccaugaccacacuugaggcagaaaguagaagcuuucagucucugaaaagccuguaucaagaaauuggcacauuacuucuaguaauauucuacugguuagagcaaucaaggcgcccuccccaucagcugauagauuuauacuauuuuuguguuuauguguguuuggugcuaggacacccagggcauggcacauacauauccuaucacccauggccugacuccuaccuuuuaaagcaaaaggcucucaaaaacuacuuuauaggcucccaacaugugugugaccacuguacacagguauauaacacacaaacacugcaugcauuuuguauguaucaaauacucuguagcaaauguaaucuaaccacacauaauugcucuuagaaacugggguacuuucuuccuucccuuccuccuucuuuuccuuagcauucuaauauuuauucaugucccuuagaguucuucucuuccuuguuuagcauuacgcuuuccuucauugcagagaugucuguucuuuucugagucugucuucccauagaaugccuaguuugaggccuuaagugaaauaucagcugucaaaaaaguaaagcuucaauuucuuggugauuuauucucuuaauguuaguuauuaguaugugaugucuauacacuuuugauuguguguauuuguuuauauuuuuugaaagugucuuaccaugaccaagauugaccucuaacuccugggcuuaagagauucuccugccucaggcuccccagguagcuggaauugcagaugcaugccacuguacucaauggcugaugucuguguuuuaaagagaauuguauauguuuuaaaauauacuacauaaaagcaggauaaauaaaauaguuauaaaaugucccucccagacucaaacuuuucuugcuuagacucagcuucagaccacauuuugaaguauguguauccuuuaggagguggggccugacugguggauguuuguuccuggggauagccuguugaagguuuuuccaaucuauggcucccucagagcucucugcuucugguuagccagauuagaggagccacuucagcauacucuugcugccauaaauucugucagaacuuucccaucuaugauggacugaaguucuuccaaaacagugaucuaagauaaacucccccuuaaaugauuucuggguuuuggucacagaauaaaagugauacaguaucauuuucagugauauuauguuguaaccucccaaacaauaggguuguuuuuguuuuuuucuuucugagacaggguuuccucuguguagccuaggcuguccuagaacucacuguguaaaccagauuggcuuugaacugagagcucuaccugccucugccuccucauuguugggauuaaaggcaugcgccaccauacccugaucaguuuucauuuuuauuuauuuucuuauuuacuuuauguauuugaguacauuguugauuucuucagacacaccaaaagggggggaucagauuguauuacagauaauugugugguugcugggaauugaacucauguccucuggaagaacagucagugcucuuaaccacugagccaucucuccaaccccaucacucgucaguuauuaaacuacaguuuuguuuuuauauuuguuguuguuauugguuugcuuguuugguugcuuuugagacauggucuuuuuaaguaacccaaaguagcccugaacuuagcaccuucuagcuucagcuuccuguguagguacacauuuuuguaugccuguuacuguuauuuaguuaauaacauuaguguucuuugcuuuucacagaaggaaaauaggguaauguaagcaagugaaaauauucaaguuuaaucacuaaaucgccaaauuagugugccuaauuuguucuuuccugcagugacuuucuaacuauucuuuccuguaguauuguuuccuuauucaaauccaucuuguauauauccauuuuggccauccugaggcaguacugacuugucaaaugucuucucaagcccuccauucugugacaguauuuacuuuuaugaagcagcuacuaaguguugacaggauuauuaagauagagucaggauccaucauauuaucagugggcuucuuugaucccagcuauuauugcuucaugauuccuaucguuuacccuacuuguccacauuguaaggcaauguaaggcaguuuucucaguaauuucucacuuuaugucucuauggugcuucccuucucaaaugcugccuuucucaccucgucucucaucauuucagccaauuuguuauuugggccaaaaacuguacugaccuagcaguauagguagugagcaguguaggacucaagacuaagacaugaacuccaagaacugucagacacagcgggggaagcuuaagccacccugaaaggaaggggccagcauuaaagaagacacuguggccuggcugaagcucucuccgucuagcugaacuggauuuuccuuuccuugaguucagcuagugaccugguucauauuaauauguaguagagcaauugauuguugacuuauuauuucauaaauauuaacucuuguuaaccagaguaagacauuugugaccaucaagcccuguuuucuguaucucuuagaaaaguguguuccgagucugaaucccuuaagguuccaccuugccuuccgugcugagacguggcugcguuauguagcccugcgcagucuucuguuuucucuaggauguaaaagcucgccuuagacuggaaguuugggaacuguaaaaggugucugcuuuuugguuuguauucuaucaugagcuuauuuuguuacagaacagcucauagcuccccaggccaguguuggucuuuggacuguauuuggaauagcacugccaucaugugagcuaucaaguucuuguuuuguuuugagacauugucuugcuguguagcuuaggcuggcuugaauucucaguucuccuguuuaagcuucaggcuacacaucaggcuacuuuguuugcuuuaguuuauaauucuuuuuuuaaauauugcauaauuuuacuggguuauauacauauauacauguauagauagauagauagauagauagauagauagauccccuuucuuugaggcagggucuugcuaggaagcccaaguuggccuuaaaucuauaacccaguaaaauauacacacacacauauaucccuauuugucuaaaaagccauugcugaagacuuuggugacauuguuccaugaaggcagauccuguccuugccuuugcaggguuucuuguucuacuuccccuauuucauuucuguugccaucugaccuccacccuacuuucucuuccaucuuuauaaaucauugcaauagauaacuaggauuuucuuucuucacaucuuugugcucuuguuaguugggacugcacaucuaacaagcagguuccuucagaacccugcuguggcucucucauuaccuuuagaaaacagguaaauauuucugugcuuucauagccuuuuaugacuuguguggagacuuuuugacugcuuugccucauggcuucuucuauguucugucuggcagcugauuccuagagauguacuugguuucuugaccuuguccccacacuauuccucaccucuaucaaagccaucucaucaaagaagaaagacauuugcuuuuuuucugauuacuucuaguucccuuuggugguaguuuuccuucuugauguuuuuauuuguaauaccaucuacuacuauuauuuccacuguuuacaguuuuguuccccauuaguuuuguaagccugguguggaaauacucuaauccuccagcuucuaaaagcauggcauuuuauauagcaggauauuacaaguuuagaucuaaccuuaaacuagguaaugacuuacucuuuuuaaaaaauugucuauauaucugacacaauuuucacauucuuuuaaaaauccaaguuuuaggggcuaaagagaugggauugagaacgcuuuuucagaugacccacuuuugauucccagcacccacauggcagcacacaggaucuguaacuccaguuccaagggcuccaacaccuguuuuugaacuaaaguguuguucauccuuagggagcagaaaccaggccuuaugucuucaacaccuauccuuuuuuuuuuuuuuuaaagauuuauuuaucuuauguauauggguacacuguagcuaugcagaugguugugagccuucaugugguuguugggaauugaauuuuuaggaccucugcucucucuggucuaugccacucucucuggucggcccaaagauuuauuuacuuauacauaaguacacuguggcugucuucagauacuccagaagagggcaucagaucucauuaugggugguugugagccaccauaugguugcugggauuugaacucaggaccuucggaagagcaguuagugcucuuacccgcugugccgucuugccagccccagcaccuauccuuuuaauacagagccugcauuugcaagguaaaucugcuugggauuuacauugauacuaaaauaaugaugcugucugagaacgaggcaauccaaggcauccuugucauaccuguuacuuaauagauguugucuuaguuaggguuuuacugcugugaacagacaccaugaccaaggcaagucuuauaaaaaacaacauuuaauuggggcuggcuuacagguucagagguuccguccauuaucaucaaggugagagcauggcaguauccaggcaggcauggcacaggaagagcuaagagcgcuaugucuucauccaaaggcggcuaguggaagacugacuuccaggcaacuagggugaggaucuuauacccacacccacagugacacacccauuccaacuaggucacaccuauuccaacaaggccacaccuucagauggugccacucccugguccaaggauauacaaaccaucacauguucuuagguaguuugauggugaauuguuaaugaauugauaccucaguagaacauauccagugucacuuggcccauuuggaagugacaauguggcagaaacuauuucucucauuauuacaacuuuagacacaagguuugaaacaggagauaaaauguaccaaguuuuuauaugcaaggucauuguuucucacugcauauaucucaagguaucaguuaccauuuaguucagcaugucuugauagaugcauggagcaaguauacauagaaaaaacugaaaagguaaaaaugggauuuuuagaggaaagcuguuugguaauaauauaguccuaacccagaauuggaagggauaaguccagauauucauaaaguauuaguguuuaauaccggaaugacuagagucaaaggaaauuaaagugcuuuuggagugcuuuucaugcaagugaacuaagaccauucccuuaaguuguacuuaaucagcccuuaagaauuuuguuuuuuguccaggcaccuuuaauccuagcacuugaaaagcagaggcaggccgggcagugguggcgcacgccuuuaaucccagcacucgggaggcagaggcaggcggauuucugaguucgaggccagccuggucuacaaagugaguuccaggacagucagggcuacacagagaaacccugucucggaaaaaaaaaaaaagaaagaaagaaagaaagaaaagaaaagaaaagcagaggcagguaaaucuugaguuuugaauccagcaaguuccaggacagcuugggguacacagagagacccugucuagagaagcaaaacaaagccaaaaauuuuugauuuauuuuuauguguauggcaguuuugucugcauguauaucuacacaccacuuggguguuggaucuucuggaauugguguugcagaggguuauaagccaacaugugaguacauggaguugaauacuggauuucuggaagaacagucuuuuaggauuagaugcuguugaucucuguaaauaaacugaacugauuguaucauuuagagagcagagagagaugauggggaaaauaaaguugaaguuaaauuacuaaauuguaauuaguuaaauuacuaaaugguaauuaguugugucuggcagaagaccacaccagaaguuagucuggucacugguuuuuagguggcaacacuuaggaccauaccaagacacucuaccugggcugcuuugaucugcuccaucuccagguaucuuuguggauaguuacacacacaauuuaauuagugcauaccuucugauucuucccguuuucauuuuguuuacuccauauuuucuacuggucacaauuagcauaccagaaaacaaagaaugucaugaaccaucaaagaccuuuucagaguaaaccaaaguguaggaguguuuucuggcagaagcagaaauauguuuugguucucagcuccguauaaaccuggucuugccuacuacuuuucuuuuauaaacugauauuaagaagaaaacaaaauacuccaaguuggaaaucuauuuguuuacaaauguaguuuuaacagaaaaaauauaaaagcuuuacuauucuguucuuuuuaauagauaagauuuuaauagugauggcaaagugguacaauaauccauuuaguuaaugaacauuugaaaauaaguauugcuuaauaccauagauuuugugugugugugugugugugugugugugugugugugugugucuuaaauaucucccaaaauagaaauugaaaauaauuuaaaaugaacccuuuuuggggaggauauaguuaaauaauggguguuuguuuuuguuugaauacagagucuugcuggguagcccagauuagugauaaacucagaauccucccaccucagccucccaguugcugggccaugcuuaacaguggaugauacuuuuguuuggugugugugcaugaggccaggaguccaauccaaagccuugcacaccacccagucacuuugccacagagcuauauuccuaguccuggaguuucauuuuuccaauacuuuuuuuuuuuucucuaaaaaauguaacauuuuuguuaauuuguuaagaauuuuguacaugcauucgauguaugugaaucauacacaccucacuaucccguccaauucauuccagaaccuucacacaucccccaaacuucauguccuccuuuuuauuguuuuuauuuuauuucaguucagucuuugcccuccuccuaguccccccuccuacaguuccucaucccauuccuccucccaggacuccccacucccucagaccucaagucuuacugaggucagaccaggcaguccucugcuguaugcguuggggggccucggacuagcucuuguaugcugccugguuggucuaagcugucaggcuuagagucugagagaucucaggaguccugguuaauugacacugcuggucuucuauggggucacuccuccuccucagcuucuuccagccuuucccuaauucaaccacagggguucccagcuucaguccaauggcugaguuugaguaucuguguuugucucagucaucuguuaguugggccucucagaggacagccaugcuaggcuccugucuauaagcgugccauagcaucagcaauagagucaggccuuggagccuccccuuaagauggauccccaaguugggcuggucacuagacugccuuuuccucagucucuucuccauuuugucccugcaauucuuuuagauagggacaauucugcaucaggguuuuugacugugggauggcaaccccauuccucacuugaugcccugucuuuuugcuggagguagacuguacccgaguucccccuccccacuguuaggcauuucaucuaaggucccuuugaguccugagaguuucucaccucccaggucucugguacauucugaagcaccccccccucccccaccccaccccaccccucccacuccucauauuuccauucauucugcuggucaucagaguccucuccuucugugucaucuguacucccccacccccagcugaucauguuccccuuuucccuucucccucaccccucucccacccaggucccucucucccucugccucuugugguuguauucuaacacuuuuugcugaugauaauuaguggaauuauuuguuuuguuuuaggaaagaacuacuuuucaugaaccacaccaucuguuuguugaaguagaaaagcgagucuuacucaucaugccugcuguagcuucaguuccuaaagaacucuaccucaguucuucacuaaaagaccucaauaagaagaccgaaguuaaaccugagaaaaccagcaccaagaagugugugcuaguuugauugucauguaaauuuuauuucauucccuuauuauuuagauuuaauaaauagcuaauuuaaaguuuauuugaaaaaugaugugaucacaagaguaaauaagaccuagagaaguucuuaacuuugucuuaacagaauaaaugugagauugcucagguuuaaguaccugcuuccugaccaguauguauacuagaugauauguauaccaguauguguacuagaugauauguauacauaccaguacguauauuagaugauguguuuaaaagaguaugaagguucuaguaaagccauuuugccacgucauuuuuucucauaaaacauuauaacuuuuaauuaagguuuuuaaucuuuuaaaagaucaccuuuacccuuguguaggacaugugcaaguuaggauguugucguacucuuucucugacugaaagaggggcuaugucuacuuuuguuuuguuuuguuuuguuuuguuuuucuaauuauccucaauaguuuuauggcaacuuaacacaagcuggucgucugagaggagggaccuaauugaaacaaauaccuccauaagaucaggcuguaggaaggcaagccuauaguguguuuuuuaaaugccugauggaagggacuuaccccaguccucugagggugggaacaucucugggcuggugguucuggguucuauaagaaagcagccuaaacaagccaggaggagcaucuccauggccucugcaucaacuccugcuuccagguuucuaacagguuugaauuucugccuuggcuucccucaauagacugacucgggauguguaagccaaauaauccuuuuccauucugaguuauuuuaguuaugguggaaucccuaagaugcaaauacuaguauucucuggguuuuauuuuauuccaguuugauagaaucuuuaacuuaaugauugauuuugugugguuuuacuuguuugggcuuacaucuaaggcacauguagaaagugugucuuuccaggagagguuccaaacucucaugguccagugguccacugauucgaauacuugcuggaaauauaaauuugcuaagaauagguuguccuuaaacuugucaacucaagugguugaggaacagaaaacuuucuguucacauuuauuuuuaccagcaaaagagauuuagaaacuaguaaguaauuacauuguuauuuagguggaaauaaaguuuuagaaagaaagguaaccaagcuaccacauuccccaaacuuaggaaaaguagaucuuagagagcaauggggagcaauagguauucucugauuggagagaaauaugaucccaaaugaaucaaugaagacaagcuaagauaccuguguaggaaugaagauggaagaaaauaaugcaucagugguggcauuugagcaguggaacuucacucaggugagagaggguccaccacauaccacugucccuuauugucacccguagcacaauggcuuuucaaaaugcccguuaggagaaaauagagaaagauuggcuucuuccugagcuaaguugguaacaugggguagcacggagaguaauuuuguuuaauucuuguuguuugauuuuuuuuuuuaaucaauaaagccaucuuugaacuuucucaaauacuaaagacagaaacuuuauaaauguuagcucaaagauggucauuucuuucuaucagggucugauguaucucuuaagacuagccuaaccccagagggaaguuauaaaucgaauugggugaaguaacaaacuuaaaucaugaaguguauuuuaucaaagucaucugccgaguuuaucuguuacauguauuuuuccccaguaccaaguuuuguaaauucucuucguuucuaaguuauauacacagcgcgcagaagaucuucaagacagcagaagaaugcagacuagaucgugaugaggaaagggccuaugugcuuuauaugaaauauguggcaguuuauaaucuuaucaaaaagagaccugauuucaagcaacagcagguacccucacuuugcuauuuuauuugauauuuuuacccaguagagcuauugauuaccucuaaaagcuuuaacuaccugugaaauuaacuuuuguuccuccucaccucccacucaauucuggcaacccgguaaugcuaagcaggaggucugucaccaacauaacaaugaauuuaaaucacauauuuaaacaauuuuaacaggacaauuuuaacuccuguggggccaggaaaagcaaagcaaaaauauauuuuuauuauuuguuaguguauucaugcauacauuuugcuuggaucaauauaugcauauaacaguauauaaaccgauuguuugcuuuuuguuguaauaaauuauugcuagaucagguggaaggauugcguuuauucagugcacugaauaagaaaaauaauagcugaguacaguggcucaugcuuguggucucuugugagcccaggaguuccaggccagcuuggacaacauagagagauccucuaucaauaaauaaaacagagggacuggagacauggcucaacggauaagagugcuuugugcagaaggcccagguuugguucccauuacccauuucaggugacuuacaaaugcuucugacuccagcucuaggguauccaacgcccuauucuggccuccuugggcaccugcacauguggcauacauucacacaacacacacaaauguaaaguaaguaagaguguguuuucaggucugcuuuaaggucagaucuguaacuaucagccuuuuuauuugacugacacuggagcuguauuagaugcagcuuuagaauuaagagcaagacuucagugucucuucauguuuucuuuuuuguucuuaaucuguuuagcagauacuagucuuucacuuugcugaagucaggaguagaaagugaggacuaucaugguauagacagagaaacugauagcuagaauuggugugaaaagaaaagauguuugcaucucaguuguccuagaaacaggcaaaauaauauauaagugguguuaaagaauaggaagaaugcuguauuagugcuucgacuuuagaaaugaccuuguuaucacaagaaacagcaaaauacugccuagagauuucuuaucccucagacgaaccauucuuugucugagugucaugcuggcuuagagguuagagucccccugccugucuccaaagcacuucaauuucaaaaguacagcggcaugucuagccaauuagaaauuaauauugauauuuuauuuuggagguuacagugacacacucuguuagcacuugauacuuuauaguauuuuacuuuguucuguagugggaaaguugacuuacagaagcaauaaaauuucucuuauuugaaguccccuuuguuuuugcccagaguauagugacugauaacaucuuuuaauaaggagggauaccuuaauaguuaggcuaaugguaguaggucauuucuucuccuagcaaaaucaugcuaauuguuauuguguuuuaagguguuuuuuuggggggguuuuuuuuggggggguuuuuucgagacaggguuucucuguguagcccuggcuguccuggaacucacuuuguagaccaggcuggccucaaacucagaaauucgccugccucugccucccgagugcugggauuaaaggcgugcgccaccacacccggcuuguguuuuaagguuuuaaugucccuuugcacuuagggauuuaucugccuccccauaaauaguugaauuaguccugcuauaggagaaaacaucuuuuaauauuuaaaggcauacuuaucugcagaguaagaagccagaagccugccuaaauucaaacacucuuuaaaauguucuggagaaauugcuuuuaaagagggcuggcuggugagauggcugacuacaaagcuggaagaccugaucugacucucuggaccugcaggguagccgagagcagauucccacaugcuguucugccuuccacaugcacacugggagguugugugucacacaccucuaccccggcuccugcccugguacucucuaaaugcuuggaaggcuucgggauuacuaacuuugguaguugcugucaucugguuagucugucauugaacugauuuuguguauuuguuuuuugcuuuacuuuuggaacuuaguuuuuuucucuuuggcaagguuggaauuaccauuuugauugucuguuccuccccauugaauagguugggauuaauuuugauggauaagaacucuuucaacagaaaguacccaaggagcugaaggggucugcaacccuauagguggaacaacaauaugaacuaaccaguacccccagagcucgugucucuagcugcauauguagcagaagauggccuagucggccaucaguggaaagagagacacauuggucuugcaaacuuuauaugccucaguacaggggaacaccagggccaagaagugggaguggguggguaggggagcaggguugugggggaggguauaggggaguuucgggauagcauuuggaauguaaaugaagaaaauaucuaauaauaauaauaauaauaauaaaaccucuuuccacauucucagugucaccgaguuugugaaggucagguucagaagcugccuucaaagggucagcuaacccaggcuguuacuuuggaugcugcagucacuugauucccuguuugucugccuagagcccucauaucuccugcuuuagaacuguuuauguuuuguuucauuuacucuaaccuucaaguaugugagguauuaaauugccuacauauuuuauaauuauaacuacuuacacugaguagggacagaauauagugcugaauuccuucuuguuuuauauugcaaaguguuuaaguaaaaguuaauguaguagagagggcacagugauggagcugaaaacucugggucuugagcagugcuuucagggucaugugagaagcaagagaagggguaaaugcuggcauagcaaauccucaugaaacuagaguuauauucaagacucaaucagagcauugcaaagcacucacacgcacgcacgcacgcacccccccuccccuuuuuuuuuggacaggcucuuauuauggagcuuagcuggccucaaauguaagaugcaccugcuucugccucagacgugcugggauuaaaggugugcaccaucacaguccugcuguuaaccuuuuuuagauuuauuuauuuauuauauguaaguauacuguagcuguccucagacacuccagaagagggcgucagaucuuguuacagaugguugugagccaccaugugguugcugggauuugaacuccggaccuucggaagagcagucgggugcucuuacccacugagccaucucaccagcccccaugguuaaccuuuuaaauuagagaagcugagagaaauaggaaagcuauacggguaaaccugugcaggauuuucaguugaggaggaaucaagaguuaucucucugugccacuugacauguugucaacaauaucuaugcugauaauggccuuuagggaaccucaguaauaauagaggacggggaggacugcugccuccuaguuucuaauagacaguuucaaacacagcagauugguuuugguuugguuuuguuuuguuuuugagacaguguuuuucuguguaggcuuaguucuucuagaacucacuuuguagaccaggcuggccuugaacucagauucacccgccucugccucucaaaguucugggauuaaagguguacaucaccacugccugccuuagacuagcuuucuaauugaguucaugaaaguaaaacaaaugaggacauuuuuguuuuugcuuuguguuuugcuuuucuaagaggcuugcaaugauuguauuguacuuuuaaagaacauguugcacuagaagucucuaauauucaguuggugcaauuuugaauaaacuacaccuuuauuaguauuacuuggugaagggcuuuucugacacagugaagcauuagaauguaaaaagucaaaggcuugaguuuuuuaguuuagaucauugcauagauacaugauaacuguuacacagauuucuuuacggucacuacucuuucccacuucgcugcugaaggugagcccuuuaucuucauaguccuucucacucacugccuuucauacacacacacacauuuuuacuacuacuacuacuacuacuacuacuacuacuacuacuacuacuacuacuacuacuacuacuguuagcgaugaaguguccuaauagguuuuguuacaaagacacagugacauggaaugaauuagagucaauaagccuugaugagccgggcucaccuuuaaucccagcacucgggaggcagaggcuccgauuucugaguucaaggccagccuggucuaaaagugagugccaggacagccagggcuauacagagaaacccugucuugaaccccccccccucaaaaaaaaauaagccuugauggcagaaucucacugaccguaaugugugaccuucugaaguaacuucauuuaguuacuuuccacaucagaccuuuuuuugaguuagauuaugcuauuacuuucuauuugauuuuagaaauucaugauuuccucaaguauaaaauuuguuuugugugucaaaaguaucuuaacucuaguuagcauguaacuguuacagauagaggcaaaaauaucuguuuaauauaguaaauacagccucucacagaggagcacaccuauaaccccauuacuugggagcugaagaugaagauccuagaaucuaagccagcuugggagacacacugagccccagucucagcaaauaaaucccaaacuauccaucuuuucauaauuugcuuuauuccuuuugagacuagagaaaagaaacuuaguguauacacauuuguaagaagaaaauuugcuuuguuuuuccaaacucuccucaguauuuaucugugaucagcaguguuacuuuuaguggcaucucauaaauaagguaaaucuauuauaucguggaucugugcauacugauguuauaaagauacuuugagaguuuuggacaguugugcauuuauauagguuagacaucaaaaacaaacacuucuguuucuuuucuacaggcaccaagauuuuaguguuuuguauaacaccagugcuguaucugggccugguacuaacaguguggcaugguuuucauauacuuucaggauuauuaucuuucaauacuuggaccugcaaacaucaaaaaagcuauugaagaagcugaaagacucuccgaaagccuuaaacuaagguacugauguuacuauaaauucuguaaaagaaugcaaauuagaagaugauaauacuauagguuuguucauuuauaucuaaccauaccuauaauagccauuuccugcaaacaagucauauguuaacugauacugcccauguugauguguuacuacuaauauucuucaugaacauuuuaggcuauuaaaauggcacugguguuuuacauuagaacucauguccaauuuuucauguuaagguauuuguaaauuuuuuuggcauaauaaaaaggaauuuuaauucuucacauauguauguuauauuagaaacugcuauuggcuuuaauaugaaguauuuauuguuaguuuuaaucucccuguaauugcaaaaaucacauaucuuaaaaacaaucugauuucaguauuuaccaugacugccuuuccaguuuaugaaaugauuacaaauaagggcuacagaaauggcucaggaguuaagagcaacuugcugcucuuucagaguacuugagcguuuuguuuguccuuugacccaguauuguuuagaaguauggcauuuaauuuucagauaugagauuuuucuggguaucuuacugauaucuauuucaauuucaucaucgcuacagauaauugauuauuaaacaguuccuguuuaugguucuacauauacuuuuaccuuggccaggaugcaguguguacuugaaaagacaagugcagugacugaauauaccccacaauggaaaugcaaguucagcuggagugugauaggguggggaugguuaggagggguuagaguugacagaccuuauuuacacuguaguacuguuugucauuuaggucucugugcuuuguugaaugcuguucagaucuuaacuauuuucugccccacccccucaaggauuuugaaccuaggcccugugcuaccacaaaugcucgaacuuggaaagauacacacacacacacacacacacacacacacacacacacacacacacacacacacacacacacacugccaugaguugcccagacuauccuugaauuugcagcccuccugccucaccgucucaaauaucugagguuauggaccugcguuuccaggccuggucuagcccagcuuuuguuacuggaggugguggugguuuguuaugaguuuuuguuuuguuucaugggguguuuauuuuggcaacgagguuguaacaauuauuaugacaggauacuaaaaaucuaaacaaauacuuuauuucucucuguaaucacauugagcuuuuguguaucuuaaguuggauuuaggaauuuauacaucuaugguuaucauacauuccugaugaauuccaucacuguuucucuuaucuggaaacagucucuccuuugaggcuggccugcagcuuuccuucauuacuggcagcccauucaauuucauucuguccuacuuuuccauuuauccugacagucugccucacugacauggucccucuguucaugccuaaaccggccguagcauauaugcuuaaggaaagcaaggggaaguacuuuuuucucuaccugccuuuccuguccuguuuucuggcucgcucuguugcuacaugaugcaggugucugccugacuccuugcugggcucuagagaaucgcccuagcuuuucugguaguccacauuugugaggaacaaguucuucacuuuucuuaucuagaaauacuuuuauuuuuacuccuguuuuucauuugcuugcuuauuuguuugggugggagcauguggucgucugccacagcuugugggagucauucucucugucagacuaaguuaugaacugaugcccuuguuccuaaguaauguuuucauaagauucgugcuucugaguugacaggguuuuuguuguuguguuuguuuguuuugucuuuugucccccuugguagcucuggcuagccuggaacgcuuuuauauagaccaggccagcaucagagucacagaagccuuuggggcgcuggaauuaaaugugcagggccaugcccagcugucuucuauugauucugacauggaaauccccaccaguugguccuguuguuaauuuacuguaugucuuauguccuucuuuccuggcuugagauuuucucuuuaguagcagucuaugaugugacuaccauuauuuuucuauuuuuucuaauugggauuacuggacucugcaucuguaaaucuaugucuuuuaucaaauuuggggaguuuggggcuaugauuucuucaaauauuuuuauucuguuucauucucuuacuggcacucuggcuauucuugugacaggccuuugguuugucaggaaauccaccugaggcuguuucuguugcugucuaagccucucuugucauaguuuuuguugcucuuuagguuguaaauguugucuccaguuuucagguuauuuuucagaaacauuuuaacucuagaauuucuguuuagcuauuuuauaguaucugcuuuuuuacagaaguguccuuuauguuuagucauuacaaaccauguuucacauagccauggccagaguugguuagcugcugugauugcuguuuuaaaucugucauucagguuuaucucagccaguuugcacugcuugcccuuucucucuggaugucuuauuuucuugcuguguugguuaguuucggacaugguggguuuuauucccuucaagaguguuaggguauuuuguucuagaaugguggugaacuuggcuggguuggauuuuauacacugucuugccugugguagucagcaucuggaaugucuuuuaaaguuagcuguuuccucaguguuugcucuguucuuacuuaguuuggguguuggcuauagacugggacaacuuuaugcaaagagggcugaaacuuuggcgcucuguauuaguuuuagcugccucuucagcacaugaaguccugguguuaggaauaaaaccaucaaaauuagagaguuugacagauguccuuccccuucccaguucuucacccugccugcuccuuaucuuuguggcaguccagagcuguggcugucuggggagguauauguccuucauauacaaguauggacaauagacaguauaagcaugccagaguuuuaguucguucuuuccuaacugacuggaguaaauuauuuguuacccuuuucucucucggcucuaccuucucucuuccuucccucaccaccccaucucugucucugucuccaucuccccugauccucuuaaguucagaaccagcagucauuacuguauucacuaaugacugggugagcaaugucuuaggauagcugcaaacuguacucaccauagcuuguuuaacauuuagcaaaauagaagauaaucacgucuugacuuugauaauaauucuccaguugaugugguuaauaccuuucuugaauacuuguuuuaacauuuugaucuaaaucaucuacacagugagauacugggagaaguccucuuccagagugaaucaagaguuuguuuaaaaagugaaauuguagcagaauugauaauuacuugaaauuagugaaaaagcaagaacaacauuaauaaaaagagcauaacauuuauuuuucaagguguuuguccaguuuaaaguacacagacagccccugagggcagaugcaugugguuuguaugggaacucuagcagaauucucccaagccaagaugcuaaguaugaaacaugaacgcccuuagcuauacuccaucacauuaauaggaagcuucuuucaacuagauacgaagaggcugaaguucggaaacaacuugaagaaaaggacagacgggaggaagagcagcugcagcaacagaaaaggcaggagauggggagagaggacagcggugcggcagccaaacgcucuguggaaaauuuacuggauuccaaaaccaaaacccaaaggguauugcaaguuuauuguguaaacgcugguccuguuugccaggugaccuaucuggaggaggugcacugccacuguaaaguucuuuugaggcaauagggauaccauugguuggaauuagaaucaaagguccugacugcagguuuuccugugagcuuccacagcagcacuguccuggucacugguuacaauguuagcagucacuacaguggaaggaggguggccugagaggaaccauuggauugucaucuaucuaucuaguucugggccugugugaguuuugcuuaacaacucuuggacucagguuugccaaaugaagaucuuuuuuuuuuuuuuuuuugguuucuugagacaggguuucucuguauagcccuggcuguccuggaacucacucuguagaucaggcuggccucgaacucagaaauccgccugccucugccucccgagugcugggauuaaaggcgugagccaccaugcccggcccaaaugaaggucuuaaaacgaggucuaaggugucuuuuuccuacugauaaaucuccauuaagagaaggaccagggccaggcauggugguaaggugagugccuuuaaucccagcagaggcagguagagcucagaguucauucaagugaguuccaggccagccagggccacacagggaaacccugcccaaaaaacaaaaauaaaauaaagagcaaaggacuugguuugcugcuuuauuuggucccaaacaguuuugguuacuggagucuuaggcacacacgccaucuauuccuuucuuccucuauuccaguuuucccuuugucuguccuguucagcguuuuauucaaucuucuuagcauguguacaagaugucuuuaucaaaagccaccagugacacaaucucugccagcugucacugugccccuuccuuacuuucucagaauuacucuccugaagauguaagugguuuucaguuguugaacuccuuggaggcugugcuuugcucccucugaucccuguguuucuuagggguacguaguguuccccuguugcuaguguggauugcugguauuugggagaggucucacuggguuaagcagucugaucucccauuguuggaauucacagggagacaaaccacuaaccuucucaacaggucaaguggcugccguaagcaauaaccggacuuaaaggggaaucuuucauuuuguugccuuuucuuuuguuuguuuuuuaagauaauuuauuuuuauucuuugggcauugguguuuucccuccauguaugucugagugcgggagucagaucuuggaguuacagacaguugugagcugccaugugggugcugguguuaagagucagcagucaaugcucuuaacugcugagucagcucucaagccccuuauugccuuuuuagaagugaguagucacuuuuuuucucuaauuugagacagagucucuuguagcccaggcucacuuaagucguuaaggcuggccuugaauuucugcuuuuugccuuugccccaauuucuaagauuauaggcccuuguaaucuugccaagcuaauggcaugcuaggguaagcaaaugaccagcugugcuacaucucccacccuguuacugugacguuaacauuugcccacuuugucuccuacacuguuucucucgcucucacucucgcucucggcuugaguauuuguacuauuugaguagcugcucugcuacuuuacugcuaacugcuuugcugcacaguucucauaacuguaguccucgccacccuguaaacuuaauaguaacuccuuaguauccccgggugcucagucuguauucggauuuugcuguugccugcauguuaauuucacaaguuaauuuguccacaaguuaauuucacaaguuaauuuguucacaaguuaauuuguugaaucaugaugcaaaacagugaacugucuucugauuguuauaucucuuaaggcgcuaaaauaauuucccuuuaagauucucuuccucugaaacuucgucauaccauguacuugacugaauaaagaaagugaaccacacuuucccccagccuguaggcuuuccuuuauuuccugcagugucagggcagugcuguuuaguuucaugaugagaauucucugcggaugauacccuguguuucauauugugucaugcuaggagccagacgauauauauaacuugggcaaauguguaccuacaaguguguuacuaacuuugacccauagguucaagcggguccucaguuuucccaucuauaaaaugagcuagcaucuuacaagguuaugucauguugccucggaaaauguaaacuguauaaguaguagaaguaguauguuguuauuacuugauuuuccuuuaauuuuaugguagaaaacacugacuagaauacuagaauugcuguuucauuuuaagaaacacuuccuaauuaaguacucaaaugauaucuggcacuuguuuaagaaaauuggagccugaacagcgauucugauacacuugugguuauuuuagcugaugccuaguaaagccaguccugugucuaaacucuugagggcagaggguguuaccaggcugaguacuucaugcacucaaggcaagugcucugcuccugagcuguaucuuuuuuuaaauguguauuuuuuauaaaaugccauuacuuggcacacuauuucuuagcuuucgauugcaauggaguauuaaguuugagucucuuuugugaaguugaaacgcuuuucuucugugaacuagauuaacggcgagaagagugaaggagcugcagcugcagagagagguaugugagaaaggacguuccgcugagucucuccacuggaauagacuucaguuugauacagggagagucuuccuguacucuguaaguucuguauugguuuacugaggggagaguuuaugcaccauuuuagucugguaugauuaaauguggcagugugcagcuuacuuguuuuguuuucuagguacaguaguuaaccauaguguaguauuugagagaugaccacucagcagcugcucuucaguauacugaguaugauacuuaccacucuaccucagcuuccccaucuguaaagaggguuucuuuuggcucacgguuccaggguacaguugaucacagcagggaaguaaguaaggagcuugaggcagcugggcagcugcagugcagucaggaggcagaggaaggugagugcuagcacucuggucaucgcuccucuucacccagacaguaccucagccguggagccaugccaccucagccagcuaauagaaaugagacaguuccucacagacgugccuagaaggugucucuacggugauuuuagauacugugaaguugacagcauuaacugucaaaggaguuaguaaggaaacaguucauagugaauucagcugcacauauuaaacuuugagaauccauaguaaauuuaagggcuguuagcuguuauuugugauucuaguuuguaagaguuaauuauuuaguggaugcccuuaugccccgaagaagaaaucuuaaccuguaauuugcauguauccauaccugguauugugagaucuagugacaaguuuaugaccuaccaauaagauagguaguugacuucaucuauuagagaaauuuuuucuuuuucagaaaaacuauaaauuaaacauaauuauauguagcaccaaaguaauuguguacugaucauacaguaauuuuaaaaauaaacuacguguaguguaagguacuuuccucgaagcuguuggugaucuuaagguuaguuuucaucauccuuguaguucauccugcguagguauuaccccauucuccgugguagaaggugcuucuggcaagccgugucuguaucuaaaguuuaaugugaugcuuuuugaucuuucgcugcaggugguaaagcugaaaaaaaaaauagcaacauaguuuuguuuguuuuugccaaauugcauaccccauuccaauuaauuaauaauuggaaaucuaaacauuccaacaguccucauagcaccucgucagagacccaaaaaaaauuagaaaaagauaaauuagaaccuguugagacucauuuguuuacgacaguaacuuaucuauacaagacuggccuugaauuuuauauguagucagggcugaccuuuuaaugcaaguacuccaccaugcccaguuuaugcaguugcuggagauugaacccagggccucguaugugcuggaaaaguauuccagcaacugagccacaucaccagcccuugugacuuuauuaaucaugcauuuuguguaugaaauguuucuauuuuaaugaagcacauauuuaauuuucuuucuuugagagaacuaauaccagauacaguugggaccuugacaugaagguuuuaauugggcgaagggagucacaauggaaucaaagccagagcugaaggcugcuaggcagauacuauuccacugagcugugucuaaccuguguauaaacaagacauggaacuugucucuuaauaaaugucaguauauguguucauguaaaagauaaaaauugacugugggaugauaagccugugaugucaggaauacuuugcucuuccauguuugcuaauaugccagcacauagaacuggguguuucuugucauuuacuacuaugucucucaauuccaaggagccaucacagcaaaggaacuauauacgaugaugauggauaaaaacacaagcuuaauuauaauggaugcucgaaaaauacaggauuaucagcauuccuguaucuuggauucucucaguguuccugaagaagcuaucaguccaggguaggucauugugugcuuagauaauagacaaagugugcuaugcuaacaggcuggccuugaauguguggugcuccugcuuggccuccugguguguaaaagacuguguccuuuucaaucaaccuguguacuguugucuccauuacuguguaagcccggugugcuuauuaccauugcucugcucauuuccuuguauaacagcuuacuggccuguuuuguuuuuagacuugggccuuuauguauuggauauguucuugcuuuuuccauuuauacaggaacauaugaauuuauuaaacuuaguauaauuaaguuuaauugauuauuaaguuacauuuaaaauuaaauuauagaauggguagaacaaaguaugaagauaauacauaagaaacuuaaauuugggaaacacuuuuugacucuguuauuacccaacaucuucacuaaacuucuaaacguaaaagaaugauguaggcaaauaaaugccucuuaagaagcucacauuucauuggcuuccauuccauuccguuguaggucaagcaucuugaucuaucucuguaaggucagcuagaugcugauaguuuauacuggcuccuccuccacugcccuucccaccugauacagcagccaacauuauuacuuaggaacagauuuuuuuuuuuuuuaguccagagacauuuugcuuuauugguaaaaguuucaccagucccacucagcuugccaguacugucgguuaaacacuaaaugcuggguggguucuagaacacuggcuuguuuuucuuuuuaaucaacagaauggaucuguguuauucaaucauccugucauucagcaaauauuuucugagcaguaggcuggguuacugugguucuaagugcugaggcuaaaccaggaaagagauaaaaguuguugccuuugugaagcuuuuauuuaaauagccagauaaggacaagaaaaaugauaaaaauuaaaauaaauaguauuccuuaaguuaaggugugguggguggauguguauugggauguguaugugucugucugaugucuguuuuucugucuuggaguagacccuaaaauuuaguuuaaggaagacucacagaaaaguucuuagcaaguguugaauaugugcacaauauucugagaccaggagugggagcaaacagagaagacagggagacuagagguccuaagcaggagcacagaaagggacaagccguuagagaagagaaggaugggguaacaggauugcagucuggguaacaggccaugguaagggccugaacuucuauaugaacaaaagaauagcugagcacugacuccuucguaguugagaacaugcuggugacaggaccuaaguuagcacagacccgagcuguaaccacaggcaggcugucaugcuuuaaggaagcaugacauaugccaggcauaugccaggguacuggaacaugggguaauagcuccugacugguacugcugcggggagucaauaacgucugaagcauauggugucuggcauacuguaagcacugugugcuugcugacuaaguuaaaucuugcuguuuacuuacuguaaguauagagagacaugagcuuaaauaugaauaauguauccaacgugacucuacaguuuagauuuggcugagaagggguccaggugauuuccuguuuucaguuuugcugugucccacccccaucuuuuuuuuauaagauuuauuuauuuauuuuacauaaguacacuguugcugacuucagacacuccagaagagggagucagaucucauuaaggauggcugugagccaccaugugguugcugggaauugagcucaggaucucugagccaacccccaucuuuuuuuuuuuuuuuuuuuuuuuuuuuuuuuuaagaaguuagaauugaagccuggcaugauggcacacaccuuuaaucccagcacucgggaggcagaggcagguggauuucugaguuccaugccagccuggucuacagggugaguuccaggacagccagggcuauacagagaaacccugucucgaaaaaccaaaaagaaaaaaaaaaaaaaagaaaaagaaguuaaaauugagucuguuucuuucccucucuaguaauuacuaaagcacuaacaugcaguaaagaagggauagaauaucuuuggcuaguuaauaucuuaauauggagcuuaacuugggaaagcuuguccugguauggcacagaauaugcucaacuuugccucaauacaaaugcucauguauuucagagucacugcuaguuggauugaagcaaaccucucagaugauucuaaagacacauggaaaaagagggggaguguggacuaugugguccuucucgacugguuuaguucagcgaaagauuugcugcuugggaccacucuacggagucugaaagaugcacuuuucaagguugggggcuuuccucauuacucuaacugccguugucugauuguugggagucugguuauuuugacuggcucuguuagacuuuuaaaccaacuguacucuuacaaaguugugcucaguaaucaucucggaggugaauauuuaauauugaaagucauaauguguuagugagccuggguucagucauucucuuuucagaaauuguacuuaagcgggugacagcaugggugcuuaucuuuggugucuaucccaguguggcaggguugggaguguuuuaagugauucauuacauuuugaaauaucuguguacagacacacaggggagggggcaaucauauaagugaugcaacaguuaaugaaauucauauaaaagaaaagacaaauuaagaguuuuguuauuuuaagcugggguggaguggaggguggggcaugcuuuuaaucccagcacuccagugggggauggggguagggcagaggcaggcuggccaaucucuguuucaggcuagccugaucuacaaagcaaguucuaggauagccagggcuauuagacacagaagccuuaucuugaaaaaccauuauuuuauagaaacacauuuugaaaaguguguauaugugcaggagguaggaauaaaccgcagaguguagaagugcuaucaggucuaggcgcucagggcuagguaggcuuuguuuugugauuauuuuauaacuuuucaucuaagaucauagauuguuuuuggguucuuaaacuuuauauaucuucauuuaauguuguauuuugaauuuauuuuuuuguuuucauuuugcuuaacagggaacaguuccacacuuggguuuguugugaucugugguuuuugcugucaagagacugucccgucuuaaagauaucuaucuuuauuuuguagugggaaaguaaaacuguccugcgccaugagccuuugguguuggagggcggcuaugaaaacuggcugcuuugcuacccgcaguuuacaaccaaugcuaaggucacuccacccccucggagcagagcugaagaggugucugucucauguauguauguauguauguauguauguauguauguauguaugugaaaauuguguuuaaaauugcuucaguacagucuaaaacacuuagguguucaggguaaccuuacuuguauaugccuuuguccuaugaaaugcuaguuuguuuucaggaaaaacaacacagacuaggaguucauguucuuuaagacaguggugauugcccuuucacucuguuagcuaucacacauagccugcauagcacguaaguacugugugugaaguuugcgguucuuaaauaaauguauuguucuuuuggcaauuuuaguggauuuuacuuaucccucauuggaagaaccaguuccuuccaaacuuccuacccagaugccaccuccuccuauagaaacaaaugaaaaggcacuguugguaacugaucaagaugaaaagcugagacugucaacccagccagcucuagcuggaccuggugcggcucccagagcugaagccucacccauaauucagccagcgccugcuacaaagaguguuccacagguauugucuuggcguuuguuuguuuguuuguuuguuuguuuuuuacuaacuuuauucuuuuguuuuaaugucauauugacacauguuacacagaauuuuauauauuaucuaugauaccuuagaaaauauaaccucagaaggauuugugcaucuuggcaccuuuauuuauuuuauuuuuuuuaagauuuauuuauuuauuugggaagcuggagaaauggcucagugguuaagagcaccaacugcucuuccagagguccugaguucaguucccagaaaccacaugguggcucacaaccaucuguaaugggaucugguaugucugaagacagcuacaguguacuuguauacauuaaauaaguuaauuaauuuuuaaaaagauuuauuuauuuuauguaaaugaauacugucucugucuucagacacaccagaagagggcauccaaucccauuacagaugguugugagccaccaugugguugcugggaauugaacucagaaccucuggacaagcaguugguacucuuaaccaccgaacggucucucuagccccaggcacuuuauuuuuaacaaaaaccuuuuauaauaauuaccucuguugcccuggcuauauuagacucccuacaagacuucaaagcucgcugguggccauuucucauaaccuguagcaacagcuuguguuccgagguagauggaagagcucagcuggugacguugcugugauuugacuggcacggcugcccucaagugucugccucagauggcucucaggacuccaugagaauaaccaagucugcaagugcucggucccucuuacacaucugugugucaccugcgcaccacccagagcuuaaguccucucugcauuacuuguggugguuacagaggcuaggugagcagccagcuaccauacuggacuguucagaguaaugaugagaacaguucucugacgugcuccggacagaagcagacuuuuacaaacaaaacauugcacuguggaggguaggcccaucacuguagaaaauggagcccaucacuguggagagugguuugccuacuuuugcuuaucagagaggugaaaugucaguguucuggcuuuaaaacauauuuuaguuccauuucauuggcguuugaaauguuaaugauaguuauuuaaagauauugaaugauauucagauaaaaauuuagagguucuuguuagguucucuuugaagaaacaguaauaaaacuugccuagacaguauucauuauggaucuguagcagucgcuuucccugcaguauuaacauuugaaguggaugaugcugauuucuuuagagcugucgaaagucaguaucuucaucauuuuuaaaguuaucuaauauuucagauuaaauauuaaacaaauugaauaaauaagucuucuuaaaguauaaauauaagacauuauaaagagaagguauauuauuguaaaugccuucauuuuaauugaauucuaauacuuguauauccaagaugacugagaauauaguuuuuccaguguauuuugagguucacugcacucaauaaucugagaagcaauugaggaaauuucuauuugaagguuuguaaauguggguaggauggauucucugcagugacugagagagaucugguguagagagagcccagucacagaauaguucaccauugcugucuagcccuuggggagcagagcaggagaacugaguuucuuuucuauagagaagcagcagcuuucuggcucugaggucuuaauggguuuacagaugcagagacggguuggaaagugagugacugggggcagacagcucuugaccugcguagcugaggguucaugcugaggagagcaccaugacagcacaggagaccagaaagacagccagugacagagaauuggaucuaaucugagcuuuguucuacagguaugaggagcugaggaaggaauuguaaguuuaagauaggaaagugugguguuucucagacuggggagggugagugugccagcagcuagggaucgaagcuuugguuuuagguccggcuccacuuuuaguguuggcuucaucuccacagugguucuuccuacuucggucucaauuguagaaaagaauaggugauuuuguuuauuugggggauuuuuuugcuuauuugaaaaaguaaaaaggcaaaaaauaaaagugaaaaggaauugggauuuuuuuccccacugacuuuguucuaaugggaacauaaaauacauuuuauaagcaugcugcauuagaucauuauuaggaaguucucaguuaaguucuccuugcuguuucaacacacaguauuuccaagaaauguuaggguuacuucucacaauguuguuagagcagcuaaagcaccucucagugcucacguucuagaauacggcagcuuucucccucagauguggugcuggcagauggcccagccaauagagagccucuugugcaagugugaggaucugaguugagggccucacagccacaugagagccaggugcagcaucacacuccuguaauccuggaacuggggaggccagaguaagggaaucuugggccugcuggcuagccaucuacuugaucagugagcuccaggcucagugaaagacccuggcucaaacaguaagauggagggccaacaagauggcucaguaguuaaagguggcuugaguuugaacucuaggaccuaugugguagaaggggaaccaacuccugcaggcugucuucugacucucccuacuaaauaaguaaaauuaauacuagcuguaaaauauauauaauaauaagguacaagaauaaagaaguggggcuggugagaugguuuaguggguacaggcauuuaugcacaggccugaugaccugagguccgcuucagucccugaauccugcaacauggcaggaaaagacccaacuuccaggaguugccuuuugaccuucacacuugacucugcauucacaucacaugcagugugcacacacaaaauaauaaauagcuauguuggggcuggaaagauggcuuagcaguuaagaguacuggcugcucucccagaagauuuggguucaguucccacacugacauagcagcucacaacugucuguaauuccagucccaggggccugacacacucacauggacauacaggcaaaacaccaaggcacauaaaauacaaauaaguaaauauuaaaaauagauaaaggaagaaaaauguuuaaguauuaaagaaugaauaguagucaggcuaugauaaaguuuauuuaauucauuuauucauuuuguauguagguauauguauguguacuacaacuuaaauaugaauagcaauguaaaauaggauguuauuaaacaaaagagaaacauggucagauuuguuuuacgaugauuacuugggugagugaauggcugggcagauaaaggcucuugccagauaaaccuggugacuugaauucaauuccuagaagguguuccauaaaggcgggagaaaagaaccaacucuacaaaauuguucuuuaacuuucacccuuaugcugggcacauaagauguguaacugaaaaugggacaaaagaggugagcggguagugggaggcucuucuggaguuugggaagagagaaugauguuaggcaguaggcuuccugguagucucggggauggagguaaagcugaauggaauuuuaccaggcagcagaaagcugugggaagaacauggccuagagcugccaggcgacugguguaguguauacagcuguguggagaguagagggaaacuguauuugugggcaucauucauucauuuuuggccaucuggguguaagguauuauggggcacuuauguggagauggggaggguguagguggguguauugguauggagcuucagacuccucugucaggucuugguucuguggucugucauuaagacauguaacucuucugagcccagaacaugaaacugaaguagguuuggggccaacuuagccuauauauaagaacuagucucgaaacagcacuaaaagcacauuuguucuauuuguguuucucuagguugaucguacgaaaaaaccgucagucaaguugccugaagaucauagaauaaaaucugaaaauacagaucagaguggaagaguucuuucugaucgauccaccaagccaguauuucccucuccaaccaccauguuaacagaugaagaaaaggcucguauucaucaagaaacugcccuucuuauggaaaagaauaaacaggagaaggaacuuugggacaagcagcagaaggaacagaaagagaagcugagaagggaggaacaagagcgcaaagcuggaaagacacaggaugcagaugaacgugacuccacugagaaucagcacaaagcaaaggauggacaagagaaaaaagacagcaaacagaccaagacggaagacagagagcuuucagcagacggggcccaggaagccacaggaacacaaagacaaaguaagagugagcaugaagcuucugaugcuaagguaccuguggaagguaaaaggugucccacgucagaggcgcagaagaggccagcagauguguccccugcauccgugucaggagagcugaaugcaggcaagguagguaaaacgaacaguaaauguguauaagauggugacacaguggccuuccacaaacagaacaggcauucuggacagugcucaaggggugagagaccguccugauccauugguauuggcuucucugcuuuccuuugaggccugugaugauguaaauugauugguuggccauagaaucuuucguuuauaaaaugucauacaacuuauaauuauugcuagaaauagucauaugcauuucugugcuugcuuggugugugaccaucaaaagacgaggauaaaauacaaucucauaauggagaaauaaggcccaguagauggaggucauuuugucuacauaggauguacagucaguaacaucgacagccugacauuuauuuuacauauaaugauauuuuugaucagucuguaugauuuuguuucuguucguacacuuaaaaucaguuacuuuuuucuguccuuaacuacauacucaaaaguugauugccuuaauuuuggaagauauguucauggaaugauauacuuuuaauuuguuuucuuuguacagcuaacaguguccuuuccuuuugacuacuauguaacagcaggaacacuaacagcuuacuuuuacguacauacaaguaaauagaaaacaguuuugguagugcagaaaugaaggcuggaaagcaaaaugcuaccuuacaaaaugcauaccuuucaaacaguacuuuagucacauuuuccagauuuacagaccauauuaauacaaugcucagggaccacgggcuaaccucacuagaguagccagguguacugcacauaccuguagaucagcucacucggcgucaauaagcccaugacuucaacacugaggaaagcucaacagaauacaacgccuguuugagaauuuucuaaacaccuacaauuagagagaugaaguuccuacuuaagauacaguuuaaauaccucaaaacacucaaggcaugucaaguauuugccaacauuuuuuauuuauagagguagccccauaagguagugaguagugaguuuacaggcaaaacugagcucagaggcugucgucugccuagaauuccauagggagugaaauuggaagacagccucuuucccccuuccuguacuggagacagucuuaagaacuuaacacuuucauauguguagagucauuugaggugcuguaaacacccuagaaaccucagcggcccucagguuaugacauguguggguagagaacacaugcaaaaaagguuuaguuaauaaauagaccuugcauuuugaauaugaucuguguaaaauucuguauuuucagcauucucuugcuuauguuuaaaauauauuagaggacagcccuuuucaaguuaauaaaaaccauauaggauauaagcaguagacucugagagcaugguguauauacacuauaagaacauaauauuuaacauuuuauacugcauuguaaaccagugcuucacguucuauugaguuuuauuuucuucacugguucauuuuucucuuuagugguaugaaaucccaaaugaacucacauuuaaacuugacaauagaauacaccuuucagagagacuuaaaagguuuuuuguuuuuuguuuuuguuuuuguuuuuguuuuuugacaggguuucucuguauagcccuggcuguccuggaacucacucuacagaccaggcuggccucgaacucagaaauccgacugccucugccucugccucucugccucugcaccucugccucugugccucugccucugccucugccccucucugccucugccucugccucugccucugccucugccucugccccucucugccucugccucugccccucucugccucugccucugccccucucuaccucugccucugccccucucugccucugccucugccccucucugcuucugccucugccacucucugccucugccccauucucucucugccucugccccacucucucucugccucugccccucucugccucugccucugccccucucucugccucugccccucucugccucccaagugcugggauuaaaggcauguaccaccaccgcccaguuuucuuuuuguuuuuagucugauacauuuaauaauaguuuaauuuagguauaauuugcauaucauaaaauuuaccuguuuguaacauacauuuagucaguaacaagaguuuacagacuaggggugaggguauuggggacuuucaggauagcauuugaaauguaaaugaaaaaaauaucuaauaaaaaauuaaaaauaaauaaaaaaauuuaauuuuaaccuauuaaaaaaaagaguuuacagacugucagggaaugguggcucaugccuuuacuccuagcacuggggagguggagguggagucagacaauuucuugugaguuugaggccagguuggucuacauagagagcuccaggacaaccaugaccacauggaaagacccuguauaaaaaacaaaaacaaaaaaaucccacauacauaagaaaaacuuaacauaguacaugaaauuguuaacauaauccaaucauaaaacauuuucacaacaccaaagaaucacucuaccuguguauauauaguccuguccuguaccccuccuaaagccucagaccaaaaccugcugucuccauugacugucuuuucucagauagucuuuagcagcugacugcuuucaucuggcucaguggcucucagccuucuuaaugcugugacccuuuaauacaguuccucauguuguggugacccccaaugaucagauuguuucauuaguacuuaaguguaauuugcuacugucaugaaucauaaugcaaauaucuaauauacaggauauuugauauucaacccccagagggguuagaacccacagauugauaacuacuggucuagguuuuuuguuguuguuguuguuguuguuuguuuuuuuguuuaaauguguauggauauuuugccugaauguaugucagugcuccuaaagagggcagaagagcacaucucuugggaaucaaacccauguccucuagaagagcagccagugcucuuauccacuaagccaugucuccaaccccuuaccuagcaguuuucuuauuuauuuuagagcauguauugguagcuuguuucuucguguaguuaauuauuauagucucugcacauaugcacuugucaauuuggauuacuuagauauugcaugucuucuugggaauuauuuugaauacugcuacuguggacauuugugucuuuacuuuugagugaguacuuaggaccggaauucuuuuuagcccauuuuguuaauaaacuuaaaaacugaaaaacaaauaaaccaaaaaaacuuugaaagagccuggcaugguggcgcacaccuuuaaucccaguacucagaaggcagaggcaggcagaucucugugaguuucaggacagccuggucuacagagcaaauuguaaaauagccagagcuacccucuucaaaaacaaacaaaugaaaaaacagaacaacaacaacaaggaaagaaacuuuaaaacaaaaaucaaacaacaaacacauuucccagugcagcugcccacuuuacaccugucagcauauaucugcaucccagccaaaacguuacagugacguacauuuccccagugacauugacgucucuuuuuuuuuuuuuuuugguuuuucgagacaggguuucucuguauagcccuggcuguccuggaccucacuuuguagaccaggcugaccucgaacucagaaauccaccugccucugccuccugagugcugggauuaaaggcgugcgccaccaugcccggcgacauugacgucucuuauguuuaucuucgcuuuguuuuuugagauggucucauagagcccagacuaaccuugaacucucaugaccuuuuugccucuacacugcaaaagcugagguuauagguagucacuaucacacccaucuuaucugucuuugacaaaaucguagccaacuuaaugacuggcaauuuugacugagccguaugaauuuguaauauucuggcuaagucccuuauuugaaguaagauuuauaaauauuuucuccaugaugagaagugucuuucauuuaguuaagaaaguguuacaaacaaaaaucucuguaaagcuagaagcaucuguagucagcguagagacccaugcuucagcaugcugcccugcauuuccacagagcacacuacaugaucuuuguaaguggauacagaagcagcugugguaggagggcuagguggcuaggagauaaucaccugacaggccuguguggcuccuucucucaccaaccaccauggagagccucugccacucaccaccaggccucugugcacucaucuccaguguugcaaacacagucacugcggaaguaacugcgugguuaaaguuuuaggaauugcuguuaaagacagagaagagucacacagcucucagugaauucuccaaagaguguaaccuuugagugucuccagacucugugcagcgugauaauuaaguaagaauaauuacccaccuuuuuuuuuuucucccagcuagcagcuucagucauagucucugcuucccaguggccucuuggcuuccuuuggaaaguucuagaaauguuauuacauuuccuucuuuauuucacauuccucuaacccuugauauaguagacuuugagaaaaacaaaacugccuucaucuuugaugcugccuuuaaaauuaugaaggguggucaagaaacuuuuuuuuuuuuucuguuuaaguacuuuaagcucaugaauggaaaauuuuaacuggaaaaucagauuauuguuuuuuaaacuaggcucagcgagaaccuuugacgagagcacgaagugaagaaauggggagaauugugccgggacugccuuugggcugggccaagguaaacaccaggguucuacauuaaaugcacgcuacuguauuuugguguuugguuugguuugguuugguuugguuugguuuuucaagacaggguuucucuguagagcuccagcuguccuggaacucacucuguagaccaggcuggccucgaacucagaaauccuccugccucugucucccaagugcugggauuaaaggcaugcaccaccacuucccggugcuacuaaaaaggcguuuucuuguuguccauccacuuuguuauagagaacauaaacucuuccccugauuacugcagagugagaucuccugguacucagccuuagaugcugacuagcauaugagcacccuggcaauauaauuuugaaauugcauauuccauuaaggcaagccuaaauuucuuuaaaaguuugaaaaacgauuauuaauuuuaauuaaguuauuuuagggccugcagaauauaaagucugugcuuagcaaauucaaggcccuagcuuuaaucuuuuagcacacguguguuuuaacccagaaguaaauauuguggugggaugacacuugaaucacuucugugcuuauauucuuucuaccuuucuguuuauucuccuuccccaaguuucuugauccaaucaccgggaccuuucguuacuaccauucccccacaaacacaguucauauguauccaccugaaauggcuccuucgucugcaccuccuuccaccccgcccacucacaaagucaagccccaggucccugccgagcgggacagggagccaucgaaacugaagcgcuccuacuccucaccagauaucacucaggcccugcaggaggaggagaagaggaggccggcagugaccccgauggucaaccgggaaaacaaguaagugcucccaguucuagaacugaagcagcggcaucgcuucaaccugucugagugucaccccguaaacguauagccuuggaggaugcgugagaguugaaucaguguguuuaguagugguagagauaggacaguguugcauacauugcuauagcacuuucccaguaccaugcccaaggccucacucaucuuucauagauccuaauuuguuuuguaacuuuuaauuuuauuagggaaagagagugugcgcguguguguguguguguuguguguguguacuugcacauuacaguacucucaucuacuauguggguauggacucagguaucaggcuugggagagagugccuuuauuuacugagcugucugaccacccaagaugacaauuuauaagauggcugaguuggcaguguuaccauacucaguuucuagccuuuguuucucucacccagucauacaggagcauagucuccuaucuauaaaaauguaggcaccauaugucuccuuuccucuuccuauuucugcucaucaggugaucaguggguuuaaguuucccagaguagcacaucauuuucuuauauuucugccccuaacuggcaggaauauaagauauaggaacugggcacuucuggggcgggggguggaaaugcaacuggccuuccauguccauggcuucugggcuggggugucacucagcagaaugcuugcuuaaaugcccaaagugugggugugaucccaacacugcauauaaaccaguaauggugagcaccacucaggaaauggagacagcagaguuagaaguucaucguuacccucaaccagccugggccuucgugagauccuaccucaaaacacaagaacaaaagcauauuggauaguuucuguaucuaggacuuaaccaauaggggaucaaaaauacuggggugggaggaauuauagaauuacugaacacaaagaggugucuguccuugccauucuuuuuaacccaccacaauagcuauuuaaauuguaucagguauuaaugaauagucagaaguaguuuaaaggaaacaggaaggggugcacaaauuaaugcagacaccauagcauuugaucuacugcaggggucuuggauauugaaguuuggaguauauauaaaugugauggauuuuuucauguauuauauauuauuuguuaauuacuaaggauuuuuuauuuaucuuuuuugacacaucccaaggaagucauugguuaccuuccugagaauucaccuuaccagggagagaccuauuugaaagaguuuuuggaauuaguaauauucaaauauuacuuuacuacaguucauuaauucggcaguguuuugaagcugucucauaaaucgcgcuguaucuuuuauaaagaguacgugaacagaaagagcguguagagaaaacgggcgguuugcugcuucccauccuccccuucauagguaggggucaggaagucgagggaguggccaccagucagggcaccuuuagucaaaagugcccagcagacaccuccaugguguccggcauggcuuuaauuuuuuguuuguuuguuuuuuuguuuucguuuuucgagacaggguuucucugucuagcccugacuucuuggaacucacuuuguagaccaggcuggccucaaacucagaaaucugccugccuuugccuucugagugcugggauuaaaggcgugcgccaccaugcccugcuaaccuuugccucuuuugagaccugucugugguuaguauauacuuuuauuuauguauaauuuauuuacaagagcauaaauaucugccucuuuauuuuuuaaauaucuaauaccuacuacaguguaaauacuguacaaauauaguauuugaggaaauaguuacaagaaaaauguaugcacacacucaguuccccaccccaccccuagcacccagccuucucaccguuccuucuaccucaggaaucuucccaugucccguggucugcaucucuccccaccucguuuccauaguuucuuuuuuccugaccgauggguucuuucugcuuacccaaagccacuuaaauacacuguuugcuauuuagcagcugggaucuacauauccgaaaacacuacauaauauccuucuagaauuaauguauaauuuauauuuauacaugauuuuauaauauuuaauucucuaacauuccgguugaguuagaguauuucaugaugcuaaugucucugggucacuuggagaagguugaaagagcuuuuucccauugggcaguagccgagccugucuagacaagaggaagcuagaggacccgucucaggccaccucuagaaccaagaacucaggagaaguggaaggcaugcauucaugggaggggccuggaacauagucacuuagccuaauugcuagaugucuuagggaacucagcaguuuagccuguggcuugugggcaggauuuuaucugguauagcugcuccagcugucuaccaucuucauguggacccagcuugagaugcucugcauaaggcaucuuguucuuucuuucucaggccaccauguuacccuaaagcugagauuucgaggcuuucugcuucucagauucggaaccucaauccuguauuuggaggaucaggaccagcucuuacuggacuucguaauuugggaaauacuuguuacaugaacucaaucuugcagugccuguguaaugcuccacaucuggcugauuauuucaaccgaaacugcuaccaggaugauaucaacagguaaaggaacauuucauucugcaguacacucucgagaaggauauuuaacuguagugccuggaugcaguacucgaguuuuguaugguuacaacaugccagacuagguaaucauuuuuguuuauuuguuuauauaaaagaauuuugauuuuuuaaaaaauguguguaucuugaguguggcuauguacaaacuagagcacacacacaagcgugaagaucagaagacagcuugcaggaacuggcucuccaggguagacuccaggauuacaucaugucaucagcucgcacgugagcgcuuuaccugcugagcuugcuuugccaucgguguagagacaggguucaggauuagcaugucaguaucucaucaggguccugugcucucccagcaaacagcaggagacccaggggcccagggugagcccuucauugugcccuuuucaguaggcauagccucuucaggucauuuucauuuuuuguuuuuucauuguaucuuuaggaguaugugcaugugugaguauagcagcaugaggcauccagaaagagucucagauucccagaacuggagcuauggacagcugugagccaacaucugggugcuaggaauaaaacccgguauucucuaggagaaacaaucccucuuaaguagcauggaggcagccgucucuucagccccuuaagggccuacuccuaggcuaugugcaguaccuacauuuuggagagacguauucaguugccacugagccucagaggagucaaauuaguaaaagagaaaugaucuuuaucuguaagaauacgggguaguuaucccagcucuggucauaaaggacgaagaagauggcagacacacugucaggguuacagcuuccaucuuugacugcagccuguugaugugcgugaggagcagggcuugcagccaggauaagaaaaugaguuggaggaccauagcaaagucagguucagauguguuugguucaagccugcaggugagugauuccuuuguguguuaugugugugguuuugugcugacaucaagaccccacuauaacuuaauuuuuuuauuuuccauaacuuuacuugcacaggucaaauuuguuggggcauaaaggugaaguggcagaagaauuugguauaaucaugaaagcacuguggacaggacaguauagauacaucaguccaaaggacuuuaaagucaccauugguaagauuaaugaccaguuugcaggcuccagccaacaggauucacaagagcugcuucuguuccucauggauggccugcaugaggaucugaauaagguaagagcgggguauccucagcuucgcuugcuucaucuucacagcaguuuaaaugcuuguucacuagugucugaguauggacugugccacugugccgugccgugugugugugugugugugugugugugugugugugugugugugugugugugugugugugcuguguggagucugcuaagcuccccagaacaaaacugaauguuuacauuuauuaaauagaaugagacauguugggacuggaaucuuagacuuaacauaaaauuuauuuuuauuuuacauauauacauauccugaagugagguggguuuuuuuuacaauauuuuugaauaauuuuuuuuuacugauuuuuuuuucucauggaguacaguuuuccacuuguggcagcaugccauguuuuagauuuucagacuaggagugugcacaguggacuugaaaaguagugugugguuauuuacucaaguacuaauaggaaguacugcacauuuaacaaaugguaaaauagcuauuggaaguguucuuguaacucucauguuaugaaaacaaaaucaugguuuuauuaauuauagucugaacauccuuguuauuuauauauuauugcauauuugugguguguguguguuauacucaaauguucuaagacuuaucuuccaaaauaagaaucgcuccggguaagcaaguggugcaugcauguaucuuuuauuaaagcaguaucuuuacgaaaggaccaccuccaucuguauauagcagcuucucuuuugcugcuucagaaagccuuuaaggucaugcuucucagcugagcauaaguauaaauuucaagcuguuaugguggcucacaccuaaggucacaguacucaggagacugaggcagggagauugucacuucagggacagccugggcuaccuaaggagauuuuucucaagggguguguauagacaccacacacacacacacacacacacacacacacacacacacacacacacacacacacacacuggauuuuaacccuaauuccuccuuacaugacauguguucuucucaaugccaugcuuuugagacuaucaagaugccucacuauuguaaaagcacuggcaaggccaagcccaauggccugauuuugauccucagaacacgaguaaaggaggcaaggagaaccagcugcacagagcuguccucugagcuccucaugcaucuuuugacacugccuuuacacauaucauucacauauacacacucaauauaaagguuaaaaaaaugguuuuaagccaaacguggcaacuuuuaaaaaauggcauggauuuaaaacauaauuauguauacuuuauauacagaauauauauuaaauguuuaauguguguuauacauaauguauaauguaaugauauacauaauacuauguauaaugauacaguaauguauacuugugacauguucacauguaccuaauagcuuuaagccugccuacccccuuacucuccuugcccucccccuacucuggcuaguuccccuuccuccuuuguacuuuuuuuuuccuuauaauucagugaguuaaugauacucacaaaaccaugauggagguuugguuacuggaacaugugcaccuuuucaguggcaugucacugaagaaacauuaacugugucaguccucagaggagguguggggaccaugaacaccccuccuucccaugccuggugugugaucacagcugaugugaguuugaaguugugcuacaugcaccucucccccuccucuuccuuccacucuuccucugugagccuuaggggugacaggucuguuccaucuauggcugggcauucagcagucauugguucucagugccuuggccaguuagagucucuacggucaacacccacacugcaaaagcagcuucacucuuaaaacaagagcugagucucugugacucagggucaguccacaaacuacucaggguugucuacaguuuacagucuuacacacuuuaaauaaaaauauguccagaagguguuauaaagacccggcaugaugaccuaugcuuuuaaucucagcauuugggaggcagaagcagguggaucucugaguucaaagccagccugacugcauagugaguucuaggacagcuagggcuacauaaugagacacuguccaaacaaaaugagaaaggggcgagggaagaaguucaagccauguccuuucaguaaaguggguuuggguuugggguagaauuaauuuuuuuguaaaugacaagaucagagcuccucaguguggcuaaauguguaagauguuuaguguuauuccuugaguuucacauuuaccuguugacagcacacccuuagauacuagcagcacucacuuguccucccccaggcugacaaucggaagaggcacaaggaagagaacaacgagcaccuggaugaccugcaggcggccgagcacgccuggcagaagcacaagcagcucaacgaguccaucaucguggcccuguuccagggccaguucaaguccacagugcagugccucaccugccgcaggaggucgcgcaccuucgaggccuucauguacuugucuuugccgcuagcauccacaaguaaauguacucuacagguacaucuaagagaaaguguguuacuaaaauguuauuugugugcaucauccugacaggaaaaucggugagcuacccuccuagcccugguaggguuuuguugcuauuuuguguguuuugccagcaugucugugcaccaacugcauacaguaccuacagaagccagaagaagguaucagauucucugaaacuagaguuggugggugcagaccgccauguggguacugggacuugaacccaagugcucaguaagagcaagcgcucuuaacugcugagccaucucuccaacccauagcuagcccuugaguuuugaaugguucuugccauguagcccagacuagucgugacccagcagugcugggaggauaggcauaugucacugggugcaacuagaagcugcuugggagggcugaacccagagcguugugcaugguggacaagccuuucaccacauagccaaacugaaaugcuuguguuuuagagacguuuugaaagcuaacuuaggaaguuguauuugaugguagcgcagauguauuuuuucuaugcacugacuugggaucagacauguugauuuccacacaacagcaguguaacuaauagaauagcuuauguugauaccuucaguuuuuacuucuuccaggaaguccaccguaauccaccagacucaggacagagaucuugugugugcuguccugagcuucugcauaccuaccccauuccucaccgcaccuugcaacacacuguuugugucccuucuuacagcagacacuuacccaccuuauugaggugccccaauaagugcugcagcauuccuacagaagagggccucuuuaaggcacuccaucaggaagugaaucgcugaguauuugugcuuuuuuuuccccaccaggacugccuuagauuauuuuccaaagaagaaaagcuuacagauaacaacagauuuuacugcagccauugccgagcucggcgggauucucuaaagaaaauagaaaucuggaaauuaccuccugugcuguuagugcaccugaaacgguaaggucucucugccugugcaguagcauuugauggaggaauugccauggcuacauaaucugcacauacugucucuuaaaggaaaccuaaggaauguucuccagcaaauaaguaaggcagacaugacaguggaauaacuauacuguuacuuuaugugcauucuaugcgauucuguuuccuuacacaauaaauggaacaaaaaauucauggaaauaaugguauuucagaaacaaaaguuuaaaugacaucaaguggaaaauguuacaguguaauucuaacacaaaugaguagauacaaaauuaacauucaguugcuggagagagauucagugguuaagagaacugacucuugcagaggacccagguucuauuccuaguacccacauggcaggucacaacugccucugauuccauuuccggcaggaucuaguguccuccucugucaucugugaccagcaggcauacacguggagcacagauacgugugcacauaaaugauacaguuguuuuuuaacuaacacucaaauuauaaauauagcaaaauuaauuuaauuauuguaacauggugggcacacaccuauaauuucaagcucuugaaaaauggaagcagaaugaccaagaauuuaaggccagccugggcucaugagaccuggugucaagaaaguuaaaauguaaagucaugcuuuuuaaaaaaauaugaguucagagcauugugccuuagcucaugugugacagucagaggacagcucuuagaagucagcuuucuccugccaccuucucagaucuagaaauugaccuuaggucauuggggcugcacacagcuguuugagcaugcugagccaccucccuagcccaaaguacacuuuuuaaguggggaaaaaagccacaguuuuaaaagucuaacuuuaagauaagaauauuugaauguugccugugcuaaggugcaagcauugucuccaaaaucugucuuaguuagaguuucuauugcugugagcagacaccaugaccauggugacucuuauaaaggacgauauuuaauugcaguuggcuuacagguucagagguucacuccauuuuccucauggcgagaagccccaaguggauggacagggucccagccagcagacaacauggcagugagagcuacagcaugucucuguuccucgggaaauccauuugggaaguuagaugucacagauagguucuugcccguguaccacaggccagcucugacccugucuuccuuagacucccuuuuugcuaaccuuacacaccaccacacccagccugaauuagcuuuaaaaaacaaaacaaaagaaaaacccuaaaguuucaucuuuguugugaacucuauuuuuguuuuugguuacuagagauucauagccaauuguuuauuuaaguuuaacauugacuguucaguuuucuguuuugacaaguuugucggcuucacuuugagcauuguaauauaaauggcaauauagacguuuuaaagcauagaauuguucuguuagaaguuguaguuaguaucaaacguuauuccuggaagcucuaaggcagcuguauagugacugaguuguugagaagcaggucaucauugaaguauuuugguauauaugaugcccuggguuugacccuugacacuguaaauaauaauugagggguuggauuuugguguguugcucuguguaaccuacaucuccuucuuuguaaaauaaaaaugaaacaugucuucccuacuaaaacaggccuuauuaaaauaguuuuguuauguguguugcugugagugcaggcagagagucauaccacacauguggagggcagccuugcagagucacuucuuccacucuuagguggguuugcacaucaagggcuuugcccucugagcaucuugcuggcccucagaucugaagugaaccuuaagagcuuccuaauguccaugcuaaauagugaaaucucauuuuugucuuucucugucaaccuaauuccugugauguuugccuuacagauuuuccuaugacggcagguggaagcagaagcugcaaacauccguggauuucccauuggaaaaucuugaccugucacaguacguuauugguccaaaaaacagcuugaagaaauauaacuuguuuucuguuucaguaaguaucauguugaacugaagauguuuuuaaagcaaacuaauaaaauaggaggcuccagcauuuccuuaccccauaggagagugagaauaaccaaaacuggaaauaacugacacaauuuuuuugugcuaaggaauaauugaguuuguuuugucuugcuuggugcagaaccacuacggcgggcuagacggaggccacuacacagccuacuguaagaacgcggcaaggcagcgcugguuuaaguuugaugaccaugaaguuucugauaucucugugucuucugugaggucaucagcagcuuauauccucuuuuauacuucccugggaccacgcauaacugauguagccacauagagaggaguaggcugucggcuuauugacgucuccaaauugcagccucacaucuaaugcuuacaaagauaauggaucgcugcagcugcuauguagagggauuccagaacacuggggcugugcuacuagcaccauauaauucaggccagugcuguuuaucaaaagaaagaaagaaagaaaacagccugacauuuaacaacuaucauaguacgcauuccuuacaggagucauuuauuucaaaacaacuuuuugagucugccccaaaguuaaaauaauucauuagucagacauuuauuauucucuugguaccaaaccaucauaaccuccauuuuccuauucacugcuccagccucuucucauuucuagccccagcucagugcacucugaaugcucuagaaugaccuagcucagauaggaauguauauguacauauuuauugcacuguugcacaucagacugcuggacacaguuuaacauagccuucugugaaagccuagaaaggauuuuuucuuuuucuuuuggccucuucuagguagcugcaaugcuuucuuaaggaaaugacagggcaaaacuauuuuucuguuggcuuccggcuguauuugugcacuaaaucuuuauucuaaacaaauggaaacuuuaauuuuuuaaaaauaauucauuuacaucuacauuaaaaucuuaaugaagaaaaaaaucauuugaaaccuuguac

SEQ ID NO: 1058 - RNA, 74363 nt, Mus musculus
uaauguaaagccaacacaucaaauuuuauucauuauauacuuagcauccugauuuucuuucuuuuuuuuuuuuuuuuuuuuuuuuuuuuggugguucugcaaacaucuuuacuaaacaguuccuuccaggguaacaggacuuagccacagggccacagccaggcaauacaccaacauccccaauagcucaguuugaacauagcacgacaggcugcccguggccagcaggagacagaggagggcaggcuccagcggucacuucucuaggggugcauaguucagcagcuucucaaucagguccacgugugcuagcagcaugcggcggcagcaguagcgcuuuaggcccagagcguccagggcaucccccuccguguacuuggccugcagcagacccagguaggcuucccauuuguugccgacgaucuucccgcaggugaagcagcgcaccgggaugaucauggcggcgucugacauccugauuuucuaaagggaagauuuauuuugccccacaguuucggagacuucugcccaagcuuaauuggcuccauuacuuugcaucugaggugaagugcaguccccuguuagcaaggguguguaaaggagacuguuugccucggagcggucaggaagcagggaggagucuugcauuuuaucuuguuauaaaauccaacuuuguucaccuggauaguugcugaugguugcagcuggaaaugauaacuggcauguccacauccagucucuuuguguggauuaaacuucucauggcauguguguugggcuccaugaccacacuugaggcagaaaguagaagcuuucagucucugaaaagccuguaucaagaaauuggcacauuacuucuaguaauauucuacugguuagagcaaucaaggcgcccuccccaucagcugauagauuuauacuauuuuuguguuuauguguguuuggugcuaggacacccagggcauggcacauacauauccuaucacccauggccugacuccuaccuuuuaaagcaaaaggcucucaaaaacuacuuuauaggcucccaacaugugugugaccacuguacacagguauauaacacacaaacacugcaugcauuuuguauguaucaaauacucuguagcaaauguaaucuaaccacacauaauugcucuuagaaacugggguacuuucuuccuucccuuccuccuucuuuuccuuagcauucuaauauuuauucaugucccuuagaguucuucucuuccuuguuuagcauuacgcuuuccuucauugcagagaugucuguucuuuucugagucugucuucccauagaaugccuaguuugaggccuuaagugaaauaucagcugucaaaaaaguaaagcuucaauuucuuggugauuuauucucuuaauguuaguuauuaguaugugaugucuauacacuuuugauuguguguauuuguuuauauuuuuugaaagugucuuaccaugaccaagauugaccucuaacuccugggcuuaagagauucuccugccucaggcuccccagguagcuggaauugcagaugcaugccacuguacucaauggcugaugucuguguuuuaaagagaauuguauauguuuuaaaauauacuacauaaaagcaggauaaauaaaauaguuauaaaaugucccucccagacucaaacuuuucuugcuuagacucagcuucagaccacauuuugaaguauguguauccuuuaggagguggggccugacugguggauguuuguuccuggggauagccuguugaagguuuuuccaaucuauggcucccucagagcucucugcuucugguuagccagauuagaggagccacuucagcauacucuugcugccauaaauucugucagaacuuucccaucuaugauggacugaaguucuuccaaaacagugaucuaagauaaacucccccuuaaaugauuucuggguuuuggucacagaauaaaagugauacaguaucauuuucagugauauuauguuguaaccucccaaacaauaggguuguuuuuguuuuuuucuuucugagacaggguuuccucuguguagccuaggcuguccuagaacucacuguguaaaccagauuggcuuugaacugagagcucuaccugccucugccuccucauuguugggauuaaaggcaugcgccaccauacccugaucaguuuucauuuuuauuuauuuucuuauuuacuuuauguauuugaguacauuguugauuucuucagacacaccaaaagggggggaucagauuguauuacagauaauugugugguugcugggaauugaacucauguccucuggaagaacagucagugcucuuaaccacugagccaucucuccaaccccaucacucgucaguuauuaaacuacaguuuuguuuuuauauuuguuguuguuauugguuugcuuguuugguugcuuuugagacauggucuuuuuaaguaacccaaaguagcccugaacuuagcaccuucuagcuucagcuuccuguguagguacacauuuuuguaugccuguuacuguuauuuaguuaauaacauuaguguucuuugcuuuucacagaaggaaaauaggguaauguaagcaagugaaaauauucaaguuuaaucacuaaaucgccaaauuagugugccuaauuuguucuuuccugcagugacuuucuaacuauucuuuccuguaguauuguuuccuuauucaaauccaucuuguauauauccauuuuggccauccugaggcaguacugacuugucaaaugucuucucaagcccuccauucugugacaguauuuacuuuuaugaagcagcuacuaaguguugacaggauuauuaagauagagucaggauccaucauauuaucagugggcuucuuugaucccagcuauuauugcuucaugauuccuaucguuuacccuacuuguccacauuguaaggcaauguaaggcaguuuucucaguaauuucucacuuuaugucucuauggugcuucccuucucaaaugcugccuuucucaccucgucucucaucauuucagccaauuuguuauuugggccaaaaacuguacugaccuagcaguauagguagugagcaguguaggacucaagacuaagacaugaacuccaagaacugucagacacagcgggggaagcuuaagccacccugaaaggaaggggccagcauuaaagaagacacuguggccuggcugaagcucucuccgucuagcugaacuggauuuuccuuuccuugaguucagcuagugaccugguucauauuaauauguaguagagcaauugauuguugacuuauuauuucauaaauauuaacucuuguuaaccagaguaagacauuugugaccaucaagcccuguuuucuguaucucuuagaaaaguguguuccgagucugaaucccuuaagguuccaccuugccuuccgugcugagacguggcugcguuauguagcccugcgcagucuucuguuuucucuaggauguaaaagcucgccuuagacuggaaguuugggaacuguaaaaggugucugcuuuuugguuuguauucuaucaugagcuuauuuuguuacagaacagcucauagcuccccaggccaguguuggucuuuggacuguauuuggaauagcacugccaucaugugagcuaucaaguucuuguuuuguuuugagacauugucuugcuguguagcuuaggcuggcuugaauucucaguucuccuguuuaagcuucaggcuacacaucaggcuacuuuguuugcuuuaguuuauaauucuuuuuuuaaauauugcauaauuuuacuggguuauauacauauauacauguauagauagauagauagauagauagauagauagauccccuuucuuugaggcagggucuugcuaggaagcccaaguuggccuuaaaucuauaacccaguaaaauauacacacacacauauaucccuauuugucuaaaaagccauugcugaagacuuuggugacauuguuccaugaaggcagauccuguccuugccuuugcaggguuucuuguucuacuuccccuauuucauuucuguugccaucugaccuccacccuacuuucucuuccaucuuuauaaaucauugcaauagauaacuaggauuuucuuucuucacaucuuugugcucuuguuaguugggacugcacaucuaacaagcagguuccuucagaacccugcuguggcucucucauuaccuuuagaaaacagguaaauauuucugugcuuucauagccuuuuaugacuuguguggagacuuuuugacugcuuugccucauggcuucuucuauguucugucuggcagcugauuccuagagauguacuugguuucuugaccuuguccccacacuauuccucaccucuaucaaagccaucucaucaaagaagaaagacauuugcuuuuuuucugauuacuucuaguucccuuuggugguaguuuuccuucuugauguuuuuauuuguaauaccaucuacuacuauuauuuccacuguuuacaguuuuguuccccauuaguuuuguaagccugguguggaaauacucuaauccuccagcuucuaaaagcauggcauuuuauauagcaggauauuacaaguuuagaucuaaccuuaaacuagguaaugacuuacucuuuuuaaaaaauugucuauauaucugacacaauuuucacauucuuuuaaaaauccaaguuuuaggggcuaaagagaugggauugagaacgcuuuuucagaugacccacuuuugauucccagcacccacauggcagcacacaggaucuguaacuccaguuccaagggcuccaacaccuguuuuugaacuaaaguguuguucauccuuagggagcagaaaccaggccuuaugucuucaacaccuauccuuuuuuuuuuuuuuuaaagauuuauuuaucuuauguauauggguacacuguagcuaugcagaugguugugagccuucaugugguuguugggaauugaauuuuuaggaccucugcucucucuggucuaugccacucucucuggucggcccaaagauuuauuuacuuauacauaaguacacuguggcugucuucagauacuccagaagagggcaucagaucucauuaugggugguugugagccaccauaugguugcugggauuugaacucaggaccuucggaagagcaguuagugcucuuacccgcugugccgucuugccagccccagcaccuauccuuuuaauacagagccugcauuugcaagguaaaucugcuugggauuuacauugauacuaaaauaaugaugcugucugagaacgaggcaauccaaggcauccuugucauaccuguuacuuaauagauguugucuuaguuaggguuuuacugcugugaacagacaccaugaccaaggcaagucuuauaaaaaacaacauuuaauuggggcuggcuuacagguucagagguuccguccauuaucaucaaggugagagcauggcaguauccaggcaggcauggcacaggaagagcuaagagcgcuaugucuucauccaaaggcggcuaguggaagacugacuuccaggcaacuagggugaggaucuuauacccacacccacagugacacacccauuccaacuaggucacaccuauuccaacaaggccacaccuucagauggugccacucccugguccaaggauauacaaaccaucacauguucuuagguaguuugauggugaauuguuaaugaauugauaccucaguagaacauauccagugucacuuggcccauuuggaagugacaauguggcagaaacuauuucucucauuauuacaacuuuagacacaagguuugaaacaggagauaaaauguaccaaguuuuuauaugcaaggucauuguuucucacugcauauaucucaagguaucaguuaccauuuaguucagcaugucuugauagaugcauggagcaaguauacauagaaaaaacugaaaagguaaaaaugggauuuuuagaggaaagcuguuugguaauaauauaguccuaacccagaauuggaagggauaaguccagauauucauaaaguauuaguguuuaauaccggaaugacuagagucaaaggaaauuaaagugcuuuuggagugcuuuucaugcaagugaacuaagaccauucccuuaaguuguacuuaaucagcccuuaagaauuuuguuuuuuguccaggcaccuuuaauccuagcacuugaaaagcagaggcaggccgggcagugguggcgcacgccuuuaaucccagcacucgggaggcagaggcaggcggauuucugaguucgaggccagccuggucuacaaagugaguuccaggacagucagggcuacacagagaaacccugucucggaaaaaaaaaaaaagaaagaaagaaagaaagaaaagaaaagaaaagcagaggcagguaaaucuugaguuuugaauccagcaaguuccaggacagcuugggguacacagagagacccugucuagagaagcaaaacaaagccaaaaauuuuugauuuauuuuuauguguauggcaguuuugucugcauguauaucuacacaccacuuggguguuggaucuucuggaauugguguugcagaggguuauaagccaacaugugaguacauggaguugaauacuggauuucuggaagaacagucuuuuaggauuagaugcuguugaucucuguaaauaaacugaacugauuguaucauuuagagagcagagagagaugauggggaaaauaaaguugaaguuaaauuacuaaauuguaauuaguuaaauuacuaaaugguaauuaguugugucuggcagaagaccacaccagaaguuagucuggucacugguuuuuagguggcaacacuuaggaccauaccaagacacucuaccugggcugcuuugaucugcuccaucuccagguaucuuuguggauaguuacacacacaauuuaauuagugcauaccuucugauucuucccguuuucauuuuguuuacuccauauuuucuacuggucacaauuagcauaccagaaaacaaagaaugucaugaaccaucaaagaccuuuucagaguaaaccaaaguguaggaguguuuucuggcagaagcagaaauauguuuugguucucagcuccguauaaaccuggucuugccuacuacuuuucuuuuauaaacugauauuaagaagaaaacaaaauacuccaaguuggaaaucuauuuguuuacaaauguaguuuuaacagaaaaaauauaaaagcuuuacuauucuguucuuuuuaauagauaagauuuuaauagugauggcaaagugguacaauaauccauuuaguuaaugaacauuugaaaauaaguauugcuuaauaccauagauuuugugugugugugugugugugugugugugugugugugugugucuuaaauaucucccaaaauagaaauugaaaauaauuuaaaaugaacccuuuuuggggaggauauaguuaaauaauggguguuuguuuuuguuugaauacagagucuugcuggguagcccagauuagugauaaacucagaauccucccaccucagccucccaguugcugggccaugcuuaacaguggaugauacuuuuguuuggugugugugcaugaggccaggaguccaauccaaagccuugcacaccacccagucacuuugccacagagcuauauuccuaguccuggaguuucauuuuuccaauacuuuuuuuuuuuucucuaaaaaauguaacauuuuuguuaauuuguuaagaauuuuguacaugcauucgauguaugugaaucauacacaccucacuaucccguccaauucauuccagaaccuucacacaucccccaaacuucauguccuccuuuuuauuguuuuuauuuuauuucaguucagucuuugcccuccuccuaguccccccuccuacaguuccucaucccauuccuccucccaggacuccccacucccucagaccucaagucuuacugaggucagaccaggcaguccucugcuguaugcguuggggggccucggacuagcucuuguaugcugccugguuggucuaagcugucaggcuuagagucugagagaucucaggaguccugguuaauugacacugcuggucuucuauggggucacuccuccuccucagcuucuuccagccuuucccuaauucaaccacagggguucccagcuucaguccaauggcugaguuugaguaucuguguuugucucagucaucuguuaguugggccucucagaggacagccaugcuaggcuccugucuauaagcgugccauagcaucagcaauagagucaggccuuggagccuccccuuaagauggauccccaaguugggcuggucacuagacugccuuuuccucagucucuucuccauuuugucccugcaauucuuuuagauagggacaauucugcaucaggguuuuugacugugggauggcaaccccauuccucacuugaugcccugucuuuuugcuggagguagacuguacccgaguucccccuccccacuguuaggcauuucaucuaaggucccuuugaguccugagaguuucucaccucccaggucucugguacauucugaagcaccccccccucccccaccccaccccaccccucccacuccucauauuuccauucauucugcuggucaucagaguccucuccuucugugucaucuguacucccccacccccagcugaucauguuccccuuuucccuucucccucaccccucucccacccaggucccucucucccucugccucuugugguuguauucuaacacuuuuugcugaugauaauuaguggaauuauuuguuuuguuuuaggaaagaacuacuuuucaugaaccacaccaucuguuuguugaaguagaaaagcgagucuuacucaucaugccugcuguagcuucaguuccuaaagaacucuaccucaguucuucacuaaaagaccucaauaagaagaccgaaguuaaaccugagaaaaccagcaccaagaagugugugcuaguuugauugucauguaaauuuuauuucauucccuuauuauuuagauuuaauaaauagcuaauuuaaaguuuauuugaaaaaugaugugaucacaagaguaaauaagaccuagagaaguucuuaacuuugucuuaacagaauaaaugugagauugcucagguuuaaguaccugcuuccugaccaguauguauacuagaugauauguauaccaguauguguacuagaugauauguauacauaccaguacguauauuagaugauguguuuaaaagaguaugaagguucuaguaaagccauuuugccacgucauuuuuucucauaaaacauuauaacuuuuaauuaagguuuuuaaucuuuuaaaagaucaccuuuacccuuguguaggacaugugcaaguuaggauguugucguacucuuucucugacugaaagaggggcuaugucuacuuuuguuuuguuuuguuuuguuuuguuuuucuaauuauccucaauaguuuuauggcaacuuaacacaagcuggucgucugagaggagggaccuaauugaaacaaauaccuccauaagaucaggcuguaggaaggcaagccuauaguguguuuuuuaaaugccugauggaagggacuuaccccaguccucugagggugggaacaucucugggcuggugguucuggguucuauaagaaagcagccuaaacaagccaggaggagcaucuccauggccucugcaucaacuccugcuuccagguuucuaacagguuugaauuucugccuuggcuucccucaauagacugacucgggauguguaagccaaauaauccuuuuccauucugaguuauuuuaguuaugguggaaucccuaagaugcaaauacuaguauucucuggguuuuauuuuauuccaguuugauagaaucuuuaacuuaaugauugauuuugugugguuuuacuuguuugggcuuacaucuaaggcacauguagaaagugugucuuuccaggagagguuccaaacucucaugguccagugguccacugauucgaauacuugcuggaaauauaaauuugcuaagaauagguuguccuuaaacuugucaacucaagugguugaggaacagaaaacuuucuguucacauuuauuuuuaccagcaaaagagauuuagaaacuaguaaguaauuacauuguuauuuagguggaaauaaaguuuuagaaagaaagguaaccaagcuaccacauuccccaaacuuaggaaaaguagaucuuagagagcaauggggagcaauagguauucucugauuggagagaaauaugaucccaaaugaaucaaugaagacaagcuaagauaccuguguaggaaugaagauggaagaaaauaaugcaucagugguggcauuugagcaguggaacuucacucaggugagagaggguccaccacauaccacugucccuuauugucacccguagcacaauggcuuuucaaaaugcccguuaggagaaaauagagaaagauuggcuucuuccugagcuaaguugguaacaugggguagcacggagaguaauuuuguuuaauucuuguuguuugauuuuuuuuuuuaaucaauaaagccaucuuugaacuuucucaaauacuaaagacagaaacuuuauaaauguuagcucaaagauggucauuucuuucuaucagggucugauguaucucuuaagacuagccuaaccccagagggaaguuauaaaucgaauugggugaaguaacaaacuuaaaucaugaaguguauuuuaucaaagucaucugccgaguuuaucuguuacauguauuuuuccccaguaccaaguuuuguaaauucucuucguuucuaaguuauauacacagcgcgcagaagaucuucaagacagcagaagaaugcagacuagaucgugaugaggaaagggccuaugugcuuuauaugaaauauguggcaguuuauaaucuuaucaaaaagagaccugauuucaagcaacagcagguacccucacuuugcuauuuuauuugauauuuuuacccaguagagcuauugauuaccucuaaaagcuuuaacuaccugugaaauuaacuuuuguuccuccucaccucccacucaauucuggcaacccgguaaugcuaagcaggaggucugucaccaacauaacaaugaauuuaaaucacauauuuaaacaauuuuaacaggacaauuuuaacuccuguggggccaggaaaagcaaagcaaaaauauauuuuuauuauuuguuaguguauucaugcauacauuuugcuuggaucaauauaugcauauaacaguauauaaaccgauuguuugcuuuuuguuguaauaaauuauugcuagaucagguggaaggauugcguuuauucagugcacugaauaagaaaaauaauagcugaguacaguggcucaugcuuguggucucuugugagcccaggaguuccaggccagcuuggacaacauagagagauccucuaucaauaaauaaaacagagggacuggagacauggcucaacggauaagagugcuuugugcagaaggcccagguuugguucccauuacccauuucaggugacuuacaaaugcuucugacuccagcucuaggguauccaacgcccuauucuggccuccuugggcaccugcacauguggcauacauucacacaacacacacaaauguaaaguaaguaagaguguguuuucaggucugcuuuaaggucagaucuguaacuaucagccuuuuuauuugacugacacuggagcuguauuagaugcagcuuuagaauuaagagcaagacuucagugucucuucauguuuucuuuuuuguucuuaaucuguuuagcagauacuagucuuucacuuugcugaagucaggaguagaaagugaggacuaucaugguauagacagagaaacugauagcuagaauuggugugaaaagaaaagauguuugcaucucaguuguccuagaaacaggcaaaauaauauauaagugguguuaaagaauaggaagaaugcuguauuagugcuucgacuuuagaaaugaccuuguuaucacaagaaacagcaaaauacugccuagagauuucuuaucccucagacgaaccauucuuugucugagugucaugcuggcuuagagguuagagucccccugccugucuccaaagcacuucaauuucaaaaguacagcggcaugucuagccaauuagaaauuaauauugauauuuuauuuuggagguuacagugacacacucuguuagcacuugauacuuuauaguauuuuacuuuguucuguagugggaaaguugacuuacagaagcaauaaaauuucucuuauuugaaguccccuuuguuuuugcccagaguauagugacugauaacaucuuuuaauaaggagggauaccuuaauaguuaggcuaaugguaguaggucauuucuucuccuagcaaaaucaugcuaauuguuauuguguuuuaagguguuuuuuuggggggguuuuuuuuggggggguuuuuucgagacaggguuucucuguguagcccuggcuguccuggaacucacuuuguagaccaggcuggccucaaacucagaaauucgccugccucugccucccgagugcugggauuaaaggcgugcgccaccacacccggcuuguguuuuaagguuuuaaugucccuuugcacuuagggauuuaucugccuccccauaaauaguugaauuaguccugcuauaggagaaaacaucuuuuaauauuuaaaggcauacuuaucugcagaguaagaagccagaagccugccuaaauucaaacacucuuuaaaauguucuggagaaauugcuuuuaaagagggcuggcuggugagauggcugacuacaaagcuggaagaccugaucugacucucuggaccugcaggguagccgagagcagauucccacaugcuguucugccuuccacaugcacacugggagguugugugucacacaccucuaccccggcuccugcccugguacucucuaaaugcuuggaaggcuucgggauuacuaacuuugguaguugcugucaucugguuagucugucauugaacugauuuuguguauuuguuuuuugcuuuacuuuuggaacuuaguuuuuuucucuuuggcaagguuggaauuaccauuuugauugucuguuccuccccauugaauagguugggauuaauuuugauggauaagaacucuuucaacagaaaguacccaaggagcugaaggggucugcaacccuauagguggaacaacaauaugaacuaaccaguacccccagagcucgugucucuagcugcauauguagcagaagauggccuagucggccaucaguggaaagagagacacauuggucuugcaaacuuuauaugccucaguacaggggaacaccagggccaagaagugggaguggguggguaggggagcaggguugugggggaggguauaggggaguuucgggauagcauuuggaauguaaaugaagaaaauaucuaauaauaauaauaauaauaauaaaaccucuuuccacauucucagugucaccgaguuugugaaggucagguucagaagcugccuucaaagggucagcuaacccaggcuguuacuuuggaugcugcagucacuugauucccuguuugucugccuagagcccucauaucuccugcuuuagaacuguuuauguuuuguuucauuuacucuaaccuucaaguaugugagguauuaaauugccuacauauuuuauaauuauaacuacuuacacugaguagggacagaauauagugcugaauuccuucuuguuuuauauugcaaaguguuuaaguaaaaguuaauguaguagagagggcacagugauggagcugaaaacucugggucuugagcagugcuuucagggucaugugagaagcaagagaagggguaaaugcuggcauagcaaauccucaugaaacuagaguuauauucaagacucaaucagagcauugcaaagcacucacacgcacgcacgcacgcacccccccuccccuuuuuuuuuggacaggcucuuauuauggagcuuagcuggccucaaauguaagaugcaccugcuucugccucagacgugcugggauuaaaggugugcaccaucacaguccugcuguuaaccuuuuuuagauuuauuuauuuauuauauguaaguauacuguagcuguccucagacacuccagaagagggcgucagaucuuguuacagaugguugugagccaccaugugguugcugggauuugaacuccggaccuucggaagagcagucgggugcucuuacccacugagccaucucaccagcccccaugguuaaccuuuuaaauuagagaagcugagagaaauaggaaagcuauacggguaaaccugugcaggauuuucaguugaggaggaaucaagaguuaucucucugugccacuugacauguugucaacaauaucuaugcugauaauggccuuuagggaaccucaguaauaauagaggacggggaggacugcugccuccuaguuucuaauagacaguuucaaacacagcagauugguuuugguuugguuuuguuuuguuuuugagacaguguuuuucuguguaggcuuaguucuucuagaacucacuuuguagaccaggcuggccuugaacucagauucacccgccucugccucucaaaguucugggauuaaagguguacaucaccacugccugccuuagacuagcuuucuaauugaguucaugaaaguaaaacaaaugaggacauuuuuguuuuugcuuuguguuuugcuuuucuaagaggcuugcaaugauuguauuguacuuuuaaagaacauguugcacuagaagucucuaauauucaguuggugcaauuuugaauaaacuacaccuuuauuaguauuacuuggugaagggcuuuucugacacagugaagcauuagaauguaaaaagucaaaggcuugaguuuuuuaguuuagaucauugcauagauacaugauaacuguuacacagauuucuuuacggucacuacucuuucccacuucgcugcugaaggugagcccuuuaucuucauaguccuucucacucacugccuuucauacacacacacacauuuuuacuacuacuacuacuacuacuacuacuacuacuacuacuacuacuacuacuacuacuacuacuguuagcgaugaaguguccuaauagguuuuguuacaaagacacagugacauggaaugaauuagagucaauaagccuugaugagccgggcucaccuuuaaucccagcacucgggaggcagaggcuccgauuucugaguucaaggccagccuggucuaaaagugagugccaggacagccagggcuauacagagaaacccugucuugaaccccccccccucaaaaaaaaauaagccuugauggcagaaucucacugaccguaaugugugaccuucugaaguaacuucauuuaguuacuuuccacaucagaccuuuuuuugaguuagauuaugcuauuacuuucuauuugauuuuagaaauucaugauuuccucaaguauaaaauuuguuuugugugucaaaaguaucuuaacucuaguuagcauguaacuguuacagauagaggcaaaaauaucuguuuaauauaguaaauacagccucucacagaggagcacaccuauaaccccauuacuugggagcugaagaugaagauccuagaaucuaagccagcuugggagacacacugagccccagucucagcaaauaaaucccaaacuauccaucuuuucauaauuugcuuuauuccuuuugagacuagagaaaagaaacuuaguguauacacauuuguaagaagaaaauuugcuuuguuuuuccaaacucuccucaguauuuaucugugaucagcaguguuacuuuuaguggcaucucauaaauaagguaaaucuauuauaucguggaucugugcauacugauguuauaaagauacuuugagaguuuuggacaguugugcauuuauauagguuagacaucaaaaacaaacacuucuguuucuuuucuacaggcaccaagauuuuaguguuuuguauaacaccagugcuguaucugggccugguacuaacaguguggcaugguuuucauauacuuucaggauuauuaucuuucaauacuuggaccugcaaacaucaaaaaagcuauugaagaagcugaaagacucuccgaaagccuuaaacuaagguacugauguuacuauaaauucuguaaaagaaugcaaauuagaagaugauaauacuauagguuuguucauuuauaucuaaccauaccuauaauagccauuuccugcaaacaagucauauguuaacugauacugcccauguugauguguuacuacuaauauucuucaugaacauuuuaggcuauuaaaauggcacugguguuuuacauuagaacucauguccaauuuuucauguuaagguauuuguaaauuuuuuuggcauaauaaaaaggaauuuuaauucuucacauauguauguuauauuagaaacugcuauuggcuuuaauaugaaguauuuauuguuaguuuuaaucucccuguaauugcaaaaaucacauaucuuaaaaacaaucugauuucaguauuuaccaugacugccuuuccaguuuaugaaaugauuacaaauaagggcuacagaaauggcucaggaguuaagagcaacuugcugcucuuucagaguacuugagcguuuuguuuguccuuugacccaguauuguuuagaaguauggcauuuaauuuucagauaugagauuuuucuggguaucuuacugauaucuauuucaauuucaucaucgcuacagauaauugauuauuaaacaguuccuguuuaugguucuacauauacuuuuaccuuggccaggaugcaguguguacuugaaaagacaagugcagugacugaauauaccccacaauggaaaugcaaguucagcuggagugugauaggguggggaugguuaggagggguuagaguugacagaccuuauuuacacuguaguacuguuugucauuuaggucucugugcuuuguugaaugcuguucagaucuuaacuauuuucugccccacccccucaaggauuuugaaccuaggcccugugcuaccacaaaugcucgaacuuggaaagauacacacacacacacacacacacacacacacacacacacacacacacacacacacacacacacacugccaugaguugcccagacuauccuugaauuugcagcccuccugccucaccgucucaaauaucugagguuauggaccugcguuuccaggccuggucuagcccagcuuuuguuacuggaggugguggugguuuguuaugaguuuuuguuuuguuucaugggguguuuauuuuggcaacgagguuguaacaauuauuaugacaggauacuaaaaaucuaaacaaauacuuuauuucucucuguaaucacauugagcuuuuguguaucuuaaguuggauuuaggaauuuauacaucuaugguuaucauacauuccugaugaauuccaucacuguuucucuuaucuggaaacagucucuccuuugaggcuggccugcagcuuuccuucauuacuggcagcccauucaauuucauucuguccuacuuuuccauuuauccugacagucugccucacugacauggucccucuguucaugccuaaaccggccguagcauauaugcuuaaggaaagcaaggggaaguacuuuuuucucuaccugccuuuccuguccuguuuucuggcucgcucuguugcuacaugaugcaggugucugccugacuccuugcugggcucuagagaaucgcccuagcuuuucugguaguccacauuugugaggaacaaguucuucacuuuucuuaucuagaaauacuuuuauuuuuacuccuguuuuucauuugcuugcuuauuuguuugggugggagcauguggucgucugccacagcuugugggagucauucucucugucagacuaaguuaugaacugaugcccuuguuccuaaguaauguuuucauaagauucgugcuucugaguugacaggguuuuuguuguuguguuuguuuguuuugucuuuugucccccuugguagcucuggcuagccuggaacgcuuuuauauagaccaggccagcaucagagucacagaagccuuuggggcgcuggaauuaaaugugcagggccaugcccagcugucuucuauugauucugacauggaaauccccaccaguugguccuguuguuaauuuacuguaugucuuauguccuucuuuccuggcuugagauuuucucuuuaguagcagucuaugaugugacuaccauuauuuuucuauuuuuucuaauugggauuacuggacucugcaucuguaaaucuaugucuuuuaucaaauuuggggaguuuggggcuaugauuucuucaaauauuuuuauucuguuucauucucuuacuggcacucuggcuauucuugugacaggccuuugguuugucaggaaauccaccugaggcuguuucuguugcugucuaagccucucuugucauaguuuuuguugcucuuuagguuguaaauguugucuccaguuuucagguuauuuuucagaaacauuuuaacucuagaauuucuguuuagcuauuuuauaguaucugcuuuuuuacagaaguguccuuuauguuuagucauuacaaaccauguuucacauagccauggccagaguugguuagcugcugugauugcuguuuuaaaucugucauucagguuuaucucagccaguuugcacugcuugcccuuucucucuggaugucuuauuuucuugcuguguugguuaguuucggacaugguggguuuuauucccuucaagaguguuaggguauuuuguucuagaaugguggugaacuuggcuggguuggauuuuauacacugucuugccugugguagucagcaucuggaaugucuuuuaaaguuagcuguuuccucaguguuugcucuguucuuacuuaguuuggguguuggcuauagacugggacaacuuuaugcaaagagggcugaaacuuuggcgcucuguauuaguuuuagcugccucuucagcacaugaaguccugguguuaggaauaaaaccaucaaaauuagagaguuugacagauguccuuccccuucccaguucuucacccugccugcuccuuaucuuuguggcaguccagagcuguggcugucuggggagguauauguccuucauauacaaguauggacaauagacaguauaagcaugccagaguuuuaguucguucuuuccuaacugacuggaguaaauuauuuguuacccuuuucucucucggcucuaccuucucucuuccuucccucaccaccccaucucugucucugucuccaucuccccugauccucuuaaguucagaaccagcagucauuacuguauucacuaaugacugggugagcaaugucuuaggauagcugcaaacuguacucaccauagcuuguuuaacauuuagcaaaauagaagauaaucacgucuugacuuugauaauaauucuccaguugaugugguuaauaccuuucuugaauacuuguuuuaacauuuugaucuaaaucaucuacacagugagauacugggagaaguccucuuccagagugaaucaagaguuuguuuaaaaagugaaauuguagcagaauugauaauuacuugaaauuagugaaaaagcaagaacaacauuaauaaaaagagcauaacauuuauuuuucaagguguuuguccaguuuaaaguacacagacagccccugagggcagaugcaugugguuuguaugggaacucuagcagaauucucccaagccaagaugcuaaguaugaaacaugaacgcccuuagcuauacuccaucacauuaauaggaagcuucuuucaacuagauacgaagaggcugaaguucggaaacaacuugaagaaaaggacagacgggaggaagagcagcugcagcaacagaaaaggcaggagauggggagagaggacagcggugcggcagccaaacgcucuguggaaaauuuacuggauuccaaaaccaaaacccaaaggguauugcaaguuuauuguguaaacgcugguccuguuugccaggugaccuaucuggaggaggugcacugccacuguaaaguucuuuugaggcaauagggauaccauugguuggaauuagaaucaaagguccugacugcagguuuuccugugagcuuccacagcagcacuguccuggucacugguuacaauguuagcagucacuacaguggaaggaggguggccugagaggaaccauuggauugucaucuaucuaucuaguucugggccugugugaguuuugcuuaacaacucuuggacucagguuugccaaaugaagaucuuuuuuuuuuuuuuuuuugguuucuugagacaggguuucucuguauagcccuggcuguccuggaacucacucuguagaucaggcuggccucgaacucagaaauccgccugccucugccucccgagugcugggauuaaaggcgugagccaccaugcccggcccaaaugaaggucuuaaaacgaggucuaaggugucuuuuuccuacugauaaaucuccauuaagagaaggaccagggccaggcauggugguaaggugagugccuuuaaucccagcagaggcagguagagcucagaguucauucaagugaguuccaggccagccagggccacacagggaaacccugcccaaaaaacaaaaauaaaauaaagagcaaaggacuugguuugcugcuuuauuuggucccaaacaguuuugguuacuggagucuuaggcacacacgccaucuauuccuuucuuccucuauuccaguuuucccuuugucuguccuguucagcguuuuauucaaucuucuuagcauguguacaagaugucuuuaucaaaagccaccagugacacaaucucugccagcugucacugugccccuuccuuacuuucucagaauuacucuccugaagauguaagugguuuucaguuguugaacuccuuggaggcugugcuuugcucccucugaucccuguguuucuuagggguacguaguguuccccuguugcuaguguggauugcugguauuugggagaggucucacuggguuaagcagucugaucucccauuguuggaauucacagggagacaaaccacuaaccuucucaacaggucaaguggcugccguaagcaauaaccggacuuaaaggggaaucuuucauuuuguugccuuuucuuuuguuuguuuuuuaagauaauuuauuuuuauucuuugggcauugguguuuucccuccauguaugucugagugcgggagucagaucuuggaguuacagacaguugugagcugccaugugggugcugguguuaagagucagcagucaaugcucuuaacugcugagucagcucucaagccccuuauugccuuuuuagaagugaguagucacuuuuuuucucuaauuugagacagagucucuuguagcccaggcucacuuaagucguuaaggcuggccuugaauuucugcuuuuugccuuugccccaauuucuaagauuauaggcccuuguaaucuugccaagcuaauggcaugcuaggguaagcaaaugaccagcugugcuacaucucccacccuguuacugugacguuaacauuugcccacuuugucuccuacacuguuucucucgcucucacucucgcucucggcuugaguauuuguacuauuugaguagcugcucugcuacuuuacugcuaacugcuuugcugcacaguucucauaacuguaguccucgccacccuguaaacuuaauaguaacuccuuaguauccccgggugcucagucuguauucggauuuugcuguugccugcauguuaauuucacaaguuaauuuguccacaaguuaauuucacaaguuaauuuguucacaaguuaauuuguugaaucaugaugcaaaacagugaacugucuucugauuguuauaucucuuaaggcgcuaaaauaauuucccuuuaagauucucuuccucugaaacuucgucauaccauguacuugacugaauaaagaaagugaaccacacuuucccccagccuguaggcuuuccuuuauuuccugcagugucagggcagugcuguuuaguuucaugaugagaauucucugcggaugauacccuguguuucauauugugucaugcuaggagccagacgauauauauaacuugggcaaauguguaccuacaaguguguuacuaacuuugacccauagguucaagcggguccucaguuuucccaucuauaaaaugagcuagcaucuuacaagguuaugucauguugccucggaaaauguaaacuguauaaguaguagaaguaguauguuguuauuacuugauuuuccuuuaauuuuaugguagaaaacacugacuagaauacuagaauugcuguuucauuuuaagaaacacuuccuaauuaaguacucaaaugauaucuggcacuuguuuaagaaaauuggagccugaacagcgauucugauacacuugugguuauuuuagcugaugccuaguaaagccaguccugugucuaaacucuugagggcagaggguguuaccaggcugaguacuucaugcacucaaggcaagugcucugcuccugagcuguaucuuuuuuuaaauguguauuuuuuauaaaaugccauuacuuggcacacuauuucuuagcuuucgauugcaauggaguauuaaguuugagucucuuuugugaaguugaaacgcuuuucuucugugaacuagauuaacggcgagaagagugaaggagcugcagcugcagagagagguaugugagaaaggacguuccgcugagucucuccacuggaauagacuucaguuugauacagggagagucuuccuguacucuguaaguucuguauugguuuacugaggggagaguuuaugcaccauuuuagucugguaugauuaaauguggcagugugcagcuuacuuguuuuguuuucuagguacaguaguuaaccauaguguaguauuugagagaugaccacucagcagcugcucuucaguauacugaguaugauacuuaccacucuaccucagcuuccccaucuguaaagaggguuucuuuuggcucacgguuccaggguacaguugaucacagcagggaaguaaguaaggagcuugaggcagcugggcagcugcagugcagucaggaggcagaggaaggugagugcuagcacucuggucaucgcuccucuucacccagacaguaccucagccguggagccaugccaccucagccagcuaauagaaaugagacaguuccucacagacgugccuagaaggugucucuacggugauuuuagauacugugaaguugacagcauuaacugucaaaggaguuaguaaggaaacaguucauagugaauucagcugcacauauuaaacuuugagaauccauaguaaauuuaagggcuguuagcuguuauuugugauucuaguuuguaagaguuaauuauuuaguggaugcccuuaugccccgaagaagaaaucuuaaccuguaauuugcauguauccauaccugguauugugagaucuagugacaaguuuaugaccuaccaauaagauagguaguugacuucaucuauuagagaaauuuuuucuuuuucagaaaaacuauaaauuaaacauaauuauauguagcaccaaaguaauuguguacugaucauacaguaauuuuaaaaauaaacuacguguaguguaagguacuuuccucgaagcuguuggugaucuuaagguuaguuuucaucauccuuguaguucauccugcguagguauuaccccauucuccgugguagaaggugcuucuggcaagccgugucuguaucuaaaguuuaaugugaugcuuuuugaucuuucgcugcaggugguaaagcugaaaaaaaaaauagcaacauaguuuuguuuguuuuugccaaauugcauaccccauuccaauuaauuaauaauuggaaaucuaaacauuccaacaguccucauagcaccucgucagagacccaaaaaaaauuagaaaaagauaaauuagaaccuguugagacucauuuguuuacgacaguaacuuaucuauacaagacuggccuugaauuuuauauguagucagggcugaccuuuuaaugcaaguacuccaccaugcccaguuuaugcaguugcuggagauugaacccagggccucguaugugcuggaaaaguauuccagcaacugagccacaucaccagcccuugugacuuuauuaaucaugcauuuuguguaugaaauguuucuauuuuaaugaagcacauauuuaauuuucuuucuuugagagaacuaauaccagauacaguugggaccuugacaugaagguuuuaauugggcgaagggagucacaauggaaucaaagccagagcugaaggcugcuaggcagauacuauuccacugagcugugucuaaccuguguauaaacaagacauggaacuugucucuuaauaaaugucaguauauguguucauguaaaagauaaaaauugacugugggaugauaagccugugaugucaggaauacuuugcucuuccauguuugcuaauaugccagcacauagaacuggguguuucuugucauuuacuacuaugucucucaauuccaaggagccaucacagcaaaggaacuauauacgaugaugauggauaaaaacacaagcuuaauuauaauggaugcucgaaaaauacaggauuaucagcauuccuguaucuuggauucucucaguguuccugaagaagcuaucaguccaggguaggucauugugugcuuagauaauagacaaagugugcuaugcuaacaggcuggccuugaauguguggugcuccugcuuggccuccugguguguaaaagacuguguccuuuucaaucaaccuguguacuguugucuccauuacuguguaagcccggugugcuuauuaccauugcucugcucauuuccuuguauaacagcuuacuggccuguuuuguuuuuagacuugggccuuuauguauuggauauguucuugcuuuuuccauuuauacaggaacauaugaauuuauuaaacuuaguauaauuaaguuuaauugauuauuaaguuacauuuaaaauuaaauuauagaauggguagaacaaaguaugaagauaauacauaagaaacuuaaauuugggaaacacuuuuugacucuguuauuacccaacaucuucacuaaacuucuaaacguaaaagaaugauguaggcaaauaaaugccucuuaagaagcucacauuucauuggcuuccauuccauuccguuguaggucaagcaucuugaucuaucucuguaaggucagcuagaugcugauaguuuauacuggcuccuccuccacugcccuucccaccugauacagcagccaacauuauuacuuaggaacagauuuuuuuuuuuuuuaguccagagacauuuugcuuuauugguaaaaguuucaccagucccacucagcuugccaguacugucgguuaaacacuaaaugcuggguggguucuagaacacuggcuuguuuuucuuuuuaaucaacagaauggaucuguguuauucaaucauccugucauucagcaaauauuuucugagcaguaggcuggguuacugugguucuaagugcugaggcuaaaccaggaaagagauaaaaguuguugccuuugugaagcuuuuauuuaaauagccagauaaggacaagaaaaaugauaaaaauuaaaauaaauaguauuccuuaaguuaaggugugguggguggauguguauugggauguguaugugucugucugaugucuguuuuucugucuuggaguagacccuaaaauuuaguuuaaggaagacucacagaaaaguucuuagcaaguguugaauaugugcacaauauucugagaccaggagugggagcaaacagagaagacagggagacuagagguccuaagcaggagcacagaaagggacaagccguuagagaagagaaggaugggguaacaggauugcagucuggguaacaggccaugguaagggccugaacuucuauaugaacaaaagaauagcugagcacugacuccuucguaguugagaacaugcuggugacaggaccuaaguuagcacagacccgagcuguaaccacaggcaggcugucaugcuuuaaggaagcaugacauaugccaggcauaugccaggguacuggaacaugggguaauagcuccugacugguacugcugcggggagucaauaacgucugaagcauauggugucuggcauacuguaagcacugugugcuugcugacuaaguuaaaucuugcuguuuacuuacuguaaguauagagagacaugagcuuaaauaugaauaauguauccaacgugacucuacaguuuagauuuggcugagaagggguccaggugauuuccuguuuucaguuuugcugugucccacccccaucuuuuuuuuauaagauuuauuuauuuauuuuacauaaguacacuguugcugacuucagacacuccagaagagggagucagaucucauuaaggauggcugugagccaccaugugguugcugggaauugagcucaggaucucugagccaacccccaucuuuuuuuuuuuuuuuuuuuuuuuuuuuuuuuuaagaaguuagaauugaagccuggcaugauggcacacaccuuuaaucccagcacucgggaggcagaggcagguggauuucugaguuccaugccagccuggucuacagggugaguuccaggacagccagggcuauacagagaaacccugucucgaaaaaccaaaaagaaaaaaaaaaaaaaagaaaaagaaguuaaaauugagucuguuucuuucccucucuaguaauuacuaaagcacuaacaugcaguaaagaagggauagaauaucuuuggcuaguuaauaucuuaauauggagcuuaacuugggaaagcuuguccugguauggcacagaauaugcucaacuuugccucaauacaaaugcucauguauuucagagucacugcuaguuggauugaagcaaaccucucagaugauucuaaagacacauggaaaaagagggggaguguggacuaugugguccuucucgacugguuuaguucagcgaaagauuugcugcuugggaccacucuacggagucugaaagaugcacuuuucaagguugggggcuuuccucauuacucuaacugccguugucugauuguugggagucugguuauuuugacuggcucuguuagacuuuuaaaccaacuguacucuuacaaaguugugcucaguaaucaucucggaggugaauauuuaauauugaaagucauaauguguuagugagccuggguucagucauucucuuuucagaaauuguacuuaagcgggugacagcaugggugcuuaucuuuggugucuaucccaguguggcaggguugggaguguuuuaagugauucauuacauuuugaaauaucuguguacagacacacaggggagggggcaaucauauaagugaugcaacaguuaaugaaauucauauaaaagaaaagacaaauuaagaguuuuguuauuuuaagcugggguggaguggaggguggggcaugcuuuuaaucccagcacuccagugggggauggggguagggcagaggcaggcuggccaaucucuguuucaggcuagccugaucuacaaagcaaguucuaggauagccagggcuauuagacacagaagccuuaucuugaaaaaccauuauuuuauagaaacacauuuugaaaaguguguauaugugcaggagguaggaauaaaccgcagaguguagaagugcuaucaggucuaggcgcucagggcuagguaggcuuuguuuugugauuauuuuauaacuuuucaucuaagaucauagauuguuuuuggguucuuaaacuuuauauaucuucauuuaauguuguauuuugaauuuauuuuuuuguuuucauuuugcuuaacagggaacaguuccacacuuggguuuguugugaucugugguuuuugcugucaagagacugucccgucuuaaagauaucuaucuuuauuuuguagugggaaaguaaaacuguccugcgccaugagccuuugguguuggagggcggcuaugaaaacuggcugcuuugcuacccgcaguuuacaaccaaugcuaaggucacuccacccccucggagcagagcugaagaggugucugucucauguauguauguauguauguauguauguauguauguauguaugugaaaauuguguuuaaaauugcuucaguacagucuaaaacacuuagguguucaggguaaccuuacuuguauaugccuuuguccuaugaaaugcuaguuuguuuucaggaaaaacaacacagacuaggaguucauguucuuuaagacaguggugauugcccuuucacucuguuagcuaucacacauagccugcauagcacguaaguacugugugugaaguuugcgguucuuaaauaaauguauuguucuuuuggcaauuuuaguggauuuuacuuaucccucauuggaagaaccaguuccuuccaaacuuccuacccagaugccaccuccuccuauagaaacaaaugaaaaggcacuguugguaacugaucaagaugaaaagcugagacugucaacccagccagcucuagcuggaccuggugcggcucccagagcugaagccucacccauaauucagccagcgccugcuacaaagaguguuccacagguauugucuuggcguuuguuuguuuguuuguuuguuuguuuuuuacuaacuuuauucuuuuguuuuaaugucauauugacacauguuacacagaauuuuauauauuaucuaugauaccuuagaaaauauaaccucagaaggauuugugcaucuuggcaccuuuauuuauuuuauuuuuuuuaagauuuauuuauuuauuugggaagcuggagaaauggcucagugguuaagagcaccaacugcucuuccagagguccugaguucaguucccagaaaccacaugguggcucacaaccaucuguaaugggaucugguaugucugaagacagcuacaguguacuuguauacauuaaauaaguuaauuaauuuuuaaaaagauuuauuuauuuuauguaaaugaauacugucucugucuucagacacaccagaagagggcauccaaucccauuacagaugguugugagccaccaugugguugcugggaauugaacucagaaccucuggacaagcaguugguacucuuaaccaccgaacggucucucuagccccaggcacuuuauuuuuaacaaaaaccuuuuauaauaauuaccucuguugcccuggcuauauuagacucccuacaagacuucaaagcucgcugguggccauuucucauaaccuguagcaacagcuuguguuccgagguagauggaagagcucagcuggugacguugcugugauuugacuggcacggcugcccucaagugucugccucagauggcucucaggacuccaugagaauaaccaagucugcaagugcucggucccucuuacacaucugugugucaccugcgcaccacccagagcuuaaguccucucugcauuacuuguggugguuacagaggcuaggugagcagccagcuaccauacuggacuguucagaguaaugaugagaacaguucucugacgugcuccggacagaagcagacuuuuacaaacaaaacauugcacuguggaggguaggcccaucacuguagaaaauggagcccaucacuguggagagugguuugccuacuuuugcuuaucagagaggugaaaugucaguguucuggcuuuaaaacauauuuuaguuccauuucauuggcguuugaaauguuaaugauaguuauuuaaagauauugaaugauauucagauaaaaauuuagagguucuuguuagguucucuuugaagaaacaguaauaaaacuugccuagacaguauucauuauggaucuguagcagucgcuuucccugcaguauuaacauuugaaguggaugaugcugauuucuuuagagcugucgaaagucaguaucuucaucauuuuuaaaguuaucuaauauuucagauuaaauauuaaacaaauugaauaaauaagucuucuuaaaguauaaauauaagacauuauaaagagaagguauauuauuguaaaugccuucauuuuaauugaauucuaauacuuguauauccaagaugacugagaauauaguuuuuccaguguauuuugagguucacugcacucaauaaucugagaagcaauugaggaaauuucuauuugaagguuuguaaauguggguaggauggauucucugcagugacugagagagaucugguguagagagagcccagucacagaauaguucaccauugcugucuagcccuuggggagcagagcaggagaacugaguuucuuuucuauagagaagcagcagcuuucuggcucugaggucuuaauggguuuacagaugcagagacggguuggaaagugagugacugggggcagacagcucuugaccugcguagcugaggguucaugcugaggagagcaccaugacagcacaggagaccagaaagacagccagugacagagaauuggaucuaaucugagcuuuguucuacagguaugaggagcugaggaaggaauuguaaguuuaagauaggaaagugugguguuucucagacuggggagggugagugugccagcagcuagggaucgaagcuuugguuuuagguccggcuccacuuuuaguguuggcuucaucuccacagugguucuuccuacuucggucucaauuguagaaaagaauaggugauuuuguuuauuugggggauuuuuuugcuuauuugaaaaaguaaaaaggcaaaaaauaaaagugaaaaggaauugggauuuuuuuccccacugacuuuguucuaaugggaacauaaaauacauuuuauaagcaugcugcauuagaucauuauuaggaaguucucaguuaaguucuccuugcuguuucaacacacaguauuuccaagaaauguuaggguuacuucucacaauguuguuagagcagcuaaagcaccucucagugcucacguucuagaauacggcagcuuucucccucagauguggugcuggcagauggcccagccaauagagagccucuugugcaagugugaggaucugaguugagggccucacagccacaugagagccaggugcagcaucacacuccuguaauccuggaacuggggaggccagaguaagggaaucuugggccugcuggcuagccaucuacuugaucagugagcuccaggcucagugaaagacccuggcucaaacaguaagauggagggccaacaagauggcucaguaguuaaagguggcuugaguuugaacucuaggaccuaugugguagaaggggaaccaacuccugcaggcugucuucugacucucccuacuaaauaaguaaaauuaauacuagcuguaaaauauauauaauaauaagguacaagaauaaagaaguggggcuggugagaugguuuaguggguacaggcauuuaugcacaggccugaugaccugagguccgcuucagucccugaauccugcaacauggcaggaaaagacccaacuuccaggaguugccuuuugaccuucacacuugacucugcauucacaucacaugcagugugcacacacaaaauaauaaauagcuauguuggggcuggaaagauggcuuagcaguuaagaguacuggcugcucucccagaagauuuggguucaguucccacacugacauagcagcucacaacugucuguaauuccagucccaggggccugacacacucacauggacauacaggcaaaacaccaaggcacauaaaauacaaauaaguaaauauuaaaaauagauaaaggaagaaaaauguuuaaguauuaaagaaugaauaguagucaggcuaugauaaaguuuauuuaauucauuuauucauuuuguauguagguauauguauguguacuacaacuuaaauaugaauagcaauguaaaauaggauguuauuaaacaaaagagaaacauggucagauuuguuuuacgaugauuacuugggugagugaauggcugggcagauaaaggcucuugccagauaaaccuggugacuugaauucaauuccuagaagguguuccauaaaggcgggagaaaagaaccaacucuacaaaauuguucuuuaacuuucacccuuaugcugggcacauaagauguguaacugaaaaugggacaaaagaggugagcggguagugggaggcucuucuggaguuugggaagagagaaugauguuaggcaguaggcuuccugguagucucggggauggagguaaagcugaauggaauuuuaccaggcagcagaaagcugugggaagaacauggccuagagcugccaggcgacugguguaguguauacagcuguguggagaguagagggaaacuguauuugugggcaucauucauucauuuuuggccaucuggguguaagguauuauggggcacuuauguggagauggggaggguguagguggguguauugguauggagcuucagacuccucugucaggucuugguucuguggucugucauuaagacauguaacucuucugagcccagaacaugaaacugaaguagguuuggggccaacuuagccuauauauaagaacuagucucgaaacagcacuaaaagcacauuuguucuauuuguguuucucuagguugaucguacgaaaaaaccgucagucaaguugccugaagaucauagaauaaaaucugaaaauacagaucagaguggaagaguucuuucugaucgauccaccaagccaguauuucccucuccaaccaccauguuaacagaugaagaaaaggcucguauucaucaagaaacugcccuucuuauggaaaagaauaaacaggagaaggaacuuugggacaagcagcagaaggaacagaaagagaagcugagaagggaggaacaagagcgcaaagcuggaaagacacaggaugcagaugaacgugacuccacugagaaucagcacaaagcaaaggauggacaagagaaaaaagacagcaaacagaccaagacggaagacagagagcuuucagcagacggggcccaggaagccacaggaacacaaagacaaaguaagagugagcaugaagcuucugaugcuaagguaccuguggaagguaaaaggugucccacgucagaggcgcagaagaggccagcagauguguccccugcauccgugucaggagagcugaaugcaggcaagguagguaaaacgaacaguaaauguguauaagauggugacacaguggccuuccacaaacagaacaggcauucuggacagugcucaaggggugagagaccguccugauccauugguauuggcuucucugcuuuccuuugaggccugugaugauguaaauugauugguuggccauagaaucuuucguuuauaaaaugucauacaacuuauaauuauugcuagaaauagucauaugcauuucugugcuugcuuggugugugaccaucaaaagacgaggauaaaauacaaucucauaauggagaaauaaggcccaguagauggaggucauuuugucuacauaggauguacagucaguaacaucgacagccugacauuuauuuuacauauaaugauauuuuugaucagucuguaugauuuuguuucuguucguacacuuaaaaucaguuacuuuuuucuguccuuaacuacauacucaaaaguugauugccuuaauuuuggaagauauguucauggaaugauauacuuuuaauuuguuuucuuuguacagcuaacaguguccuuuccuuuugacuacuauguaacagcaggaacacuaacagcuuacuuuuacguacauacaaguaaauagaaaacaguuuugguagugcagaaaugaaggcuggaaagcaaaaugcuaccuuacaaaaugcauaccuuucaaacaguacuuuagucacauuuuccagauuuacagaccauauuaauacaaugcucagggaccacgggcuaaccucacuagaguagccagguguacugcacauaccuguagaucagcucacucggcgucaauaagcccaugacuucaacacugaggaaagcucaacagaauacaacgccuguuugagaauuuucuaaacaccuacaauuagagagaugaaguuccuacuuaagauacaguuuaaauaccucaaaacacucaaggcaugucaaguauuugccaacauuuuuuauuuauagagguagccccauaagguagugaguagugaguuuacaggcaaaacugagcucagaggcugucgucugccuagaauuccauagggagugaaauuggaagacagccucuuucccccuuccuguacuggagacagucuuaagaacuuaacacuuucauauguguagagucauuugaggugcuguaaacacccuagaaaccucagcggcccucagguuaugacauguguggguagagaacacaugcaaaaaagguuuaguuaauaaauagaccuugcauuuugaauaugaucuguguaaaauucuguauuuucagcauucucuugcuuauguuuaaaauauauuagaggacagcccuuuucaaguuaauaaaaaccauauaggauauaagcaguagacucugagagcaugguguauauacacuauaagaacauaauauuuaacauuuuauacugcauuguaaaccagugcuucacguucuauugaguuuuauuuucuucacugguucauuuuucucuuuagugguaugaaaucccaaaugaacucacauuuaaacuugacaauagaauacaccuuucagagagacuuaaaagguuuuuuguuuuuuguuuuuguuuuuguuuuuguuuuuugacaggguuucucuguauagcccuggcuguccuggaacucacucuacagaccaggcuggccucgaacucagaaauccgacugccucugccucugccucucugccucugcaccucugccucugugccucugccucugccucugccccucucugccucugccucugccucugccucugccucugccucugccccucucugccucugccucugccccucucugccucugccucugccccucucuaccucugccucugccccucucugccucugccucugccccucucugcuucugccucugccacucucugccucugccccauucucucucugccucugccccacucucucucugccucugccccucucugccucugccucugccccucucucugccucugccccucucugccucccaagugcugggauuaaaggcauguaccaccaccgcccaguuuucuuuuuguuuuuagucugauacauuuaauaauaguuuaauuuagguauaauuugcauaucauaaaauuuaccuguuuguaacauacauuuagucaguaacaagaguuuacagacuaggggugaggguauuggggacuuucaggauagcauuugaaauguaaaugaaaaaaauaucuaauaaaaaauuaaaaauaaauaaaaaaauuuaauuuuaaccuauuaaaaaaaagaguuuacagacugucagggaaugguggcucaugccuuuacuccuagcacuggggagguggagguggagucagacaauuucuugugaguuugaggccagguuggucuacauagagagcuccaggacaaccaugaccacauggaaagacccuguauaaaaaacaaaaacaaaaaaaucccacauacauaagaaaaacuuaacauaguacaugaaauuguuaacauaauccaaucauaaaacauuuucacaacaccaaagaaucacucuaccuguguauauauaguccuguccuguaccccuccuaaagccucagaccaaaaccugcugucuccauugacugucuuuucucagauagucuuuagcagcugacugcuuucaucuggcucaguggcucucagccuucuuaaugcugugacccuuuaauacaguuccucauguuguggugacccccaaugaucagauuguuucauuaguacuuaaguguaauuugcuacugucaugaaucauaaugcaaauaucuaauauacaggauauuugauauucaacccccagagggguuagaacccacagauugauaacuacuggucuagguuuuuuguuguuguuguuguuguuguuuguuuuuuuguuuaaauguguauggauauuuugccugaauguaugucagugcuccuaaagagggcagaagagcacaucucuugggaaucaaacccauguccucuagaagagcagccagugcucuuauccacuaagccaugucuccaaccccuuaccuagcaguuuucuuauuuauuuuagagcauguauugguagcuuguuucuucguguaguuaauuauuauagucucugcacauaugcacuugucaauuuggauuacuuagauauugcaugucuucuugggaauuauuuugaauacugcuacuguggacauuugugucuuuacuuuugagugaguacuuaggaccggaauucuuuuuagcccauuuuguuaauaaacuuaaaaacugaaaaacaaauaaaccaaaaaaacuuugaaagagccuggcaugguggcgcacaccuuuaaucccaguacucagaaggcagaggcaggcagaucucugugaguuucaggacagccuggucuacagagcaaauuguaaaauagccagagcuacccucuucaaaaacaaacaaaugaaaaaacagaacaacaacaacaaggaaagaaacuuuaaaacaaaaaucaaacaacaaacacauuucccagugcagcugcccacuuuacaccugucagcauauaucugcaucccagccaaaacguuacagugacguacauuuccccagugacauugacgucucuuuuuuuuuuuuuuuugguuuuucgagacaggguuucucuguauagcccuggcuguccuggaccucacuuuguagaccaggcugaccucgaacucagaaauccaccugccucugccuccugagugcugggauuaaaggcgugcgccaccaugcccggcgacauugacgucucuuauguuuaucuucgcuuuguuuuuugagauggucucauagagcccagacuaaccuugaacucucaugaccuuuuugccucuacacugcaaaagcugagguuauagguagucacuaucacacccaucuuaucugucuuugacaaaaucguagccaacuuaaugacuggcaauuuugacugagccguaugaauuuguaauauucuggcuaagucccuuauuugaaguaagauuuauaaauauuuucuccaugaugagaagugucuuucauuuaguuaagaaaguguuacaaacaaaaaucucuguaaagcuagaagcaucuguagucagcguagagacccaugcuucagcaugcugcccugcauuuccacagagcacacuacaugaucuuuguaaguggauacagaagcagcugugguaggagggcuagguggcuaggagauaaucaccugacaggccuguguggcuccuucucucaccaaccaccauggagagccucugccacucaccaccaggccucugugcacucaucuccaguguugcaaacacagucacugcggaaguaacugcgugguuaaaguuuuaggaauugcuguuaaagacagagaagagucacacagcucucagugaauucuccaaagaguguaaccuuugagugucuccagacucugugcagcgugauaauuaaguaagaauaauuacccaccuuuuuuuuuuucucccagcuagcagcuucagucauagucucugcuucccaguggccucuuggcuuccuuuggaaaguucuagaaauguuauuacauuuccuucuuuauuucacauuccucuaacccuugauauaguagacuuugagaaaaacaaaacugccuucaucuuugaugcugccuuuaaaauuaugaaggguggucaagaaacuuuuuuuuuuuuucuguuuaaguacuuuaagcucaugaauggaaaauuuuaacuggaaaaucagauuauuguuuuuuaaacuaggcucagcgagaaccuuugacgagagcacgaagugaagaaauggggagaauugugccgggacugccuuugggcugggccaagguaaacaccaggguucuacauuaaaugcacgcuacuguauuuugguguuugguuugguuugguuugguuugguuugguuuuucaagacaggguuucucuguagagcuccagcuguccuggaacucacucuguagaccaggcuggccucgaacucagaaauccuccugccucugucucccaagugcugggauuaaaggcaugcaccaccacuucccggugcuacuaaaaaggcguuuucuuguuguccauccacuuuguuauagagaacauaaacucuuccccugauuacugcagagugagaucuccugguacucagccuuagaugcugacuagcauaugagcacccuggcaauauaauuuugaaauugcauauuccauuaaggcaagccuaaauuucuuuaaaaguuugaaaaacgauuauuaauuuuaauuaaguuauuuuagggccugcagaauauaaagucugugcuuagcaaauucaaggcccuagcuuuaaucuuuuagcacacguguguuuuaacccagaaguaaauauuguggugggaugacacuugaaucacuucugugcuuauauucuuucuaccuuucuguuuauucuccuuccccaaguuucuugauccaaucaccgggaccuuucguuacuaccauucccccacaaacacaguucauauguauccaccugaaauggcuccuucgucugcaccuccuuccaccccgcccacucacaaagucaagccccaggucccugccgagcgggacagggagccaucgaaacugaagcgcuccuacuccucaccagauaucacucaggcccugcaggaggaggagaagaggaggccggcagugaccccgauggucaaccgggaaaacaaguaagugcucccaguucuagaacugaagcagcggcaucgcuucaaccugucugagugucaccccguaaacguauagccuuggaggaugcgugagaguugaaucaguguguuuaguagugguagagauaggacaguguugcauacauugcuauagcacuuucccaguaccaugcccaaggccucacucaucuuucauagauccuaauuuguuuuguaacuuuuaauuuuauuagggaaagagagugugcgcguguguguguguguguuguguguguguacuugcacauuacaguacucucaucuacuauguggguauggacucagguaucaggcuugggagagagugccuuuauuuacugagcugucugaccacccaagaugacaauuuauaagauggcugaguuggcaguguuaccauacucaguuucuagccuuuguuucucucacccagucauacaggagcauagucuccuaucuauaaaaauguaggcaccauaugucuccuuuccucuuccuauuucugcucaucaggugaucaguggguuuaaguuucccagaguagcacaucauuuucuuauauuucugccccuaacuggcaggaauauaagauauaggaacugggcacuucuggggcgggggguggaaaugcaacuggccuuccauguccauggcuucugggcuggggugucacucagcagaaugcuugcuuaaaugcccaaagugugggugugaucccaacacugcauauaaaccaguaauggugagcaccacucaggaaauggagacagcagaguuagaaguucaucguuacccucaaccagccugggccuucgugagauccuaccucaaaacacaagaacaaaagcauauuggauaguuucuguaucuaggacuuaaccaauaggggaucaaaaauacuggggugggaggaauuauagaauuacugaacacaaagaggugucuguccuugccauucuuuuuaacccaccacaauagcuauuuaaauuguaucagguauuaaugaauagucagaaguaguuuaaaggaaacaggaaggggugcacaaauuaaugcagacaccauagcauuugaucuacugcaggggucuuggauauugaaguuuggaguauauauaaaugugauggauuuuuucauguauuauauauuauuuguuaauuacuaaggauuuuuuauuuaucuuuuuugacacaucccaaggaagucauugguuaccuuccugagaauucaccuuaccagggagagaccuauuugaaagaguuuuuggaauuaguaauauucaaauauuacuuuacuacaguucauuaauucggcaguguuuugaagcugucucauaaaucgcgcuguaucuuuuauaaagaguacgugaacagaaagagcguguagagaaaacgggcgguuugcugcuucccauccuccccuucauagguaggggucaggaagucgagggaguggccaccagucagggcaccuuuagucaaaagugcccagcagacaccuccaugguguccggcauggcuuuaauuuuuuguuuguuuguuuuuuuguuuucguuuuucgagacaggguuucucugucuagcccugacuucuuggaacucacuuuguagaccaggcuggccucaaacucagaaaucugccugccuuugccuucugagugcugggauuaaaggcgugcgccaccaugcccugcuaaccuuugccucuuuugagaccugucugugguuaguauauacuuuuauuuauguauaauuuauuuacaagagcauaaauaucugccucuuuauuuuuuaaauaucuaauaccuacuacaguguaaauacuguacaaauauaguauuugaggaaauaguuacaagaaaaauguaugcacacacucaguuccccaccccaccccuagcacccagccuucucaccguuccuucuaccucaggaaucuucccaugucccguggucugcaucucuccccaccucguuuccauaguuucuuuuuuccugaccgauggguucuuucugcuuacccaaagccacuuaaauacacuguuugcuauuuagcagcugggaucuacauauccgaaaacacuacauaauauccuucuagaauuaauguauaauuuauauuuauacaugauuuuauaauauuuaauucucuaacauuccgguugaguuagaguauuucaugaugcuaaugucucugggucacuuggagaagguugaaagagcuuuuucccauugggcaguagccgagccugucuagacaagaggaagcuagaggacccgucucaggccaccucuagaaccaagaacucaggagaaguggaaggcaugcauucaugggaggggccuggaacauagucacuuagccuaauugcuagaugucuuagggaacucagcaguuuagccuguggcuugugggcaggauuuuaucugguauagcugcuccagcugucuaccaucuucauguggacccagcuugagaugcucugcauaaggcaucuuguucuuucuuucucaggccaccauguuacccuaaagcugagauuucgaggcuuucugcuucucagauucggaaccucaauccuguauuuggaggaucaggaccagcucuuacuggacuucguaauuugggaaauacuuguuacaugaacucaaucuugcagugccuguguaaugcuccacaucuggcugauuauuucaaccgaaacugcuaccaggaugauaucaacagguaaaggaacauuucauucugcaguacacucucgagaaggauauuuaacuguagugccuggaugcaguacucgaguuuuguaugguuacaacaugccagacuagguaaucauuuuuguuuauuuguuuauauaaaagaauuuugauuuuuuaaaaaauguguguaucuugaguguggcuauguacaaacuagagcacacacacaagcgugaagaucagaagacagcuugcaggaacuggcucuccaggguagacuccaggauuacaucaugucaucagcucgcacgugagcgcuuuaccugcugagcuugcuuugccaucgguguagagacaggguucaggauuagcaugucaguaucucaucaggguccugugcucucccagcaaacagcaggagacccaggggcccagggugagcccuucauugugcccuuuucaguaggcauagccucuucaggucauuuucauuuuuuguuuuuucauuguaucuuuaggaguaugugcaugugugaguauagcagcaugaggcauccagaaagagucucagauucccagaacuggagcuauggacagcugugagccaacaucugggugcuaggaauaaaacccgguauucucuaggagaaacaaucccucuuaaguagcauggaggcagccgucucuucagccccuuaagggccuacuccuaggcuaugugcaguaccuacauuuuggagagacguauucaguugccacugagccucagaggagucaaauuaguaaaagagaaaugaucuuuaucuguaagaauacgggguaguuaucccagcucuggucauaaaggacgaagaagauggcagacacacugucaggguuacagcuuccaucuuugacugcagccuguugaugugcgugaggagcagggcuugcagccaggauaagaaaaugaguuggaggaccauagcaaagucagguucagauguguuugguucaagccugcaggugagugauuccuuuguguguuaugugugugguuuugugcugacaucaagaccccacuauaacuuaauuuuuuuauuuuccauaacuuuacuugcacaggucaaauuuguuggggcauaaaggugaaguggcagaagaauuugguauaaucaugaaagcacuguggacaggacaguauagauacaucaguccaaaggacuuuaaagucaccauugguaagauuaaugaccaguuugcaggcuccagccaacaggauucacaagagcugcuucuguuccucauggauggccugcaugaggaucugaauaagguaagagcgggguauccucagcuucgcuugcuucaucuucacagcaguuuaaaugcuuguucacuagugucugaguauggacugugccacugugccgugccgugugugugugugugugugugugugugugugugugugugugugugugugugugugugugcuguguggagucugcuaagcuccccagaacaaaacugaauguuuacauuuauuaaauagaaugagacauguugggacuggaaucuuagacuuaacauaaaauuuauuuuuauuuuacauauauacauauccugaagugagguggguuuuuuuuacaauauuuuugaauaauuuuuuuuuacugauuuuuuuuucucauggaguacaguuuuccacuuguggcagcaugccauguuuuagauuuucagacuaggagugugcacaguggacuugaaaaguagugugugguuauuuacucaaguacuaauaggaaguacugcacauuuaacaaaugguaaaauagcuauuggaaguguucuuguaacucucauguuaugaaaacaaaaucaugguuuuauuaauuauagucugaacauccuuguuauuuauauauuauugcauauuugugguguguguguguuauacucaaauguucuaagacuuaucuuccaaaauaagaaucgcuccggguaagcaaguggugcaugcauguaucuuuuauuaaagcaguaucuuuacgaaaggaccaccuccaucuguauauagcagcuucucuuuugcugcuucagaaagccuuuaaggucaugcuucucagcugagcauaaguauaaauuucaagcuguuaugguggcucacaccuaaggucacaguacucaggagacugaggcagggagauugucacuucagggacagccugggcuaccuaaggagauuuuucucaagggguguguauagacaccacacacacacacacacacacacacacacacacacacacacacacacacacacacacacuggauuuuaacccuaauuccuccuuacaugacauguguucuucucaaugccaugcuuuugagacuaucaagaugccucacuauuguaaaagcacuggcaaggccaagcccaauggccugauuuugauccucagaacacgaguaaaggaggcaaggagaaccagcugcacagagcuguccucugagcuccucaugcaucuuuugacacugccuuuacacauaucauucacauauacacacucaauauaaagguuaaaaaaaugguuuuaagccaaacguggcaacuuuuaaaaaauggcauggauuuaaaacauaauuauguauacuuuauauacagaauauauauuaaauguuuaauguguguuauacauaauguauaauguaaugauauacauaauacuauguauaaugauacaguaauguauacuugugacauguucacauguaccuaauagcuuuaagccugccuacccccuuacucuccuugcccucccccuacucuggcuaguuccccuuccuccuuuguacuuuuuuuuuccuuauaauucagugaguuaaugauacucacaaaaccaugauggagguuugguuacuggaacaugugcaccuuuucaguggcaugucacugaagaaacauuaacugugucaguccucagaggagguguggggaccaugaacaccccuccuucccaugccuggugugugaucacagcugaugugaguuugaaguugugcuacaugcaccucucccccuccucuuccuuccacucuuccucugugagccuuaggggugacaggucuguuccaucuauggcugggcauucagcagucauugguucucagugccuuggccaguuagagucucuacggucaacacccacacugcaaaagcagcuucacucuuaaaacaagagcugagucucugugacucagggucaguccacaaacuacucaggguugucuacaguuuacagucuuacacacuuuaaauaaaaauauguccagaagguguuauaaagacccggcaugaugaccuaugcuuuuaaucucagcauuugggaggcagaagcagguggaucucugaguucaaagccagccugacugcauagugaguucuaggacagcuagggcuacauaaugagacacuguccaaacaaaaugagaaaggggcgagggaagaaguucaagccauguccuuucaguaaaguggguuuggguuugggguagaauuaauuuuuuuguaaaugacaagaucagagcuccucaguguggcuaaauguguaagauguuuaguguuauuccuugaguuucacauuuaccuguugacagcacacccuuagauacuagcagcacucacuuguccucccccaggcugacaaucggaagaggcacaaggaagagaacaacgagcaccuggaugaccugcaggcggccgagcacgccuggcagaagcacaagcagcucaacgaguccaucaucguggcccuguuccagggccaguucaaguccacagugcagugccucaccugccgcaggaggucgcgcaccuucgaggccuucauguacuugucuuugccgcuagcauccacaaguaaauguacucuacagguacaucuaagagaaaguguguuacuaaaauguuauuugugugcaucauccugacaggaaaaucggugagcuacccuccuagcccugguaggguuuuguugcuauuuuguguguuuugccagcaugucugugcaccaacugcauacaguaccuacagaagccagaagaagguaucagauucucugaaacuagaguuggugggugcagaccgccauguggguacugggacuugaacccaagugcucaguaagagcaagcgcucuuaacugcugagccaucucuccaacccauagcuagcccuugaguuuugaaugguucuugccauguagcccagacuagucgugacccagcagugcugggaggauaggcauaugucacugggugcaacuagaagcugcuugggagggcugaacccagagcguugugcaugguggacaagccuuucaccacauagccaaacugaaaugcuuguguuuuagagacguuuugaaagcuaacuuaggaaguuguauuugaugguagcgcagauguauuuuuucuaugcacugacuugggaucagacauguugauuuccacacaacagcaguguaacuaauagaauagcuuauguugauaccuucaguuuuuacuucuuccaggaaguccaccguaauccaccagacucaggacagagaucuugugugugcuguccugagcuucugcauaccuaccccauuccucaccgcaccuugcaacacacuguuugugucccuucuuacagcagacacuuacccaccuuauugaggugccccaauaagugcugcagcauuccuacagaagagggccucuuuaaggcacuccaucaggaagugaaucgcugaguauuugugcuuuuuuuuccccaccaggacugccuuagauuauuuuccaaagaagaaaagcuuacagauaacaacagauuuuacugcagccauugccgagcucggcgggauucucuaaagaaaauagaaaucuggaaauuaccuccugugcuguuagugcaccugaaacgguaaggucucucugccugugcaguagcauuugauggaggaauugccauggcuacauaaucugcacauacugucucuuaaaggaaaccuaaggaauguucuccagcaaauaaguaaggcagacaugacaguggaauaacuauacuguuacuuuaugugcauucuaugcgauucuguuuccuuacacaauaaauggaacaaaaaauucauggaaauaaugguauuucagaaacaaaaguuuaaaugacaucaaguggaaaauguuacaguguaauucuaacacaaaugaguagauacaaaauuaacauucaguugcuggagagagauucagugguuaagagaacugacucuugcagaggacccagguucuauuccuaguacccacauggcaggucacaacugccucugauuccauuuccggcaggaucuaguguccuccucugucaucugugaccagcaggcauacacguggagcacagauacgugugcacauaaaugauacaguuguuuuuuaacuaacacucaaauuauaaauauagcaaaauuaauuuaauuauuguaacauggugggcacacaccuauaauuucaagcucuugaaaaauggaagcagaaugaccaagaauuuaaggccagccugggcucaugagaccuggugucaagaaaguuaaaauguaaagucaugcuuuuuaaaaaaauaugaguucagagcauugugccuuagcucaugugugacagucagaggacagcucuuagaagucagcuuucuccugccaccuucucagaucuagaaauugaccuuaggucauuggggcugcacacagcuguuugagcaugcugagccaccucccuagcccaaaguacacuuuuuaaguggggaaaaaagccacaguuuuaaaagucuaacuuuaagauaagaauauuugaauguugccugugcuaaggugcaagcauugucuccaaaaucugucuuaguuagaguuucuauugcugugagcagacaccaugaccauggugacucuuauaaaggacgauauuuaauugcaguuggcuuacagguucagagguucacuccauuuuccucauggcgagaagccccaaguggauggacagggucccagccagcagacaacauggcagugagagcuacagcaugucucuguuccucgggaaauccauuugggaaguuagaugucacagauagguucuugcccguguaccacaggccagcucugacccugucuuccuuagacucccuuuuugcuaaccuuacacaccaccacacccagccugaauuagcuuuaaaaaacaaaacaaaagaaaaacccuaaaguuucaucuuuguugugaacucuauuuuuguuuuugguuacuagagauucauagccaauuguuuauuuaaguuuaacauugacuguucaguuuucuguuuugacaaguuugucggcuucacuuugagcauuguaauauaaauggcaauauagacguuuuaaagcauagaauuguucuguuagaaguuguaguuaguaucaaacguuauuccuggaagcucuaaggcagcuguauagugacugaguuguugagaagcaggucaucauugaaguauuuugguauauaugaugcccuggguuugacccuugacacuguaaauaauaauugagggguuggauuuugguguguugcucuguguaaccuacaucuccuucuuuguaaaauaaaaaugaaacaugucuucccuacuaaaacaggccuuauuaaaauaguuuuguuauguguguugcugugagugcaggcagagagucauaccacacauguggagggcagccuugcagagucacuucuuccacucuuagguggguuugcacaucaagggcuuugcccucugagcaucuugcuggcccucagaucugaagugaaccuuaagagcuuccuaauguccaugcuaaauagugaaaucucauuuuugucuuucucugucaaccuaauuccugugauguuugccuuacagauuuuccuaugacggcagguggaagcagaagcugcaaacauccguggauuucccauuggaaaaucuugaccugucacaguacguuauugguccaaaaaacagcuugaagaaauauaacuuguuuucuguuucaguaaguaucauguugaacugaagauguuuuuaaagcaaacuaauaaaauaggaggcuccagcauuuccuuaccccauaggagagugagaauaaccaaaacuggaaauaacugacacaauuuuuuugugcuaaggaauaauugaguuuguuuugucuugcuuggugcagaaccacuacggcgggcuagacggaggccacuacacagccuacuguaagaacgcggcaaggcagcgcugguuuaaguuugaugaccaugaaguuucugauaucucugugucuucugugaggucaucagcagcuuauauccucuuuuauacuucccugggaccacgcauaacugauguagccacauagagaggaguaggcugucggcuuauugacgucuccaaauugcagccucacaucuaaugcuuacaaagauaauggaucgcugcagcugcuauguagagggauuccagaacacuggggcugugcuacuagcaccauauaauucaggccagugcuguuuaucaaaagaaagaaagaaagaaaacagccugacauuuaacaacuaucauaguacgcauuccuuacaggagucauuuauuucaaaacaacuuuuugagucugccccaaaguuaaaauaauucauuagucagacauuuauuauucucuugguaccaaaccaucauaaccuccauuuuccuauucacugcuccagccucuucucauuucuagccccagcucagugcacucugaaugcucuagaaugaccuagcucagauaggaauguauauguacauauuuauugcacuguugcacaucagacugcuggacacaguuuaacauagccuucugugaaagccuagaaaggauuuuuucuuuuucuuuuggccucuucuagguagcugcaaugcuuucuuaaggaaaugacagggcaaaacuauuuuucuguuggcuuccggcuguauuugugcacuaaaucuuuauucuaaacaaauggaaacuuuaauuuuuuaaaaauaauucauuuacaucuacauuaaaaucuuaaugaagaaaaaaaucauuugaaaccuuguacauguuuugucuucuuuuuuucuuaaguguuuugagacagucucacuguguguccucuccugguuguccuggagcucacagauccgccugccucuugcuuuguguguuuuacacacacuauucccuacacucacucuggauuuaguuucuuauucugcaaauuaggacuugauuccacucucuccucgugugguauucagaucucaagagcuggaagucaguuacguaaucccagaugccugucagaauucuguagaagaaucaaggaagaguccugaguggcuguguuuguaacaugcacacugcacuacggagccugcuggucuuucuagagcagagacguaagggagcccuacccuuccguaaggacagcaacggggacugcacagugggucuuagaggggcugcuggguuuguugguuuguuuguuuggaggcuuccauacugugcuguuuagaucauuuucaaucuguccuuuucauuccucucauguuccccagcucucucuaauccaugaccucuuacguugcacgcaugcgcgcgcgcacgcgcgcacacacacacacacacacagagagagagagagagagagagagagagagagagagagagagagagagagagagagagauacaaacccaaccugcugaguccauuuacuguuaccuauaugguuuuggagcuaaccacuugagauuggauuuaguguuagugucaggguucuccucccuggagaaggcugaucccccucucucaguagccauuaguugcuuguagcucuucauugggggguggcaccuccccagcuguggguaguugacuagauuuacagucuguuuaguagguguggauucccuccuuuugaaugguuuaaauccauuuagacagcuguugguuguccccaagauauaagugcugcccuugcaccuuuugggcuaucuucaugcuguucagcgugguucauacguguugcagcugacagcacuguuggcugcuuccucccugggcgcuugcacaguaccuugggaugccaugagaacguccucaagugcaggcuuucaggucacuuccagcuugauuccuucaaagccugugucuaaaguaugcuguccucagcaccggggccucaaccuuccagugcugcaaggcagccaagggcagugcaauagcucauacuguugugggagccucuucuaaacaaggacucuuaggaagugguuauuuagcuuacuaggggaagguuagagcuuggguuucgacucauaaacuuaauaacuugaaaggacagucucccuaaauuacugugaaaucuuuguuuuguuuauuuguuucuuugggauucuuuucuuuuguuuuuguuuucugagauaggguucuugguguagccuuggcuguccuggaacucaaagaaauccaccugcuucugccucugccuccugagugcugagacuaauggcaugcacccccacagccuggcuacauguuuuguuuuuaagacuuauuuuuacaugucuugguauucuaccugugugucuauguguaccaugugggugcugagaacugaacccugguccucugcuagcagcaagggaccauaaccucugagucaucucuuccagcccaccaggucacauacuuaacacucagagccauuugcaccugauuuuuuuucuugugcuagcaucaagacucaggaccuggugcaugcagaagaaacacucugccacugagguuucuguucuguuuuguuuauucacauguguaaacaaaaaugauuuguguugggcuggagagaugguucacuggguaaaaaugucucccacuaaugcugaggaccugagucccccaggacccacaugguggaaaggagaauuaauuccacaaguuauccucugacuuccacaugcacauagauacaaaguaaguauaaaauuugggggaaauaacuucauauauaugaaauacauuguaacagaaacccauucauugcagggggcauugaccuuugaagccugcaguucuuaggccccugauggcacugcauggccuccaugcugccuucugugcugcagacuuguuuuauagaggcugucugugagacguaaguaggugguaaggauuuaauaacaaagcauauucacggccacuuucggauagcuugcuugcaguggucaggaguacuguccuggcucuugcguuucugugcugguauagaaaaaggcuggcagcuauagaacagaagauaggcuguagcuguuugaacagaaguaucugggaucucacugacucgggugucaucaaagcuguaccaggccugaguuaccgaguucuugcagaaagcaguguagugaccaccauccagaucuccaaagugguucuagggaagaaaggcaugguuuccacaugugaaugcucugacugaugggauaaaaaugacaaggccaaagaccauuuuaaagggucuuauacugaggagaucauuuucucaagucuuacauacugucuaacuuggaacugcuuauacauuguauucauugacuuuaauagaauuagauaggaaaucagacuaacuggaguucuaaguugugacccuccaugugugguugugccucagugucucagggcugcagcaguaaaacugaagagcuggcacaaaaaccucugaccuccaaggccuagaauauuuccuagcuaguuuuuacaaagucugcugaccccucauacaaaagaaagagaauaacaugaagugcuaaccuuaagaacccuccccuuugacaagccccacucugcaucuguugacagcaggaagcagcagcugcagcucacgccuguaacccuaggccuuggaaagguugaggcaagaggacugccacgaguucaaagcuuagacccugucucaaaaagaaaacauccaccuuuuuuuuuguuuuguuuuguuuuuuguuuuuagagacaggguuucuuucucuguguagaccaggcugaccuugaacucagaaauccuucugucucccaagugcagggauuaaaggugugugccaccacugcccagccagcuuuuuuauuuaguacguguauuucccaaguguacguauguacaccaugcgugugcuggugcauguggaggccagacaagaguuuguaguucccuggaacuggagcuacugaugguugugagccaucaugugggugcugggaaccaaacccagguccuccuccaagaacaagaagugcucuuaagcaccgagcagccaucucccuagcccccuuucagccuuuaucagauuucuuaugcaccacagcacaagggaugcccacuaacauuuccucaguuuccaucaugucucuuugccuaucauggaucaaaauggaggaagaggauuaaagaggagaaugagguaggugggaacuagagcacuggaacugcaaggucacacaagcucuagagaacagggcuucgguuucagaaaauaugcuagauugaggucugcauaccucaguggaaagacaggcuaaggcucuugccagcaagccugauaaccugaguuguguaucugggacccacauuggggaggagaacugauuccugcagguuguucucugaguuccauauguucccugucaugugugcuuacauacauacauacauacauacauacauacauacgcauaauaaccucuaaaauguaaaaccuuuagcacuaggcaugguggcugaaaucccaccauagaagguugaggcagaagauugugaaguggaggccagacugagcuagaaaaaaagaacugggugaaaaagaaaaaaacaaaacaaaaaacuagggacaaagcaaaugaaaaauguucagugugauagguaauaaaggaacuucuacucaaaaccacaaggaauccagguaugguggcacaugacaguacucuggauaugguucaagaccugccugggcuauaagagacucuguuuauaaauaaaucaguaaauaaauuaauaaauaaaauuuucauuuuuagucauauuuuuuaagagcuggauaauaacaaguguagagaucgagugagcugggaccucauacacuggugaaacaaaacacuggucaccgucacguuggaaaucaaguugacaagucuucaaggguuaaguauacaguuaccaugugucuaagcaauucacuaguagguaacuacccaagaaaaaugaaacuuauguccccacagaccccugugcaccacugauggcagucauagagccaucccaaguaccucucagugacugaaauguguuguuuccauaguagaauguuacugacaacaaaaaaaugaugcuccaacauagggcaaccuuuaaaagcagaaggauucaaggccagccugcucuuucucucucucucucucucucucucucucucucucucucucucucucucucucucucucucucucauauauauggagagagagagagaguuccaggcuaaccagggcuacauaguacucaaaacgcaagauaagugguuuuaugauuccauuuuugugaccugccuaaaaaugacaagcccauagaaacaggaagucuguucguaguugccugggucugguggaaagaagaaaugagaaggaaagauucuuuuaagaacacugaagauguucuaagauguuaacugugaugaucuugaacaacuauguaaauauacaccaaaacccacagagccauacacacccaagugaacauugcacacacuuaagucugaaagacaaaaaugacuguauacaaccagccaaagacugaauggaggcaauuguugagcacacacauuaguaugcuuuggaacagugccacccagauugacauauguaggccuugucuccaaagugaggugguagaaucuuuagagauggggacuugagagagguccuuaggucaaugggcaugugucccugucucaggaugugaguccuugcauguuagguaaauaaguaaauggcuguaaggcauuaagacuugguuuuccccagauacuaaacuugaaccuaggcauguacacaugcccaacaaacaguguaucucugaguggcacagccccagaccuguauugcaauaagaaaacacaggcaaaagacuugacuuguuuucacacacaaaccagaccacaguagggcacgauaguauacacgccugaaaugccagcacccaggaagcaaguucaaggccaugccauuguggaagaucaaggacaaaccaguucaagugcuaucccacuauggaggcagcuagaacggcccagugggaggcuguggaguagaguagggacuuaggcaagcacagcuccucuugcugcugcugagaaggaacuggaacaucugcuuuggaaagccuguguuuacugugugcaugcccgcccgccaguacccccaacuccagaaagagucuccaaaaggcuguguucauggcaaacaucugagaaccaaaaggcuguguccaucuugcuaauauccgagaacuaccacagcagugcucuuaacgguucaaagcacucaaguacaacgcgugagcagguaauggggucuucacacagugaaagccaacccaguggagaacgaagcaucauauguguagcaauguggauaacaguuucagaauuuugagcaaaaggagcggauccgggcuggugagauggcucaguggguaagagcacccgacugcucuuccgaagguccagaguucaaaucccagcaaccacaugguggcucacaaccauccguaacaagaucugacucccucuucuggugugucugaagacagcuacaguguacuuacauauaauaauaaauaaaucuuaaaaaaaaaaaggagcggauccuaaugaucuggcaccuacugcaggacucauuagcauaaaacaaaaucagaguuaucccauuagaagucugguuucugcacuugaagaggaauuuuuggauaguuacacacugauaaaauugucugcacccuguucuuacugcguggaugugcucacuagacaacuugccaaauuguauacucagauguuauguguucuccuguuuuuacuucaaaaacuguuuguuugguuuuuuguuguuuuugguuuguuuuuguuuugagacagggucugauguagcccaggcuagccucaagcuuacccaggugaagauaaccgugaccugguccugccucugccugagcgcuuacauuauaggcauguacaaccaguggcaguuuauggugcuggagauggaagccaaggcaucguggauccugggcaagcuacaaccucuaucaccaauuucuuauuuauuuaaaaacaaagugguggcgcacaccuuuugucccagcacuugggaggcagaggcaggcgaaucucuugaguucgaggcuagccuggucuacaaagugaguuccaggacagccagggcuacacagaguaacccuguugucccaaaacacuacaaggcuuucuacaaggugauuuaaccaaagcaccaguacuccccggcaccuccacaaagaaccaagcagcaaauguagagcuucgaaguuacugagaacauuggaguacaguggaguaaacaugacacccgcucccacuccugcaguuccacggcagugagaaaccuacuguagacugagggugacacugcccacuccauaaacaguguagaagacagcugucacccgccacccgccaugguaaugaagaggcuucguucugcagugacaggcucacagcugaacuacauaaugagccugacugacauuucccaaguaaugcucuggggugcuguagccaggagccaucuggauaagggaccuguugucugaaugcagugugcuagagaaaccucaccgugacucgguagagagcuguaucacuaaccaaacagcccagcugacuggcucccacucagccuuauugacugccgaauacagaaguugugacacggaggggaauagagaacacccucaaguccugggggaagaggagccuucccucagaggccaggcacgcggggacucagaagagucacacauugccaccccucccccacauggcugcaugggagcacuugccacacccccagaugcagaggcagcaucacccuccuuccagcagggcagccucaagcuuaggaccagaagaugcuauugaaucuuacuuagaaauaccaaaucauucugugaggguuucugaguaguggacucucaucagaugucacacacugauaccagcuuuuuaaaaaaaaaugugacuuaguaacuaaaaaugagccguggaagcugaaaacuacacaacuucagaucuagacugaggagagggaugaaugcuugcuucugaugacagaagcccagagccaagggacgcuuucuccagacagcaccuaggcaugucagcaagaagggugggguuaagcgcaccucagccucuggcaauuccagcagacuggggcugggaugugcuuuuguuagcugugaaauggagagugcuggugagucugaagcagucuguguuugugaauccugugugugagguguucugauuguugcauagaguaagggcagaucugcagaaucagaagagagcuguaugguccuguuuaucagucaguaccaaaugauuaaagaugaauggggauguaugaucaguagaacagaauggaagagccaagugugaauccguguaacuacagcugccugauuugugucugagauugcuaaguuuuuacuguaugaguguguguuacccccuuguuagucuguaccaaguauauggucaagagggaguuggaucccucuagaccuggaguaacuaaugguuguaaaacugccaccuaagugcugggcaucaaccaugggucccuccagagcaacagcaagcuccucugagcaaucaaagaugccaacagaguggagggaaaaaccacugugcaagaaaauauuggcaaaccaucucucucuuauucauauauauauagaauauauauauauauauauacaugaaaacucaagagcaagaaacaccaguucaguuggggcuggagagauggcucagugguugagagcaauagcugcucuuccaaagguccugaguugaauucccagaaaccacaugguggcucacaaccauccguaaugcuaucugaugcccucuucuggugugucugaggacagcgacaguguacuuacauaaauaaguguuuaaaaagaaaaaaaccccaacugaaaaagcaaguaaaggaccuaaguagguauuucucaaaggacaaaaugugaugguuccagagagauucaaacagugccuggcacacagugugacuagguaagaauaaaauaaaucagcggccucggggauaaagccauuagcugaggggcugaaagagcucugcaguuaagaucaugugcgugcucugacaaaagggccauguuugguucccagcucccagccaucccuaacuccaucucuaagggauuuagugcccccuccuggccucuguggguacuguauacauagggugcacacagagaguccacaaagagucacacagacacacauacuuaauaaaaaucuuaggggaaaaaagccuugugaaggaccacauucagccaggugugguggcaugugccuguuaucucagcauuugagggguaaaggcaagucaccaggaguuucuugacaaagaaaauucaaaaacagcuggguuaaaugagaccuugucacaaaaaagcuuccagaaugacacuauaaacacaguugguaaaauguucaauaucacugggcagugguggcacaugucuuuaauuccagcacuuaggaggcagaggcaggugguucucugugaguuugaggccagccuggucuacagaaagacagucaacgcuacaaagaaaaacccugucucaaagagcaaauaaauaaaaauguucaauacuguaaguguagcaauaccuuaaguguagcaauuaaaaagcaaguaagaggcuggagagauggcucaguggguaagagcacugacugcucuuccaaagguccugaguucaauucccagcaaccacaugguggcgcacaggcaucuccaauggaaucugacucucucuuccggugugucugaagacaacuacaguguacucauguauauagaauaaauaagucuuuuuuaaaaaguaaaugaaagaaaaugaaugaagugcauucucuuucgaggcucacacacacuagagggcugguccccucuagucuagaugaguuauuccagcaaucaguguguacaugucacccagcagcugaagugugcgcuauaggucagaggucuggaaugggaccaggaguccuccguuucuaacaggucuggaugcucuggcuuucuugugcuccauggugaauguagcuggguucuagucaccuuuuuacuagcaccaugcacuagaauuugaaagaugcauaguucuuaccccuggacucaucauugaugugccacaaguucuaaaugucuguuucuuucagagcuaacuuucagugccucaacugacugauaacuuagaucuauaaauaauaggauuuuuuuuagauacuuagagugauucuugcauaagugugcaucuuucauaacacacaguuauagucuaaauauaagcuccauuuucucuguuaagauauuuuucuaagucagaaaccgauauaaugagaaguuaacuaagaucucaggaagcaacaccuuuggaacucccauuaauuacaucgacuucugaugguagaagcccggaaagccccagaguaugaagaacaguggugugaacggagucugaagagcaggaaaggcaaaugauguaaaggagacggccuacaggggagagacgggagggcugugaaagcacaagggugcugcugugccagggagugcgaaagaccaaugacugacagaucccucuucaacauuuuugaaacagggucucacuauguagcucuucuuguccuggaauaaacuauguaggugaggcaguccuggaacucagagaucuuucugccugccccugacucccaaaugcuaguggugcgcaccaccacaccugacuccuuuucuuaauauaucauugagcaguaagaugaacgggcagaugaaugccaaaggauccaugacaggguuacacucuagaagcaccccccccccccgcccucagacacaaaaguucauacaugaucccaaagcccagagaauggcugcugcucggguggcuccugugggaggcucugcagagugcaucugaauuguagcacaucguuugcuaggauucaguaugagucacagcugacuuaaagccaaaggagccccagggugcuccagggcaggcauggagucucggaacuguuaguaccuagugugggggugcuggcuacaaaggguucguucugucaggagacacgcaauuaccacggaccugaccucuggccgugcacguggccaagaugcuaggccuccaggcagagauagggccagacaacggguguucucuccuuucaauaugaaagcauuagcaucgaacucaccaccacugcgcacagguuguacaugggauguuuccggaaaacuggacagauauaaggagugagguccagguuggucaggggguaauggaugucuguccgcagcuuccucuuuacugugcccuggaugucaaaccuggggaggugacaaaagcaggaaacccgcaggaugucuguaagccucgagcgagggagguccacacgccugaacacauucccuggacaguuaaggcuaacuucugaaaagaucaucugguauugaaaucacuuccucaccuaaauauauuuacaaaugccagacccaucagccucagcaaaguaugucagcgagagagagcacagaccucagcaaaccauagcuaauguggagagagcaaagcaagccugccuggggagacagcgcagcagaggccgcugagggccaagucaaaucaccuucacuucuuucucuccacacaacccccucccuggccucuccuccccucucccccaccccugccccggagucccuuucuaucuccucucuccuccacccuaccucucccuuccccucaccuuucucucucuccuuuccauccccucuucccccucucuccauucuguccucuccucccucccucucuccccccucucuaccuccacucuccuuucccuccccccaccccucucuucccagugucucauuaugugguguuggcuggccuggagcucucucuguagaccagguuggccucagacucagagauccacugccucugccuccugagugcugggacuagaggcgugcaucaccacaccuggccccugucuugauguuggcacuguuaucauccugguuuuucaaaguggagaucuacaucuaaagauagaguuguaauaugaaauucuugucugaaucuuuaaucucucugguuauauagaucagaggucagcagaucuagaaucuuaucagaaucauucagaacuuuuuagaaaaucauguucauggggcuggagagaugguucagcagacaagaguacagacugcucuuucagaagacccggguucaaucccaagacccacauggcaauucacagcugucugaaacucuaagaucuuacacccucacacagacguacaggcaggcaaaauaccaaugcacauaaaauaaaaacaaauuauuuuuuuaaaaaaaaucauguucacucagaaaaugugcugguuucgaucugaggcaggaaaguuaccagauaagcugggucacuguuggguuauaaagaagcaaacccuguaccccaaaacuuaaggggaugcccuguguggugguuuacaugaaaauggccuccacaggcucacagggaauggcacuguuaggaggagucucugggcucaagcccgagccccugccaugguauguaggguuggucugguacugcuauauauccagacacuaaauacuggccccuaaggucuggcugcuccuugacaaggcaauccucauguauaccaaaugaugcuauguaacuuuguuccccaaguuaauuggucuauauuaggccugugauuagacaguaggcagguuuuucaguuaccuggcuggaagaugcagggaggggaaaagggagaauaaaggacacagaagagaggaggaagccaccaagagaggaaauggaccaugagcacguggccgggagaggagacgggccacgagcgcguggcugggagaaacagguagcaagggacacauggcuggggucuaaguuagaauagcucccgaaccugcccagucuaggcucacagcuuguaaacaaaauaccuggacagugugucuguuauacacugugugucuguuauaugggccagcaagaaugauugauuccuuuuacagugauacguagaagugacugaggaagacaccagauaucaaacuuuggccacauacaugcgcacacacugcccccacacauaggcauucacguauuuuucuuuagguaagucccgggggcucauggcaaagggagagaacaugguaaagaaccaucggagagcuuucugacagguguuguugacacaggcguugcagugaauaugauugcauccauuuguacaaguucauagacaaaagaauacauuuuauacguguaaauauaucuuuuuaagagauuuguuuauuuuaaaguuuuuaaaaaaauauuuacguauuuauuuguguauuuauuuauuuaauguaugugaguacacuguugcuaucuucagacacaccagaagagggcauccaauccauuacagauggcugugagccaccaugugguugcugagaauugaacucaagaccuccaggagaacagucaguguucuuaaccacugagccaucucuccagccccuauuuuaccguuuuauggacauaaguguuuugcucuccuauauguguguaccaugugacugccuauugcuugcagaggccagaagagggcuuuggguccccuggaacuacaguuacagauaugguugugaguugccauggaaccgaacccuggcccuguacaagagcaggaagugcuccagcuauggugguuugaacaggaauggcccccauagacuuguguguuugaauacuuggccauaggaagugacacuauaaggagguguggccuuguuggaggaagugcgucacggugcgggugagcuuugaggucucagaugcucaagcuaggccuggcuuagcauucacuucugcuucuguggaccaagaugcagaacucucugcucccucucugccugcgucuugccguauuuccugccaugaugauaaugaacuaaaucucugaaacuguaagccuaccccaauuaaauguuuuucuuuauaaacaguaauagaaaccccaagauacuagccauuauauaaacauaucuuaauauuaauaagugaaaagcuaaaacuaaugaauguaaucauggaaccuggauugaaaggauugugugcuugguggcgcgcgccuuuaaucccagcacuugggaggcagaggcaggcaaauuucugaguucaaggccacccuggucuacagauugaguucuaggacagccaggccuacacacuacacaaagaaacccugucucagaaaaccaaaaaaaaaaaaaaaaaaaaaaaagaagaagaagaagaaaagaaaagaaaggauuguaugccaaaguacacaugucgaagaaugaugcucacucgcuuguuccucauggcuugcucagccugcuuucucauggaauccaggaccacccagucauugauuaaggaaaugcccauagucaggcagugguggcucaugccuuuaauuccagcacuugggaggcagaggcagguggauuucugaguucgaggccagccuggucuacagagugaguuccaggacagccagggcuacacagggaaacccugucuugaaaaaccaaaaagaaagaaagaaagaaagaaagaaggaaagaaggagagagagagagagggagagggagggagggagggagggagggagggagggagggagggagggaggaagggagggaagaaagaaagaaggaaaggaagaaagaaagaaggaaagggagaaagaaaaggaaaugccccacagccuugcuuacagccugaccuuauggagacauuuucucaauugagguucccccacccuucagaugacucuagcuugcgucaaguugccauaaaacuaaggcacaauugaucccuugcaaacuuacaaucucaucaacuuuauauuaaacauggccuuuccuuuccuguuguucccagcauccauauuauaauauaaaacauacuacagacuucucaccaagaccccuucaaucuuugggcuucaguuguuacccuucaucaguggccucuccuggccucucaacaaugcugagccucagcugcucucugugacccauucaugccuucaaaacccagaacuaccuggacaucaccuaguucaucugccagcacaagguacagccuuggcuaccuaugaaacacugcuccugugugcuaacuuugugggaaggucucucagauuucaccccggugacacuggucuccuuuuaaucauuauuaaugguaggcauaauguguuauacgguguguaaaguuuacccuuggguuauucgaaugcugguuucucugcccucacaucuucuuucaaucuggacucggcacuguaauguucauaccaauaaucuccugucucgaguuuauguaaacaauucuugccauuuauucucugccuugucaauaaaugcugaucacugaauagcuggguggaagagagaauaggcuggggcauccgccagcagagagaggaaagagggagggaggagccgcucagugaggaggauggagccaugaagacgggguccgaagagccagaucaauaaugauaugcaaguaucgugggacggggcugggaaguagccaggguagcauagaaguuaagguacaccaucuaacugcucagauauugaggugcaguuucaaguaaauuuuggauccuuuauauacuuacugggggaauggcauaaaguaaagagauauagccacugaguuaagucauccuuuauauuuauaguaaggauaauucauguacaauuaauuucuugcuuccagacagccaucaacuauugucccgggaagcacagggcucacuccagugccgcugacucuuacuaaccagcgcugauucuucagucccggccgaccgggacuacggaggcuuaauucaaaauagcagcuauacaaaacagccccgauagucuauaauaacucucaaaugucccuuuggaacuucacaagccaggccuccgugggcuccauugcucuccgcacucuuaucuuccucaugcccgcugagcucucaacucucguugguuucucuagcccaaaguuccaaaguccuuuucccagucuuuccccaacacaacauaaucaagacugucacagcaguacuccacuauccugguaccaagcaagagguuccuauugcugugaugaaacaucagcaaagcagcucugggaggaaaggguucacccuucugugucaccauucaucaucaaaggaagucaggcaggaacacaaucaaaugggaggaaccuggaggcaggggcugaugcagaggucauggagggcugcugcuuaccggcuccuuccgccugccuucuaauggaaccccagaccaucaucacaaagguggcaccacccacagugcacuggguccuccuccaucauuaagaaaaauguucuauaggcuggccuguagacuaaucuuaugcaggcaacuucugaauugagguucccuucuuuaagaugacucuagcugugugaagcugacauaaaaguagccugacacagccacucuagagcaagaacagguaaaucaacagaggcagaaacgacauuagggaaggaggaaggaggaacacgggagggagaggaacaaggugaaggagguguugcuuaauggggacaggguuucugucuggggcauuaaaauguucugggaauuguggugacuggcuuuaacauuguaaauguaauuaauacaaaugacuacacccuugaaaugaucagaauaauagauuuuauguugcauauuuuuuauuacaaaauuuaaaagaaauuagauauuaaaucaaaauccaauccauugaacccgcuuggaauccuucucucuugacacugaggacuaaacccaggcggccuugcagcuaagcacccacuuugcugcugauuuuaggacaagcuacauauuaaauggauaaacuauuaucaugugaaucauaucucaauaaaacuguugaaaaccaucugcccacaagauuucaaaacccacauaccuuuuaaagugaaaaacaauuauuuucggcaccuuggaaaucgugguccucacagcugccucuugcuugauuucacaaaaggaacaauagauuugguugcuccaggucaguguguccuguuggaaaaaacacuggagacaguccuguugggggagaaagaacacuugcuggcccgggauccucacugacaauagaagaaaaagcagaacucugugguguuugcauguuggguggaggcaggagaaugguugguuugagaccagccuguguaauucaaagagacccgucuuuuauacacacaaccaaaccaaagaaguuuggaggagcugugcaaaugugcaucugggaauuuuucuaaggaacaaacccaggaacuacacucuaccaacccccauggcccgagucccauaaaaucugcuuagcaacuguuuucguuuguugagccaggacugguggguggcucacaccuuuaacccagaggcaggaggagcucuucuaguccaaggcuagguuggucugcauaccuaguuccagggcugccagggcuacauagugagaccccggguaaagaauaaguaaaaaucuaccuagcaacaagagaugcuuuuucacuggacuguuaggauaggcuuagauucuuuucccacucuauugcguuaccuuuucugguuuauuucugguuuaccuuuucaaacacagacuuugaaauuucuaccaacaaaucagacagcucuuuuauaauuauguauccccugacucagcucaacagggggugggccugaaaaaugaccauaucucaugguuuugggugacacuuuucagaugaauuugaguccacacccaggaaaaugacgucuacagccagguccugcuucugcaagaucuuggcuuagaggagaacaaacagacuguuuccacuagaccugccagugccucaguccagaacuugucauucuuccuagugaacuucauuuagccuuuugaucaaguggaaaacaaaauuaacacauaacaggcuucuguuguuccccagcuguauacacaaaaacucaucaacagaugugcuuuuacagucucaaaagaacaagacagguuugugcaauugugcaaggaaaauguuuccugauucccaaagguuccuaaccaagcucucuccucccacacccaccccucacuuacagagcacucugagcacuguggucaagacgaucagagaggaaaacuacgcugcagacccccucucuccacacaguacacagcuucuauccagaccgcauggcacugcaauuccagggaaucugacgcccuuuacuggcccucucgggcacugagcacgcacauaguacacacauaugcaugcaggcaaacaagcauacacuguguaauaaaaauaaaucuuuuagccggguguugugucgcacgccuuuaaucccagcacuugggaggcagaggcagguggauuucugaguucgaggccagccuggucuacaaagugaauuccaggacagccagggcuacacagagaaacccugucucgaaaaaaaaaaaaaaaaccaaaaaaaaaaaucuuuuuuaaaauuuuuauuuauuaauuauacauaaauacauuguguagcugucuucagacggaccaggcgucagaucuuguuaaugguggcucuaagccaccaugugguugcuaggauuugaacucaggaccuuuggaagagcagucuuacccgcugagccaucucaccagcccaaaauaaaucuuuuuaaaaagaaucuauuaugacuaguucuagcuuuaaacuauagaguguggguagggagccaugauaucauuguaagaaaucacaaacugcucaucucaagagacugaauaaaccucaccuauauuuaaaguuuuaaguggggcuuugccuugaguacauuuagaaauaaaauuaaauccacaguaacuauaacaggcugcuuuuuaaaaaugcuguucauucauggaccaccuuuauuuauggcuuugaggcauaaugcagcccuuuccuacuuaaaauuguaggaaauaacagccgacacuguaauccucaguaucugagagacucaggcaggauuacaacaagaaccaccacuaccacgcaccccuccccccacaucucaaaaacaagaaaauauauucaggagcugggggcucccuaccuggagggaacauucauagucagaugggauggggagggagaggauggugaaaacuucguucuugugcgugcagcucucacacuuuaaacaugugaugcuguaacugagcuguccuucaaacagccgggugaugauggaggucuccugggccggcaccuuccugcagcagcuuuggccuguucuuuucucauucacucuucuucggcagugcugugaaaaaggacaaauuccacauaaaaaccacggaagccgggcgugguggcgcaggccuuuaaucccagcacuugggaggcagaggcaggcagauuucugaguucgaggccagccuggucuacaaagugaguuccaggacagccagggcuauacagagaaacccugucucgaaaaaacaaaaacaaacaaacaaacaaaaaaccacggaaaacagaauggcggcuuucucuauucaagugauacguggaugagaaaacaguuuggauucagagggaacauuaagacauugacagcauaagccaugagugacaucuggugaugcagcuauuucccuuucaggauggcucugaagaaugaccauaauuguccuggcaggagaucagauacuucacggggagacauuugugcccucccguuagcuaucagaagacuaaaaacaaugguccucaagagauuggaauugcugcucucguggcugaaugaagcuuggugugggugauggaagagcccaggagauuaaacacaacugcaacaacuugucagacuaucuugcaagagagauggguaccaauacagugaugguucaggaaugcgcagcacuggcuuugaacagacucuuaguuauuuacgcugcuagccaccuauuugaaucuaaaccucaugucaguacccaaacuugacuugaggacgacugaaccaacuucuuuauggguucuucccgguguaggcaagccggacagaucuccugugucuccccagugcgacugccucucacuguccuagagaggaaggcagggggcuggaacuagcuuguuaaggcuuuuagggcucaggcuuugacccuuagaaagcauugguaacaguuuggcaagcuaggcaggcauuggaagcagguuggccuugaacugcuuuccugagaggacuuugaucucaagcuucauccagcccgagcugcuuuguauuugugaaaaagaagcaguguuuagacacuugguuuuaaacucaggugaauuccuccugggcaguuggaccugggcuuuuuugccuuccuguuggcuuggaggaaugguuuugucuuguuuugagcuguuugauuuuguugaaccaguugggcuaugauccucugaaugucugagcacaucuggaguaauuuugggcucuucagcacaggaaugugagaauuucagaugucuauaauaucugcacauggagcagggcugaggcaggaagauuccgagucauagaccugacugggcuccacaguaaaacuuaguuucagaaaaaaauaaaaguaaauaaaaaaaauaauuuuaggaacuggacagaggguucagugguuaagagcuuuggcugcacuggacaguagcggcgcaugucuuuaaucccagaccucaggaagggaaucucugaguuggaggccagccugguauacagagugaguucuaggacagucaggucuauacagaggaacccugucucgaaaaaacaaacaaacaaaaacaaacacuggcucuuuuccagaggaccuggguucaauucccaacacccacauggaugguggauggaaauugucugacacccucuucuggccuccauaggaaccuggcaaacaaguaguacacagacauacaugcauaaacaauaaaaauuuuuuaaaauuuuaaguaaaaaaaaaaaagcaaaacaaccacuaaauaacaaauauccuaaccuggacauuuuccucaggaccccagcaccagagcaggugcugggcaggccaugcagucugaauacacauacagccuacaucuccuagcucagacuuguuaguucuuaccuuuuucaaagcuucgugaagcucguugaggacguaaaucaggaacuccugcgcaucuugcugugucuuuuucagaaaagcuggguaaagacugccaacagccgacagaaauaucucuggugagacacagucugaguccccaagccacauaucugucaucagguaggcaaaggcggugguaaccucacugcagucccugagaagaagagcagaggcaaagggcaaauauucccugcugauuuaaugaaaagaaaagacccagucuccguggcaagggauccguccacgccccugcaccagagcccuguccaccuugcucuccgcacccuccauguguguucucuggggaccuacugugucugggcuuguggcccuucacaaggacuccagcggguccuuuccucaccucaccugggggagcugggguggggcagacucagggaagaccuccucuuacuucuuaagagcugugauguacuuuccggacaggaaguacuccaccaguggagauacgcugcagaggcauugcaagauggcguucauguagcagguguugcccagguuccgcagucccgucacgcccuggaaguguggcugggucuuagacuccggcagggagucauagucugcacacuccgcacugugugggccacauggaaggagaguguuuccaggggagagcaugagugcuagugccgcucagacccuggcaaccucugaaauaaaagugcucuuuuguggcugggaggcaaggucugauaaccuaggccuucucugaacugacaagucucuuguuucacaccucagugacugaaguuagaagucaccagccuggcaagaaggguuuuguuccuuuuguuuugugguaggcccuccccaugugucucuggcuggcucugcacuggcuacguugaccaggcugggcuugaacucacagagauucccccggccucugccuccugggugcugggauuaaagauguguaauucuagccagggggugguggcgcacgccuuuaaucccagcacucgggaggcagaggcaggcggauuucugaguucagauuucugaguucgaggccagccuggucuauaaagagaguuccaggacagccagggcucagaaaaacccugucucgaaaacccaaaacaaaacaaaaaagguguguacuucucugauuggcuaggaaggauucuuaguggguuuuucucucaaacucacucucuaccaaggacagaaggaguuuaacuuaggcccagaacucugaaugacauaaauguuugaaugucugacauaaauaaaaguuucuuccuaaaaagagaguaaagagauagaguaaaccugccguccaggucucaggguggcuuggcuaaacauccaaacucagcuguuaaaaaaccaaagccuuuccugcuuuaacaguaacaucauagacauuuuguacuuagucugacuauauuaaacauuuaauauacauuccccauuaaauauuugcaacagcucuucuggguagaaacaguccuucuaaaaucccauuuacagguggacuaaccagcuuaugugagugagucauuugcccacaguaguauaccaagggcaagcacauagugaugcaggagaaaugaaggcauuuaccuaccuuaccuggccauuaaauuauauggaauuacagcauaugcugagaaugaauauaacucuauaggugacauauggagaacauaauacaguguuggagcuguggcucaguggguaagaacacugacuauggauucaaaggaccccaguucaaaucccagcaagugcuuuauggggccguuaaaggguuguaacuuugagccuuuguagcuucuuuuggugucuggagacagcuauagugagcaugauacauacacauaguaggaacauauacauucauauguuaagggcacagguauguauauaugcauacauaugugugcauacaugcacauugcuacgcuaauaacugauuauauauauuuaugauuaggguucuuauguuugcucauuuauaacacagaaacauucagcaugagaaaguguccuuggccugugugaggcacuggcuuuggccucaagcuccugaucccccagcaaaacaaggaacacuaccucuuccuggcaggguuacugcgagggccaugcaggugccaugcaaggugcuuagcuuagaucacauaauaaaugauaucuuuuaaaagaauacaacauagccaguuauugguggugcaaaccuuugauccuagcguucaggaggcagcagcaggggggaucucugagucugaggcuaaccugguguacagaguggguucuagaacgaauagcuaaggcuacacagagaaacccuguguccaaaaaaagacaaguguauauuuauacacacacacacauauguauauauacuuauauacacauacacauguguguauauaugucuauguguguauguauauauguauauauacaucuauguaccuguauaguauguauacacguauauuuacauguauacacacauauauacauauauauguauacacacauauacagauauacgugcauacacacacacacacacacacacacacacacacagcuuggguucugaagagauggcucagcaguuaagagcauuucugcuguucuuucagaagauccuggcucacuucccagcaaccacauggcagcucacaaccauuugugucuccaguuccaagggaucuaaugcccucuucuggccuccaagagcacugcuuuggugugcuuaaauugucagcaaagcauucauauacauaaaauaaaaucuuuaaaagaauaaaugacuuaauguggagagacgggacuggagcaucugcccagcaugcagagaugggaaauacugcaggcuccaggaggccuccuugaucugcacagcucccucuuaucugaccgauucaguagggccgcucaccaccuuuguccuuuauuaccuuucuucccacagacugaaucugaaauccaggccccaccgcucagcggccucacucagugccucugcucaguuucacccaucugaaaagugugccauucucacuuuuacucagugaugucacggaggcccugagcugacugaucagggaguacauguauguuaucucuucuggguccuucaugggucaaaucuggcagagcccucccaaaugcaacaggugccaugcccccucuagguaagcccucccccagccccccacuccugagguuaucuauaaaggcacaggacauagaggcucacagguuguaguaggcaccgaagucgucugcagggaccggccgaugagacgccaugucaaugaagcacaucaggcuuucacuucuacucacgagcuaccuuugauccuuuuaacuucauuucuccaggacugcucccuggcuuguuuuugguuuugaaccguuugaaugccccccuccccccuuuguguuguugcugucugauuucacuugacucaggcccaguucuucuuggauccuccccug

SEQ ID NO: 1059 - RNA, 1688 nt, Mus musculus
uaggugguaaggauuuaauaacaaagcauauucacggccacuuucggauagcuugcuugcaguggucaggaguacuguccuggcucuugcguuucugugcugguauagaaaaaggcuggcagcuauagaacagaagauaggcuguagcuguuugaacagaaguaucugggaucucacugacucgggugucaucaaagcuguaccaggccugaguuaccgaguucuugcagaaagcaguguagugaccaccauccagaucuccaaagugguucuagggaagaaaggcaugguuuccacaugugaaugcucugacugaugggauaaaaaugacaaggccaaagaccauuuuaaagggucuuauacugaggagaucauuuucucaagucuuacauacugucuaacuuggaacugcuuauacauuguauucauugacuuuaauagaauuagauaggaaaucagacuaacuggaguucuaaguugugacccuccaugugugguugugccucagugucucagggcugcagcaguaaaacugaagagcuggcacaaaaaccucugaccuccaaggccuagaauauuuccuagcuaguuuuuacaaagucugcugaccccucauacaaaagaaagagaauaacaugaagugcuaaccuuaagaacccuccccuuugacaagccccacucugcaucuguugacagcaggaagcagcagcugcagcucacgccuguaacccuaggccuuggaaagguugaggcaagaggacugccacgaguucaaagcuuagacccugucucaaaaagaaaacauccaccuuuuuuuuuguuuuguuuuguuuuuuguuuuuagagacaggguuucuuucucuguguagaccaggcugaccuugaacucagaaauccuucugucucccaagugcagggauuaaaggugugugccaccacugcccagccagcuuuuuuauuuaguacguguauuucccaaguguacguauguacaccaugcgugugcuggugcauguggaggccagacaagaguuuguaguucccuggaacuggagcuacugaugguugugagccaucaugugggugcugggaaccaaacccagguccuccuccaagaacaagaagugcucuuaagcaccgagcagccaucucccuagcccccuuucagccuuuaucagauuucuuaugcaccacagcacaagggaugcccacuaacauuuccucaguuuccaucaugucucuuugccuaucauggaucaaaauggaggaagaggauuaaagaggagaaugagguaggugggaacuagagcacuggaacugcaaggucacacaagcucuagagaacagggcuucgguuucagaaaauaugcuagauugaggucugcauaccucaguggaaagacaggcuaaggcucuugccagcaagccugauaaccugaguuguguaucugggacccacauuggggaggagaacugauuccugcagguuguucucugaguuccauauguucccugucaugugugcuuacauacauacauacauacauacauacauacauacgcauaauaaccucuaaaauguaaaaccuuuagcacuaggcaugguggcugaaaucccaccauagaagguugaggcagaagauugugaaguggaggccagacugagcuagaaaaaaagaacuggguga

SEQ ID NO: 1060 - RNA, 30148 nt, Mus musculus
caaagaccacgccccagugacgucacgcggcgguuaccgcgcuuggcgcucgcgauuuaaaacuuacuccggagacguggagagcaagaugagaauuccgcgcucaggugagcucgaguggguccaggcgcggcuggcaggaucaggaccgaagggugcucgcgugggcagguccagaagggacgaauguguucggcgggguucggccgggggcuccggcgggggaggggaagagagugcaagggaaagcggggcgcugggccaaucaggacgcagcugccaguggcggcugggcucuaauacuccccgcgcccugguucuaacggaggauaaaguggguuuuuuuuguuuuuuguuuuuucuggacuggacguuguguggggagcuguggaagcaaagugucgaccgcucuguguugagcauucgugccuguguuuuggaacugauucuaaagucuugagggcuuccuuugggacagaccuucggucagacgccgagauucgcaaccgaagaagccugggcacuugagauggagacuggaggauuagaaguucaagguuguccucagcuauagcgacuucgaggcuagccuggauuacaggagacccacucugaaagggggcgggggguggggaacgaaacagauaaauaccuuuuccucuuggagcuugugucaaguugagguaguauggcaaauauuugacagauaaaaccuagugcuauaacuccuguccguuauggacucgagauuuuuaagcaaacauugagaagaacuuuaugggcugagcauccuguacaagagaagagcuaggaaggaaccuggacuagucuaggaauuaacuacaccguagguucucaaccuuuggguggcagcccccauggggaggugucaaaugaccuuuacacgggguucgccuaagaucgucagaaaacacagauauuuacauuaugauucauaaccacuaaauuuacaguuauaaaguagcaauggaaaauaauuuuaugguugggggucaccacaacaugaggaacugugucagagggucacagcauugggaagguugagaaacucugagcuagaccgucauaacuaagcuuagugagacugaccaccugguagaccuaagucauaguuuuggaauaauaguuucaguuuggauuuguugccugugacuucuggagaggcgcucaggugaagggguucguaucuacugggcgaguuugaccgagguccauaggcugggagguagauuuguuuuucuucaucauggagaugauaaagccauggguaccggugagaucacuagacagaccuugcagagaauacauucaggaccugcaccaguuguccggguguggggaggaaauaacucagguuauggguaccacagggccuagagcagcucaagaagaaaaagaugagucccgaagugggcacuucaggcugagaaccgaagcagagcagaggagcugaggaacgugcucuugacuucaguaacaaucuguugaacuagacucuugucuacugcccacggcagagagcagcgggggaggaguuagccccuccgugcuuccaguuucucaauuccuuuccauacccacauuuacagagucacagaugucuugauuuaugcccauaaaacgucucucaucuccucuuuugaccuuuuuguuuugucuuggugugucaacuauacuccucgaccuguaggaagcauuguaaugccuuuccuccugcugcccuguggacaagcauuuguuguuuauuaugucucuuuguuuacuuuuguggugaagccuuguaccauggcgugugugugccaggcaagaauucuacauugcucuauacucccugccuccuuuuauuucuccguguuccuauaaaaugucaucgugccaccuguuccuaaacagcaaguucugugcccgggucacucccccccaucccuccucccauuucucucccucucuccuuuucucccuuuuucccucccucuuccuucuucucagcacaugcccaccuaccagccaaggaugagcgcuaggucaggacuccucacuagcuguacccacagccaagugauggucuuccauucagggcgauggugaagcagagacagcauagagacagagagcuuguuugcuugccuaaaguuuucuuagcuaauucauuauaaagccagguuuaaaacagugcucucuguuucuuaaaucgggguagggaugaggaugaguuggguucuuuuaacuccuuccaggaaucuugugucuugcucuaaaacaguaggucagcagugccacagucacacguugaacaugucauugaugggagccucgucagcuguuaccuguguguucacuauccccccacccccacccccgugugcccagcucauuuccucuuauuuacauacugaggucggcuuuuguuucugcggcuucucaccaugcagugccaccuuguguuccuuucccuccuuauuuauguuacuuuccuggucagucaauaugaucaggugucucccuguguccucuuggcagugccgagaacgcugguuaauuuaaacacugccauucugcacacuugacaguggccagagagacauccucagggcugcugagugacugguucugggcccuucagagcuucgucagcaaugccauccucuccacuucauucauuccuaauccuagauggccaccucuuccuuuccuuagcuuuccagugccuuuucccugacuggcccccuagcugcuaaguucaccugcguucuagucauaaagagaguaaaagccacagagagcgugugaccuaguugguagagccucguuggcuuuucccgauuccgugugcuuccgcagcccuuuuccuguuguguaggguuguuuuuuuuuuuguuuuguuuuguuuuguuuuuuuggcgggggugggguggggugggcuuuucgagacaggguuucucuguguaguccuggcuguccuggaacucacuuuguagaccaggcuggccucgaacucagaaauccaccugccucugccuccugagugcugggauuaaaggugugcgccaccaccgcccggccuguuguguaguuuuguaggugucccaggaccccucuacgcugucaccucuucuccauucacuuauuucgugaauaaaugacuaccugcuggcgacucccaaacuuaccuagccagaaacugcccccugagaucuaccauuacgcguccagcuguguagugcaguuggauggcuaggaaaugcaugugggguaaagcuacggccuugccuccugccccgcagcaugcugcuucuguagcuuucucagguccaggcaacucagucaguuguugaugauaacucggaguuagccuucagccuucacaauccacauuuaaaccaucaggaagucauacugacaucauggagaccuauccaguauccauacacaucuaaucaucaguauugccgccugucuggucaucuuacuguuaagaugguaaugaugguugcuuaacuuaaaucucuucuaauuggcucuuaccugguccucuguccucuagaagcucaggcuagcucauuuuguucuuccucucacuguuacccagugauguccuuucucacugcauuugagaugcacagguagggcuggggacgaagcucgguugauagagugcuugccuagcguugagugaaccccagguuagaucccagcaccauggaaaccaggcaugguggcauaugccugucaugccagaauguaagagguagaggcaagaagacuagagguugaaggccaucuucucagcuguugugacuuugaggcuagccuaagcuacgugagacccugucuaaauauuuucaggggguggggugagauguaaagucuguacaguggucuccugcuagucugucuucauugcucuaauuaguguuuuuccuccuuggcccuggagagcccaaggcguccauggacuacuguauucagccacaguagguccugacacaugccagcauggucccaccuuuggccugugcccuugccuuccauuuggguuuuccagaccgucuucacggcuuugauaauuucugcuguaaccuuuuucgaaaagccugcccugaccacuguauuuaaagccaucucacucacagccccugucuuccuuauuccuuuccugccucaccccguccccaaagcacguauacccaucucacacaccaucugauucccaacuuguaauugaaguaccaagaaaggaaaaacuccgugccuugaccugaguccaacaguugcucauguuuuaccaccuuuacugugaaugcaaguuacacucuucagcucacuccacaccgaagcuguuucucacacaucuuugaaaaacagugacuuuccacaucaaaaugucaccgugacaccuaagauaaucaaaaucgauuuccuacacuaaggucuagacuuuauucuagauuuccaaaaucaccuccaaauguugcucuuugccgacuuuuugagcagggauuggcugaaaccuucuaugugcugcuuggcuuauguggccaguugcuuucuuuucauccagaagagcuccccuggcucuguugauaauucgcuuguuacucuuguuuugagaccauaucaccguguagcccccaccugccuggagcuugaccaggcuggcuucaaacuuuagugucccacuacagcauucuaagcaugcaccacucagcccaaccuucuuuucuguguucccuggcacucaucugucucagcaccgcuugucugaaucagcccuaaagacagcugagcuuucuuuucucuccuugggcacaagcagaggaagcuguggugugaugaaaugcgccacuagacuuggaguuagaagccuuggauuucggucugaggcuugguggcccuugcuagguuguuuuagacaugcguuaaucaggaaagucuugcuucugccacaguucuuaucuuuaaugauacuaaguuuccauucauuuccuuuuugagaccuggcucauuacuuagcccagguugggcuugaacucuuugcaguuguucuccugccucagccuccuagaugcugggauuacaggugugaacuaguuuguacauacagugucucuccccauucucaauuuagguaaaugcuuauuugucuccuuugacucauuccccguucuuauaauuucuuacagggugguaacaucuaaaguguuaguaacauuuaaauaaaauaguccugguaaaaccauuuccaaggugauucuaagaauuuccuguaguuggggcuggggcuggagagauggcccagugguuaagaguacuggcugcuuuuccagaagaccaagguuuaauuaucagcacccacgcucgugugcacacacacacacacacacacacgcacacacacacacacacacggcagcucacaacugccuguaacucuaguuccaggggaucuggcaccuucacacagucacauaugcaggcaaaacaccagcacacauaaaauaaaaauaaauaaauuauaaaaacuuggugcugagucacaucagaggugaggaaacuucaguuucucauuuuugucugcuugguuaauguagucacuguugaaggguuuuauguuugcaugugaucugugggcaguucuuaggaaggauguguguguaugucugucugucugucugucuguguucuacauauuuccaauguuuuuucgcuaucucgcugcuaagagauggaggagccaggaucagagcccagccuugucaucgcuucacaccagugucucccuggccugggauuaugagugacaaugagugacagauguuuguucugccaguuugugagcuuaucaaaggcagcagcaaauuuuccucauccaucucucuguccuuggaagugcuggggacggacuagccuugagcaugcuaggcaaaugcucuaccaaucaacuccacccccaguccugccuugccauucauauacccugugguuugcuugaauauacaguagcugugaaguggauauauguccugucaucuuuucuuugccccucaacccccacucuaccaagaaacccaaauuguagugucuagcaucaugcauuguuggacuuaaaugagaacguaccaggaacaccaugacagaaccggguccccccuuccauauaggaaauuauucuguugaagcuuucuugagcaaguacuuuguuuugucaccagaaacaaugaauagcucuuuucugaaggcccgaggacaacaggauguucuuuccucaccuuuggaacgggugcccccagcaucccggcccgggaaggcuccacuuggcacuccuaaaaccccaguccucgaagacuuuccucagaaugacgaugaaaaggagcggaugcagcggagacgcuccagggucuuugaccugcaguucaguacagauucgauucaucuggccuccccuaacaggugagugcagcucugcauugauucugucgggguggcauggggguggcguggacuguaaggguccucccucgggucuccagaggacuucauuggcauuuguuucuuauuuuaauauguuuauucucuguguguaagucagaacagaaguuacucccccacccucacccccuuugguuucagggaucaaucucaggucuucagguugggcagcaagcaccuuuaccuccuggguuuguguuuugaaguaguuauauuguagauccuugcuagaauuuuuguuuuucauuuaggaauauugauguuucaacuaccauaucuaaguuuacaaacacacagauuacagaacauuacucuaccuguaucaagcuuucuucugaaaaugugaguauuuguugguuuggaguuuuuuuuguuguuguuggcuuggauuuuuuguuuauuugcuuuuuguuuuuucuuuuugcuuuuuuguuguuuuuguuuuuguuuugugacaggguuucucuguguauccccggcuguucuggaacucacuuuguagaccagauugaccucaaacucauagagauccaccugccucugccucccaagcucugggaucagagguguacgacaccagguccagcuucguuuauauuuauuuaggcaggaucuugcuauguagcucaggcuggccuugaacuugcaauccucccgccucacuucccgagaucucagguguacaccagcaugcugaauucugauucugggcuuucuugauuuauguaggagacgaggugguuuguuuauucucuaguguagcugugcuguuucuggcagagcuuugaugcugggugcuuaguccuugcaguaccucucacacaacaacauggcuuacaggcaaauggugugaguguggaagcuaauaaugaguucuggagucaccugcaguagaacuuucuuucccacguauaaacuggguggcuguaacaaaucucugaccgccccccugcuguaaaggggagugaggguggaggcuauuccugccucacaggucccaacucgacugaguccucugugcggaguucucagagcaaagcguuagagcucucaggaggagcgguccaucccaguuaggcugugcuacaagugguuaugggaacugagguuaguguggguauuuguguguaaacuuuggugggauuauuuacaugcuagguauuuguauguaaacuuucuuuacaugcacuuauaaggcaagccuauaaguaauaaaguuuuaauucucuuuccccuagaaaaucacuacuaagaaugcuuucggcuugcauuugauugauuucaugucagagauucugaagcagaaagaugcagaaccaaccaacuuuaaaguaaggagaacgcacacuuccuguauagcucacccaguucuuaucaucagugcuuacuguaacacacuuggacucugcacacaagagaguaccacucucacacuuggacucugcacacaagagccccggugagagaguuccauccucacacuggaauucugcacacacaagagcccccgugagagacucacacaggaauucugcacacacaagagccccuggugagacaguaccaggcuucuuuauauccuuuccucagaggugaacugcagagaaagagggacauguuuuuauuucccaucauucacugaguaccuuucugucucucucuuuuuuuaaguauuuaauaaaucucgcuggauuuuacuuguucaaagugcuguccugugcaucuucacaaauguaauguagcugugcuuuugaccuagguggcugcuggcaccuuggaugccagcaccaagaucuaugcuguccguguggaugccguccaugcugauguauacagaguccuuggggggcugggcaaagacacaccaccucaaggagaggagagccacaguggagguacacaggcuggggucuggacuuaaagggcugcuucuaguauguacuggacaauauuugagugcugugucaggaugaaaacaaaaauuuggaaagccuuuuuuuuuugaaggcauggcuauuuccagaaugugguuuuccaugaggaaauauaggaaaaucuaguuuacuugcuuccguagagaauucaugauggaugguugauuauuuuauauaucuacuugucucuugggaugggugguuuacuggaaauugaaccgagccucauccaacugacagcccuuacauuuguauuuugugcuaggguuucucagggugguuuugcugguuguuaaaggccuucuauucuccuuagaggagcuugcuuuuggccacacuaguuccaaagacuguauaaaagcucuuaggauuacuuaguuaaauuugaguaaacacuaacuagggagcuucugcaugguuuuauuagaagugaaguguauugucuaguaaguuacacugucaccgcagguuagaucagccugcugacgugaggggauuuccuguuuaaauuaugacugccguagagggcuuuuaagaacugguguuacuccuucagauggaaguacccuugaaacagaaaggacuaaaaaaccugcaaagccaaagaagaagcaguccugcaaaaccauugaacagaaucucagcaauaucaaugucucggaagccgaugggaagugugcgguaaggaagugugcgccucgcucgcguggucucuggcaaauucggcaggacagucgguagggccaguguuuauggcuuggcugggcuuugaaagaaagcuggauggauuuggagcauuaacugcagacucaggaccuguaggucugggcgacacacaggagcacaagccugagagaggaacuggcagugacaacacugguucugggggcccggugcaugaguggcccuggggggaggaagggugaguggaugcucauggugggugcugccugcauggggacagcugagaggguggagguguuccuuucugggacucaggaugcugagaugggguugugaagacagcaaggucccacccuccaagggaagccaaggagccacaucuauguuaucagauccaagugugcuucuccuuggaagccacauccugaagcuccuguucuguuccugggagaucccaagugaugugcucuuuuccgccucacauucauuugucuugaccuguccccaugugugagaugugauguaccuuuggguugguaucacaugacugugccccucuucucccugacccagccucugagcuccucacaacccuugccgcccuugcucugccacuagcccuucuggcucugccuguccuucaccucgccauccugguuggguucucccaaaucuuaaaaauuguguucagaggaacaguagugagugagugagccagaugugguuucgcacaccuguaacccagcacucaggaggcugggcaggggcuucugagugagaugccagccugggaguaagaccccaccuucaauagaagguccccagagcuaguaggaaggauagagccugugacugcuaagcaagcaauuuguugugaugucauuuacugugcugggacuguuagauguagucauuuaggaacugccugcagcagggugucuguccauguguguuguagguagagagauugacaguacacuucuccacacuuauccaucugagcaugcgcagacauucaaucuugcagacagcugugggugagcuugugucuccugcugcuaccgccgucauucuuugguucccuguuuuccucgcgugcagguggauccuauguuucagaagacagcagccuccuuugaugaaugcagcacgacugggguauuucucuccacgcugcacugccaggacuacagaagcgagcugcucuuuccuuccgacaugcagacccucuccucaggagagccccucgagcugccggaucuggguuucguagacaugacagauuuagaaggugaguaaagucagccuuugucagggcaucuuagucacagagaugcuucucauaguccgaggggcaauguuuaaguugccucugaacacugaacguuacacagguggcucuucuggaaaaccaccuuggguguucuuuggcagugccuagcaauccacucuccucuuccuucuucugugguaaagagucucagcaguaagccaucacuguguccgugugcuguggaccuucugcaguaagagucucagcaguaagccaucacugugucugugggccgugggccuguuuacugcucacugguuacagcacccaacucugccacucacaggcucaccuggagggucagugacugagcugggaugcaggaaagagacacuguuuggcuagagacagcuuguucuuacuugcucccaguucacaggucuuuucaggacccgugggguuguuaugacuuuauucuuguugcaguuaagaacugaccuauccuguuaguaguuaguaguuuccugauacuuggcaggauuucaacaucuuccccuagcccccaguucucccucuuuccuacugacccagaaauguuguaggggacauugugaaggacaugugcugcaguguaguaacugggcagcuuguggucccuucuaugugcugaacacuauugaucuccccccucuggacugaccuuacagauacuuuguuaccuauucuugucauuguuauaaaaagaguccugcuguuuaccuaagcuguccuaguaccucucuccuucccccuucuucccugagugcuggaaucacaggcucacacugguacuuucacuuacauucuuuguagucuuucuuuuuuuguuuuguuuuguuuuuuuaauggcauagccauuuauuuuuacauaugugacuacacggaagcugucuucagacacaccagaagggggcaucaaauccuauugcagaugguuaugagccaccaugugguugcugggauuugaacucaggaccuuuggaagagcagucagugcucuuaacugcagagccaucucuccagaccccuuucuauucuugcagaaguuaugaccucagcuagggcucugauccccugagauuugucaucuguaacuacuuuaguuucagacugaaaaggaguaccauuuugccauuacugaagggcuuaguauacuuuuaaagaaaggcuuuaugcauuuucgagcuacacuucagaaagaaaugucugugcuucugguuucuccuuugcauuuaacucugggaauagcauuuagcccgacuccacugugggugcacuugugucugugucaggagauugugaaguaaugaugugacugccucucccucugugucauccuugccccccccccucuaaucuaugcugugaucuugcugucccccagcuuccuugcagcaguguguggaagaccgcccgcucugcccaucccuggccggguuccaguuuacuaaaugggacagcgaaacacauaaugaggugcggucagcuuugggguuuauagggcucgggguguucccgguggcuggugguuucaguuagcuagcccaagaucagcucugcccagugggagccgagacauggacuguguuuauucaggagcacagagaauauuuccuguggcucuuguguaggaacucucagcuuggcugggagggugggacugugagccccagcuggaccaucacacaguuguggguucuggggucagcucccugucucuucauuugcuucccaggggucagauuugcucuggaguccacauaucacaguagccucuggccuccagccacugucaggcuagaggcauuuccuucuuugggggcuaagucacuuggcacacuguuuccugagaaacugucauguuuaaagccuuccuuuguguauuuuuagcagggcccccuuuagccuacuuacuacaacuuccaacauaaauugucuccauggaaaacuguucuccaaacaugcaguugaugaaugcagauuccuguuuaguguuuuacaaaauguaccuaacacaaugcagccgcaaccugcacugcacaauguaaacuuccuccugacagcgcugcuucugguggggcagggccaggaaaaagagaggcugaaaaugugggggcuacuuuccagggaugaacuggggcgacccaaagaacggggacagcuggagagcugugucuucuccuuguagucugugucggcccugguggacaaguuuaagaagaaugaucaaguauuugacaucaaugcugaggcugaagacgaugaagaggaugucccugaugggccccugguggaggauuuuguugacaaugaugagccagaccuuucugcagcuggggaccaugaagaguuccggagcuggaaggagcucugucagguccagagcaaccaguaaggcucccggggucccagaagguuucuaaauaggccucuagcuccagcuggccgggcugguaugccauguugaauacacggcugagcuacauccugacucacagggagggucacaccuggcuuuguguguuggugacccacuucauuauagaacugauguuggucaggcagcgcucacucccacucugagaguaaaggacugaaguguucugcuggcugacagcugccucugagcuggcuggcaggaauuguuagcucaauggcauuaggacaauuagacugaaggggagggucucugcauugucagaaagaugugacagaagugaagauugggaggaacagccuuaaaaugaaguauaauauagauuuuguuaguuauauagaguugggcaagggguaucugucacucagaauguguugaaggauauuuugggugacuggagaguucuguaagccuacagggccucuguaugguaucaggccaggcuguggggaagggaggcaggcuccucacaccuuugccuguaaaugcuugucuuaguccugcacaaacaucaugaccaagaagcaaauuggagaggaaaggguuuauucggcuuacauuuucauacugcuguucaucaccaaggaagucaggacuggaacucaagcaggucaugaagcaggagcugaugcagaagccauggagggauguucuuuacuggcuugcuugaucuggcuugcucagccugcucucuuauagaaccaagacuaccagcccagagauggucccacccacaaggggccuuucccccuugaucacuaauugugaaaaugcuuuacaguuggaucucauggaggcauuuccucaacugaagcuccuuuuucugugucaacuccagcugugucaagcugacacaaaacuagccaguacaauugacccccuugucuacuugacacacaaacacaucacuaguaagccucacccuuacauucuuauucauccccaaggucuaaauaacuuuaaacgucccacagucuuuacauauucuuaaaauuucaaucucuuaaaauauccaucucuuuuaaaauccaaagucuuuuuacaaugaaaagucucuuaacugggcuccaauaaaauaguuucuuccuucaagagggaaaauaucaggacacagucacaaucaaaagcaaaaaucagucuccaaccauccaaugucugggauccaacucacgaucuucugggcuccuccaagggcuugggucacuucuccagccacgcccuuuguagcauaugcgucguccucuaggcuccagcugccuguacuccacuacugcugcugcucuugguggucaucucaugguacuggcaucuccaaaacacugcaugaccccuuuaguccugggccgucaauugcaacugaggcugcaccuucaccaauggccuuccauggccucucacagugccgagccucagcugcucugcaugaccccuucaugccuucaaaaccaguaccaccugggugacccuuacagugcuuaaccacuaagagccgaccacagaaugcagguggggacccaugaggggaggcucugacgcagucuaguuccaucuguaguucugugggacuacacauguuaguccgugacaugcucuagguccuugacagcacugauccagugggccggaaauguggggcuuuuguguuuuaauuuuaaaaauuauguuugaaauauguaguuucuugggcuuuugauuuguuugguuauguuuuugguuuauuuuuguuauuuuugagauuuuauagagaaaaccagucugcuuuuuacggcuuuuuuuuucuugcucuguagagugugccauaaggauucauucucagcucaauaccaguacaaggccacucugaaagaucucacucgucaccuuuauccucacaggccggcagaggagaggguucccucccacacuagagcugccgagcugaacaggcucuguguaucacagagagcagaugaagcuggaugacaucgcagauuguuuuuaaaaaaggggggucccaaaguguuuggagcuacauauguaaaguggaacgacuuuuucacuuuuaggaagaacuaaggcagugucuaagggucauaaugagugagcaaauggaaacuaagauugucugggauucagacaguugcauccuuugcuuauuuuuuugagaguaaauaucauuguguagccuaggcuaacuucaaacucaagauccuccugccucauucuccucccuauguaugccaccacacccagcccagcacugccguuucccugggguauguagugaguuucaggcucuccagagcuauguagagaccugccuaaaaacacaaacagcccuugacuuuucuaccuguuuucuugucccucagaugggcuaccacugggaccacucaacaaggagaaacuuggugguuccuuuuguuuguuugcuuguuuguuccucuagauaggcucuuacuguguagcccuggcuguucuggaauucacucuauagaccaaucugaccucgaacucacagagaucugccucugucugccucccaagugcugggauuaaaggcaugugccaccaccgcccagcuaacuugcugguuucuuaaugaaguauuugcuuggacugguugcucacaaccaucuguaauuccaguuccagggaauccaugcccucuucuggccuggagaguaccaggcacguauguaauucauguaggcaaaacauccauacauauuaaaaaaaaaaugaaaaagaaagaagugcucuuuugugguagaagagguggcuagcauuuccgguuucaucaguuucuuacauguaacuacaugguuuauauuccaugccguguacaugaacaugauuucauauguguuacagggaagaaguuauuucccucgaggacagagacauccaagucaugugcuccuuuuuauccaugaaaccuggggaauauuccuauuucaguccccggaccaugaagaugugggcuggcccagaucacuggcgcuucaggccucgacccaagcguaaguccugugggugggacuuguagacagggcagugcagcggcacaugcugccugcggucugcaguaagcagacaagagaugcugcugaucucuguccuuugcaucuccugaggaggagcuaaagccggagagcugagccagccucugucugcggucagugucaaccucgggagagucagcaggaggggcaagagggagauuuagucgggagaacaaggcucauggccuuacccugcuuccacggaccaguacgacuuaaacuguaggagccucucuuaaauuggaggggcuggaggaagccccuccagccuucuacagacauuaaguuaggugggcaugagguguagugauguguaacugccauaaauugcaccuuaagcuugacaaggccauugguagaugugagaugagaauacuguugacacggagacgaacggugcuauaaacuguuuauuucugcagaagaugcuaccuccugcacagagcacaaaaagaagagugcaaagaaagacuuugaaauuaauuuugaugaugauauugauuuugaugcauauuuucagaaaacaaagguuugugccggaucuccgugcccuucuuagaugacugcccuccucuugcccuuucagacaggcuuuucaaaagucucuuaacaagcugggugguggugguggcgcaugccuuuaauuacagcacucaggaggcagaggcaggcagaucucugaguucaaggccagccugaucuacagagagaguuucaggacagccagagcuauacagagaaacccugucucgaaaaaucaccaccacaacaacaaaaucauuguacagccugguguagugguauacgccuuuaaucucugcacucaaaggcagaggcuguggcucucugaguuccagacuaacccagguuucauagagagacccacaacaaaagaagcaagcagaaaguuauuguauauuucaguuuuuguuuuuuagaaauagggucuuauguagcaggccauccucaccucaaacuugcuauauagaugcggcuggccuuaaauuuuuguuccugacuauacuccccaauaugccaccaugccuagcuauaacuuuaauuugguaagcaaguagucuguucucucccucagucccugagggaccauugagaaacaaagucaguggcagggucaagaaaguuuaggguuuuagauaggguagcaccauguagcccagucuccugcccucuacagggcuggccuugaacucaugccagcgcgccugccucagcccucugaguacuuugguuaagugcaucugcucucgugccuaguacaaucacuucaucacuucaucagacagacccgagaguugcaaguaguagagcaaugcccaaacccauuugucaguuauuaagaauuuuucuuuaaacaaauaggcugcuaccauucugaccaaguccacuuuggagaaccagaauuggaaagccaccacucuucccacagauuuccacuaugaaacugauaaucugauccagcuucaccucaaaccaggcaaaaggguaagauggugccucccuuccuuuaagcuguuguggcugccaggccugucgauggccuguguggaucagguggcuuguccuguugcugaugugcaguaccucagaggaaaggagggaggccaggaggggucacagagaguggauggugagguagagcugaggacagagacugcagagcccucacucagagagcucugccugcuuacagcccaucgcagggucucggaggguuccuccugguuauagcccaucaccuggguuacaccccaucacagagagcgcuccgcucagguuacagccagcucuguaguucugcucuugcacugguuuguaguuuccuccuuaucuugucuguucuucuacaugagcuugcguucuuuuccucuagggcuugagcauguucuaacuuuuguuuucuuuuguagcucaggcuggccuugaacucgcgacauauucccaacuugccucagucucuggcuccucaugcuuccgcauuuuuaaaaaauuuuuuaaagauuuauuuuuaugaguacacuguagcugucuucagacacaccagaagaggacaucagaucccauuacagauggcugugagccaccaugugguugcugggaauugaacucaggaccucuggaagagcagucagugcucuuaaccgcugagccaucucuccagccccgugcuucagcccuuugaaggaccaggauuccaguugugcaccacuguguuuagucaccgugcaguuuuaaugauaugcauauauuuuccuuaguucaccaagaugcuacacucuacuuaaaacagacuggcauguuuucuuucugaucaauguuguucacuuagcagaaaugcuuugguaaacacaggaaucggcagcugcacagcacugaguugcagcucuugaugccagcaaggacagacagucuggugcaggauggcagagcaaggcugagcuacagccgcacagcagaguccccuggauggcuccccucccuguggcugugauuguggacuuuucaguaggcuagccaagaugguaauuugcauauugagaggagaaugugauggagaaaagccguccuauuguagagucugguuuuuacucuuugauuuccccaaccccugucaauaaguagcugauuuucuacaaauugcuuuuguuucuuguuccugacccccaccccacucccacccagaagcuuauccuguagcucaagcuagccugaaacuguguaguccagguuucugucuccaccucauaaaugcuaggacgagcccccaugccuugcuugucaguauuucuuugaaagaaagaacuugaggucuuuauuauacucagaaucauaugagaggcaggcaggcaggcaggcaggcaggcaggcaggcaggcagcaggagcuggagguccuuuguucuuccacggagcuacacuagacgcuagaaguuuggcaaggggcaagcuugcacaugcacagagaagggcuucccaguggagaagagcuccaugugucaugagaaacaguggaaggacguugggcaucucucuuuccuuuuuuucuuuuugguuuuuugagacaguguuucucugcauaguagcccuggcuauccuaggauuagcuuuguagaccaggcuggcaacucacagagaucugccugccucugccucacaaggucuaugauuaagagcaugugccagcauugcucggcuagugggccauuccuuaacucacucaauguuugauauuaucuuugaauuuguauuauaaaaauauuguuuuaaacaguugauuuuagauuguauuagaaucaucaagauaguguugcaaguuaaauccaucuccagcuacauucuccuuaauucaaaggcauauuccaaggauagccgacaggguaagagccacagaugcuugagggcuguggugccugagcccucccauagggaggcacaguucugugggcuguggaaggcugaaugaaaacucagggauaaguaggggaaagagcuucuuucuuugcugugugcuugccccaguaaggggcagcugccuuuauuauuuuauuuuuugugugcacgcgugcgcucaugcuuguguaugugcugggacagauguagauuuggggugucuuccuuguauauccugugugggaacaugcacauggguaccgcaguguguguguagaggucaggggauaacuuggaggagucaguuuucuucuucuaccauauugaaccaggggauugaucuuaaguugucaggcuuaguggcaaacagcugcacccacuaagcauccucccagcuccuccugagacagugucucacgucgcccuguagucaccaguuagcuaaacuggcuggucagcacaguucuagggacccaucucuuggcuuuccugaacaucugcuuuuuuacauggguguugaagagccagacauaggccucaugcuugcaaggccagcacuguacugaguccucuccccaggccccugugggcugccuuuaagauaaggaguucuuagcaggguuguucaaguacaaguugaguuucuuuuagaaaguuguagauggguggccagccuuugguuuuaaguaaaacugcagaagaugcaguuugcagagcagaagaggaaguguuuugguuuggggggugaguaguggcucugaguccuguaucuuguguuguucugugcaguagagacuugguuagacuauguagccuuuuagccacacacacacacacucuagggucauguccugcuaaaaugagacugaaauaggaaacaagauugauauccccagcuucgcccaguagcugcuuuuuuuagagauuucuuuuugcacacccccuccucuauucuagucacuuaagauggaccaggaccagaaggcuaagacugagcacuaugaggaaauugaagacuaugauuacaacaacccuaacgacaccuccaacuauuguccuggacuucagguaaggggagaagaguucuugccucuuccaaaugguggguagucucuucccugguuucugaugcccucugucucaguguauagcagugaacagugcugagaaaugagcuggcauggccgcuuuccucauacuccaggggcaggaagcagugggcaggaucuguggggugguuuguauaugcuuggcucagggagugucaaguagguaugcccuuguuggagugggaaugucacugugggugugagcuuuaagacccuucucccagcugccuggaagccagucuucuaguagucuucagaugaagauuuaggacuuucagcuccuccugcaucauugucuggacacugccaugcucccaccuugaugauaauggacugaaccucugaaccuguaagccaaccuccauuaaauguuguccuuuguaagaguugccuuggucauggugucugucacagcagcaaaacccuaacuaagacacucugcuaaugaauagacaaguggauaggcucuggccuguacaacacagcacuaaucuuggauauuguggaauuucaaagaaauauaacuacacuuccuguucauaggagcuaauauuuuggcuaugaguugaaacaaggcaugcgaaaguggugugaucuaguagggccaagaacucucuggaaguaccuacuuaucaggagaacuuguccaagccuuuccucauucucagaccuuggugggcauugcuaauuuguuucucauugugagucuccugaagaaacagcaaauagaagcuauggugaggaggacagagccuccugugacccuucaugcagggaggacagaauuggacagucauuuauucuguuucuuucucuacugaggggagagauuguuuuguuuuaaugaggaucuagucugaccucuuggccgaugcuucugcaacuucagcgccgguaaggaccagcccuggaaccuguucagagcucugccauacugccuaugucacaguucucauccguucacucugggcuugguucugagaauggcuuucugugaguggagacugcagaccagcaugaaugaagcagggauugcuccccaucaccuuauaaaccaggugucuuagaguucuguugcugugaagacuguggcaacccuuauaaaggaaaauguuuaauuagggcuggcgugcagaggcuuaguccauuacuagcauuguggaaacauggugacauucaggcagauguggugcuaagaaagguaacugagagguccguaucuagagggugaaagacccacaacgugaagacucccccacguucugacucaggagagcaacaccccaaaucacucacgagaaauggucuuggugcaaaccgcaagaggacuuuuauuccaggcgugcucugggacccacagccauacaccacacaggggguagaggaccgugggccccgaguagcugggacaggggguauuuaaaggaaggaaccacaacucaaggggguggggagagcguuguuggaaaauaccaaaaauaccaguuaagagucgugagggagugggagucaagacaguuucuaugagucucuaacaauagcacauuugcauaguggguuccaggagcuguccaggugggucagggugacuuucuuugaaugaacacuccccaaacccaggaagccaguggauggaggaaugucacuaucuguuuuauaauuagcaugccuuggagcauugagucacaaaggucacauucucaagccugggccuaacggccuagaauuuuuuguuuuuuauguuucacuuuuuuauucaccacuucuacuugcuaaucuuagaacuagacacuauauucucccugaugcacuugauccuuuagggcaugguacuguugucucaaaacuaaaagcugcacuguacuaaguuuugcucuaauaaaggcaacuagccuaucuaacacacauggaccuauaauuaaaaguagaagcaaaaucagaaggggucccauaggauagaaaguaggauggucaagaguacaagauaagggccuuuccaccgagucucaagguuuucugcgcaauggcaucuacuguagacugaaucucuaacuuggaagcgaugugggcuugcaggucuccuucucuugaguaggcauucuggagcugcuuccacacucgcugucucacccuuuugagcaccuugagccuagagaacaaaggcugggaaagcagcaugucugcacuauguacagaggcuauuuuuaccaguggagcccccccccccccauagaguaauucauagggggucaguccaaacugucuagggguguuucuaacccugaagagcacaaaggguaggagagcuauccaaucauuagcgccagucucugcugucaauuugguaagggucucuuuaaugguucuauucauccucucuaccuguccugagcuuuggggccuguaugcacaauguaacuucuaaucaauucuaaucaauguaacuucuaaucaacccccaauaucuuggccagucccugacuuaccuggacaacaaaggcagguucauuaucggacccgauuaccuuggguaucccaaauuucgggaagauuucuucuaagaucuucuuggccaucacauuggccgucuuaguccugguaggaaaagcuucuacccagcuugaaaaggugucuauuaacacuaauaaguacuuguuaccauaucuagcuggcuuaauuucuuuaaaaucuaccuuccaauaggcccccagccaguugccccugagccucuucccaggaguauacauggaguguccugcauuagucauagcacaggccuugcagcuuugacuauuucuccugccaagucagagaguccuguaacauaguagucagaggaccuaaccacaccuuuuaauuucuugaccccaagugggucaaguaauguaaguugguaacauacuuguguccuucuucccaugggagaacucauuuucuuucuucuguuucuauuaccccauaugagguuuccuuuaccaucccuaauuuguccauaacuugauaguccucagggguauaucuaaagcuggucucugacaucauaaucuuuaggcuucuugacugccaggaucauuacuccuugggccgccuguuuggcgguuagaucugccaucugauucccuuuagccacagcaucuuaggucuuucucugcaggugucaacagcccucuuugucuguauauugcuccgugcaguggcaaaagcauaucugcugucaguguaaauguugauagacuuccccuuugccauuuguagagcuuauaucaaagccacaaguucggcuuucugggccgaaguuccuucagggaggcugcuggcccagaucacuugcuuucuguccaccacugaugccccuaccuuccgcuuaccuucaaccacaaaguuacugccauccguguaccaacucggacucccaggccaaggcugauccuucagaucauuucgaguaccaguuucuucugccagaaugucagugcagugaugagcaggugaagagucaucagucucgggcaguaggguagugggauucaggacagcagggggagcaaaggucacucguucagucaacaaagggcucugauaaugugucauaugagcguuggucauccauuggucaggaggcuguuggauaauacuuucaagaguguggggugccacuacaguuauuugcugucccagagugagcuuaucagcauccuugacaaguaaugcuacugcagcaauagcuuucaagcaagaaggccaccugcuggcaacagggucuaacuucuuggauagguaagccacuggccuuuuucaaggucccaaagucuggguagacuccuauggcaaccccugcucucucaauaaagagugaaaggcuugguuaggucaggcaaggccaaggcuggggccaucaguagggcuuuuuaaauuucuuuaaaggcuuucuggugaucuggguucuacacaaacaccuccccuuccuuggcuaggggguacaaggggcagcuaaggucgcaaacccagguauccagagccugcagaagccaacggugcccaagaauucucuuacuugccuugguguaguugagguaggaaucugaguuacagucuuuuuuuuuuuuuuuuuuuuuuuuggcuuccuuuagccaccacuucccaucucgaagguuguaucucaaauaaauaacuucagucugacacagcugaggcucgguccccuaacucaccuaauucuguuaagcacauuggucuucuaauagucccuuugagucuauguguggggcauuuuuauuguaaccaucacacuggguguggugggacacaccuuccagucuugagguggaggaaggugaaucgaaagucacccuuugcuacaaggcaaguuuaaggucaccuuggcauucuugagagucuguauccauccaaaauauaaaagggcguugcuccugcuacaaaauuagauagcaccugggauuuccuguacuguuuuugggugguaaggauggaaccuaguaacucacaugaaauguguguguacucuguacuuagcuacaugcccagccccuguucugugcucuuguuaggcaagggaugcaggcugugcuccagcguuuugggaauguuuucuguaagaugaaauauuuaucuaguuacuaagcaaaggggaugcuggucucuguggucauugcacucuuuaaacucaugcuuccgaggucucaggcugauaagagaccccucucucuguaguagggcuuaugugaagcaggaagaagugagcgagcaggccacguuggugggacucugcuugcuuuguguacguggagucucucccauugauagcaucuaccaaacuugaaggguuguuuccuugcccaggcugcugacagugauuaugaagaggcagacgauuuauuugcggauccagucgggacccuugaccuugagucugauccaaagacaacacaagagaauggucacauuucuccugaaaaccaaggaguagauaucacaacuuaccaagaguugaacuugguggcugagccucaaaagguaaggaagagacaacaaggaauuguguggauuccuggcugucuguuuaacuccucucagaugugagucccaucagccugcgcuccacuuguuuuccgguuccaucuuaaccugcuaucugaguuuucacacaggguugugcugucuaaacugcuucccaguuauugacauuggcuacuuagguuauaugguagugauauuuuuccaaagaccuuauuuuaucuuauuaacuuuuauuuacugcuguaguguugagagucaaacccaagucauaaguaggaguggauuggccacaccaauaaaacacauguaggaaggcugcagcgagagcauugcuguggggcuuugaauaccuuggccauuuucaguuccugucauguguuaaauaccugaugccuuaucccaagagccaggcugggugcuaucuguuucauauacucaucucuuacacugcaauucuuggucuuaaucuaaauuuccucugauuaaaaggaguuaggauugguagaguguuuaccuagauucagucccaugcacuggcucauuaaaauugggcguggugguucauacuuguaaugccagcacuugcuuggaggcaagagguugacaaguucaggaucuaacaguaagcccaggcaagacucggcuacacgagauucaaaagcaaaacagcaaaauccgaaagguaaaaacagaaagaagugagaucuuuuugcagggaacucuguauaugagguugagacuggcuuucuuuuuugcuuuuguuuucgagacaggguuucacuuuauagcccuggcuguccuggaacucacucuguagaccagguuggugucuaacucacugagauucaguugccucugucucagagggcuggcaucaaaggugugugccacugugcccggcugggauuucuccuugauuuccaacuuuuucauucgagacuucuauuuuacaggaaauugauagugaauguuuuucuucugguuaauuuugcuuuguuacaccuauuccaggugaauaaaauagaaauucauuacgccaagacugccaaaaagauggacaugaagaagcugaagcagaguauguggagucugcugacgaaguuuucuaggaaggaggcugacacagagguaacaucacucaugcuccuuagguucccaauguguaggaagggagagcugaugucuacagcucaugaucccucagugugguccccacccuaaagcagagagaugcagucacaguuuaaaacagacaucaccguggcuuggaagaagagacugucccagcagaggaugggacaggucacacagcaagcuaaugccuuggccucuaucucaccuuacuggugaugaaaacgugcagaugcaagcuuucccaugcugcccuagcagcugcgugcuuuacaguccugaugggcauucggaguacuuacccaguagcaaccggacuuaaaauaggacuuuguacaaaguauuguggcuaccuuacaagugucagaagguguguaugcuuugaagugguguucugccuuaggaugcccauucucagcaggaacgcuggagacauaaucacgcugccagaccccucuccugagagugaagcagacuaagugugcagaccuagaaccccgguucagacccauugagcucuacaaacuccauucuugcuuacacguuuugcuggcugugcagugaaaugcaugauuauugaggacccuaagcuguguggucuuggguaugucagagaaugccucagucgcaguguuaguguguguacaacaaacagcagaggcucucaccucaaagaaaagccaauccauugacucaccuuuagagguuucagucugcagugcguuggcaccauugcuuuggucuuguaguacuuuacagaagcacaaagcagggucugaucauucgugucauggcuagacuaugaaagaacaaggagggcauaugguccacuauccacagucacaccuuggugaauucgugacucagccaggcaugcuggcucauaacagaagcagauggacagaccucuguaaguucaaggccagccugguccacauagugaguuucaggacugcuaggacuacauagaaacccuagaacaaaacaaaaaauucuaucaccucuuaagagugccaguguggggaucaaacuaagacccauccuuaaggucuccagagaauuuaacuuugcuuccuucaguacacuuuucuuuaugggauuuacaguuuuguaaguuucuguuguuucaacccauaaauaugcuuuuuugguuaggcaaaccacacugaaaguggacaggaaggugcccccgaggaaguggcugaugagaagaaacucagugggcucacaaaggaccugcagacaaggugugugcugauagacagagggcuagggugcgcuguccccucugagcccugggcaacuuucuuggugggacuuuuagcaugaagggcccauuguccaccucuuacuuucuauaaacacuugaaggagcugcauuguccucuggguugccugaccuacucagugcuugccccucucuucccaggcugcccccgcucauggcucagaaccucuccauaccccuggcuuuugccugucuucugcacuuagcaaaugaaaagguaagccauccaaguaaguaugggggcguuugaauccaccucugccagcucucuagagcuuuuacagcagaucuuccgagcauugccacauuagugggcaagagcacauacuccucuucaguccccagcauccuuaucgagcaacacacgacucuucuaacugcggcucaaggagauccacacccuuggccuuuaacacaaacacacagagagacagacacacacaugaauaaaauagaaaguuuuuuuucuagauaggguuucucuguguagcccuggcuaucuuggaacuugcucuguagaccaggcuggccucaaaugcagagaucugcugccucugccuacugagugcugggauugagguguguaccaccaccaucaccuagcucaguaaaaauaaaaaucuuuaaaaaaaaaaaaaaaaaacaagcccaugggggcuagagaggcaggcacacagcaccugucugcgcuuaugguagucgaagcgucucugugugguuccugacagaagcugaaguaccugucaugccagcaacccaaagaaaggcuaagaaaagcugacugacugggguguacuguuaccacccugacaagagugugcaaagcggccguugagacucacuugacgcaggagcguggcucacugaggccccugcucugcagcucugccccguucccuagugauggccaagguuuuaguguccugacucccuccugcugcagucaagucuccccuguagagguuuggauaucuaaaguaugcaagauagccacagcccgugugcugucaggcugacacaggauuggacauuuccuaagaguucugugaugauuuagagcucagcaccuccacggaagacacucgucccagacauuccuuuagucacucccauguggacccuagucauccuuugcugugugguggggcuuagggacggaugggcccugcugcuccucccucugccuccauagugagcaggauacaauugaucagcauacaacugaucagcauacaacugaacuggaaccaccccaaucccacgcuagagagcaaacuuagccuuacauguuaggcaagugcucuaccacugaacucucccccaucucaacagcuucuagaaccugagcuacaacauaccaggaagacaaguuaggggagaguguauggcagaugugaguaccagcaggucucaccacugcaccuuugaggggaaaagacagucuucucuuggcagucaguuagcccuaagggaaaagcugccugaaguuaagaugagagguguagcagccggggaugggguaauggccugggggccuauguuggucuucugugggaguccugucagcugcagcagaggcggagaaggaucucugcuuuucccugcacuuggcaaggccugagaagcaacuuugugcaaacuguauuugccacgagaugauucuccuugugauaauaaaacagcucguucuccguggucaccuugucuccucaacuaaaaugugucuuaggauucuguucucaagucuaucaaagccuguguuucuuucuucucuucccucagaaucugaagcuagaaggcacagaggaucuuucugauguucuggugaugcaaggggacugaguccacuuugagacgucugcagcgggaugcccauggcuuccugguggccguggagaggugcugggccuguagcguggcuauagccaaccaccacggugcugguucucgggaugccaccacgcuaggaagcuccaugcuguuggaaggucucacguggguaacguccaccuaggagagggaagcccuuuagucuguacagacagucugaucuuuauauccaugugcucuggucacuuucugugaccgucccacuuuucauucuguacugucgagaaucauuucuccauagccucuuucuguccuuaaagaauucccagaucuauguacauaaaauuuaucauuuuuaaacuuguaaguguauuuaauaccccaaaauaaaacuauucuggcaagugucugagugcccaguaaac

SEQ ID NO: 1061 - RNA, 8112 nt, Mus musculus
ggcuuccaguuacggaggaugaggggagugacuacaagucccagaaggucacgcggcgucaacagcgggcacgucaauuccuagggcgacauauuuugcagaagcuguacaucugacggucucaagguucuauagugcccagcgcguuuggcgcguugcuucucucggugugcucuccuuacccuaaaacagucgccaugaaagauucucugguacugcagagccgcgucccggcgcacccggauucccgcugcugguuccuggccuggaaccccucggggacccuguuggcuuccugcggaggcgaccguaaaauucgcaucuggggcaccgaggguaaggccuggcuuggcuuuguggcccuggugccgaggaaaacacuacucugaaaagugucggggaaggagugugccagcgucaacagaggcuggaauuguugcgggaacugggauauuugcugcgggaacugggauauuugcugagguagaaaaaugaggaaagucgccugaagagcaguuuaacaguuucagaaucuugaucgguugcaucguaguaauaauggugacugacuuugucccagcaacagggucccacuuaaaguacuacuuagugaauggcaucgauggcgcuccaaagccuagccuguucucugcuugcaggugacagcuggauuugcaagucuguccuuucugaaggccaucagcgcaccguuaggaaaguggccugguccccguguggaaauuaccuggcaucugccagcuuugaugccaccacuuguauuuggaagaagaaccaggaugacuuugagguaaacagguuggaugggagcaguuuauuaccuguuugcaccccagggcuuggucauauuaguuacagccuuaacuuaauuucuacacuauagaaauaguagcugaguaugguaguucaugacuguaaugccagcauuugggacacugaagcaggaugauugcuguaaguccaccaaggucauccugcuauagaaugaaacccuuucucaaacaacaacaaaacugcucucuuagauauuuuacuagggcuuaggacucuuagcugccauuaacucaauauccuuucccuuuccagugugugaccacucuugagggccaugaaaaugaggucaagucaguggcuugggccccaucuggcaaccucuuggcuaccugcagcagagauaagagcgugugggucugggaaggugagucuaggugccucuggguacagcaggaaaccagcucgcuggcuuucagcuuugucccugacuggucaccucugggucuaauuuguuccucccacaguugaugaagaggaugaguaugagugugucaguguccucagcucucauacgcaggacguuaagcacgugguuuggcacccgagccaggagguaagagugagacagggugggaaagaaccugcuguggagguuugugcccagccugccuccacucuucagaaccacucuuguucuuagagggaucgcugggacuguccugcucugacaggguuugauaugggaaccauuguaucuuaguuuggguuugauugcugugaagagacaccaugaccaagacaacucuuauaaagggaaacauauaacugagucuggcuuacagauucagagguuuaguccacuuucaucguagcaggaagcaugacagcaugcaggcagacauggugcuggagagggagcugagaguucugcaucuugauccaggcugcuaggagagggucucaaagucuacccacaaagugacguauuuccuccaacaaggccacaccuccuaauagugccacuccccgagcccagcauauucaaaccacaggcaccuccuggaccauauagauaguugcugggucuccuuucucuuucagcuuuuagcuucugcuagcuaugaugacacagugaagcuauaccaggaagaaggggaugacugggucugcugugccacccucgaaggucaugaguccacuguuuggagcauagccuuugaucccagcggccagcggcuggcaucuugcagugaugaccgaacuguacgcaucuggcgccaguaucuaccgggcaaugaacaaggugagggucugggaguuaaaggaaacuccuuuucguagagguuuuuaguuugccagauauaugaucuaaaagaugcagucugccaugaaucacagauuggauucaguuugucagucccaagagaagcacugaaagaaccagggauagcuuugcgggacaagaggcagguggcuacuugaggccagccugguuuacaucauguucuaggacagggugggcuggcaaagaaacccugucucuaaaaaaaaaucaaaaaagcugaccaugguggugcaugccuuuaaucucuguauuuggagaguaaggcagcugaaucucugugaguugaaggccagcccgaguuccagggcuacauaaugagacccugacucaaaaaacaaacacccagcagcgugaguugaugagcuggcugauggugggaauauccaaacugaaugugaagagugugaagacaggauuggaagggaggagugaagucgauggggugggucggcuaguggguggccugcagcuuaguuggugaggucuggccuaagguagaacagauacuuucuuuuuggaagguucccguguguaaggcagauaagcagcgugggaacacaguugguacaaggacucugauuggcaaggggaugaggaagggcacguuaggaucuccuuuguaauaguacaacuacucaggacauaggaugucuuggguuuaagaaaagucuguuacacagggguggcaugcaguggcucugaccccagcuggaaauguaucugcacuuugucgggcuuccacaccaggaccauuuacgacguugcuugguaagacuugaucccauccccguagcagggauuuuagagauggcacggccugugcugcucugcauuucuccauauuaaaccucccaugcuggcuuguaacugucuggccugggguuguaggagcaggauguugacugugucuggaauaagaucccaggcuuuggcagcaccagccuuuaggauucaccuaccuuuggaucauccugagaugaucauugaauaugugcauuugugacuagggaguuuguggcuugauaacuaacuuaccgaaacuaggaaagguggcccauucuuagaauagaggacguuagaggugacucuggacccaagucuuggaucuuagaaauaauuccaaaccaugaaaaaaaaucuguugcauauucaagcuuuauuuaacauugggaauaucuaucccaugaaaaugaacucaauggguggcagaggcagaggcuggcagaucucuguaaguuugaagccagccuggucuagagaucaaguuccaggacagccagggauacacagagaaacucugucucaaaaaaaacaaaaacaacaagacaaagaaaauggacucgaguauuuugacgucaaggaaaauuaccacacacacacacacacauacacacacccacacacaccccuacuaaguaaaagcaaaguuuaugacauuuucugugcuaaaacugaaauuuacuuugagcuaaggaggguuuuuuuggugggggaggguagguuuuuaaagauuaauuuauuuuauguauguaaguacacaguugcucucuucagacacaccagaagagggcaucagauuccauuacagaugguugugagccaccaugugguugcugggaauugaacuuaggaccucuagaagaacagucagugcucuuaacugcugagccaucucuccagcccuuuugguauuuaaaauuaaacuuacuugaagcuggagauauaugccuuagcaguuaagagcacugucuacucuuccagaggaccuggguucuauucccagcacccacauggcaccuagcagucaucuguaacucugguuucaagggaugugacaaccuuuuagccucagugagcacuauauauacaugguacacagaaauacaucuaggcaaaaacaccuaugcauaaaaaauacaaacaaaccuuacauaacaaaaaucuuccuuaaaaaacaaacucaaacauucauugcuagacaaauggauuuuuugcugcuuuuauaauuuacuaagaugaaaugaacauuucagguucaaaaguuuuauacagugaugggcaaugggggaauuguuagugcuuaaaguucuugacuuuaaaaagaggauuaaguuaugagaaaacuuguuaguauuaaaaggagguuaagggagauuagaaagauugcucagugguuaagagcacuggcuauucuuccagauguccugaguuuaacucccagcaaccacaugguggcucacaaccaucuauaaugaauucugaugcccucuucugacauacagguguccaugcagauagaacacucauaaauuaaauagaucuuuaaaaaaaaaaaggaaaaggaagaaagaaagaaaaagaaagagaagagguuuaaggaugccgugacauagccaacugacugcaugugccggcagggaaaaugacucaaucucaucuauagcuggaguaaacaggugggaguaggaggaagagccuuuguagaugugguggaucuuaguuaggaaagcuuuucuaagacacuuagcugaggccugagguuuaggaagaaacuaggccagggacuguugaacaccuguaauuugccagguuggagaggcaggagucaucggcuacccccugacauguauguuucucucucaggugucagcugacaggggccuuggcuacagcuuguggagaugaugccauccgaguguuugaggaagacccaggcucagacccacagcagcccaccuucucucugacagcccaucuucgucaggcccauucccaggaugucaacuguguggcuuggaaucccaaggagccagggcuccuggccucuuguagugaugauggggagguagccuucugggaguaucaccagccugcaggucucugagcuauagcuugacuugggagucuugauucccacagaaaacguccuaagacuucuagucgucaagaagaccugaagcauccuugaccuucauuuugcucaggacuauucacuguuucccuuccuugaggaagccauuggagagagccacagaacagcaguauauuguauuaaaguuuugcuugauuuagggcaugguguuacauuuuggggguaaaauauauuuauaaucaauauauaugaauaagagcuuuugaaauugugaucuuuauagaaauaauccaucugugcuccacuuccuguuuuauaaguaaggucauuuaucauuucuuauaacuugacuauugggaauaagcuccacugucccaauucuagaguaguucuugcauuuaaaacaugcaagcuagcuguaguguuuuccuagcacucaaucggcaaagacgggcuauacuuugcugcauaguaaguuugaagccagccugggaugagacccuuuucucaaaaaacaaagacauucaaaacuagaggaauuuccccccaaaaauguaaguuuguucauaguaaaaggacaccucugcuuuuccuuagaaacccucauaugccucuugagacauuaugcugugggcuucugaggauaugaaaagaaaugaacuccuauaaagaggagguuuucagugagggacacaaaacaucuacaaagugaguuccaagacagcuaaggagacagugaccauagaaaaaccaaaaaucaaaucuuugguguuuuucagggccaagaauaguuaaggugucuaauuagccuuuuagaagaaugcgauuagacagugagaaaugcuuacagguuugggugugaguugucuccaaaacuggagccuucacuuaacuuuuuacacuguacaacugugaccuuagauuuuugcagacaguggagacauagcguugacuaguggucuguagauuccugggaaggucaacacuguaucaugaucaaggaauggcaccaguuaagucucuaucugucuucuuuaucuucuucauagugagaauggagccagcuucacucaagacaacaaacaugacuuaaaauugacauugagaccauuucugauacugacaaaugagaaaguuccaccuagccccucugaaaugaagauagucuugaggaaaaacaguuggacaguugcuacuagccaaguuagcuauucauggcauguauuuuuaaagucagaacuagaagauuagcauuuaggcuuguauauuuagcuguguuccugaaaaaugaacauacugaaccuuucacugauaguguucacugcugaugguaaauguuuaaaagacaaaauuagaauuucugaaaacuuguguuucaacaaacuuuaaugguauugaaacuagcaaaugcauggauauuuugaggucuguggaauuuugugggucacuguugaaaugaccaauacacuggcauuacaaaaucauuuugugacucuaagauggggcagugguuuuaacaguacaggaugcauggguacagcugaggagccuacacugccuuuaggaaacuuccacauacaguaccauacaguaguaucuaaggacagccacagugauuuggaaacucuucuuucccaaccugaaguugacaugcucagcucaaccauacaacagacugagcagacacgcuaacuggcuucucuuaagcuagacguaaagugauuauaacacuguaccaugcuacucuucucccaggauuuauuuuucuuaaaauauguuaaugaaguuuuuuuuuuuaaaaaacaaacugccuuaauuuuuaauguaacaaguaucaaugaauauaaccuagguaauaaaagcuuugggggcugugcuuuuaguuuucugaagggggagugggguauugagaucauuuuaaaacggcuggccgaggggaaaaugaaucaccuuucagcauuauucauguuguucauggugucccagagaacagaaagcagacauugaaauaccaugucugagauugugauaaggagacaaaagucgaaucuaccugguguauauuaaccaccccagugcugccuccugggagggaaggcuacagaauuuuacaacauagaucaagaggagccucuaccuuuuguucucuggccaagaugggagucagcuccugcuaugagaguaacuuugaagagaagcuauguaccauuguuuuguccuucagacuaacccaaucagagggcaaguuuguucuuuauguacuccauagaaaaggucagugccaaaaaggguuuuuuuuuuuuuuuuuggccaugaccuuugauuaaagaaaauuuaguaucacuguuaaggacauauaguuuuuucaaauuauuuauuagaaugucugacucaaggaacuagaaaaccaugccuccaaauauuguacaguucaugcuugacaugacacuugaaaauacaagacccagaccuugaacuaagguccaaagugggacaguaacuggauguggacuggggacagcagcggccugaauggccagaccucagccugacagaccuaguccacauuccuguuuucagguucagugccucagacucaaucugaaucacugucugucucagcuucuuucacauccacacugaacuuauacuccuggucacagcccauguaugcgucacucaugaaguacaggguauaguuguggccaccuguggcuggggccacaaagucuagcuucaccuagagagaacaggcagaaaucagguuaguggggaccugggaggaagcagcccuaugcagccccagggauaggugcagggcaauugcauacacucaccuuggcuuucugcugcagggucagccucuugauggagaugaggcuguuggacuuggcgucuccaaucacaacccaccagcccucuucacguuucuacaaggaccaaaaccaacaacuugagcauguaaaacuugauggccacaggcaagugugagaguggcuaugaaauagaguaacagaacucagauuaaaacucuaaaaguugccggaacacuugaagagguuuuuuguuuuugaugugggagugcucugucugcauguacacc

SEQ ID NO: 1062 - RNA, 13237 nt, Mus musculus
cggagggccggagaagaaggaggcggggguggggugggguuggaggaagccggaagugcaucggccaggguccgucugggcguugcggguuuggggccugggaucguuuggcccgggcagcuaagaagccugugaccgggcggagcggcgccaucccagcccugaggccugcugaccggugaggagcagggacuagaguagggaggguuacugaggcuuaggucgcaccccaaagugcggauucccgaucucggcggcccagcugcauccuccgccccucagcaccccucugucugauaacccugguccaagucuccuccgguccccuugccaguagccgauccccucccccggccccccaguaccuccgcccguucauccuggcaugucuacagccaauguaguccccugccaucuccgagcccugauccagcaccccucauccagagcccucgguccccgccccccgaauucccgcaguccuuuggucugugcucagcccugggucccaccccgcagucucuggugcgggcccugacagcuccgggccagccgcccauugcguugcucuccaccuggguacagacaggcucugcgcgccccgcugaggucggcggccaccaccaacgaccgcagagcuacagcgggcagccccgggcauguaugccccuggaggugccgggcugccgggagggcgccggcggagaagcccgggaagcagcgcucuucccaagcagccggagcggagccuggccucggcccugccuggcgcccuguccaucacagcgcugugcacugcccucgcggagcccgcuugguugcacauccauggaggcaccuguucccgccaggagcugggggucucggacgugcugggcuauguaaacccggaucugcuaaaaggugagagcgcugagcuccugcucucuuggcuugaggggcggugcagaacagauaugaggcuggcugaaguauagauagccagaggcagucauuugucaaaggaaacagccccauucuugcuugguguucaugcccaccagguggcucuguuugggggucuagccucucauuaauuuugauguuauucagccaagcaccuacuccucaccgucaugcuaauccaaacugcugcuauuuuagguuucugccagagguagguagaagaaaaaaggguguuugucagguauuacaauuagccuccccuuucuaacggacaugugagaugcagaauagucguuuggggcagcucgaucgauggagaaaucagaacuguuaaugugaccaauuguaaaagacauuuuaguauucuaugauaauuggauuuacaauagaggggacuuguggcaucccaggucaucagauaucaguucuauuaacaccuucaacaguugaaacuugguuuuccaugccuuuacagguaugccauauuaagacgguugcuuuauucaucaacagauuucccagacuagcaggcagaagaaagcaucuggucuguuuauuggaugagauaggagucuagggcuuagaggagggccugacucaggagccuccuagcuccuccucgguuucuaggagugaggagaaaggcugugcaguaugaaagcagaaauguccuuccugauuuuaaacauaaaaguggucagugggacccaauggucacaucuuguugccuucaaguccuuugaacuagucucaaaaguccucaccuuucuucuuugacacucuuuaguucuaguauguuccuauuagauaugugcaaggugucucaugaauggcucaggcccuaggauuuggugaaaaggucagcgccccccucugcauugaaauaaaaacccugcuguaggucuaugcugagaagcccuauccugucaccugguggugucuuuggaggugaguucuugaacaacuugcuucucuuugcauauuugcacauucaagacuuuaggaugguuuuuuauagaaaacaggaugaaagcuucugguugagauauuuuuuacccucuuccugaguuugucucuuuaagaccaagauuggggcuggugagauggcucaguggguaagagcacccgacugcucuuccgaagguccgaaguucaaaucccagcaaccacaucguggcucacaaccauccguaaugagaucugacucccucuucuggagggucugaagacaguuacagcguacuuacauguaaucaauaaauaaauaaaccuuaaaaaaaaaaaagaccaagauuauaggcuggcuagagguguucuuuagcauauaccugauggcgcaaaggcuguggaguuugaaucuggaugccuuuccauuucuuugugcucaccuucauucaggccuuguggcuuugauaccaugguguuucuguuucaggagcugagugucaccacaaacugggaaagaguuuaugaugcuuguccuuugcgggucaucccugggaugggagggucauagcauucaagagguggagagaggcagucugauuucauccuugugucagagauccaggaagaaaagggaagcgagcucuccaggcuugcccugcagagcggcaucgcugacacugccuccuaucaguugaugccagaauccuuaaauguuuaucuuuuguuuuucuucaucuguuguaaagaaggauaucaugacacccuguguguacauugccaucagaggcauguuaaaagaaagucaguucuugugcaagucucuguuuguucacagauauauuugcccuaagaaauuauccagaccuucucaaacguugccuuaaccauuccauugcauuugcuacauuugcuacauguuucgaucucuuagccugugugcguuugccuucucugcccacuuccuuggccauggaagccaggaucacuuggcuccugcuauaaauaggagcauuggcaguggggccuugugagccacugcagaaggcaaggaaucuggugucuuggagcuucggucuucugcucucuaccucuguguuuugggugucuaguagacuuucaggcaugugguauccuaugugacuguugauuuuuaggccgaccagauaaucuacucugagagucuggaauaguccaguuccagaaaggaguaguagagcugugcugggcaaauaugguguuuauugauccuugcagagagacucuuccugccaggacucugcagguaacagagugaggugggcuagaaggcuccaaugcgagcaguaccaggcauagagcuaagcacacuucacauuugccuuaauuucuuauucacaaaugcucauguuuaaguaaaccuauucagagacacagccuauccaaguugugacucugacguccacacucuuaugugcccucugagauucuuuuccuuucuguuagaacuauguucaauuuaccauuuacuguucauugguuuuuguuuugugugugugugggggggggaguguuuguuuuguuuuuguuuuguuuuuguuuuguuuuguuuuuugccaguaaagaaaagcuuuuauuagggcugaggaaaugcacacacacaacaaggcacacaaagaaaaagacccuuuucaaagcacaaaggagguuugggaagcugaagcugcuccuguuaguuuuuaucacaagcccaggcagagcuguguuuuuuagcuccacacuaucucucaaguuucaaccuggugaaccugaggcagaaccacucacucuugccaugugaccagauccgugaaggcuuuaggaaaagccagcucaacagauucuuuucugaaucuucucacacagcuucucugggcuuagguccagagaaagcuuagaaacacccagacguuuggugucaggaacagagacccugaaagcccucucugacucucuaguguggccagcaaagggcagccccacuaccagcuucggaagcacuuuuggagaaugaggaagcuugggauuuaaugucaagugacucaaggcugacaacagccacuggagaaccaaggaucuuccagggagggccugugcaccugauggguggugacagauacuguugccaccaccaggcccuugggggcuguccucagguggcuuggccaacaccauugacaucuguaagaugucaucuggacacuagagcaagcuguuagugguccaugucagguuuggcuuaaagccaagaguugcagugagggggugccaagcugggagaaggugcucagagggccugggacaguggcaauuccucuagcccacuugaaccccuuuguggaaggaggaaaggaagaacaguaggaagcuggucugaaaccaccuuagcuuuacugccuucagcacacaugggucaggaggaggucagacacugacagguagacaggaagagacagagcauucaaaacaaauccagcccugugacucaccaaugaccuuggccaaagucaguuccuuaggaucuuauuacauagcagcugccuucugcgacgacuagaagggguagucaagcaguguuuaccaaaauaaacaggccagaacacaacuggagggaagacacaacauacugugaaauguaguguaccaaacuacugguuaaacuuaaagucaagccccagccccacacagucuuucugucuuccacaagaagucgaguguaucuaccuaccuggcauuggggacuuuugugucucuguccagauauacucagaugcccuuggugcugcagagguuuaacaccauaugaagccaguuuugucuuaagucccuguaugaucccucagugauucacacuuuccaugccuuuuuguugcuguugcugcuccugcugcugcuagaguggguuugaguccuuacacuacuuuuuucaugagcucagcagcugcugucuuggacagcauucauacuaguccaucugacccuuuuuuuuuccaauauaccuccuuagaguuugauugauuauuuccaucaaggaaauaagaaaagcugccagugagugcuuagcgguuuccaagcagcacagugcagugucugcgggucgcugugugaucuggaggaaguaagucaucuaaccuucuggagccucugacuccucauuugagcuguaugaugcagugucugggggucacugugugaccugaaggaagucauuuaaucuucugaagccucugacgcuuuauuugaagaaucacaugaugauuuccaggguggcagucaggcuuagcaaaaauaaugcuugaccaucugugugcacaggcuccuggaccuucagccauguuugcaucugggaagggcagacgaaggggagucuuucuugaagcucuaucaaugugcauaucuuguuuauuacaauaaaaguguuuuaaaauugaaaagcacaccaggcgguaguggcacacaccuuugaucccagcacuugggaggcagaggcaggcggauuucugaguucaaggccagccuggucuacaaagugagccccaggacagccagggcuacacagagaaacccugucuugaaaauacaaaaauaaagaauaaaaauugaaaagcacauaggugugaauacauauuuuuaacgauaauaaaaagaauauccuguguucagccaucaucaaaaaccagucuuuaaaagguacucugcccccuucuuuacacagugcuugguaaaagugaguaaugcaagugaacugcugcaaaguggccugugaugucagcccuuauacccugccucuggcagggauuuuuggugguacuagaauacuuagguuuugccacagcauucccacaugccaugcagacccccaaaagaacugaucaguuuucaauaauguucaaaucagaaccaggaaucagcccuucauuuuucaagccuuccuuccuaggccccuuuagaauuucccugagucugaaguaggcagugcuagauacagugauaguugaugcuggcuucuggcagaacucauggacaggcaagcuccauggcaguagguaaucacccaagcuggaugguuggucccaaacacaugcucggcaguuaagaucaugaccgauagcucugaaggcagccagauggagccaucugagucuugucugggucuagccagcaucuaccuggaaaauuugagucugaggcuguaaacauaucagucacaaaaugcuuggcaucucccgcugcccaagaucccaugauaggcugcaucuacuggauugaaucuuuuuuuuguuggcagugggucuaccacuuagcuccuuggacuuucuuccaucugucuacauucuugugguguuugggaaccaaguacaugagugcagcagcaccucagugaucaggauguauguguacuagaaauugaaaauuguuaccuucagauucagaauuugacauuaaagcucaagaaaggagucuguagccuauaaguuugaucagcucaaaggaaaacacuuggcaauaaaacacacccugccuuuggcuccuuuuucuaucagccuuauucucuucuaugcuucggaggccaucacaguuugcauaccuucaaaggagacugacaguauuauuuaacugaaaaaaauuuagaaaguuauuuaaauacuguaaggagauacaaguuguucuguuuuggugcauguuugucacccuggggacuccugaauguugucucuccuguuuuagcauuuuuccuugguuuccuccccuuuuugguagcauauacgugcugucguuucugggucuuccagggccuugugguaugacuuccuagcuuuuccacggcugacuugcauuucagcugucuaguacuaaccaagucuucucucccucuuuugugggggcgcuucuagaaguggggauugagacagggucuugugaagcucaggcuggccucagauuugugaguaaaagaaacuggccuugaacuccagaaccuccuggcaacaccucccaagugcugugaugacgagggugagccaguggccagcucagcaguauggacucacauccuuguuagucuucaccacugucuaguuccagaaccuuuucaugaucccaagcugaaaacccacagcuaacacacugcuucccuuucuccagcuccuggcagccuucagcucucugugucaaugacucugacuucuuggcaucucaugaacauaaucauauaaucuuuggccuucuguguuugacuuagcuuacuucacuaccuuaguaucuccaaguuucaaugucuguuuuggaaugaaaaaggaaggaaagagugaauaaguggaggaugagcaguuacagaggaugagcaguggaggaugaaacagcucucucuggcuguuucagcucagaaaucaccgucuggccuaaagcauccuuuagcaaaacagcuuaaugugccaguuuaauugucaggaucuugaaaaacauggcuuuaagcuaggucugguggcacacgccuguacuucaggcggcugaggcaaaguuugaagccagccugagcugcacaaugagacuaucucaaaagcaaaaggggugugggagugggcacugucagucuggaaagagucgggcauacaggaaguccauugguuggugccauaaaguuaugugugauggugcaugccuguaauucuagccccucagagguugagacaggaaggucacaaguucaaggucaucuccuaucccugcuuagcaagguugaggucagccuuggauacaugagauccugccucacaauggcucagugguuaaagagugccgacugcucuuccaaagguccugaguucaaaucucagcaaccacaugguggcucacaaccauccguaacgaaaucugaugcucucuucuggagugucugaagacagcuacaguguacuuauauaauauaaacaaacaaacaaauagaaauuaaaaucaaagagcaugacaaugcaacauaacagucagccuagacuaacuaaucuuguuggaaauggacuugagguguacagauaacuccaguuugcagcagggugucaggagcacauacuaugcacuccagggcuucugucucccagagaccccagggggaugggaaccaaaauccuuucagguacauugcuugccucaggguguuuuuugggaugaagccaccauucucuguccacagauuucugcaugaacccccagacagugcugcuccugagggucaucgcugcuuucugcuuccugggcauccuguguagucucucugcauuccuuuuggaugucuuugggcccaagcauccagcucugaagauuacucgucgguaugccuuugcucacauccucacugguaagcccagggucuacucacaagggagaggaccugcccugaagcagggugguacaugggacuguuucucuguggaaagcuuguuugauaagcuuuagcuuuucagggccuggggugccuuaguguuagugucuaucauuugugaguaacuugcccaguauuagagggaauguuagaacuccacaggaaucucaugacucuaaaaaugacgauuuaaguugauaggcauucagggcuugauguaaucauggaaggaguugggcugucugccuggaguaugccagcagagugugccuggugugcaucgucagcuucuccccacuccuugccaggccucuuccucugcugugucuagccacuuuccucagccaggccugggccuauguguugauuuggcuuuugauagugauugacuuucaguccuggcucaauuucuaaaacuucacgaucuugucuguuccuucuuagugcccagaaccauccaggagcuuuaucuaguuguauucuuucuucuuuuucuuucuuggggucaugggguggugcuggagacugaacccagggccuuguguauguuaagcaagcugucuaccauugaacaguaauucuuaagauagacgcuaucuacucaguauggaucagagaacuguccauggcaagagucauauagcuaagaaagcucuuagggucuuggcugggcaaauccuuugagaccuggugagagguuauaauuagcuccuuaagcauccuaucugcugacccucaucugugcugucucucugucucccaguccuacagugugcuaccgucauuggcuuuuccuauugggcuucugagcucauccuggcccagcagcaacagcauaagaaguaccacggcucccaagucuaugucaccuuugcuguuagcuucuacuugguggcaggagcugguggagccucaauccuggcuacugcagccaaccuccugcgccacuacccaacagaggaagaagaacaagcacuggagcuacuaucugagauggaggagaaugaccccuacccagcagaguaugaggucaucaaccaauuccagccacccccugccuauacacccuaaugccagccggggcucucuuccucagcagcccaucccccagugccacagcuccucuuacacccagaggagccacuucccccagcaggucucauugguaggacccugaccaucuucaccaaaucuuccccaggagacacucugccuuuagguuuguccaugugucccugcucugcagagccgggacucugauuucauauaauguacucuuuccccucccaguacccucugcuccuuuccuauucacuagcuccuuccaaccagggauggucagauaaguuuccucucucugugggccaugucuuugggacugggacuuuccuuggguugcugcugguaguggucagucccugagagagguaccaacagagcacaaggggaagggacuaugccaugcaaguucacuuugccaggcccagcauuugugccacuuguguaucucugggcugacccucauuccuucuagagugcccaggcccaguuguccacguuguggauucucugcacuuuagucuccaggcacuccucauacaugaucugguuuucuggagagaaggaaucacugcuggggagcaaugcaacuguucuccugcccugcccuggcuuccugugguuagaaccaggcaaggaagcagaaccagacaagagacugcuccuaucaaggaccccagugaaggggacugagugcccuagccucuucaccguuuaaugugagugguuuugaaagaaaaaaaacaaaaccaagcaauagcagccauacucuuucuaaaauagggauaaggcuguuguuguucagaaauguagcccaucccuuauggcucugcaauauuuuggaccauagcacccucugagccuauagucacgccuucccaguuuccaacaguaugcaggcuuucuguccuggcuccuucuuccaggcagcugugacucccuggggccuuucuguggaacuagggccacauggcccccacggggcugagaacuauggccugcuggcuggccagcguggugcuccucagaacuauggcacugagauguaaccuggccucaguucagggacaggggccaagcagggcaggacccuccacucuccacauagguacuccacccagaggcccaccagguuggugucagggcccugucagaugugcaggccuggcuguagccuucagagucaauguggcccuagacugugacuuggggcuacagcuugcugcaugccccucuuccguuuuggaauguaugcuggucuuguggugugcuacugggcuguuacucuagguauucuguuugccuuggguccaguuuuuuuuuuuuuuugagggggggggguguuggguuuuuuuuucccuggugaucuggggcacaagguagguaagaccugagaggccugcagcauggauccagguaggcaagcuguucuuguuccguuaugagcaucucuggaguaauagucuaguguuagcugaagggaagaugaauuccaaucucugcccucccauaagacaacaaacauuuugaacaagaauggagaaugaauacaguuguugaccugugacuacaagaagacugucaacucgccauucuuuggccagaaagaauggugaauauguggacaaaugccuaugcagaugaagaccaagcgugcccacaagaaggcaucugcuuggaguucccugcugcaaugccaaagugugccccaguaugacucucccauuuucccagaccccucucggaggcaagaaaggcugccaggugaugccugagcacaaagucaaggagcuaaauuaaggcuaccuuucugugaaguucugagcucaucauuggcagguugcugaaguguguagccagcucucucuaacauggcaccugagggagcaggccagaagaucaggcaccaaacaugcaugccaaagugaaugaggacuugauccugcggaccguuccuugugauuuggaacccacuuuuuacuagcuuccuguuccugggccuuucuuccuccucucccugccauucugacacugauaguuugucauauaaaggucccugguuguguuucccccccaaggggaaaaauuaaaaugcaaaacaaaaaccaggaacuacaaaugagaacgcaaaugccaguggcugccugucauuucuguuacaauucuccagauguuuguuuucuuccucccagagaagcagaaggcauucacugacgaagcuuguaauaugaaacaaagugaggagggacuuggcaugcgccugcaccacgcacauuuggauccuugggagccucccacuccuggcaccuuucacagaggaaguucucaaagcccacagcuagauauaguagguugcucugcccaaaaucucaacuacagaccuugagccgccucucucugcauguccugauuagcugcagaagagcuguuucagaccucugcugguacuuacugggagaagccugaaaauaaaaaugagcaagaccugcagagucgcucuuccaggcaguugaugggugauaccuugauggcuacccacagucuuaguucauucauucucaacccauacacuggaccccaagugugugaaagcauuuagggcugucuuugggaaauauuccauuccuagcaggaugcaugucuuuccuggaaacugauaaucuucucaauacauguucguucacacacuuauaugaaggguccauuggauuaugcacaaaaugaaauuaugagccccaugaaagaaauagagugccugacaggaccucucuccuaggauucuuuccuuagcucaggagauggacucagccacaaggaaacagugaaaugaguagucuccuggacacuuugggaaauccugugcuagaaaugggaggcuggaucuaaccagaaaaauuaccaacgucuuccaggugggaagcugauggagcuggguuggugugcgagagcauuucagggaggggcuguucccucugagggaauggcaguaguggucagguuguagugugaagugggacgcugaaggccuaucugauguuucucaaagcaaugggaagccauaggagggugcuuaaaaaaagggauccaguuuuauggugauguggaggggcuauugauauuaaguaaaguaccugaaagugugagaauuggggggacagguauacaucauguggaggacccucaggccugguaggaggagagaaugaucacugccaggugcugggguagagagcccaggaacauccuugucauaugcacuagaagaugggaucaaccuuguagcucaagugugccucaaaagagagcuauguuggguaaggacagcagagagaggccucugaaaacacaaaguggcuguuguaucugggggaaaggucauucucucuagaugacuccaaaaucuccagcugguuucuuacucagagguaccugggccaggacaguauggaauacaagguucuguggggagaaaaaaaagaacuaauaaacuuuauagccuuuguuuucaaauagccuguagucuuccugugccuuucuugugggaguaccauuguaacuagcucaggcaggacauacagagaagaugacuccaaucugggugaaucugcuugaaaugagacaaacucuuuggggaugucaguuccuuaugagauguggggaaaugcuugacuucaauccuggaauaggggcucuuucuucagaagagauucagaguggacuggcuuguccguuauacugagugggaaaacccaagccuggugaggugccuuuuccaaagaugcugaaggggagguagaggccaucucugcccaaucaugugucugagggguuaguuaauaaaagaacuuccaaagaggcuguuuccggucuacucuuuacauggcucucuca

SEQ ID NO: 1063 - RNA, 986 nt, Mus musculus
caugccuuuuugcagaagcggcugagguagcguggcuuccgaggagagcgccguugcacgaggcccucucggucccgacagcccgcccgucuguguguacggcgggaacucgcggggcccccgcggccagggcgcgggaagcaaagcgguggccgucccaggccacagcagaagcggucccgugcgccuguguccgccucucgcgccgagugcgcgcaaccuaaccuguuuguccugcccgcacucugauugggcgcaucucagaacccugggcgcucauuggcuaagccaaagugcuccuccgcccuugcuccgggcugccugguagcaagcuagguggcguggcgggagggccugucaagggcgccuggagagugacccucggacccggcggugcagccauuuagggacgucucacccgguccggaggagaggcacggucaggugcgguggcguuccguuguccugagaggcccggccuguuucccuguucucuacagucccgggaggggcggugcacgcccuacgugaccccgcaccuaucacagcccaggggcagcuuccuuggucccccuugcccugauuccccgagcccuccuaaguaucugcggcagggacgcgguucuggguuccggcuccgagagaguacgggugguccauccuuagggccgaagaacaccuugcagagaacucgagggcgggugacccguugcucucugaaaaugcguuaggccugagcagucucugacucggaggaggcaacaagguaggagaguaaccagguuucccaaaaccugucuggccacguguauguaaccuaaugguuacuacauggagucucaggauacaucaguauucuaagccagggccugguggcucaugucuguaaucccagcacuccagaggcugaggcaggagcauugccagccugagcaacagugugucucaaauaaauaaauaaauaaauaaauaaauaaaauugccag

SEQ ID NO: 1064 - RNA, 2221 nt, Mus musculus
guacugcucuuuuuuaaacaaaacacuguuuuuauugacacaaccucaauguucuauauaaauauaaagugcuguuuccaacgccccucccuggcccacagggccgggaggaaguuggggagagagcguuaaaugucaguugaacacaaauaacuuuucagcaccaauuacagcgagaugcccacacacacacacacaaaagucagauguccguaacaugacacacacgucacuuccuggcuccccugggagcacaaggcuuaagcuuugggucaagggcugcacaccccuagacaugguuucugcuugucacagcuuguuuucugagcccuugggugaccaagggcuuuaauauaguaaauuaauuaauuaaauuaauuucugcaagucgaaggagggagagcaaauaagggccagcccuuaugccaccucagaagagcaccauaucagagcagccgucauccuggauuuccuagcaccccagugggacggcaagaugaggagggaggagcugggccacagcagcuucccccaggagucagucaaagccagagcuguggguggggccaggcugggcuuugccucagugacacagcaccugggucuccagcuguagcagcugccccaugaaacugaaguugggggagaugacuccccgacguugcuuaacaaagucaaaggccucguccagccguacccgguggcucugaaucagguaugccaggcagaugguggcugagcgagagaugccagcuuggcagugcaccagcacccggcccccacuauucuucaccgagucugaaaaagaaauguggagccgagagucagacaggaagguggacagaggaaucaggugccuguaccuucuccccuacaguucccacagaacccugggcugaggcuccccuaccuaugaagcugauagccuccuggaaccaggcacuuaucuccaccaucugguuaucuucuacuggaaugcucuuguaauggaaaagacccucaaagugguuggggcagcuggcagagacauugagaacugcugugaugccgcaggccugcaggcccugaagaucugaggagugguugcagcugcccaaguacagguagggcaagauuuccacaggaccacccuggaggaggaaggggacgguggugagaccucacucagccuugugcuggagggcuugauccagacaucuuggauuggcuagaaacaagagaagcucuaggccuucugaccaaggacagaauuaaaagucuugaggccacaaggggacauauguucagacacuuugugccacauaugccuuaaagucuguaugaggauauauacacguucacaccauuugcaggucacacaaacacucuccacaucugggaauguauauuggaacacaccccugucuuuccccacuggcguucuccagaggcaucccucuagaaugcacaaugaagacaacaaauucgaauaucaacucaccuggucauagaucggaacccucgggucagaguugcuauuuucggccccagcaggaggcagggccugggcaggagcuucagagcacagauccggacaguacgucuggaagcuuuugaaaccgccugugggaaagacaagaaaggguaugauuagccaagaggucgggaacggggcacggaacgugggacaaggggcuaagagcgcggggcgcggaacaugggagaaggggcgaagggcgcagggcgcggggcgcgggcucaccucgcaagaagcacacggucgugggucccccgcgcaucucgugcugcagugcggcuagcagcaggugagcggggccguccggcgggagcucggccacagacgcgcugcuuucauccagcaccacggcacgggccagcuccccgcggcccaggcgcgcccggagugcgcggucgggcaacagacaggcgagggcagcggcgggggugccgcgcgcacgccgccgcagcagcgcguuccagggcaccggucgcgcggcgcgcacguggcuccggcagaaggccaggaacgggcggcagucgagcagcagcgugcgcucggccucccgcggcucccgcagcagcgcgcccagcgccgcgcacucuagcucgcacgccgucuccagccccauggcgaucggcaucgcaaagccuccugcuuccggauguccucucccucggcuccggcggcgcggugucuguguggcgggagcugacgguucug

SEQ ID NO: 1065 - RNA, 19022 nt, Mus musculus
caguugccaccuugcagcagucugacagaguugcuuccugaugaugaccuggaacgccauagguggagucauuuauagagagagacuaaaggauucuggggcuccugguucucaaggcugaggaguuuaagaccagcgguugccucuggugaggaccuucuucucucugaugggaauucugcugagucccagcaucucauagggcaucacauggggaggcaggaaucuugguucagguucuauaaagccagaguccuaucaggccccuugcucaaagucuccuuaggacagaccauaugaagcucaagaagaaggaugaccaaaguguggauacuucagugcuucuuagaagggggggggcaaaauacucacaggaggaaauauggagacaaaguguggagcagggacugaaggaaaggccauccagagacugccccaccuggggguccaucccauauacagucagacacuauuguggaugccaggaagugcuugcugacaggagccugauaaggcugucuccugagaggcucugccagagccugacaaauacagagguggauguggaugcucgcagccaaccauuggacugagcgcaggguccccgauggaggaguuggagaagggacugaaggagcugaggggguuugcaguccugugggggagcaauaguguuaacuggacagacccccuggagcucccagggacuggaccgccaaccaaaauaauauacacggagggacccauggugcugguugcauauuuggcagaggauggccuuguuggacaucaguagaagcggcccuugguccuguggggguucaaugccccaggguaggggaaugccagggcaggaaggcagaaguggguagguggggagcacccucauagaggcaggaggagggggaugugauaagggguuucugaaggggagaccuggaaaggggguaacauuugaaauguaaauaaagaaaaaaacuuaauuaauuucuucccaaaagucccacuucaaauguccaauuuggucugcuuuuccaccuguugaugcccaucaaggguuccauugcaaagugaagcgugcgugcgugugugugugugugugugugugugugugugugugugaaugacuaguucuguuccuuuccugcuuccucaccccugcuagucucacugcuaccucuaaggucugcgucucugaguccacagcugcagaagugguugucuguucucuucaccucuuuuguuggccuguccccuggagcucuugcuagcucugcaagaucaaaccuuucccccaccccgccccucagaggugaucucauuucuccuggagucucuauauucugguccaaagcucaagcuacuauuuccugcucauuuuccaaagaugcagcccucucaccccuccucuguaguuggcgcccugcucugcguccgucugaaucuugagaggcagaauguuccagaagcagcuuuuuaaauucucuucuuggccuaucuaguuccacccggguucuuccccguccucaauccagcaagauaccaccuuuugcccaaagccacucccccaaagaccuucuugccuccugcucugggcuuuguugggaguggccuugugccuaugcaggagucucauuaaaacguaguucucacaaucagcaggagucacagaugaagcugcugccgccccacagccaaauguucaauuauuagugcuggccacugggcugcucaggaacucuacaggguggugagaacaggggcuguccugaguguaaagugcgcuucuccugcagcugcugccucccaaggucaaaguaaagcuaaugugacauaacuugacucuauugcaacaacaacaacaaaaaaaaacaaaaaaacaaaaaaccaaaaaaacaaacaaacaaacaaacaaaacaaaacaaaacaaacccaagcaaagcuugcagaugcuuuacugguggugcccgcugcuucuauuggccucugacacccucccggucuguaugaaucuucuggccuuccgccuuuuuauucacagucaaaagagcuugggauugcucaagguucccaaaguugauccaggauuaacuagcaacacgaauucccucuuuugcccaaacugcagccuucccggguuggggcuaagggugugcacugugcaugugugaagucaccauaacacucccacaucccggcauccuacacaucuguuuuguuguccuguucauguuaguuagaucuuggaggucacugguuucggggacauuguuuguuuccccuucucuuguccuauagccucguggaauuuguaugagggucauguuaccaggaaagggacagaggccugauggaaaaggaugcacugagaaccucgccaagccccuccaagcccucagggucucacacuacaggaagugcccccccaaagaucaggugacaaacaucugccaaccagagcaagcagaagcuuagaacuucacaggcaucuugaaaugaaagggcucccugcaggguguguguuaaaggcucuagaaacugugguggccauuuuugccauccagggccaagcauccugaaauaacuaacuugcagagagguggagaucaaaagaaaccugacuugcugagaaaauacugcagagaaauagugccagcucccucugcaguucuggugucugguuaggccuaccgguucccuuuauaggccaacccauuugaauuggacuuuuugcuacuuacaaaaucgagaucugagaggucccaggaugaauuugaucagaacacagaacacccaacauccugucuuagccauccaagccuugcugcaggaggagcaggggccccucaaagaacaacacuauccacauuccaaagaggccucuccugccuuagcucucccagugaugaacugacauccaggccugcaucgccaacucacucccguuccaacucuaccuaaggucuaguugacuagccaagcugacacuaggacaccuaccucuucuaagacucuaggaaagcuccuugccuccagauagaaggaugcucaggcacagggaggauagaaaccaggggagccagagggagccauuguaucucccaggccugggguggaggccuccuguugguccacucucuucuugcccauuagaacugaaacaaagaaaucugucuauagucuuugucucccuagagauaacuuggcgaugucguauaacucgagaucaaaggaggcugaaacacaucucaaaucccacccuaccugagaacacucugccucaaauagccuuugcacaucucauguuccccaaggcaggguggcacuacugagaggcaaaaggacuuuaagggguagggucuggugaggaugucuuuggauuacuggggugugcccuugaaaggagcucuuucuggucucuuccaucccccaccccuccccagccaugaaagcagugcuuguauuucuuucucucuugcagacuuggcucuggagucuuaaagauggaauguuugucucuuuagcaacugggaccuuuaaaaccaaggccccaaagacccucucccuucucuaggcuaccucagggauuugugaugauaagaagcugggugaugggggggggaagguacaucaucaccuugcaggccugggacccucauggaaaggcucuauucuuuuucuggcccuagugaggcauaacggaaaaguauccagaaagagguagucuucucugcugguuggugccuagaacugaagcagcuauccuauaauccugggaaacuggucugagcugauccacuaaggagggcaacagggaauaaagauuggaccccuauugaugucacuacagccuugaacuaaccaggucugggccauccuacccauggacugauugucacauguguccuuuuaugguuaagcacuucugaguugagcuuucuugcagcaggaagcaucguacccagucccccuauuucugcucugcugagucccugcuucaauaugccaguguagaucagcaccccuacccuagggaagagcaacaauccagcuagcucccuuucacaaccccgcgggagcucagucuuguguguagcuggcuguucauuacagaaccgcagccacagagagccgagggcuguguucaaaccccuaggcugcagguggcuggggaagguguuaugaaaacugccuagagcagaucucagucuuccuaaugccaggauccuuuaaugcaguaccucaugauguggugacccccaaccacaaaauuauuuucauugcuacuuuauaacuauaauuuuugcuacuguuaugaaucguaauacaaauaucuauguuguuuuuuuuuuuuuuuggauggucuuaggugacccuugugaaagggucauucaaccccuuaugggguagagacccacaggcugagaaccauuugucuacagaaagguuauuuccacauccucagagccaaauacugcaucaauggccagcccugcuugccuggguuguaacaaugcaggcaaaggagaauggaggcagggccuggggaugggccagaaggcccucauggagggaguaggcuguuuuguggcuacugcucauuugcccacuguggggugaaagcaacuacugauuauagauauuugcuucugagcaagcauucucuuuauaaugcaccaggaccccuugagggcccucuccagagucauuaugcuuaaaacacacugauuugauccgggguguugcuaaggaggaaaaccaaaaagaaccuccaaguuccaagcaaucaaacccaccuacccugccagcuuguuccuuacugggaaaggacugggggucaggagaaaggccugggaggaauuacuaggguccuaaauaucuuuggaccccaaggccaccuacgacaaugcuaaguggaggauccugagaguccugggauggucucuccugcguugagcagacaugaaccauccuuuugccccucuuccuuacucggcgugccuuucccugugcugcguccucuggcuaugacccauguaaagcagccaagcaugcuguaugugcucauaagcacagugaaggaaagcagagauagguggagccuuugggcucccuggccagucagccuggcaaacuugguaagcuccagguuagagagacccagucucaaaauacaaggugggcaucucuagaggaguaacaucugagguggacuuuuagcuuccacagacacuaacacacauucauaccugcacccacauuugcagccaugugaacaugcauggaacacacacacacacacacacacacacacacacacacacacuucaaagucuuuccugcuucagcuucuacagaacuaacaaugacaaggagaugcuaccagcugcucucagcauuaauucugcuaccuuuuccuaccaacauccaaacucugucgagcuccccauucucggcuguggauugccacaguguuuacaagaccauauggaagauucugaaggaaggaagagaucuaugacauagaaaucaggccccaucaauggccaccucaugaggguggcuguccucagagcuccuggcauaugagaggaucuucuaggaguccuugaacgugucauauugcuagugagaagaaguggguaucccaacucuagaccugcugauaaaugcacccuuccucuguccucugucucaacucuugguggauuggguggugucugcacaaguuggggagaacaacuguucuuucauccacucuuacaauacccauucuucuagaaacacccagaaguaacaugcaaauauguguuccccacaggagggcauuuguccuuuugggcccuaggagucaguuccaugaguuaggaucuuuggggcaguaccuauguccagggagggguuuucucaguucauucaugguucaugggcugagcaaaggagaguuucagugucuccaaggaucaagucagaccaccagugugcauagcauuuggccugcaggucucaccauaucauguagcucuggaccugguccagaaugcuggucagaucuuuagcaucaaacccugagccaugucuacagaguaugcaucuuucaaugcccaaauuacagcaggcagcuguugccacugcagccucccaacacauccuuucuaaagcagaagugcagcugaggccugaacgaggccagaacucugcuaaauacagcccuggggcccacugucccuacccauggaaccuuccagucggaagcagcuauugugggaucccucucagaaugagaucccuccaagaaggugagaggugcucacaaccaaccacaaaagcucaccuuucuauccagauggugaucuugggagacaucuagauuugcacuuggagguggggggggggcaacuuacugcuucuaaauaaugggguuuccuuuuccuugcuugcuuuuuucaguuucugagucuucuuguuguggccugugcacuaugauacaaaacaacaguuaacaugggagccagauacaacaugugaagcuggugaugcuguuccugaggaggaagagacagaaaggucagguguucaaggccacccucuguuucauggcaaauuugagaccagccucaaaacacacacacacacacacacacacacacaagccacgaaagagacccuugggccuugagggacacaaaauggcacaaagcagggaacacaguggcuauacccucaaggggaaugucgguggaggagagguagagguuaggaauaagagccagcucuugggacccauggccucacagguucugaaacuggaggucagugggcugucacgugggcuggggguacagggaauaccuccccccaauuuauuuuauauugcacuaaccuuuuaaaguuguuauuuuuaaaacauuuguuuguguguggguaugugcacaugaguguaguuaccugaggagaccaggagagggugcuagaucccugaaguuggaguuacaggcagcugugagccaccugauguaguuguuggacccugaacucagguccucuggaagagcaauaugaacuccuaucugcugagucacuuucccgguccuguggagaccuuucagggcuggucucuugguggcuugcugcaacagugaaaugaugaaggaacccauauguccuuuguuccuagagugcucagagccgauuaccuaaaugaccccacucucaucuuuauacacuuugccuguugauguaaccaaacagcugaccaaaagccacucuaggaaagaagggcuuguugugguucacaguuugagggcacuggacaucuuggcugggaaagcauggcagaggaccaugaggcugcugaccacaucauagcuuggcaggaagcagaaaacagauaagugcuggugcucagcucagguucuccuuuaaaaaaacacacgucuuuauuuuguguauacaagugaggaggucaaaggauagcuugggguaauugguucucaccuucugcuaugggucuuuaguucccgggacucgugagggaccacugcgcucuuguuaacuccaauuccagauccaagcccucuucugaccacacaugugcauacccccacaaagccacacaugcacauauauagaucacacacacacacacacacacacacacacacacguaauuuauuuugagacagagucucacuauguaguucugggugaccuggaacuugcuauguagaucaggcuagacucgaacucacaaagauccauccgccuuugccucucgugugcugggaugagagguguacacuauccuccccacauccuuuuuaagacuccccuccuuggguccuuugcauuccacacuuccagauuaggacaagcagguuccuaagccagaauguccucuccccaacaaacucucaacacuugcagcgaguugugggugaugggcguggagggagcagugaucaugugguacaggcagcaaguccagcagagcauauagggugucaagggauggggcuucgagccuagagcgcguucugauuggcuggccccucagcugcugaggcgcaugcgcagagcccaguuuccggcuucgucggcucagucacacggcuguuuggcgggaguuggcggcuggugugaggugagcuuccugagacucgugugccggauuggaccaggcuggguugggcugggcugggcuuggcuuugggucaggcagggacugauguggaacucgggcuggugggcgugucucacagacaaacagucagaggcaagcugguggcccuggagagccccacuuugcccuuugcuuggcuuguggcaccugagacucagagagcaggcaaggauggacuuccggugccgccucggagacaggcccugcccuccaucuugguuuuggcgagaaccuuccuugcaggcguagggguauuugcugcagcugagaacuuuuuaaaguuaaguucugugaugguuaguagggcaggaacauuggggauguguguguugcauuuuagccuuuggugaagagcuacauaagagccaggcaccaagugccaccuguguagugcgggugggaggacucagaguggaagggacguggcuucugggcgcccccgagccgaggcccuguuggguaucugcucagauaccacaucucaaaguuauuuuuacagcagcagcuggaaacccccgcucuuuauauaacaagcucucugcuuuuaaacguuggccuuaauuccuaauguuuaagcacgucauauagucagcgagaagaugccugugaacuguacuggcccucggggaagagugugcaucuacacagacugccaguggcccucacuuagggaucuugcuugccagaugugucuguaauagugguguuugagaaacagagggaggaggauggagaauucaaagcuggucggggcaaaauagcaagacagugucuuaaaaagcgugagugagcuguccccaacugaccuggauuucaugagcuagguaguuggcuuaauuggcucaugagaaugcuccaugccuugucuuuuaaucuguuauuuuagggccagcauuggucggugggguuagauuuugagguuaggagucucaagcugaggagugucaaacgucuuccuugcaaaggaggcaggccuccuuacauugcagccuugaccuugggcuucucugugcuuagggucugaauggggcugugagaacauuuuuuaaaguaggggaugcaucugaaaugagaucuccagggccuguguauacaucaaucaggauccgguuacugcuuggcuucauggugcuaaauagcaccaaggggcagaggaggagcaccagaggaacccuggaaacuaagccacaggcaucuggcucuccugggcccuuuccauaccacuuaauugcugggucuacacaugaauuauuugcaauucuuacccucaggacgacuuucagaugaugugagggaagugagaugggaaccccgagggcuccacaaggcugcuuuucuggcugccuugggcccuggaacucauggagaaagaagaaucuagauguaucaugaacuaacaauuuguggucucaaaacucaaaaaggcacucucaggcuagcgugcaguuaaugugauugaguuggggaauaaaaagaauauaaauaauuaggccagucuguucaccauggacaugguggaagaucaggguaggggacccuuuugggcaggagucucucuuccacagaagcauaauggauccgagguucugcaagagggcugcucagcaggacuuagguuuauggagagaguauccuuuuccuuguauccucuucuugcugguauaauccagcccagccuaggcuuuuccuucuacacggagagccuuacguugccauuacaaucacaguugcuguuagaacacauuggggcauguggauggaagauagccacucauguugccugagggagccccugacuuuucaaguacagcucacuuccuggagggaccacuugggucagugacagggauuugaucagacugccuccagucuccuggcaauuguccucauugcugauggcuuaaguguugucugucuugggguagacucuggcaucaccccacaaaaccuuggauuauggaucagauuccauucuuuuaguuuuuuuucuaggucaggucuguguggagagagacacagugcuugauucacugaucuuacagaccuucauggauaccauguugaaauccaacccccaaacccagcagaggaguaaccacaauggucaagagguaguguggaauucuuacacccuugcccucccacuugcccucugugaccuccacuccagaugugcuccucauucugucaaagacccugaguucgaucaccucucuuguggcccuuuuccagaccagccuuugguccucaagcuuugggaugaagauggaggccaucacuccauuccugggaaaguaucgccccuuuaugggccgcugcugccagaccuguacuccuaagagcuggguaagugaugguagggaugggccucccuuggaaaucuuaggcuggcuugguccugggagugaggauccugggcagcugccucccucucgucuucccaagccucaucuuucacugcugcaugccuuugccuguuagaggaauggauauaguggggucuguuguugggauggggcuuaggagaguuggguaggaggccucaggagagcuaggcuaugcccacaaggcuggaauauaacugacucuguucaguuugggaacagugcccacucagacucccauagcacucagcaucucuugcaugucuguaucauaugcugguaccaagaaggcucagcauucuaauggagauucaagaugcacauuuucuucuccagaugagguaauaccccuacucagggccuuaaugugcuuagcucuaagagggcaacuccacacaaggggacaguggugucauuuuaagcauggagcccuuuucuuucugagccaacauuaugaucugggguagacagcucaugggaaauguacucuauaccuucuucugguauacucaaaaggccaccaggcagaggcuagauggauaggguacagaugugacuugcaaaagcacccuaggacaugcuguccuucccucuuggacaggagucccucuuccacagaagcauaauggaccugggcuucugcaacgugauccuugugaaggaggagaacaccagguaguuggagcuguuggggcaggcaguggguugcaagggccuucuguggcaucacuuucuuccuacaauggacaaaaggagauccauagcaaauggaggcaagcuuuacuccccugcaguuccuucuaugggcugccuguaagguguagagccacugugcccccucaguggggaagcagggugggacuaaggccuauauaggcaagugaguaguuuguuuguuuguuuguuuugguuuuuuuguuuguuguuguuccauggucgagcuugguccugggauaugagacuggggugcaaacccuuccugaugaauagacagaccucugugggcucuggggagcacuuucugaacugucuucccccagguuccggggcuggcugguucgcaggcucugcuauuuccuguggucccuggagcagcacauacccaccaguuuugaugccucccagaagaucauggaaaacacugggugaggaggcagaucagagucuggcauuugugggauacuuaaaggggugacaaaggcuauaggucaggauggccagggcuggcugggcaagacuucuggaauguuaucucuguuugggcccauaucagacuuuucuggcugugcacuggaggacugacuagggagacuauugguauuuagcccaacgcuguccccugaccucaacagggugcagaaccuccucucggggaggguuccgggagcggcuggagaaggccaggcgccugaauuagugaagaaagagguacagcguauccugggccacauucagaccacaccccgccccuucuugcucagguaacuauggugaggggcaugcauccuuagguugaggccucugccccuucuggagaguggaugccggcugggcuuggacaaucaccagauguucuucccgaguauuuggaugaugguuacagaaugggcuacagccgacugcagcccuucccuggguuccuacagagcagaucugcaugcuuagaugcuggggauuaaagagguggacagugauacagcuggucaaaggaagggacaaggaaagagccagaauauccaggagggcggacauuguaguuagagccaggagggaagaaagccagcccuggaggcauaggaguaaaaguugaggaaauggucucuuuagagggaaaggccugagucagggccuugagcaggaaagggccaggcucacugaagauguaacaagguugggagcuguggaagcuggugagugaagaugagagcagcuggagaaucugagacgugaaaggaaccagaucagagccaaauaaguagaggcuacucuaaggguagucagaacggcucaacaguuuuaaguggaaaguggcagaaugaugggcuuggcaacaagaguagaaaccagagcaucugcagagcugacugacaggcuggaaagacuagauugagaaguuaaggugguaacucaggggacucacagauggaccaaaagugcugagaggaaacgggaaaguagugagauaggaaauccguuucuggccuaguacccaguguguauacaagagggucaggcuucaugagaagggagguggccuuggauggauguuuggauucaaagaguuccaguaacugacuuaaugacuugguugucuguauaggccugggagcucagaagaagggacauauauuugcagagcuguaauauacaguuuaugguuaaagccggagcaugaguuaaggugcugaaggaaaagggcucgggguugggugucaggcucagcugucuuaagugaaaaggaagcacaggcuguuggugaccuggaccaauccuccacuguaacaguucuucccucgauugagguuuucaggcccuaggacucaugcccuuguguaggagcucccaagcgcaauucuagugggcuuccuaccuccucuguacaccuaaguaguaagguagguuuuuuuuuuacaguacagcauuuacaggggcacgacauucuccuguguccccacauauugcugcuucucagaauugccccauuuaaugcuuccaucagauguggacuugcugcuuguccaccaguuuuucuguuaacuucuuugguaagauggucccccuaccgggcauaugagcaagugcagcaugccuugcccuccuuguaucauuucccuuuugcuccacuuuuccugguaguugguaaauauaggcugacuggguucuguguggaaagggucugguucuuuggucccccuuuagauaauggaggcagaauucgugucugaugugagccagcugcagcaugaggucuuagaagagucuaccucacaaguguacucuguggcaugaggacuuuauagcucuagcacccccuuagcaaugccuacugcucagcagguuguaaccgcuccacucacuuuccucuucuguucaaugugggcaaugauguugcuugucuuagaggaguucugagcaaccuuuuggggugcuacggggaugagccuuguagaagguggcccugcugcaccucaagcuggcauugcuuccaaggcuguucagcugggcacugcugugguuccugaaccgccucuuccugaauguacaacuucacaagggacagaugaagaugguucagaaggcugugcaggagguaagccagaccauacugaaugggcuuggauggccagaguguaggugaaucuaggcugcaucagcuguuagagaauccacauuuccuaaauaaccuugcugccauguuagcccugcugcuacagggucuccugcucaaccuucaguuucaacagccauugaaacaagccacuguauuuccuuuuaaaguuguggaaaggcugcuuuaccuuagggaaguuuaccuugcagaggagaagcccuuccucccucagugcugcccugggacuucaggugcugaaguuuggcuguguuuuuaggaugggcauuuccuucugucucuggagcagggcucuccacuugucuuccuuucuacacacaagucccucuuggauggauuccugcugccuuuuguacuguucucccaaggccucggugugguccguguggcuuuagacucccgcacauguuccccugcucucagguaugaugaugggagagggaggcccuagcuggagaagugggauggagguuauuuuguuuucucagccuauuuucagcuauggcagcccagcuuacagacucaaauggaaggguggcuacaggucgcuugggccauggcuacuucaaguuucuaaacagacagguguggaagaaucaaggccuuugcaggccucugggcccggccucuccuucagagccccuuuucauuacuguccugugcucacagagcucuauugaggaaacuugggggacuuuuccugcccccagaggucaaccucuccuuggacaacucagagggcauccuugcaagggcugugguccgugcagugaguguucccagugguuaugcguggggugggccaaggguguagggucugcugcugagcuggccuugauguccacccuuccucuccucuucuagacuguggaggagcugcuuacuaguggucagccucugcucaucuuccuggaagagcccccuggguccccagggcccaggcuuucugcccugggccaggccuggcuaggagugguaauccaggcgguccaggcaggcauuaucucagaugccacacugguaccaguugccauugccuaugaccugguuccagaugcaccauguaacaugaaccaugugagaccugggauccgaguagauuaucaaccaguucuggguggcacaauguucuguggcuggguuccuuuagggcugaagucagauugggaugugaaguguuuaagaacugucccuauagucacuauccuaaagggucucccaucuuugcuaucaccaucuuucaaaagaccccacaguacagacuguagguggaaagacaggacucagugaagagccgugaacaguguggagggcggaaaggguggcagccccgagacuugcccaagaaaauacaugugcagccucucauucccugcaggauuuggcuccccuggggcuauggacaggagccuuggcugucuuucggagacuguguaacugcuggggcugcaaccguagagucuguguucgggugcaccuugcccagccauuuucccuccagguaugaaaccaguugggaaaggcugggauuaaccuuuguggugguuuggccuucaaagcauuguaaggauaguauuuucucuuagaugguuuguguacagguuucuugggggugggguguggcaagggcagaccucacaucuuuauccugggcaggaauacaccaucaaugcuagaaguugcugggauagcaggcagacccuggaacacuuguugcagcccauugugcuaggugaaugguaaggagcacagauguaugggucucagagggaggcaggcggcucuucaacucugacuaucccagaacaucaacaccagauguccguauaguccaaauguaggguggcacauaggccuggaaguggggaggguuauaugaauucuccuaggacuugggaaaacagcuguagcuuugaaaagcuuuugacucuuacaacauuuuaggcccgcuucauucuuugaucugucuguaucccaguaguguuguuccggacacugagaaggagcaggaguggaccccaccaacuggccuccuccuggcccuuaaagaggaggaccagcuccuggucagaagacugagccggcauguucugagugguaagggaaacgcagagcugcaccuuuggagugugacuugaacagcacuuucucuguguagauaauaaagggcuaguuaucaggaccccauggaugcccguaccugacccccacccccuucacagcacacagggauacuggaagagcggggcauccagggaaguggggagcagaugagcucaguaucugagccaaaggcagcugugcagaucucugugagauccccccaaccucacccuaaagguccuuuuaacaguguccuuagcugugaggaugacugaguggaggagcaacaugugccuacagaaggcacgugcugacuggaugucccucuggcaugcuguugggguggcucuggcucacaaugcacgugauccugcucuccccugcuaggguagaguuuggguugugugucugggaacaucugucaaaugauggaggagagaucaaggcucucuaggccccucccaucagcaccuuccccucucuccccagccaguguggccagcuccgcagugaugagcacagccaucauggccacacugcuuuugcugaagcaccaaaagguaaggcacugcaugguggguggggccagggaagggccaggcguggcacucugcucaggccuguuuugccuccagggugugguccugucacagcuccugggagaauucuccuggcugacagaggagacacugcuccgagguuuugaugugggcuucucagggcagcugcggugccuggcccaacauacacugagccuauugagggcacaugugguucugcugcguguccaccaaggggacuugguggugguaccucggccuggcccaggccucacacaccuggcacgcuugaguauggaauugcugccaaccuuccugagugaggcuguggguggugagucagugggucagcaggauugggaugcaugugcaggggagagggagggagcagguccccuucuuaugccaucuucucugccagccugugcagugcggggguugcuggcaggcagaguaccaccugaggggcccugggagcugcagggcauagagcuacugagucagaaugaacuguaccgccagauccuacugcugcugcaccugcuaccucaagaccuacugcugccccaggucagacccccuccuguagcucagcaggaccuugggccuuguccuuaugaccuccugugauagugacuuuggccuccaaacaccucuggucaggauucugccagcagccccuuccccccauggguguucucugaagggcauuggugcuucucuuccuacagcccugccagucuuccuacugcuacugucaggaagugcuagaccggcucauccaguguggacuccuaguugcugaggagguaggcucccacuccaagugccaguguccuggacuguuucucugacccaggugugcucugggaguguacugccaguggcugggcacauggaagccugccugcacugggcaugugucucaugccaccuuggcauguguagcucuaagguucucuccauacugucugcuuccacauuucuuagugagcuuggguauuuggcccaaguagcucugaacagccuuuugggcuucccagaccugcuuugaccugccaaggccagguaugagggcuauagugcugcuuccugcccagccuuaccagggaccagaccaauaacucucccccagacuccaggcucccggccagccugugacacaggaagacagcaucugagugcaaagcugcuguggaagccgaguggggacuuuacugacagugagagugaugacuuugaggagccaggaggccgcugcuucaggguguguggggaggagcuaccuggggaggcagguggaggugaggugcaugggaaccuaccuugcucacucuggucucucuccagcuuagccagcaaucccgcugcccugacuucuuccucuuccucugccgcuugcucagucccauacucaaggccuucgcacaggcggccaccuuccuccacuuagggcagcugccagauucagguaagguucugaacacuccccuagcaguguugaguguggggcucagucccaaagcugagguauaggucuaaucucuccugcagagguggccuacucagagaaguuguuccaguuuuuacaggccugugcccaagaagaagggaucuuuggugaguuccaagccccaucccaggcuccccagggguaggcuugcuggugacugcugcccccugcugggaaguggcugccugacuucagggaagggucuuuggcuccaaguaggcccgaguuggucuuccucuuaaaggaaguccugccuaguggcucccugccugccucagagcuuuuacugccuuucuucccuccagagugugcagacccaaaccuugcuaucagugcagucuggacguucaaagaucuggggguaagaggccauaucaccauccugucucugaccucacccucagccccaugggcugcuagaacugcucaagggaaccaucuuguucccuuacccaaugggcagggaggggguagugguggaggcucuaacauccuaaugaaugauagaauggauaguuuuucugccuuccuaauucacaaaggaauguguguuaucaaguaguaacacacuauaucaaguaguaacacacuuaggcacugugagauaucuauagguuuugggggacaagcuuguuccccucagcaggggugcuuacaguccaucuugugguucagguacuucaggagaugccuagcccuacaggaccccagcuccaccuguccccuacauuugccacccgggacaaucaggacaagcuggaacaauuuauccgacaguucaucugcaguuaguaccagguggagccugaugggacuugucagcuuaaacucaagugugugucucugcucaggacacagcuaaccugaaccuguguuugcucaucauuugguguaauaaauagacuagguuaguuucuuccuaagucugaag

SEQ ID NO: 1066 - RNA, 19022 nt, Mus musculus
cuucagacuuaggaagaaacuaaccuagucuauuuauuacaccaaaugaugagcaaacacagguucagguuagcuguguccugagcagagacacacacuugaguuuaagcugacaagucccaucaggcuccaccugguacuaacugcagaugaacugucggauaaauuguuccagcuuguccugauugucccggguggcaaauguaggggacagguggagcugggguccuguagggcuaggcaucuccugaaguaccugaaccacaagauggacuguaagcaccccugcugaggggaacaagcuugucccccaaaaccuauagauaucucacagugccuaaguguguuacuacuugauauaguguguuacuacuugauaacacacauuccuuugugaauuaggaaggcagaaaaacuauccauucuaucauucauuaggauguuagagccuccaccacuacccccucccugcccauuggguaagggaacaagaugguucccuugagcaguucuagcagcccauggggcugagggugaggucagagacaggauggugauauggccucuuacccccagaucuuugaacguccagacugcacugauagcaagguuugggucugcacacucuggagggaagaaaggcaguaaaagcucugaggcaggcagggagccacuaggcaggacuuccuuuaagaggaagaccaacucgggccuacuuggagccaaagacccuucccugaagucaggcagccacuucccagcagggggcagcagucaccagcaagccuaccccuggggagccugggauggggcuuggaacucaccaaagaucccuucuucuugggcacaggccuguaaaaacuggaacaacuucucugaguaggccaccucugcaggagagauuagaccuauaccucagcuuugggacugagccccacacucaacacugcuaggggaguguucagaaccuuaccugaaucuggcagcugcccuaaguggaggaagguggccgccugugcgaaggccuugaguaugggacugagcaagcggcagaggaagaggaagaagucagggcagcgggauugcuggcuaagcuggagagagaccagagugagcaagguagguucccaugcaccucaccuccaccugccuccccagguagcuccuccccacacacccugaagcagcggccuccuggcuccucaaagucaucacucucacugucaguaaaguccccacucggcuuccacagcagcuuugcacucagaugcugucuuccugugucacaggcuggccgggagccuggagucugggggagaguuauuggucuggucccugguaaggcugggcaggaagcagcacuauagcccucauaccuggccuuggcaggucaaagcaggucugggaagcccaaaaggcuguucagagcuacuugggccaaauacccaagcucacuaagaaauguggaagcagacaguauggagagaaccuuagagcuacacaugccaagguggcaugagacacaugcccagugcaggcaggcuuccaugugcccagccacuggcaguacacucccagagcacaccugggucagagaaacaguccaggacacuggcacuuggagugggagccuaccuccucagcaacuaggaguccacacuggaugagccggucuagcacuuccugacaguagcaguaggaagacuggcagggcuguaggaagagaagcaccaaugcccuucagagaacacccauggggggaaggggcugcuggcagaauccugaccagagguguuuggaggccaaagucacuaucacaggaggucauaaggacaaggcccaagguccugcugagcuacaggagggggucugaccuggggcagcaguaggucuugagguagcaggugcagcagcaguaggaucuggcgguacaguucauucugacucaguagcucuaugcccugcagcucccagggccccucaggugguacucugccugccagcaacccccgcacugcacaggcuggcagagaagauggcauaagaaggggaccugcucccucccucuccccugcacaugcaucccaauccugcugacccacugacucaccacccacagccucacucaggaagguuggcagcaauuccauacucaagcgugccaggugugugaggccugggccaggccgagguaccaccaccaaguccccuugguggacacgcagcagaaccacaugugcccucaauaggcucaguguauguugggccaggcaccgcagcugcccugagaagcccacaucaaaaccucggagcagugucuccucugucagccaggagaauucucccaggagcugugacaggaccacacccuggaggcaaaacaggccugagcagagugccacgccuggcccuucccuggccccacccaccaugcagugccuuaccuuuuggugcuucagcaaaagcaguguggccaugauggcugugcucaucacugcggagcuggccacacuggcuggggagagaggggaaggugcugaugggaggggccuagagagccuugaucucuccuccaucauuugacagauguucccagacacacaacccaaacucuacccuagcaggggagagcaggaucacgugcauugugagccagagccaccccaacagcaugccagagggacauccagucagcacgugccuucuguaggcacauguugcuccuccacucagucauccucacagcuaaggacacuguuaaaaggaccuuuagggugagguuggggggaucucacagagaucugcacagcugccuuuggcucagauacugagcucaucugcuccccacuucccuggaugccccgcucuuccaguaucccugugugcugugaagggggugggggucagguacgggcauccaugggguccugauaacuagcccuuuauuaucuacacagagaaagugcuguucaagucacacuccaaaggugcagcucugcguuucccuuaccacucagaacaugccggcucagucuucugaccaggagcugguccuccucuuuaagggccaggaggaggccaguuggugggguccacuccugcuccuucucaguguccggaacaacacuacugggauacagacagaucaaagaaugaagcgggccuaaaauguuguaagagucaaaagcuuuucaaagcuacagcuguuuucccaaguccuaggagaauucauauaacccuccccacuuccaggccuaugugccacccuacauuuggacuauacggacaucugguguugauguucugggauagucagaguugaagagccgccugccucccucugagacccauacaucugugcuccuuaccauucaccuagcacaaugggcugcaacaaguguuccagggucugccugcuaucccagcaacuucuagcauugaugguguauuccugcccaggauaaagaugugaggucugcccuugccacaccccacccccaagaaaccuguacacaaaccaucuaagagaaaauacuauccuuacaaugcuuugaaggccaaaccaccacaaagguuaaucccagccuuucccaacugguuucauaccuggagggaaaauggcugggcaaggugcacccgaacacagacucuacgguugcagccccagcaguuacacagucuccgaaagacagccaaggcuccuguccauagccccaggggagccaaauccugcagggaaugagaggcugcacauguauuuucuugggcaagucucggggcugccacccuuuccgcccuccacacuguucacggcucuucacugaguccugucuuuccaccuacagucuguacuguggggucuuuugaaagauggugauagcaaagaugggagacccuuuaggauagugacuauagggacaguucuuaaacacuucacaucccaaucugacuucagcccuaaaggaacccagccacagaacauugugccacccagaacugguugauaaucuacucggaucccaggucucacaugguucauguuacauggugcaucuggaaccaggucauaggcaauggcaacugguaccaguguggcaucugagauaaugccugccuggaccgccuggauuaccacuccuagccaggccuggcccagggcagaaagccugggcccuggggacccagggggcucuuccaggaagaugagcagaggcugaccacuaguaagcagcuccuccacagucuagaagaggagaggaaggguggacaucaaggccagcucagcagcagacccuacacccuuggcccaccccacgcauaaccacugggaacacucacugcacggaccacagcccuugcaaggaugcccucugaguuguccaaggagagguugaccucugggggcaggaaaagucccccaaguuuccucaauagagcucugugagcacaggacaguaaugaaaaggggcucugaaggagaggccgggcccagaggccugcaaaggccuugauucuuccacaccugucuguuuagaaacuugaaguagccauggcccaagcgaccuguagccacccuuccauuugagucuguaagcugggcugccauagcugaaaauaggcugagaaaacaaaauaaccuccaucccacuucuccagcuagggccucccucucccaucaucauaccugagagcaggggaacaugugcgggagucuaaagccacacggaccacaccgaggccuugggagaacaguacaaaaggcagcaggaauccauccaagagggacuuguguguagaaaggaagacaaguggagagcccugcuccagagacagaaggaaaugcccauccuaaaaacacagccaaacuucagcaccugaagucccagggcagcacugagggaggaagggcuucuccucugcaagguaaacuucccuaagguaaagcagccuuuccacaacuuuaaaaggaaauacaguggcuuguuucaauggcuguugaaacugaagguugagcaggagacccuguagcagcagggcuaacauggcagcaagguuauuuaggaaauguggauucucuaacagcugaugcagccuagauucaccuacacucuggccauccaagcccauucaguauggucuggcuuaccuccugcacagccuucugaaccaucuucaucugucccuugugaaguuguacauucaggaagaggcgguucaggaaccacagcagugcccagcugaacagccuuggaagcaaugccagcuugaggugcagcagggccaccuucuacaaggcucauccccguagcaccccaaaagguugcucagaacuccucuaagacaagcaacaucauugcccacauugaacagaagaggaaagugaguggagcgguuacaaccugcugagcaguaggcauugcuaagggggugcuagagcuauaaaguccucaugccacagaguacacuugugagguagacucuucuaagaccucaugcugcagcuggcucacaucagacacgaauucugccuccauuaucuaaagggggaccaaagaaccagacccuuuccacacagaacccagucagccuauauuuaccaacuaccaggaaaaguggagcaaaagggaaaugauacaaggagggcaaggcaugcugcacuugcucauaugcccgguagggggaccaucuuaccaaagaaguuaacagaaaaacugguggacaagcagcaaguccacaucugauggaagcauuaaauggggcaauucugagaagcagcaauauguggggacacaggagaaugucgugccccuguaaaugcuguacuguaaaaaaaaaaccuaccuuacuacuuagguguacagaggagguaggaagcccacuagaauugcgcuugggagcuccuacacaagggcaugaguccuagggccugaaaaccucaaucgagggaagaacuguuacaguggaggauugguccaggucaccaacagccugugcuuccuuuucacuuaagacagcugagccugacacccaaccccgagcccuuuuccuucagcaccuuaacucaugcuccggcuuuaaccauaaacuguauauuacagcucugcaaauauaugucccuucuucugagcucccaggccuauacagacaaccaagucauuaagucaguuacuggaacucuuugaauccaaacauccauccaaggccaccucccuucucaugaagccugacccucuuguauacacacuggguacuaggccagaaacggauuuccuaucucacuacuuucccguuuccucucagcacuuuugguccaucugugaguccccugaguuaccaccuuaacuucucaaucuagucuuuccagccugucagucagcucugcagaugcucugguuucuacucuuguugccaagcccaucauucugccacuuuccacuuaaaacuguugagccguucugacuacccuuagaguagccucuacuuauuuggcucugaucugguuccuuucacgucucagauucuccagcugcucucaucuucacucaccagcuuccacagcucccaaccuuguuacaucuucagugagccuggcccuuuccugcucaaggcccugacucaggccuuucccucuaaagagaccauuuccucaacuuuuacuccuaugccuccagggcuggcuuucuucccuccuggcucuaacuacaauguccgcccuccuggauauucuggcucuuuccuugucccuuccuuugaccagcuguaucacuguccaccucuuuaauccccagcaucuaagcaugcagaucugcucuguaggaacccagggaagggcugcagucggcuguagcccauucuguaaccaucauccaaauacucgggaagaacaucuggugauuguccaagcccagccggcauccacucuccagaaggggcagaggccucaaccuaaggaugcaugccccucaccauaguuaccugagcaagaaggggcgggguguggucugaauguggcccaggauacgcuguaccucuuucuucacuaauucaggcgccuggccuucuccagccgcucccggaacccuccccgagaggagguucugcacccuguugaggucaggggacagcguugggcuaaauaccaauagucucccuagucaguccuccagugcacagccagaaaagucugauaugggcccaaacagagauaacauuccagaagucuugcccagccagcccuggccauccugaccuauagccuuugucaccccuuuaaguaucccacaaaugccagacucugaucugccuccucacccaguguuuuccaugaucuucugggaggcaucaaaacugguggguaugugcugcuccagggaccacaggaaauagcagagccugcgaaccagccagccccggaaccugggggaagacaguucagaaagugcuccccagagcccacagaggucugucuauucaucaggaaggguuugcaccccagucucauaucccaggaccaagcucgaccauggaacaacaacaaacaaaaaaaccaaaacaaacaaacaaacaaacuacucacuugccuauauaggccuuagucccacccugcuuccccacugagggggcacaguggcucuacaccuuacaggcagcccauagaaggaacugcaggggaguaaagcuugccuccauuugcuauggaucuccuuuuguccauuguaggaagaaagugaugccacagaaggcccuugcaacccacugccugccccaacagcuccaacuaccugguguucuccuccuucacaaggaucacguugcagaagcccagguccauuaugcuucuguggaagagggacuccuguccaagagggaaggacagcauguccuagggugcuuuugcaagucacaucuguacccuauccaucuagccucugccugguggccuuuugaguauaccagaagaagguauagaguacauuucccaugagcugucuaccccagaucauaauguuggcucagaaagaaaagggcuccaugcuuaaaaugacaccacuguccccuuguguggaguugcccucuuagagcuaagcacauuaaggcccugaguagggguauuaccucaucuggagaagaaaaugugcaucuugaaucuccauuagaaugcugagccuucuugguaccagcauaugauacagacaugcaagagaugcugagugcuaugggagucugagugggcacuguucccaaacugaacagagucaguuauauuccagccuugugggcauagccuagcucuccugaggccuccuacccaacucuccuaagccccaucccaacaacagaccccacuauauccauuccucuaacaggcaaaggcaugcagcagugaaagaugaggcuugggaagacgagagggaggcagcugcccaggauccucacucccaggaccaagccagccuaagauuuccaagggaggcccaucccuaccaucacuuacccagcucuuaggaguacaggucuggcagcagcggcccauaaaggggcgauacuuucccaggaauggagugauggccuccaucuucaucccaaagcuugaggaccaaaggcuggucuggaaaagggccacaagagaggugaucgaacucagggucuuugacagaaugaggagcacaucuggaguggaggucacagagggcaagugggagggcaaggguguaagaauuccacacuaccucuugaccauugugguuacuccucugcuggguuuggggguuggauuucaacaugguauccaugaaggucuguaagaucagugaaucaagcacugugucucucuccacacagaccugaccuagaaaaaaaacuaaaagaauggaaucugauccauaauccaagguuuuguggggugaugccagagucuaccccaagacagacaacacuuaagccaucagcaaugaggacaauugccaggagacuggaggcagucugaucaaaucccugucacugacccaaguggucccuccaggaagugagcuguacuugaaaagucaggggcucccucaggcaacaugaguggcuaucuuccauccacaugccccaauguguucuaacagcaacugugauuguaauggcaacguaaggcucuccguguagaaggaaaagccuaggcugggcuggauuauaccagcaagaagaggauacaaggaaaaggauacucucuccauaaaccuaaguccugcugagcagcccucuugcagaaccucggauccauuaugcuucuguggaagagagacuccugcccaaaaggguccccuacccugaucuuccaccauguccauggugaacagacuggccuaauuauuuauauucuuuuuauuccccaacucaaucacauuaacugcacgcuagccugagagugccuuuuugaguuuugagaccacaaauuguuaguucaugauacaucuagauucuucuuucuccaugaguuccagggcccaaggcagccagaaaagcagccuuguggagcccucgggguucccaucucacuucccucacaucaucugaaagucguccugaggguaagaauugcaaauaauucauguguagacccagcaauuaagugguauggaaagggcccaggagagccagaugccuguggcuuaguuuccaggguuccucuggugcuccuccucugccccuuggugcuauuuagcaccaugaagccaagcaguaaccggauccugauugauguauacacaggcccuggagaucucauuucagaugcauccccuacuuuaaaaaauguucucacagccccauucagacccuaagcacagagaagcccaaggucaaggcugcaauguaaggaggccugccuccuuugcaaggaagacguuugacacuccucagcuugagacuccuaaccucaaaaucuaaccccaccgaccaaugcuggcccuaaaauaacagauuaaaagacaaggcauggagcauucucaugagccaauuaagccaacuaccuagcucaugaaauccaggucaguuggggacagcucacucacgcuuuuuaagacacugucuugcuauuuugccccgaccagcuuugaauucuccauccuccucccucuguuucucaaacaccacuauuacagacacaucuggcaagcaagaucccuaagugagggccacuggcagucuguguagaugcacacucuuccccgagggccaguacaguucacaggcaucuucucgcugacuauaugacgugcuuaaacauuaggaauuaaggccaacguuuaaaagcagagagcuuguuauauaaagagcggggguuuccagcugcugcuguaaaaauaacuuugagaugugguaucugagcagauacccaacagggccucggcucgggggcgcccagaagccacgucccuuccacucugaguccucccacccgcacuacacagguggcacuuggugccuggcucuuauguagcucuucaccaaaggcuaaaaugcaacacacacauccccaauguuccugcccuacuaaccaucacagaacuuaacuuuaaaaaguucucagcugcagcaaauaccccuacgccugcaaggaagguucucgccaaaaccaagauggagggcagggccugucuccgaggcggcaccggaaguccauccuugccugcucucugagucucaggugccacaagccaagcaaagggcaaaguggggcucuccagggccaccagcuugccucugacuguuugucugugagacacgcccaccagcccgaguuccacaucagucccugccugacccaaagccaagcccagcccagcccaacccagccugguccaauccggcacacgagucucaggaagcucaccucacaccagccgccaacucccgccaaacagccgugugacugagccgacgaagccggaaacugggcucugcgcaugcgccucagcagcugaggggccagccaaucagaacgcgcucuaggcucgaagccccaucccuugacacccuauaugcucugcuggacuugcugccuguaccacaugaucacugcucccuccacgcccaucacccacaacucgcugcaaguguugagaguuuguuggggagaggacauucuggcuuaggaaccugcuuguccuaaucuggaaguguggaaugcaaaggacccaaggaggggagucuuaaaaaggauguggggaggauaguguacaccucucaucccagcacacgagaggcaaaggcggauggaucuuugugaguucgagucuagccugaucuacauagcaaguuccaggucacccagaacuacauagugagacucugucucaaaauaaauuacgugugugugugugugugugugugugugugugugaucuauauaugugcauguguggcuuuguggggguaugcacauguguggucagaagagggcuuggaucuggaauuggaguuaacaagagcgcaguggucccucacgagucccgggaacuaaagacccauagcagaaggugagaaccaauuaccccaagcuauccuuugaccuccucacuuguauacacaaaauaaagacguguguuuuuuuaaaggagaaccugagcugagcaccagcacuuaucuguuuucugcuuccugccaagcuaugauguggucagcagccucaugguccucugccaugcuuucccagccaagauguccagugcccucaaacugugaaccacaacaagcccuucuuuccuagaguggcuuuuggucagcuguuugguuacaucaacaggcaaaguguauaaagaugagaguggggucauuuagguaaucggcucugagcacucuaggaacaaaggacauauggguuccuucaucauuucacuguugcagcaagccaccaagagaccagcccugaaaggucuccacaggaccgggaaagugacucagcagauaggaguucauauugcucuuccagaggaccugaguucaggguccaacaacuacaucagguggcucacagcugccuguaacuccaacuucagggaucuagcacccucuccuggucuccucagguaacuacacucaugugcacauacccacacacaaacaaauguuuuaaaaauaacaacuuuaaaagguuagugcaauauaaaauaaauuggggggagguauucccuguacccccagcccacgugacagcccacugaccuccaguuucagaaccugugaggccaugggucccaagagcuggcucuuauuccuaaccucuaccucuccuccaccgacauuccccuugaggguauagccacuguguucccugcuuugugccauuuugugucccucaaggcccaagggucucuuucguggcuuguguguguguguguguguguguguguguuuugaggcuggucucaaauuugccaugaaacagaggguggccuugaacaccugaccuuucugucucuuccuccucaggaacagcaucaccagcuucacauguuguaucuggcucccauguuaacuguuguuuuguaucauagugcacaggccacaacaagaagacucagaaacugaaaaaagcaagcaaggaaaaggaaaccccauuauuuagaagcaguaaguugccccccccccaccuccaagugcaaaucuagaugucucccaagaucaccaucuggauagaaaggugagcuuuugugguugguugugagcaccucucaccuucuuggagggaucucauucugagagggaucccacaauagcugcuuccgacuggaagguuccauggguagggacagugggccccagggcuguauuuagcagaguucuggccucguucaggccucagcugcacuucugcuuuagaaaggauguguugggaggcugcaguggcaacagcugccugcuguaauuugggcauugaaagaugcauacucuguagacauggcucaggguuugaugcuaaagaucugaccagcauucuggaccagguccagagcuacaugauauggugagaccugcaggccaaaugcuaugcacacugguggucugacuugauccuuggagacacugaaacucuccuuugcucagcccaugaaccaugaaugaacugagaaaaccccucccuggacauagguacugccccaaagauccuaacucauggaacugacuccuagggcccaaaaggacaaaugcccuccuguggggaacacauauuugcauguuacuucuggguguuucuagaagaauggguauuguaagaguggaugaaagaacaguuguucuccccaacuugugcagacaccacccaauccaccaagaguugagacagaggacagaggaagggugcauuuaucagcaggucuagaguugggauacccacuucuucucacuagcaauaugacacguucaaggacuccuagaagauccucucauaugccaggagcucugaggacagccacccucaugagguggccauugauggggccugauuucuaugucauagaucucuuccuuccuucagaaucuuccauauggucuuguaaacacuguggcaauccacagccgagaauggggagcucgacagaguuuggauguugguaggaaaagguagcagaauuaaugcugagagcagcugguagcaucuccuugucauuguuaguucuguagaagcugaagcaggaaagacuuugaaguguguguguguguguguguguguguguguguguguguguuccaugcauguucacauggcugcaaaugugggugcagguaugaauguguguuagugucuguggaagcuaaaaguccaccucagauguuacuccucuagagaugcccaccuuguauuuugagacugggucucucuaaccuggagcuuaccaaguuugccaggcugacuggccagggagcccaaaggcuccaccuaucucugcuuuccuucacugugcuuaugagcacauacagcaugcuuggcugcuuuacaugggucauagccagaggacgcagcacagggaaaggcacgccgaguaaggaagaggggcaaaaggaugguucaugucugcucaacgcaggagagaccaucccaggacucucaggauccuccacuuagcauugucguagguggccuugggguccaaagauauuuaggacccuaguaauuccucccaggccuuucuccugacccccaguccuuucccaguaaggaacaagcuggcaggguagguggguuugauugcuuggaacuuggagguucuuuuugguuuuccuccuuagcaacaccccggaucaaaucaguguguuuuaagcauaaugacucuggagagggcccucaagggguccuggugcauuauaaagagaaugcuugcucagaagcaaauaucuauaaucaguaguugcuuucaccccacagugggcaaaugagcaguagccacaaaacagccuacucccuccaugagggccuucuggcccauccccaggcccugccuccauucuccuuugccugcauuguuacaacccaggcaagcagggcuggccauugaugcaguauuuggcucugaggauguggaaauaaccuuucuguagacaaaugguucucagccugugggucucuaccccauaagggguugaaugacccuuucacaagggucaccuaagaccauccaaaaaaaaaaaaaaacaacauagauauuuguauuacgauucauaacaguagcaaaaauuauaguuauaaaguagcaaugaaaauaauuuugugguugggggucaccacaucaugagguacugcauuaaaggauccuggcauuaggaagacugagaucugcucuaggcaguuuucauaacaccuuccccagccaccugcagccuagggguuugaacacagcccucggcucucuguggcugcgguucuguaaugaacagccagcuacacacaagacugagcucccgcgggguugugaaagggagcuagcuggauuguugcucuucccuaggguaggggugcugaucuacacuggcauauugaagcagggacucagcagagcagaaauagggggacuggguacgaugcuuccugcugcaagaaagcucaacucagaagugcuuaaccauaaaaggacacaugugacaaucaguccauggguaggauggcccagaccugguuaguucaaggcuguagugacaucaauagggguccaaucuuuauucccuguugcccuccuuaguggaucagcucagaccaguuucccaggauuauaggauagcugcuucaguucuaggcaccaaccagcagagaagacuaccucuuucuggauacuuuuccguuaugccucacuagggccagaaaaagaauagagccuuuccaugagggucccaggccugcaaggugaugauguaccuucccccccccaucacccagcuucuuaucaucacaaaucccugagguagccuagagaagggagagggucuuuggggccuugguuuuaaaggucccaguugcuaaagagacaaacauuccaucuuuaagacuccagagccaagucugcaagagagaaagaaauacaagcacugcuuucauggcuggggaggggugggggauggaagagaccagaaagagcuccuuucaagggcacaccccaguaauccaaagacauccucaccagacccuaccccuuaaaguccuuuugccucucaguagugccacccugccuuggggaacaugagaugugcaaaggcuauuugaggcagaguguucucagguagggugggauuugagauguguuucagccuccuuugaucucgaguuauacgacaucgccaaguuaucucuagggagacaaagacuauagacagauuucuuuguuucaguucuaaugggcaagaagagaguggaccaacaggaggccuccaccccaggccugggagauacaauggcucccucuggcuccccugguuucuauccucccugugccugagcauccuucuaucuggaggcaaggagcuuuccuagagucuuagaagagguagguguccuagugucagcuuggcuagucaacuagaccuuagguagaguuggaacgggagugaguuggcgaugcaggccuggaugucaguucaucacugggagagcuaaggcaggagaggccucuuuggaauguggauaguguuguucuuugaggggccccugcuccuccugcagcaaggcuuggauggcuaagacaggauguuggguguucuguguucugaucaaauucauccugggaccucucagaucucgauuuuguaaguagcaaaaaguccaauucaaauggguuggccuauaaagggaaccgguaggccuaaccagacaccagaacugcagagggagcuggcacuauuucucugcaguauuuucucagcaagucagguuucuuuugaucuccaccucucugcaaguuaguuauuucaggaugcuuggcccuggauggcaaaaauggccaccacaguuucuagagccuuuaacacacacccugcagggagcccuuucauuucaagaugccugugaaguucuaagcuucugcuugcucugguuggcagauguuugucaccugaucuuugggggggcacuuccuguagugugagacccugagggcuuggaggggcuuggcgagguucucagugcauccuuuuccaucaggccucugucccuuuccugguaacaugacccucauacaaauuccacgaggcuauaggacaagagaaggggaaacaaacaauguccccgaaaccagugaccuccaagaucuaacuaacaugaacaggacaacaaaacagauguguaggaugccgggaugugggaguguuauggugacuucacacaugcacagugcacacccuuagccccaacccgggaaggcugcaguuugggcaaaagagggaauucguguugcuaguuaauccuggaucaacuuugggaaccuugagcaaucccaagcucuuuugacugugaauaaaaaggcggaaggccagaagauucauacagaccgggagggugucagaggccaauagaagcagcgggcaccaccaguaaagcaucugcaagcuuugcuuggguuuguuuuguuuuguuuuguuuguuuguuuguuuguuuuuuugguuuuuuguuuuuuuguuuuuuuuuguuguuguuguugcaauagagucaaguuaugucacauuagcuuuacuuugaccuugggaggcagcagcugcaggagaagcgcacuuuacacucaggacagccccuguucucaccacccuguagaguuccugagcagcccaguggccagcacuaauaauugaacauuuggcuguggggcggcagcagcuucaucugugacuccugcugauugugagaacuacguuuuaaugagacuccugcauaggcacaaggccacucccaacaaagcccagagcaggaggcaagaaggucuuugggggaguggcuuugggcaaaaggugguaucuugcuggauugaggacggggaagaacccggguggaacuagauaggccaagaagagaauuuaaaaagcugcuucuggaacauucugccucucaagauucagacggacgcagagcagggcgccaacuacagaggaggggugagagggcugcaucuuuggaaaaugagcaggaaauaguagcuugagcuuuggaccagaauauagagacuccaggagaaaugagaucaccucugaggggcggggugggggaaagguuugaucuugcagagcuagcaagagcuccaggggacaggccaacaaaagaggugaagagaacagacaaccacuucugcagcuguggacucagagacgcagaccuuagagguagcagugagacuagcaggggugaggaagcaggaaaggaacagaacuagucauucacacacacacacacacacacacacacacacacacacgcacgcacgcuucacuuugcaauggaacccuugaugggcaucaacagguggaaaagcagaccaaauuggacauuugaagugggacuuuugggaagaaauuaauuaaguuuuuuucuuuauuuacauuucaaauguuacccccuuuccaggucuccccuucagaaaccccuuaucacaucccccuccuccugccucuaugagggugcuccccaccuacccacuucugccuuccugcccuggcauuccccuacccuggggcauugaacccccacaggaccaagggccgcuucuacugauguccaacaaggccauccucugccaaauaugcaaccagcaccaugggucccuccguguauauuauuuugguuggcgguccagucccugggagcuccagggggucuguccaguuaacacuauugcucccccacaggacugcaaacccccucagcuccuucagucccuucuccaacuccuccaucggggacccugcgcucaguccaaugguuggcugcgagcauccacauccaccucuguauuugucaggcucuggcagagccucucaggagacagccuuaucaggcuccugucagcaagcacuuccuggcauccacaauagugucugacuguauaugggauggacccccagguggggcagucucuggauggccuuuccuucagucccugcuccacacuuugucuccauauuuccuccugugaguauuuugcccccccccuucuaagaagcacugaaguauccacacuuuggucauccuucuucuugagcuucauauggucuguccuaaggagacuuugagcaaggggccugauaggacucuggcuuuauagaaccugaaccaagauuccugccuccccaugugaugcccuaugagaugcugggacucagcagaauucccaucagagagaagaagguccucaccagaggcaaccgcuggucuuaaacuccucagccuugagaaccaggagccccagaauccuuuagucucucucuauaaaugacuccaccuauggcguuccaggucaucaucaggaagcaacucugucagacugcugcaagguggcaacug

SEQ ID NO: 1067 - RNA, 16618 nt, Mus musculus
uggagauucaagaugcacauuuucuucuccagaugagguaauaccccuacucagggccuuaaugugcuuagcucuaagagggcaacuccacacaaggggacaguggugucauuuuaagcauggagcccuuuucuuucugagccaacauuaugaucugggguagacagcucaugggaaauguacucuauaccuucuucugguauacucaaaaggccaccaggcagaggcuagauggauaggguacagaugugacuugcaaaagcacccuaggacaugcuguccuucccucuuggacaggagucccucuuccacagaagcauaauggaccugggcuucugcaacgugauccuugugaaggaggagaacaccagguaguuggagcuguuggggcaggcaguggguugcaagggccuucuguggcaucacuuucuuccuacaauggacaaaaggagauccauagcaaauggaggcaagcuuuacuccccugcaguuccuucuaugggcugccuguaagguguagagccacugugcccccucaguggggaagcagggugggacuaaggccuauauaggcaagugaguaguuuguuuguuuguuuguuuugguuuuuuuguuuguuguuguuccauggucgagcuugguccugggauaugagacuggggugcaaacccuuccugaugaauagacagaccucugugggcucuggggagcacuuucugaacugucuucccccagguuccggggcuggcugguucgcaggcucugcuauuuccuguggucccuggagcagcacauacccaccaguuuugaugccucccagaagaucauggaaaacacugggugaggaggcagaucagagucuggcauuugugggauacuuaaaggggugacaaaggcuauaggucaggauggccagggcuggcugggcaagacuucuggaauguuaucucuguuugggcccauaucagacuuuucuggcugugcacuggaggacugacuagggagacuauugguauuuagcccaacgcuguccccugaccucaacagggugcagaaccuccucucggggaggguuccgggagcggcuggagaaggccaggcgccugaauuagugaagaaagagguacagcguauccugggccacauucagaccacaccccgccccuucuugcucagguaacuauggugaggggcaugcauccuuagguugaggccucugccccuucuggagaguggaugccggcugggcuuggacaaucaccagauguucuucccgaguauuuggaugaugguuacagaaugggcuacagccgacugcagcccuucccuggguuccuacagagcagaucugcaugcuuagaugcuggggauuaaagagguggacagugauacagcuggucaaaggaagggacaaggaaagagccagaauauccaggagggcggacauuguaguuagagccaggagggaagaaagccagcccuggaggcauaggaguaaaaguugaggaaauggucucuuuagagggaaaggccugagucagggccuugagcaggaaagggccaggcucacugaagauguaacaagguugggagcuguggaagcuggugagugaagaugagagcagcuggagaaucugagacgugaaaggaaccagaucagagccaaauaaguagaggcuacucuaaggguagucagaacggcucaacaguuuuaaguggaaaguggcagaaugaugggcuuggcaacaagaguagaaaccagagcaucugcagagcugacugacaggcuggaaagacuagauugagaaguuaaggugguaacucaggggacucacagauggaccaaaagugcugagaggaaacgggaaaguagugagauaggaaauccguuucuggccuaguacccaguguguauacaagagggucaggcuucaugagaagggagguggccuuggauggauguuuggauucaaagaguuccaguaacugacuuaaugacuugguugucuguauaggccugggagcucagaagaagggacauauauuugcagagcuguaauauacaguuuaugguuaaagccggagcaugaguuaaggugcugaaggaaaagggcucgggguugggugucaggcucagcugucuuaagugaaaaggaagcacaggcuguuggugaccuggaccaauccuccacuguaacaguucuucccucgauugagguuuucaggcccuaggacucaugcccuuguguaggagcucccaagcgcaauucuagugggcuuccuaccuccucuguacaccuaaguaguaagguagguuuuuuuuuuacaguacagcauuuacaggggcacgacauucuccuguguccccacauauugcugcuucucagaauugccccauuuaaugcuuccaucagauguggacuugcugcuuguccaccaguuuuucuguuaacuucuuugguaagauggucccccuaccgggcauaugagcaagugcagcaugccuugcccuccuuguaucauuucccuuuugcuccacuuuuccugguaguugguaaauauaggcugacuggguucuguguggaaagggucugguucuuuggucccccuuuagauaauggaggcagaauucgugucugaugugagccagcugcagcaugaggucuuagaagagucuaccucacaaguguacucuguggcaugaggacuuuauagcucuagcacccccuuagcaaugccuacugcucagcagguuguaaccgcuccacucacuuuccucuucuguucaaugugggcaaugauguugcuugucuuagaggaguucugagcaaccuuuuggggugcuacggggaugagccuuguagaagguggcccugcugcaccucaagcuggcauugcuuccaaggcuguucagcugggcacugcugugguuccugaaccgccucuuccugaauguacaacuucacaagggacagaugaagaugguucagaaggcugugcaggagguaagccagaccauacugaaugggcuuggauggccagaguguaggugaaucuaggcugcaucagcuguuagagaauccacauuuccuaaauaaccuugcugccauguuagcccugcugcuacagggucuccugcucaaccuucaguuucaacagccauugaaacaagccacuguauuuccuuuuaaaguuguggaaaggcugcuuuaccuuagggaaguuuaccuugcagaggagaagcccuuccucccucagugcugcccugggacuucaggugcugaaguuuggcuguguuuuuaggaugggcauuuccuucugucucuggagcagggcucuccacuugucuuccuuucuacacacaagucccucuuggauggauuccugcugccuuuuguacuguucucccaaggccucggugugguccguguggcuuuagacucccgcacauguuccccugcucucagguaugaugaugggagagggaggcccuagcuggagaagugggauggagguuauuuuguuuucucagccuauuuucagcuauggcagcccagcuuacagacucaaauggaaggguggcuacaggucgcuugggccauggcuacuucaaguuucuaaacagacagguguggaagaaucaaggccuuugcaggccucugggcccggccucuccuucagagccccuuuucauuacuguccugugcucacagagcucuauugaggaaacuugggggacuuuuccugcccccagaggucaaccucuccuuggacaacucagagggcauccuugcaagggcugugguccgugcagugaguguucccagugguuaugcguggggugggccaaggguguagggucugcugcugagcuggccuugauguccacccuuccucuccucuucuagacuguggaggagcugcuuacuaguggucagccucugcucaucuuccuggaagagcccccuggguccccagggcccaggcuuucugcccugggccaggccuggcuaggagugguaauccaggcgguccaggcaggcauuaucucagaugccacacugguaccaguugccauugccuaugaccugguuccagaugcaccauguaacaugaaccaugugagaccugggauccgaguagauuaucaaccaguucuggguggcacaauguucuguggcuggguuccuuuagggcugaagucagauugggaugugaaguguuuaagaacugucccuauagucacuauccuaaagggucucccaucuuugcuaucaccaucuuucaaaagaccccacaguacagacuguagguggaaagacaggacucagugaagagccgugaacaguguggagggcggaaaggguggcagccccgagacuugcccaagaaaauacaugugcagccucucauucccugcaggauuuggcuccccuggggcuauggacaggagccuuggcugucuuucggagacuguguaacugcuggggcugcaaccguagagucuguguucgggugcaccuugcccagccauuuucccuccagguaugaaaccaguugggaaaggcugggauuaaccuuuguggugguuuggccuucaaagcauuguaaggauaguauuuucucuuagaugguuuguguacagguuucuugggggugggguguggcaagggcagaccucacaucuuuauccugggcaggaauacaccaucaaugcuagaaguugcugggauagcaggcagacccuggaacacuuguugcagcccauugugcuaggugaaugguaaggagcacagauguaugggucucagagggaggcaggcggcucuucaacucugacuaucccagaacaucaacaccagauguccguauaguccaaauguaggguggcacauaggccuggaaguggggaggguuauaugaauucuccuaggacuugggaaaacagcuguagcuuugaaaagcuuuugacucuuacaacauuuuaggcccgcuucauucuuugaucugucuguaucccaguaguguuguuccggacacugagaaggagcaggaguggaccccaccaacuggccuccuccuggcccuuaaagaggaggaccagcuccuggucagaagacugagccggcauguucugagugguaagggaaacgcagagcugcaccuuuggagugugacuugaacagcacuuucucuguguagauaauaaagggcuaguuaucaggaccccauggaugcccguaccugacccccacccccuucacagcacacagggauacuggaagagcggggcauccagggaaguggggagcagaugagcucaguaucugagccaaaggcagcugugcagaucucugugagauccccccaaccucacccuaaagguccuuuuaacaguguccuuagcugugaggaugacugaguggaggagcaacaugugccuacagaaggcacgugcugacuggaugucccucuggcaugcuguugggguggcucuggcucacaaugcacgugauccugcucuccccugcuaggguagaguuuggguugugugucugggaacaucugucaaaugauggaggagagaucaaggcucucuaggccccucccaucagcaccuuccccucucuccccagccaguguggccagcuccgcagugaugagcacagccaucauggccacacugcuuuugcugaagcaccaaaagguaaggcacugcaugguggguggggccagggaagggccaggcguggcacucugcucaggccuguuuugccuccagggugugguccugucacagcuccugggagaauucuccuggcugacagaggagacacugcuccgagguuuugaugugggcuucucagggcagcugcggugccuggcccaacauacacugagccuauugagggcacaugugguucugcugcguguccaccaaggggacuugguggugguaccucggccuggcccaggccucacacaccuggcacgcuugaguauggaauugcugccaaccuuccugagugaggcuguggguggugagucagugggucagcaggauugggaugcaugugcaggggagagggagggagcagguccccuucuuaugccaucuucucugccagccugugcagugcggggguugcuggcaggcagaguaccaccugaggggcccugggagcugcagggcauagagcuacugagucagaaugaacuguaccgccagauccuacugcugcugcaccugcuaccucaagaccuacugcugccccaggucagacccccuccuguagcucagcaggaccuugggccuuguccuuaugaccuccugugauagugacuuuggccuccaaacaccucuggucaggauucugccagcagccccuuccccccauggguguucucugaagggcauuggugcuucucuuccuacagcccugccagucuuccuacugcuacugucaggaagugcuagaccggcucauccaguguggacuccuaguugcugaggagguaggcucccacuccaagugccaguguccuggacuguuucucugacccaggugugcucugggaguguacugccaguggcugggcacauggaagccugccugcacugggcaugugucucaugccaccuuggcauguguagcucuaagguucucuccauacugucugcuuccacauuucuuagugagcuuggguauuuggcccaaguagcucugaacagccuuuugggcuucccagaccugcuuugaccugccaaggccagguaugagggcuauagugcugcuuccugcccagccuuaccagggaccagaccaauaacucucccccagacuccaggcucccggccagccugugacacaggaagacagcaucugagugcaaagcugcuguggaagccgaguggggacuuuacugacagugagagugaugacuuugaggagccaggaggccgcugcuucaggguguguggggaggagcuaccuggggaggcagguggaggugaggugcaugggaaccuaccuugcucacucuggucucucuccagcuuagccagcaaucccgcugcccugacuucuuccucuuccucugccgcuugcucagucccauacucaaggccuucgcacaggcggccaccuuccuccacuuagggcagcugccagauucagguaagguucugaacacuccccuagcaguguugaguguggggcucagucccaaagcugagguauaggucuaaucucuccugcagagguggccuacucagagaaguuguuccaguuuuuacaggccugugcccaagaagaagggaucuuuggugaguuccaagccccaucccaggcuccccagggguaggcuugcuggugacugcugcccccugcugggaaguggcugccugacuucagggaagggucuuuggcuccaaguaggcccgaguuggucuuccucuuaaaggaaguccugccuaguggcucccugccugccucagagcuuuuacugccuuucuucccuccagagugugcagacccaaaccuugcuaucagugcagucuggacguucaaagaucuggggguaagaggccauaucaccauccugucucugaccucacccucagccccaugggcugcuagaacugcucaagggaaccaucuuguucccuuacccaaugggcagggaggggguagugguggaggcucuaacauccuaaugaaugauagaauggauaguuuuucugccuuccuaauucacaaaggaauguguguuaucaaguaguaacacacuauaucaaguaguaacacacuuaggcacugugagauaucuauagguuuugggggacaagcuuguuccccucagcaggggugcuuacaguccaucuugugguucagguacuucaggagaugccuagcccuacaggaccccagcuccaccuguccccuacauuugccacccgggacaaucaggacaagcuggaacaauuuauccgacaguucaucugcaguuaguaccagguggagccugaugggacuugucagcuuaaacucaagugugugucucugcucaggacacagcuaaccugaaccuguguuugcucaucauuugguguaauaaauagacuagguuaguuucuuccuaagucugaaguacauguccaauaucugcucccuccuuagccccgugaaacggcccaccuucagggacaggggaggugggggagaaguguguggcuguaugacuaaaagacaguggaagcuaaacugcaacucugagagaaaauuuauuuccaaggccuaccuaagagcagccucaaguggacagggccagcaguuagcugggugggagcagaagucccgccuugugucaaguccagugcuaacagggacaccaucacaccaccuuguugaugaugacaccaaguucuucaaucucacacuggacuucaucgcccuucuguaacacaguaugccacaaggcuuuuagccuuuggcuccugaacacgcuuuccccuuuaaagcccccaggcugcuucaagcuuuacaggccaccuagcuuucaucuuuccaccauuuccucuucuaaacuaacuuaccuugaggaagacaggaggcuuccuaaacaugccaacaccuggaggcgucccagucaggaggagguccccuggguaaagagugacaaaccuaggggaguagaggggucaagucagacagucggcugagagugggcuuaguucccaggugugccagcggguggggcuggcucugacagguuccauccacuuacugggagacccaggcuaucagauauucagucuugaacaccaucugguugguguugcugcucuggacuaccucuccauucacucgacagcagaucuuuaaauuguguggaucuggaauucaaaaucaacacugggauuaucuacacccaacccccagcccuaaaagaaaggaaacuuagggagcaugucugcccagccugauuagcacuuuacccugggacuuccuguaaagacugguccccugaauuccugcaucaagugaggaaaggaguagucuccuguagucucugaacugggagaaaaacagcugauuugccuuuaaaaaaugggcaugcaggccaggcaagaugggucacagguagucacuuacugccaagccuuggggccugaguuuaauuccugggacccauaugaacccaggaagagaaucaacucuugcaaauugaccucugacuuccauccaugggccauggugugcacauaugcauauauaaaaauaguguuuuaaaaagaguacauucagggggcuagagagauggcucaguagcaauggcugcucuuccaggggucccgaguucaauucucaauauacacaugguggcucacaaccaucuguaaugggaucugaugcccucuucuggugugucugaggacagaguacucacauaaaacuuuaaaaaauaguacauucacuuaguuaugaacuacacuaauucucuauauauuuaacauauuucacaguaaaauaaaaauaauagaaaaauaaaauaggaaaaaacaggcaucaauccacagcagaggcugguaauuguagaucuaaaaugacucaguaucuccaaagugacagagacacagcagcagauaaugggguuacccaagcuauccuucccaccugacagcaguuggaauacagcuucugaggcacugcuaucuugaggggcucacccacgagccaugacagaccccauggaugcaugcauagaggaugugugagauccuauugaugcuccgacucccuugcagaaaugaacagguuucaucauggccauucuccagcaugcuaaacagucuuacuccuuccagccuaaggacuauuccagauggagguggguggaggaagccccuucucccacgugcaguguuggcuguaguucacacuauggauguaguuucacagcaguugcagcuguguucccucuaagaggcucauggaaggaaguuguacugagagcuggcucauagcugaggcugggaacagcagugacacugcagcucuguggauagcuguaaccagaguccuugcuagagcaccgcuuugucccgacacucaaagguauugcacauggaagggcauaaucggcaaagaccagugaccuaccugcuaugguauccuugguaaccaaggcagggcccagggggcagaaaguaucaaaaguuuuucccaguaaccacugcuuuccauuucucauuugccagucccgagcacucacaucaugagccacagugaagccagccacgugagccaugacaucuguggccuauuggggcaggagauuuggccagauaagguuacaucacaggugacacaaccucuaaaacaaagaaucucaaagccauuaucacacauuagcaccaaggguagcuaaaggugguaugugaaagcccaguguguuccaguguagaacaguaccagugugggggguauggucaggacuagcagaggcgggauccaggacugcugcuccucccuggucugggacccccuuccaccucaccuugauguguuugccuuucuucccaaugaccacggccaucucgaccucccagucaacuuccugcaaagugggagaggauaggugagcugcagaggcugugagguagaccuuagcuucuagaaccagggugaagggaacgacgugugggcacggcuugcagaccauaagcucugggcagugguaagcagcagcacuggaagugacuaggagaugaacacaugucuggggcccugaauuuacacucacuccugacaccugcagugaagagugaggccaguaaacacugagaaauguguaacuacugugugccugacacuguauguacuauaaugcauuuacucauuuuaauagacugagauacuggaauaaauguauuuaaggggcuuaagccacaauaggccacagaacucacaagaagaaaugcacauggcuacaaaaugucugcaaaugccaggcucugcaagagagcaaaaugcaaccagaaagaacuuacaauuuacucuucccuggcuguuuuucaugauaaugagaacuggcagaaguucaccugaaccggggugcuagccugugcuacccaugcaacuaaaggaagaaggcuccucagggaaauggcugacucaugcaggagaaagcacaaaggagccuucagugaaggccagaaaguaaagauguguucaaaagugaauagaaguccacaggauggguccacuggccaaacugaguaagaggaaaaaugagaacuccaaguaaauccuaagagcacagagggaaggauaggagguggugaugcaggugaaggugcuggccacagaagcugaugacccagauccaaaagcuggaugcagcagcacacaucugcaaucccagcagagacaaucacagcuuaggaaccagccagccugggguaugcacaaaaucaggagacccugccugccuaaacaagguagauggggagaguccauagaguggggguggggagaacaccacaaacuagagacuaaagagacucucuuuaggagaguuuccuaguacccauaucagguguucacauuguguguaacuccagcuccaggguccucacccacuccagccucacgggcagucauggcagagaguaaacaaauggucacacuugacaacccuggcaugggagcccccugacgggcugcugugggaaacaggucauuccugugcaggaugccucagaaaacugccucagcugagucucaucacagagaaggaaggcagaacugagcaaagggcacucugaggaaacaguucuucacaaacugucaggaaaggaaaccauuuagcaaccucaaacguguuagggagaagucugagugggaugagagaugcucuugaaggaaucuggacaaggugcacguguggcagagacacagcuggacaagcaccacugggagaaugcgaagcaaaaugugcauaccaaagugugcccagcagggaugcugguggcuuuaucuagauuauuaauauacuuucacuguagaaaguuacuuuuguaauugggaaagaugaaaguuaauuccuccugucaccuauaccugaggcuguauuaguacagcgcaaucuucucuaguauaguauauuacugagugacagagucccuuaagacaacuguuuucaacccuugggucaccaccaccacugggguuacauauaggauauucuugcauaucagaagauauuuacaauuuauaacagcaaaauaagcagcaaccaaauaauguucuggcuggaggucacuacaaccauauaugaaaguguugcaguacuaggaagagugagaaccacugcucuaaggaaacgacgccuaugcuggagcccggugaccugggugguaaggagcacaaaccuugcucucuggugggaggaugaucucaucguagggccccacgauagagcuggagaacuugcugaagaugauggggcucuugggcacccgcacauucuguucuuggcaguggucugcauaauucaagcccacacauaucaccuugucuggccgggugacaggggccaagaaggucaccugugaccgagggaugacaggcagcuggguagccagggcucuguagugaucaagcaggagaagggcuagcucgaccagguugggaaucccagagcaggcuggggcgaucccucagcaguuaugacuuuugcuuuuugcauuuucuagaucuuucaccuaucaguguaaaggacucaguccuuuuauagcaaacauggugguauucaucaagugcucauuucguccccacuuggguaauuguugcacaugugaaggguacacuugggagugaguggaaagguuucccucaccucuucuaagucaccgugucccucccuggagacaacuccuguguccugcauagcucauaccagcugcaguggaacacccuucucaucucaugguuuuguauaugaaugauagaguauauuaugcauuuuaacuuucucuagaacacaaaguccuuccccuccccaccccacuuuguuuucucuauauagccuggaacucauuguagaccaggcuggccuuggacucaagagagccacaugccuuugccuccugaguauggggauuaacagcauccuccuccuuauggcugcuauucuacacugucaacacauacuggcuuccuaauaacaggaaaggaagugguuucuaacuuuuaagaaaaugaccauuuggggucacagugcucugggucacugugcugucaaacauuucuauuucugccacucugcugagugaaaacgccuucuuaaauggcuucuaaacuacugcuugacccuuuagacggauuauuccaugacuggcugcagggucacucccaguuaauguagcacaaacuugaggaaucucuuuaauagucuaaaccacaccuacaucuucccaagaggguucuuuagggccuugugccaggcuccuccagugggagggacuuagccucuugacagccaauauaaugagguaagguccugacuacacaaucaaauaaauuaaucaccuccucugaaccucaguuucccucucuuuaaauugaaaguguuguuuuauaaggucguauacaccucuaauucagucccagcauucaagggguuaaggcagaaagcucuccaguucaaagcccgccugggcuacagagcaagacccugucucaaaaaugcaaagauuuauauuucuauuagcucuuuacuaaaaggacaaaugaaagacagacagugggauccccugcuccuuugcaggggagcuagcuaccuucugguucugauucucggggcaggagaaggggaugggaggagggaggaacuagggcaagacugccugcuuacuuaccuucuugccacugaaaggguggucucuccuugcuccaggaacugcaccauugucuuagggaguguugagucaaaagcauuuaagucuacaacucccccaccaaccccugacuccagacccaggugaggcucuuccaggugaggugccuggaacuguaccagucucauguuucuggaggguugacagggccucuucugaaccugcagcagagcugagaacagccuccuccucccaaagcccagcaucaaagccuaaaaggagagaagcagccacaggagacagaggacuauagaacugucaugaagaucccuucaugaaggaaagaagcagccacaggagacagaagacuauaaaccgucaugaagaucccuucgcuccuuugccccagcaagcagucccagcaugccacuugggaagugcucgcacaggucauuucacccugucauacuucaaaaagccagaguacagaugacuaggccaggcuuuaagcuagcuccggggaucccagccuugccucaaccaguguuuccugaaaguucccaccacugcaggcaagugggaaacacagcaggcuaacucggaccugccgucuugcaugugggguaacagauaugagcgacugauguacacaggccucagauguugagaugauguuaugaagauggccaggccgcuaccucuagcuuuuagaggaugucccccuucacuggggaaggcuaaggugugcaggacuaggacucagccccaaguuaggcaaauggcuauugcuagaaauggcuucccagcuaccucaugcaacuuuuaaaaauacuugguccuguugccuuuugaguuaaacacuuucuucugcucacaugcucaagcuagaaccccagccagcuuggcuuaggagcuacccuccaucaccucuaguagguaccaguuucugcugcuggugaacagggagacucagggcaccaagagcccagauacuuggcuucacacauugcuuagcuaucucccuggguucaguagcaaugucugucucuuuaacuacugagccuacacuguugcugcuguguauggaacacaggcuugcacugccucuguccacugaacagauggaaggugcaagggacuugacuuuucacuucuuggaaaagccuagugaugaucaacuuugggacguggcccaugucuuccuucuucagauccagaccucuuggauaccauugaaaagguucagggccugcuaugaguuccaggcuccacccaaaguuaagcuucauuaucgugcugccuuuguuuuuaaugguacaggugccggccuggaaggcacaugcuagcuugagcuauuccccagauaaucugcacucuauauccucacucauucccuuucuuugucuuaaucuaggucuggucuucauucccugucagaguccucucccuucuggauagcuuucuuuuaaaaccaguguggggcuaggaagacagcauggcugguaaaauguuuccacugaaagccugaagaucaguuaaauccccagaacccacauaaaaaaguuuguacacaguggucuaugcuuguaaucccagugccggauagguggagacagguagauuccuggggcuugcuagccagccagucuagccuaauuguugaguuucaggccaaugaaaaacucugucucaaagacuaaaguacgcguacgcgcacacgcacacgcacacacacacacacacacacacacacacgucuuuauacuaaaaaugagagagacugcuagacguagcuccgucaguucagggcucuugguccucaccugguugagccaaccuacccuguucaggaucaccagagugccagcuugcaagucuggccagaaaaccaaaggcuuuccaucuccugcucugucguuuuacacaaguaccgccaugccacaguccaaaggcugguccagcauaugugaccagucacaccauacacuaaaacaguacugucccagggaaagccaagugucucacuugugaggucuacuauaauucucuugacgguggcuuggcaggugcugcugguccaguuuuacagaugaacaagccaaggcuuggauaggguaagagggguuugguuugccuaagguucaagggucuuacagcuaaaagaaaauuggcauuugaauccaugucuagaugacauugaaguucuuaauucaaaagcaagauacuucucaagcaagauaaucuaguuucaauccugccuacuccucucagguccuaacugcuaccagcccauggucauggccguggagguaaggcagaacaccugcucucugauaacucuaagccccgcugaugaugaaucugugacgggcgcucacagguuauuucauucucucgaaucacuaugacucgcagcacaaaggucccuuagcaaacagcacagcaaugggcagcuugaggcgcugcgccgugcgugugacccugcugaucugggaaccgaggucagccacucggcucccaacguccgguucaacucccucugaguuggccuagccucaguuuaccuggucguugcagccggacuuguccggcuuccugcgcugucagcggacgccugcggagccgcaggacaagaggggagggcggagaagccacagccaguaccgcugcaagcacuuaacucuucuccaaggaauauagggaccgccccuucg

SEQ ID NO: 1068 - RNA, 16618 nt, Mus musculus
cgaaggggcggucccuauauuccuuggagaagaguuaagugcuugcagcgguacuggcuguggcuucuccgcccuccccucuuguccugcggcuccgcaggcguccgcugacagcgcaggaagccggacaaguccggcugcaacgaccagguaaacugaggcuaggccaacucagagggaguugaaccggacguugggagccgaguggcugaccucgguucccagaucagcagggucacacgcacggcgcagcgccucaagcugcccauugcugugcuguuugcuaagggaccuuugugcugcgagucauagugauucgagagaaugaaauaaccugugagcgcccgucacagauucaucaucagcggggcuuagaguuaucagagagcagguguucugccuuaccuccacggccaugaccaugggcugguagcaguuaggaccugagaggaguaggcaggauugaaacuagauuaucuugcuugagaaguaucuugcuuuugaauuaagaacuucaaugucaucuagacauggauucaaaugccaauuuucuuuuagcuguaagacccuugaaccuuaggcaaaccaaaccccucuuacccuauccaagccuuggcuuguucaucuguaaaacuggaccagcagcaccugccaagccaccgucaagagaauuauaguagaccucacaagugagacacuuggcuuucccugggacaguacuguuuuaguguauggugugacuggucacauaugcuggaccagccuuuggacuguggcauggcgguacuuguguaaaacgacagagcaggagauggaaagccuuugguuuucuggccagacuugcaagcuggcacucuggugauccugaacaggguagguuggcucaaccaggugaggaccaagagcccugaacugacggagcuacgucuagcagucucucucauuuuuaguauaaagacgugugugugugugugugugugugugugugcgugugcgugugcgcguacgcguacuuuagucuuugagacagaguuuuucauuggccugaaacucaacaauuaggcuagacuggcuggcuagcaagccccaggaaucuaccugucuccaccuauccggcacugggauuacaagcauagaccacuguguacaaacuuuuuuauguggguucuggggauuuaacugaucuucaggcuuucaguggaaacauuuuaccagccaugcugucuuccuagccccacacugguuuuaaaagaaagcuauccagaagggagaggacucugacagggaaugaagaccagaccuagauuaagacaaagaaagggaaugagugaggauauagagugcagauuaucuggggaauagcucaagcuagcaugugccuuccaggccggcaccuguaccauuaaaaacaaaggcagcacgauaaugaagcuuaacuuuggguggagccuggaacucauagcaggcccugaaccuuuucaaugguauccaagaggucuggaucugaagaaggaagacaugggccacgucccaaaguugaucaucacuaggcuuuuccaagaagugaaaagucaagucccuugcaccuuccaucuguucaguggacagaggcagugcaagccuguguuccauacacagcagcaacaguguaggcucaguaguuaaagagacagacauugcuacugaacccagggagauagcuaagcaaugugugaagccaaguaucugggcucuuggugcccugagucucccuguucaccagcagcagaaacugguaccuacuagaggugauggaggguagcuccuaagccaagcuggcugggguucuagcuugagcaugugagcagaagaaaguguuuaacucaaaaggcaacaggaccaaguauuuuuaaaaguugcaugagguagcugggaagccauuucuagcaauagccauuugccuaacuuggggcugaguccuaguccugcacaccuuagccuuccccagugaagggggacauccucuaaaagcuagagguagcggccuggccaucuucauaacaucaucucaacaucugaggccuguguacaucagucgcucauaucuguuaccccacaugcaagacggcagguccgaguuagccugcuguguuucccacuugccugcaguggugggaacuuucaggaaacacugguugaggcaaggcugggauccccggagcuagcuuaaagccuggccuagucaucuguacucuggcuuuuugaaguaugacagggugaaaugaccugugcgagcacuucccaaguggcaugcugggacugcuugcuggggcaaaggagcgaagggaucuucaugacgguuuauagucuucugucuccuguggcugcuucuuuccuucaugaagggaucuucaugacaguucuauaguccucugucuccuguggcugcuucucuccuuuuaggcuuugaugcugggcuuugggaggaggaggcuguucucagcucugcugcagguucagaagaggcccugucaacccuccagaaacaugagacugguacaguuccaggcaccucaccuggaagagccucaccugggucuggagucagggguuggugggggaguuguagacuuaaaugcuuuugacucaacacucccuaagacaauggugcaguuccuggagcaaggagagaccacccuuucaguggcaagaagguaaguaagcaggcagucuugcccuaguuccucccuccucccauccccuucuccugccccgagaaucagaaccagaagguagcuagcuccccugcaaaggagcaggggaucccacugucugucuuucauuuguccuuuuaguaaagagcuaauagaaauauaaaucuuugcauuuuugagacagggucuugcucuguagcccaggcgggcuuugaacuggagagcuuucugccuuaaccccuugaaugcugggacugaauuagagguguauacgaccuuauaaaacaacacuuucaauuuaaagagagggaaacugagguucagaggaggugauuaauuuauuugauuguguagucaggaccuuaccucauuauauuggcugucaagaggcuaagucccucccacuggaggagccuggcacaaggcccuaaagaacccucuugggaagauguaggugugguuuagacuauuaaagagauuccucaaguuugugcuacauuaacugggagugacccugcagccagucauggaauaauccgucuaaagggucaagcaguaguuuagaagccauuuaagaaggcguuuucacucagcagaguggcagaaauagaaauguuugacagcacagugacccagagcacugugaccccaaauggucauuuucuuaaaaguuagaaaccacuuccuuuccuguuauuaggaagccaguauguguugacaguguagaauagcagccauaaggaggaggaugcuguuaauccccauacucaggaggcaaaggcauguggcucucuugaguccaaggccagccuggucuacaaugaguuccaggcuauauagagaaaacaaagugggguggggaggggaaggacuuuguguucuagagaaaguuaaaaugcauaauauacucuaucauucauauacaaaaccaugagaugagaaggguguuccacugcagcugguaugagcuaugcaggacacaggaguugucuccagggagggacacggugacuuagaagaggugagggaaaccuuuccacucacucccaaguguacccuucacaugugcaacaauuacccaaguggggacgaaaugagcacuugaugaauaccaccauguuugcuauaaaaggacugaguccuuuacacugauaggugaaagaucuagaaaaugcaaaaagcaaaagucauaacugcugagggaucgccccagccugcucugggauucccaaccuggucgagcuagcccuucuccugcuugaucacuacagagcccuggcuacccagcugccugucaucccucggucacaggugaccuucuuggccccugucacccggccagacaaggugauaugugugggcuugaauuaugcagaccacugccaagaacagaaugugcgggugcccaagagccccaucaucuucagcaaguucuccagcucuaucguggggcccuacgaugagaucauccucccaccagagagcaagguuugugcuccuuaccacccaggucaccgggcuccagcauaggcgucguuuccuuagagcagugguucucacucuuccuaguacugcaacacuuucauauaugguuguagugaccuccagccagaacauuauuugguugcugcuuauuuugcuguuauaaauuguaaauaucuucugauaugcaagaauauccuauauguaaccccaguggugguggugacccaaggguugaaaacaguugucuuaagggacucugucacucaguaauauacuauacuagagaagauugcgcuguacuaauacagccucagguauaggugacaggaggaauuaacuuucaucuuucccaauuacaaaaguaacuuucuacagugaaaguauauuaauaaucuagauaaagccaccagcaucccugcugggcacacuuugguaugcacauuuugcuucgcauucucccaguggugcuuguccagcugugucucugccacacgugcaccuuguccagauuccuucaagagcaucucucaucccacucagacuucucccuaacacguuugagguugcuaaaugguuuccuuuccugacaguuugugaagaacuguuuccucagagugcccuuugcucaguucugccuuccuucucugugaugagacucagcugaggcaguuuucugaggcauccugcacaggaaugaccuguuucccacagcagcccgucagggggcucccaugccaggguugucaagugugaccauuuguuuacucucugccaugacugcccgugaggcuggagugggugaggacccuggagcuggaguuacacacaaugugaacaccugauauggguacuaggaaacucuccuaaagagagucucuuuagucucuaguuugugguguucuccccacccccacucuauggacucuccccaucuaccuuguuuaggcaggcagggucuccugauuuugugcauaccccaggcuggcugguuccuaagcugugauugucucugcugggauugcagaugugugcugcugcauccagcuuuuggaucugggucaucagcuucuguggccagcaccuucaccugcaucaccaccuccuauccuucccucugugcucuuaggauuuacuuggaguucucauuuuuccucuuacucaguuuggccaguggacccauccuguggacuucuauucacuuuugaacacaucuuuacuuucuggccuucacugaaggcuccuuugugcuuucuccugcaugagucagccauuucccugaggagccuucuuccuuuaguugcauggguagcacaggcuagcaccccgguucaggugaacuucugccaguucucauuaucaugaaaaacagccagggaagaguaaauuguaaguucuuucugguugcauuuugcucucuugcagagccuggcauuugcagacauuuuguagccaugugcauuucuucuugugaguucuguggccuauuguggcuuaagccccuuaaauacauuuauuccaguaucucagucuauuaaaaugaguaaaugcauuauaguacauacagugucaggcacacaguaguuacacauuucucaguguuuacuggccucacucuucacugcaggugucaggagugaguguaaauucagggccccagacauguguucaucuccuagucacuuccagugcugcugcuuaccacugcccagagcuuauggucugcaagccgugcccacacgucguucccuucacccugguucuagaagcuaaggucuaccucacagccucugcagcucaccuauccucucccacuuugcaggaaguugacugggaggucgagauggccguggucauugggaagaaaggcaaacacaucaaggugagguggaagggggucccagaccagggaggagcagcaguccuggaucccgccucugcuaguccugaccauaccccccacacugguacuguucuacacuggaacacacugggcuuucacauaccaccuuuagcuacccuuggugcuaaugugugauaauggcuuugagauucuuuguuuuagagguugugucaccugugauguaaccuuaucuggccaaaucuccugccccaauaggccacagaugucauggcucacguggcuggcuucacuguggcucaugaugugagugcucgggacuggcaaaugagaaauggaaagcagugguuacugggaaaaacuuuugauacuuucugcccccugggcccugccuugguuaccaaggauaccauagcagguaggucacuggucuuugccgauuaugcccuuccaugugcaauaccuuugagugucgggacaaagcggugcucuagcaaggacucugguuacagcuauccacagagcugcagugucacugcuguucccagccucagcuaugagccagcucucaguacaacuuccuuccaugagccucuuagagggaacacagcugcaacugcugugaaacuacauccauagugugaacuacagccaacacugcacgugggagaaggggcuuccuccacccaccuccaucuggaauaguccuuaggcuggaaggaguaagacuguuuagcaugcuggagaauggccaugaugaaaccuguucauuucugcaagggagucggagcaucaauaggaucucacacauccucuaugcaugcauccauggggucugucauggcucgugggugagccccucaagauagcagugccucagaagcuguauuccaacugcugucaggugggaaggauagcuuggguaaccccauuaucugcugcugugucucugucacuuuggagauacugagucauuuuagaucuacaauuaccagccucugcuguggauugaugccuguuuuuuccuauuuuauuuuucuauuauuuuuauuuuacugugaaauauguuaaauauauagagaauuaguguaguucauaacuaagugaauguacuauuuuuuaaaguuuuaugugaguacucuguccucagacacaccagaagagggcaucagaucccauuacagaugguugugagccaccauguguauauugagaauugaacucgggaccccuggaagagcagccauugcuacugagccaucucucuagcccccugaauguacucuuuuuaaaacacuauuuuuauauaugcauaugugcacaccauggcccauggauggaagucagaggucaauuugcaagaguugauucucuuccuggguucauaugggucccaggaauuaaacucaggccccaaggcuuggcaguaagugacuaccugugacccaucuugccuggccugcaugcccauuuuuuaaaggcaaaucagcuguuuuucucccaguucagagacuacaggagacuacuccuuuccucacuugaugcaggaauucaggggaccagucuuuacaggaagucccaggguaaagugcuaaucaggcugggcagacaugcucccuaaguuuccuuucuuuuagggcuggggguuggguguagauaaucccaguguugauuuugaauuccagauccacacaauuuaaagaucugcugucgagugaauggagagguaguccagagcagcaacaccaaccagaugguguucaagacugaauaucugauagccugggucucccaguaaguggauggaaccugucagagccagccccacccgcuggcacaccugggaacuaagcccacucucagccgacugucugacuugaccccucuacuccccuagguuugucacucuuuacccaggggaccuccuccugacugggacgccuccagguguuggcauguuuaggaagccuccugucuuccucaagguaaguuaguuuagaagaggaaaugguggaaagaugaaagcuagguggccuguaaagcuugaagcagccugggggcuuuaaaggggaaagcguguucaggagccaaaggcuaaaagccuuguggcauacuguguuacagaagggcgaugaaguccagugugagauugaagaacuuggugucaucaucaacaagguggugugauggugucccuguuagcacuggacuugacacaaggcgggacuucugcucccacccagcuaacugcuggcccuguccacuugaggcugcucuuagguaggccuuggaaauaaauuuucucucagaguugcaguuuagcuuccacugucuuuuagucauacagccacacacuucucccccaccuccccugucccugaaggugggccguuucacggggcuaaggagggagcagauauuggacauguacuucagacuuaggaagaaacuaaccuagucuauuuauuacaccaaaugaugagcaaacacagguucagguuagcuguguccugagcagagacacacacuugaguuuaagcugacaagucccaucaggcuccaccugguacuaacugcagaugaacugucggauaaauuguuccagcuuguccugauugucccggguggcaaauguaggggacagguggagcugggguccuguagggcuaggcaucuccugaaguaccugaaccacaagauggacuguaagcaccccugcugaggggaacaagcuugucccccaaaaccuauagauaucucacagugccuaaguguguuacuacuugauauaguguguuacuacuugauaacacacauuccuuugugaauuaggaaggcagaaaaacuauccauucuaucauucauuaggauguuagagccuccaccacuacccccucccugcccauuggguaagggaacaagaugguucccuugagcaguucuagcagcccauggggcugagggugaggucagagacaggauggugauauggccucuuacccccagaucuuugaacguccagacugcacugauagcaagguuugggucugcacacucuggagggaagaaaggcaguaaaagcucugaggcaggcagggagccacuaggcaggacuuccuuuaagaggaagaccaacucgggccuacuuggagccaaagacccuucccugaagucaggcagccacuucccagcagggggcagcagucaccagcaagccuaccccuggggagccugggauggggcuuggaacucaccaaagaucccuucuucuugggcacaggccuguaaaaacuggaacaacuucucugaguaggccaccucugcaggagagauuagaccuauaccucagcuuugggacugagccccacacucaacacugcuaggggaguguucagaaccuuaccugaaucuggcagcugcccuaaguggaggaagguggccgccugugcgaaggccuugaguaugggacugagcaagcggcagaggaagaggaagaagucagggcagcgggauugcuggcuaagcuggagagagaccagagugagcaagguagguucccaugcaccucaccuccaccugccuccccagguagcuccuccccacacacccugaagcagcggccuccuggcuccucaaagucaucacucucacugucaguaaaguccccacucggcuuccacagcagcuuugcacucagaugcugucuuccugugucacaggcuggccgggagccuggagucugggggagaguuauuggucuggucccugguaaggcugggcaggaagcagcacuauagcccucauaccuggccuuggcaggucaaagcaggucugggaagcccaaaaggcuguucagagcuacuugggccaaauacccaagcucacuaagaaauguggaagcagacaguauggagagaaccuuagagcuacacaugccaagguggcaugagacacaugcccagugcaggcaggcuuccaugugcccagccacuggcaguacacucccagagcacaccugggucagagaaacaguccaggacacuggcacuuggagugggagccuaccuccucagcaacuaggaguccacacuggaugagccggucuagcacuuccugacaguagcaguaggaagacuggcagggcuguaggaagagaagcaccaaugcccuucagagaacacccauggggggaaggggcugcuggcagaauccugaccagagguguuuggaggccaaagucacuaucacaggaggucauaaggacaaggcccaagguccugcugagcuacaggagggggucugaccuggggcagcaguaggucuugagguagcaggugcagcagcaguaggaucuggcgguacaguucauucugacucaguagcucuaugcccugcagcucccagggccccucaggugguacucugccugccagcaacccccgcacugcacaggcuggcagagaagauggcauaagaaggggaccugcucccucccucuccccugcacaugcaucccaauccugcugacccacugacucaccacccacagccucacucaggaagguuggcagcaauuccauacucaagcgugccaggugugugaggccugggccaggccgagguaccaccaccaaguccccuugguggacacgcagcagaaccacaugugcccucaauaggcucaguguauguugggccaggcaccgcagcugcccugagaagcccacaucaaaaccucggagcagugucuccucugucagccaggagaauucucccaggagcugugacaggaccacacccuggaggcaaaacaggccugagcagagugccacgccuggcccuucccuggccccacccaccaugcagugccuuaccuuuuggugcuucagcaaaagcaguguggccaugauggcugugcucaucacugcggagcuggccacacuggcuggggagagaggggaaggugcugaugggaggggccuagagagccuugaucucuccuccaucauuugacagauguucccagacacacaacccaaacucuacccuagcaggggagagcaggaucacgugcauugugagccagagccaccccaacagcaugccagagggacauccagucagcacgugccuucuguaggcacauguugcuccuccacucagucauccucacagcuaaggacacuguuaaaaggaccuuuagggugagguuggggggaucucacagagaucugcacagcugccuuuggcucagauacugagcucaucugcuccccacuucccuggaugccccgcucuuccaguaucccugugugcugugaagggggugggggucagguacgggcauccaugggguccugauaacuagcccuuuauuaucuacacagagaaagugcuguucaagucacacuccaaaggugcagcucugcguuucccuuaccacucagaacaugccggcucagucuucugaccaggagcugguccuccucuuuaagggccaggaggaggccaguuggugggguccacuccugcuccuucucaguguccggaacaacacuacugggauacagacagaucaaagaaugaagcgggccuaaaauguuguaagagucaaaagcuuuucaaagcuacagcuguuuucccaaguccuaggagaauucauauaacccuccccacuuccaggccuaugugccacccuacauuuggacuauacggacaucugguguugauguucugggauagucagaguugaagagccgccugccucccucugagacccauacaucugugcuccuuaccauucaccuagcacaaugggcugcaacaaguguuccagggucugccugcuaucccagcaacuucuagcauugaugguguauuccugcccaggauaaagaugugaggucugcccuugccacaccccacccccaagaaaccuguacacaaaccaucuaagagaaaauacuauccuuacaaugcuuugaaggccaaaccaccacaaagguuaaucccagccuuucccaacugguuucauaccuggagggaaaauggcugggcaaggugcacccgaacacagacucuacgguugcagccccagcaguuacacagucuccgaaagacagccaaggcuccuguccauagccccaggggagccaaauccugcagggaaugagaggcugcacauguauuuucuugggcaagucucggggcugccacccuuuccgcccuccacacuguucacggcucuucacugaguccugucuuuccaccuacagucuguacuguggggucuuuugaaagauggugauagcaaagaugggagacccuuuaggauagugacuauagggacaguucuuaaacacuucacaucccaaucugacuucagcccuaaaggaacccagccacagaacauugugccacccagaacugguugauaaucuacucggaucccaggucucacaugguucauguuacauggugcaucuggaaccaggucauaggcaauggcaacugguaccaguguggcaucugagauaaugccugccuggaccgccuggauuaccacuccuagccaggccuggcccagggcagaaagccugggcccuggggacccagggggcucuuccaggaagaugagcagaggcugaccacuaguaagcagcuccuccacagucuagaagaggagaggaaggguggacaucaaggccagcucagcagcagacccuacacccuuggcccaccccacgcauaaccacugggaacacucacugcacggaccacagcccuugcaaggaugcccucugaguuguccaaggagagguugaccucugggggcaggaaaagucccccaaguuuccucaauagagcucugugagcacaggacaguaaugaaaaggggcucugaaggagaggccgggcccagaggccugcaaaggccuugauucuuccacaccugucuguuuagaaacuugaaguagccauggcccaagcgaccuguagccacccuuccauuugagucuguaagcugggcugccauagcugaaaauaggcugagaaaacaaaauaaccuccaucccacuucuccagcuagggccucccucucccaucaucauaccugagagcaggggaacaugugcgggagucuaaagccacacggaccacaccgaggccuugggagaacaguacaaaaggcagcaggaauccauccaagagggacuuguguguagaaaggaagacaaguggagagcccugcuccagagacagaaggaaaugcccauccuaaaaacacagccaaacuucagcaccugaagucccagggcagcacugagggaggaagggcuucuccucugcaagguaaacuucccuaagguaaagcagccuuuccacaacuuuaaaaggaaauacaguggcuuguuucaauggcuguugaaacugaagguugagcaggagacccuguagcagcagggcuaacauggcagcaagguuauuuaggaaauguggauucucuaacagcugaugcagccuagauucaccuacacucuggccauccaagcccauucaguauggucuggcuuaccuccugcacagccuucugaaccaucuucaucugucccuugugaaguuguacauucaggaagaggcgguucaggaaccacagcagugcccagcugaacagccuuggaagcaaugccagcuugaggugcagcagggccaccuucuacaaggcucauccccguagcaccccaaaagguugcucagaacuccucuaagacaagcaacaucauugcccacauugaacagaagaggaaagugaguggagcgguuacaaccugcugagcaguaggcauugcuaagggggugcuagagcuauaaaguccucaugccacagaguacacuugugagguagacucuucuaagaccucaugcugcagcuggcucacaucagacacgaauucugccuccauuaucuaaagggggaccaaagaaccagacccuuuccacacagaacccagucagccuauauuuaccaacuaccaggaaaaguggagcaaaagggaaaugauacaaggagggcaaggcaugcugcacuugcucauaugcccgguagggggaccaucuuaccaaagaaguuaacagaaaaacugguggacaagcagcaaguccacaucugauggaagcauuaaauggggcaauucugagaagcagcaauauguggggacacaggagaaugucgugccccuguaaaugcuguacuguaaaaaaaaaaccuaccuuacuacuuagguguacagaggagguaggaagcccacuagaauugcgcuugggagcuccuacacaagggcaugaguccuagggccugaaaaccucaaucgagggaagaacuguuacaguggaggauugguccaggucaccaacagccugugcuuccuuuucacuuaagacagcugagccugacacccaaccccgagcccuuuuccuucagcaccuuaacucaugcuccggcuuuaaccauaaacuguauauuacagcucugcaaauauaugucccuucuucugagcucccaggccuauacagacaaccaagucauuaagucaguuacuggaacucuuugaauccaaacauccauccaaggccaccucccuucucaugaagccugacccucuuguauacacacuggguacuaggccagaaacggauuuccuaucucacuacuuucccguuuccucucagcacuuuugguccaucugugaguccccugaguuaccaccuuaacuucucaaucuagucuuuccagccugucagucagcucugcagaugcucugguuucuacucuuguugccaagcccaucauucugccacuuuccacuuaaaacuguugagccguucugacuacccuuagaguagccucuacuuauuuggcucugaucugguuccuuucacgucucagauucuccagcugcucucaucuucacucaccagcuuccacagcucccaaccuuguuacaucuucagugagccuggcccuuuccugcucaaggcccugacucaggccuuucccucuaaagagaccauuuccucaacuuuuacuccuaugccuccagggcuggcuuucuucccuccuggcucuaacuacaauguccgcccuccuggauauucuggcucuuuccuugucccuuccuuugaccagcuguaucacuguccaccucuuuaauccccagcaucuaagcaugcagaucugcucuguaggaacccagggaagggcugcagucggcuguagcccauucuguaaccaucauccaaauacucgggaagaacaucuggugauuguccaagcccagccggcauccacucuccagaaggggcagaggccucaaccuaaggaugcaugccccucaccauaguuaccugagcaagaaggggcgggguguggucugaauguggcccaggauacgcuguaccucuuucuucacuaauucaggcgccuggccuucuccagccgcucccggaacccuccccgagaggagguucugcacccuguugaggucaggggacagcguugggcuaaauaccaauagucucccuagucaguccuccagugcacagccagaaaagucugauaugggcccaaacagagauaacauuccagaagucuugcccagccagcccuggccauccugaccuauagccuuugucaccccuuuaaguaucccacaaaugccagacucugaucugccuccucacccaguguuuuccaugaucuucugggaggcaucaaaacugguggguaugugcugcuccagggaccacaggaaauagcagagccugcgaaccagccagccccggaaccugggggaagacaguucagaaagugcuccccagagcccacagaggucugucuauucaucaggaaggguuugcaccccagucucauaucccaggaccaagcucgaccauggaacaacaacaaacaaaaaaaccaaaacaaacaaacaaacaaacuacucacuugccuauauaggccuuagucccacccugcuuccccacugagggggcacaguggcucuacaccuuacaggcagcccauagaaggaacugcaggggaguaaagcuugccuccauuugcuauggaucuccuuuuguccauuguaggaagaaagugaugccacagaaggcccuugcaacccacugccugccccaacagcuccaacuaccugguguucuccuccuucacaaggaucacguugcagaagcccagguccauuaugcuucuguggaagagggacuccuguccaagagggaaggacagcauguccuagggugcuuuugcaagucacaucuguacccuauccaucuagccucugccugguggccuuuugaguauaccagaagaagguauagaguacauuucccaugagcugucuaccccagaucauaauguuggcucagaaagaaaagggcuccaugcuuaaaaugacaccacuguccccuuguguggaguugcccucuuagagcuaagcacauuaaggcccugaguagggguauuaccucaucuggagaagaaaaugugcaucuugaaucucca

SEQ ID NO: 1069 - RNA, 12462 nt, Mus musculus
caguucugcggaaccgggaaagagucugggaacaucgggaaggagcccgggggugaaugagacaaagugugggaaguccguaaaggcccaaaguuuauuaaacauauguugccuuuguuguguauucaugguacagguuguucacacacagucauguuccagcccgaggccacggguuuuaccccaccugcucauggcuuuacacuauccaugcuugcccaaaugagucacauaugaugguucuggacuccuccccugaaacuuuaagccugcaauaaacuguuucuguguugcccuggucaugguguuuugucacggcaauagaaaguaacacaggggcuuucuucauuagcuucuugggauuaucauuuaaggcuucuaccuuuccugagggcagugguuguugggcaagccacauuugcuaccuaaugucuuggucaugauucgaaacaccugcagucucugagcaaguucagaauugcuugugagagugccuuggcuacuuuguaagucuuugcagcacaggcuggggaggcuuuaguucauucaguaaggauauccaugaagaccuauaggcagcugaagacguggcaagacuugguaaacuauguccuccaaaucugucacagguucgugaccaugucugagcacauaccaugcagcccccaagaaacucaggagcagacuggaagaaucauuuuccugagaagaggugauuguauguuucuccugaccuuguccaaccaaaguaucacagggcucuuuuacaagcucucugggaacauaguugaggauuucuguaugcagccauccuucagaauugcagaagaacccuuucacagcugcccuuuucacugccuuaggggcagaccgaggcuuacaagagauccaugagacugacagaggcgaaagggaucaacaaaaauuagacagcagugcugagaccuuggcagccuagugauaugauuuauucccucuacugacaagccacccauuuagugcccccuguagccgacauagcaacacuggagaguuucuggaugccaugcacgagagacaaaaccuguggucaauauuugaugggacugcucuuggaguucagcaaaucacuuuccuuccagaaagcagcaugaacauguaacauccagaagguagguauuuacucaguagaaaaauuuacuucuuuaccaauucuagguucuauuuaagaaaaacugauauuggagagguuuaauugauagccaaagagaucaagguuuuaggaaggguguacagauaguaaugggagaucaaagagucauugucagucccuggagauacuggggucaucuuggguuucaggauccaguuguucagacagguaugguaugaccauuugugaccacccaauggccagaugagaauggguaucagcccugcuuuuugguaauguauaguugaaacagcccaucccuuuggaagucccagugcuggagcuuucuuaagccuaucaaaagaguguuccuuaaucccucaauuacaaaugguaugggcuugggacccucauuuaauuucucaugacuggccuggcuauuucuuuaaauauuguaauucauauucugcaguauccaguuaauuccagaaaagccaaaaccugucuuuugguucagagagggggcaaauccagaucucauaguaccaaaugaagguugccuuuuuuuuuuuuuuuuuuuuuuuuuuuuuugccucacaaauugagaauuuucccuagaaguuuugcuuccuuuuugaaguuuuguagccuuuuugagcuuuugagauacaaagaggccagguggggugaugcacaccuuaaagcccaggucuuuggaggcagagacagguggaucuccaaguuugaagccauccugguuuacauagugaguucaggacacagagagaggggggugggguggggaauggacugagcuacaacguuuaaagucuguuguuuggcugguauccucugaagcaguagguagaaggucacccucauucaggauuacagcuacagaguuggguguaaauucuccgacaugcuaccaaaucugggauuaaaccuacaccacgaauucuugauggaagacugcgacagguauguuucugggcucaugcaucugggauagucuacugaaagaacgggaacccuggcuuucagaaaaaauagguacacuggcaaaccggaaacgaacuagaaaucgaacuugugcuguuuagggucagagccugguccuauccguuucagcaccacagaccuggagugcaaccuugugcaggauuuuacccgucaucucacggcgcgccggcuauugaugcuucugggaaguguaguucaugcaaaggcaacacuaugauuggagcucagaggccgaagaucuucgcgcaggcgcacugccuucccgacacgaggcggugaguguucgcagguucccaguacucuugccaaaggugaggguugcgggucuagguguucaagaagccgaguggacgcgguggcggaggagacacggggacacugggcacuugggggaggguuagugggcguggccuguguggacagagagucuucccuucuggugugugucgguuccguggggacaguguccucguaggguauguccacugugugucagaauccuguacuuucaaguuggagaucccggucuuccuuucguuccuucuuuccaugaugggugcuacguggauguggaugguaccgacgcuaaaucugggagcauccacuccauucucucccaaguccccuagaaaacgucucccuuugcuucagcuucucgcccugagccugcaccggaauguccuggugugagcauaggguguuccuggacgauaccggauuugaggugaagaaaaccccaaaggaaaucgcaaauggcuuuaggcaauuuuaagaugauauugacuggagugcacuguuaaggaauagugggaaauaagggugaagggacuauacugcggccagacaagacccacaguaucagaguaagacccaccaagcacgauauuuugugcgucucaaaugaggucaacauaaacaaaauuuugagaaacaauucuagagguugacauucugaccaccguuaaaucgaacuagcacaacuucguuccaaccaccaguaagugucagaugucuagaaguccgugggauggccaguugucuguuacuccauugaaguuguuggcaauuuacuagugaucuuuucccuaguguucuuuuuacauuugagauacgaucuuauuuuguagcuuaaccuggcguuguguuaagccuuagccuuccaagugcuagcauuacggguguauaucaccauaguucuguuuuccgugaaauuucagucacgcgaaucaagcuucccgggaugcugggauguguugcagguaaagaucugcuuaacuuuauggcuaucuuucaaugaaaguaaauuauaacagaauuaaaagcuuccaggcagacuuuucccaguuccaccucagccuuuuacaaagccugacucucuuaauugcugugaaauagugccucucuuauugauguaugacgauggaacuaaauuaucuuuauagaaagcacucagcauagugccucaugagagcaagcacucaacgcuaguuaugguggaguuccguagugcuccaagugugucuagccgcuggacaauagauuauuuaaucaaguugucugucauagaugcuuaggagaguccagauuuugguugcauuaccuaaagauuaaauaggauauguguaaugugcuuaggaagcuggcuggcagauaacuuucaauaaagauaacguguuagugaugguuaauuaaagccguuguaacuauucucuuauacuucuuaaauaaauucucgaagagaauuggccaaccuaagaaugucuguguuugaaggcucuugcuacuugucccagugaucuuccuaaagaacuuaacuaaugaggacacagcuaugcugaaaucaccccuugcccaaagcaccuuuugauguacucugaccucugcugguuucuccgguuucauguucucuacgguguugcucacaagugacuuucuccuaucuaauuucaguaguaguucuugaugugauaacgaucugccucuaucuauucaagacuccagguccucccagccugugaaguuucgagcacacacacacacacacacacacacacacacacacacaucaaaacuguaggucccagaugugcagagaaagcugcugcauuucucccuugaccucuuccggccugggcuaaggcagugcugagauugcaagcacacaccgccacaccccaucagucuuuaguuagacucuucauugugagagagugagauccaguuagcuaacuuaagcaaagggagguugaagaggguaagagucuucuggaaauccaagaauaaguaaagcugcaaccggagcucacuucucuccucgggaagcaccggugagcuccagcacuucagcacuaauggagccgccaccacauccauugguucugucuuccaggacucugcuccucugggcccugugacuacacagaaccuucuccuagcuuuuugacucaucuccugcauauugucccaacguuuuaaaauucauguucacaaagaaggaugucaucuuuucauaccagaucauaucugucguaguuuuuguugacuaaauacaaacuuaggcacacuugggaagagagaaucuccacugaguugccuccgucggccuguuagcauauuugugugggacaucuucugaauugccagucgauauaggaagaccuagcccacugcggauagugucaccccgggaagguaggccugggcuguguaaguagcugagcaagccaguaaacagugucccuacacagucucuguuucaguuucugccccagguuccagccaaggcuucucuugguaaugugcuguaaucugcgacccauaugaaccuguucuucccugaguugcuuucauccaguguuuccuuagagcaagagaaagccgaccgggaugugccuaguuacacacucaaugcucagcugugauaugaucagucugguucuggaagugaggugaacagucuuacagugucggauggaugcuucauuagcuggagcuguaaaugggaugcugcucugaagaggauacagaacuuguuugucuuauccauccagucguuucuaaaguuccuugcgguguuugcucaguaagcauucagggugauauuaaaugugaauauauaaauaucacaugacucucgcuauauucugauuccuggguucugauuccugggaacagaaaucaaugcgcuguggcuuuaauauccauagccuuuguucuaacucuggacugagcauggagugcucuuggccuugcuugguuuacucuuugugaggugauggggaugaagguggcuacauugcacucacugguguauggaggggccuugccacgugggucaggaccccagaaaugcucauucucauaucuuuucucccccacacuuuuuccucacuaggacucuuauccuucccuaccagagcagcauaggagagaauggcugccgugucuccgccuaccagaugucaggugagguggacuuguuuugcuuccaaaagacuguuauugguugccaaaauguaguuaguuucuuuaucccaagugucuuccuuccuaguccucuauuccuagcccagugaaaggcuccaaaacaaggugaccuucaguuccuugagccugcgcuuaccagccuaggaccaagcccaagacaccuguagcuguuguuccacgugaucuuccccaaagcugacagaacaggucaccuggaggucaucuaggaucagugguucugucuuggcugucccacuggugcggccaguuauggacugagugagagcccccauacaucaaagagugcuggguuaggcuggaguauauguugcuugcuauaaaacacugagaguuagacccugucucaugaaaaacaaaacagacaacaagaaaggaaaggguuguaagggggaguaugguuguauuuucaggcauuggugacauuugaagauguggcggugacuuucacagaugacgaguggaagcgucugguacccgugcagagggcucucuacaaggccgugaugcuagagaacuaugagagcaucaucucucugggugagcaucaucucacugggugagcaucaucucacugggugaggaggcucccugugaggagucagaacucguccugaaugagugugaggcacaugagcugcggaucacuacccaccugaguucagagccaccuggcagacaaaaagagccaaaggagauggcuuuagaugcacagaucgugaacccagcccuggacagaucggcugcccugauguuaacagcacuaggcagccacaggccucccuguucagcaacuuguuugacaaaacagaaggcaaucuagaggauagagcagaguauguaauguauguguagaucuggcuuuccggaggcagcaaguaaaaucguuacuauguccaggucuucuccugacaugccaacagaucauguccuuaguuccaucugguagaauaaggagccaucuuggugcgaggagauauugaucccuucauggaagccagaggaagaagcuacaaagauguggcccugugaacaggagaaagguuaucagagauaugcuugauuuuugaguauuuguuuuauugacacuaccuauaaauggcacuuuguaguuauacuuaugugacaaggggaaauugagagcuguugucgaugccagcuguuaaugagguaaagugaaguacccguaaguaauaaggaacucaaagaagcuuccaggauaagagucugaagcuaagaacaguggugcauuccugcagucuuggccacucuggaagcaggaguacacagguauagaaacaaacuaaaacagcagauuuauauuaaaaaagcaaauauugggcagaggguguagcuaagugguccuguguuuuccuagcauaugcaaggccuucuguuuaauaccuaccuccacacacacacacacacacacacacacacacacacacacacacacacacuucuggauuaagcccaaaucauauccuaaacagaacagaauguucaauugccauugaggaacaccugagcuuuagagagugaaaucuuaggacaguaugggaucccugagguuagagaccagaagcaccaggaagggaugccaauggcccgucaggagagaaccagcacacagcagacagaugcuucucaagcaggaggagaaaauaccugucucccagggcagauccccgcgcgugcacagggagcuccgucucccagggcagaaacccgcgcgcacagggaacuccgguguuucuaggcaugggaucgaacuuuguuuauauggcuauggguaugauugcuucuggcgaaugaaugauacaaggaaugcaauaagauuacuaauucauacagcucacggggacacauuugccacaguauuguauagccauuaaaaacacuguagaaaaucugugcuaauuaaauuaauauuuuaaauucguuacaugcaaagaacuucaguuuacaagucaguauuucauuauccaguuuuuaaaaaguucuuauaacauuucauugcuuuuuuuucuuuauucauuugaggguggggcauacauaugccacagcaugugugugaaggucagaggacaacucucgggaguuuccucuuugcuuuuaccaugccagcucuagggagccagcccaguuuagcagacuuggugcauccaauaaaccaucucacuugcccuauuaucuaguuguuaguagaaucacauguaaggucuuucugcaucaacaugaaaugaaggaaagaaaaauuaguagacagcaugacaggugauuguuuuucuuuuuacuuguacagaacucuaacuuuccuacagugaacacaacugacguguuucaguaaaagcauuauacuaaauacgagcaaacaaauuugagcuccuccuucagcguuuuuagucgagaugauuccguuuucuuuuuuuuuuuuuuuuuuuuaauacuuaccucuugagccaagggccucuauccugccggugccaauggaaagcuuuccuucgcugcuugugaacugagguggguuuugugggcacuacccuggugccugccguuuguuccuuucaagagcuccaguccugaccuucccucgggcuuuuuggucaguucucugcauuucuagaagagucuagacuuagaggccaggguuaaguuuuggaaugguuugacauuuucaucccagcagccaccugccuuucuuuuccuccaugagcaggucuuccuguuccucgaccugaugugauucuucaguucaagagaaggggcgagcccuggauucgggguuuucauggaucugaggagaaaacauggccagagagugucucucuagguaagcagguuggaacagcaugggcaggauuguguuugcuucuguugucugggucggaggaguguuaggagccaccuuugcucaaaugcagguugucugguugucugggucagaggaguguuaggagccaccuuugcucaaaugcagguugucugguugucugggucagaggaguguuaggagccaccuuugcucaaaugcagguugucugguugucugggucagaggaguguuaggagccaccuuugcucagacagguugucuguuugcaugaucgauuccugucacucacugguucucuuucccccucuacacggucaaguguuauuuaucuguauucaccaacuuguuucucagaacugugaccuugccugugugcacuuaggauauuuuuauuggucacccagcucucuccucagccuacccuaauaagcuauugccccacucagggccguucuccuguauccugagaggucugcucagauuccuucccaggcuccuccuucauucccacaccuucggcuugagcugugccgugaccaggcaucaccuuuacgucuguccuagcaucucaccuuuacgucuguccuagcgucucuccccucugucaugucuccuaguccagagaagaaaccacauguguuuucucuuuguugcagacuuggaaacuaagccugagacccuagaugcuucaagaggcacacugagagaaauccauagaaagcaaaguucucuaugcccuaaacgagaaauccaaacacuaacaggugggccggaaccagagaaggaaagucccaaagcaaggacuugcaaaaagccccuuuccuuggauaaaggcuugcaucaaaugucagcuccauccaagaaagcccucacuaaacaccaagaccaggaauguagugagugugggaagaccuucuuugaccauucgucccucauccgacaccagaggacucacacuggagagaagccauaugacugucccgagugugggaaggccuucagccacaggagcagucucaguagacaucugauguuccacaccggagagaguccguacgagugugaugcauguggcaaggccuucuuugaccguucaucccuaacugugcaucagcggauucacacaggggagaagccguuuaaaugcaaugacuguggcaaagccuucuucgaccgcucaucccucacucgccaccagagaauccauaccggagagagucccuacgaaugccagcagugugggaaagccuucagccagaaaagcauucucacucggcaccugcugacccacacuggcaggaagccuuacgaaugcagggacugugggaaagcauucuauggcgucaccucccuaaacagacaccaaaaagugcacacugaggagccccgcuaucagugcagcgaguguggcaaagcuuucuuugaccgcucuucucuuacgcagcaccagaagauacacacuggagacaagccauaugagugcggcgaguguggaaaggccuucagccagaggugccggcucacgagacaucagagaguucauacgggggagaaacccuuugagugcagugugugcggcaaagaguucagcucuaaguccuccauuauucagcaucagagacguuacgccaaacaagggauagacagagggggaagcaugagcuagacagcgggccuuccugcgagccuggaaggguucccugucgucuacaaggccagcauuuguucuuucugccaacucuggccgcugucuucagcccaaccucugcuccaggguccgaguaaacggugcaccuccuuccugugcuacagaacuaacguggagugcagaaacuaaaccaugaaucuccacauucaaaauucugcacagaggcugcgcauagcucagugauagacucccgccuagcaugcaugaggagcugcaguuugaucccaagcacugcgaaaggaagcuggagagaucauaggacagauguuaggagaggaaucugcagacacagugagaauaggccuguuaucacugcacuuuaaauaucugcaggcuauuacaguuggagaaugucacaauuaugagagaguaccauuuucucuagaaguuucuauagcucuucuggagcuuuuuggcaccuagaccuuauucucuugugccucaguaaagcucuccuagacuaguaguagugguagcacuuacuaagcacugaucuuaggguaaagucucagcagugaauuguaaaagggcuagguugacugauccucucacuaaaucucugaaacggguccuuuuacugucugaauuucacagaggagcacccugaaguuuagagaaauuaaguacuauagucuaggagaugcaaggugaagccaggugucuugguuauuucucuauugcugugcagagacaugauggccaaggcaacuuagaaagcauuugcaggccuugcuuacaguuccagggggugagucucugaacaucaucauaggagcauggugacaggcagacccagugcuggagcagaacuuaaaucugauccacaagcaguaggccaagagauagggagagacagacagacuggucuuggcacacuggucuaggcaagggcuucugaaacuucaaagcccacccccagugacacaccucuuccaacaaagccacaccuccugauccuuucuaaacauuccaucaaucaggaaccaaacauucaaauaaguauaugagccuaagggggcaauucucauucaaaccaccacauucugcucacggacaugaucaacaaccaauccucacacugaaauaggccuuguugaaguucacagaucagcuuacugaagguuagagagauuaaguaaaauacccuacaugacacaaggagaaaugaggucuucaguaugaaucugccuucaguauuucuacuauagauuacacucuaaaauuuugucuuauaauuggcauaccugaacuaucuucuuagcuagauuguaagcauuuggaggugugauuuaauaggucucugugucuuacagcgugccuugcaaauauuaggugaucaauaaauguuuaucuaaaugaauacugaagugucucuauucaaaaccugcuuggguccaccuucuuucucucagaauuuucacaguccugccucuuaauauaguagucaucucucccaaguucuauuucuuccuucuucauugcucaugguacaauaaucaagaccugucacucucaucugguguguaugaguguccauucaaucuguacuguuugggcccagcacaucaccaugaauaaggaagggaacgcuaaagauaauuuuauugccuaggugccauucugaucacuucuacuugagccaguauccacaccugaaggcuacggauacaggcaccuugauauuuggaugacacuagaagccacugucaaaguuacauuuugcacacgacuuagcugaguccuuccacaugaucccuuucuacccauuauuccagaccuaaaagaagcucucuauuaaaugaaauaucucuagauauuuaaaaucuucaucaaugcaguuccccaucaccaagcuuuagauccugaguacccaaaugcaucuguuuccuuggagaaucccuguauuuuauuguauuaaaggucagguaugagacaaccuugacuuugggagucuucccuuuuugcaagguaaggccuggaaaugggcuuguguauuccaguagauccagguggauuuccauugaaacugagaggagguuaaguugccgaacaguccucucccaugcuacuaaacaaauucauuuuggcuucuugaagcagaagagugucagggaauacauuuguguguguguguguguguguguguguguguguauuuuauauaauaagcagcuugaagaaaaauaucacaggaucuguguguagauaauaccuaauguuuuguaaugucgaguaaaaaaauaaaggagacuauuggca

SEQ ID NO: 1070 - RNA, 31668 nt, Mus musculus
caagugcggcugcgcggggaauucgaaucgccggcggccuucgagacucgggguuaggggcugauggggaguuuggucggcggcuggugggguauuucgccgcugcgcguuuuuucucgucauggacaaccuagaaaaugucuuucgguaagugucggucaggugcggugaggugggccggucgggacgguuagaguccgggucccucaggcgcgcuuucuccucagcgccgcuuccucagcggguucgcugcaccaggccucagccaaggcgguagcccccgggucacucgaguagacgugcaagcugcagccggcuaccguuuugugccgaggauuugggcagucugcggaaccuucugaagucacguaucuucuccauggggaacuuccucuagacgcgagggacgccccgccuucaaaacccaaacuuguguggugguggagauuuuuggagaaaauuucaaagucugauaaaaaugccacccaacuaaggaaagaauuuauuauuucucgauugccugauacguaagaaaaaaauuaaagcugaacuuuaugggggggggggaaugcuugcuauuaagucauuugaggcuuccugcaggcacugauugguuauuuguuuuuguuuuggggucugggggcgggcgcuuaggugacuuacucagccugugauguuaagccauuuaaaacuguuaaaucggauguuacaagaaauacaauuuuauuuucaucaguucuuuagguauucuaagaguaagauauccaaaaucuguuggcguuaagcaauuuaauuuuugaucagaucgacuaaggauuuccccuccccguucuaaaauagaagcuagguauuuugauuuuuaaagacuaauuuauuuuaaugauuugauguuuaagccauuuucccaggaggugugguugguguggggcuauucaauguuuguuuaucuuggacaaauauuuguauuucuuauuuugcuaaauaagaacuucuaaacacagaaguagugcugacauuucaaacaugcuaaaaagaauccaaaaugaauccaaagugaaaaagugagaaucguugacuuaaaaauaaauugcuaaaaucucuacuaaauuaugagaaaaccauugcaguuucucugaaugaucauuucaguuugccagugaaauauauuuugagauauaguuuucuggucaucuaccaaaauacuacuuuuaaauucuuuuucuccuaaucuuaucauuucucaguuuaaaaaccuaugguuguuucucaacuugaugcauacugagaauacaguuaauugccauguauccucucuccaaaguuguacacauacuauucucacccuuacuugcuguaacuucugaacucauuacuguuuaugguuccagcccugcuccuuuuugugaaggaacaaagaagacauuuaaaaugcagauagagcuugccaccucuucucuucacacuuuauuugacucuuucugcucaaguucugucagccuguaugauuucccuaacaugccugugguagcuagcuaacaaguccuuaaguauaacauaugcccacucuuacuccuuuaguuugccccccuuuucuauuuaauaguuaacgaaacaugguacuauuuuuauguuuguguuuguuuaucccacuagcaucugaggucauugggcccugauuuguuugccugacuucuuaagcugugguuagguacuauggaaguaagggaagcaaaguccucugggagcauugucaucaugggcucuuccuuugggacaauguuagauuuggacucaagccaacagucucuggaaacuccgaauugaauuacuggggcuaucacaccaaaaggagaggcauucuuuggaucuuagucuaacccucuaacuuagcugugcucuugagaaauaagacaaugacguuggagaucaacuaaucuagauagacuaugaagcaaauacuguuucugacuuuuugaacacuucugaaugauugcucuuuuaugugauauuuggguuguugaagucaagauuuccauucucuaguacauagauaacauaauguagaaucaaauauaucuuugucaucuaggaauuauucuuucuuucauguguguacuucucuauucuagcauguuugaagcccauaugcaaagcuacacggguaaugacccacuuggagaaugggaaagguuagugcauguuuguuuguuuuccuuuaaacaaaggaaccauauuuuacccuguggaaaacuaauauccguggaaaacuaauauccguauuuuuuucuagcuuuauaaaguggguagaagagaauuuuccugacaauaaagaauacuugaugacauuauuagaacauuuaaugaaggaauuuuuacauaagaagaacuaccacaaugauucaagauucaucaauuauugcuuaaaauuuguaaguauaauuucagguagauaacuaaauauaauguuuuacuucugguccuuuccccuuuuuuuuuuuuuuuuuuuuuugcuguuguuguuuuugguuuuguuuugguuuuuuggaaggggguggggguuguagcccuggcuauccuggaacucacuguguagaccaggcuggacuggaacucaaagagauccaccuaccucuaccuccaaguguugggauuaaaggggugcccaacaauuggcuggcuuuuggacuccucccuuguuaagaucauuuuagacugccuuuuuuaauauaaauuucuuauuuugacucaugaauguuuuagaaguuauauagucagaaguauauauuuuagagcauuggcuucugaaauacugaagaaucaaugauuuaauuuuaaacccaucuuuauuucauaugucuaaauguucuaacaugauaggaacuaaaaguuaaaugaauuguuagauaagaaaugugguuggggacaguuguggcucacuugggagagagaggcaggcagacauaguacuaaaagaaggaggcagccuggagguggugucguacuccuuuaaucccaguacuugggaggcagaggcaaguggauuucugaguucgaggccagccuggucuacaaagugaguuccaggacagccagggcuacacagagaaacccugucucaaaaaaaaaaaagaagaagaaggaggaggaggagguagucucagacuuuaagaggauaggagucuguguuuauauuauggauuccaguuuaguguuucuaugggauuccugaguguucaaacaaguaggucucagacucuugugucuucucuuugggcucuuuuccuucuuuugguuugucuuauucaauuuugaugugaucauuuuuguuuuaccuuauuauauuucauuuuguuauauuuaaaaaaauggauaaaugaacaaaugaaaaccuagcuacuaggguaaaaguuaacaacugaacugucauuuauaccuaccaggagagggaaaaucuguuuucucagauggaaugacacuggguuuaucaaccacuccaggguaggucucauguuugggaauaguugaccaacaaauaauguacuccacgguuuuuugcauacguuuauuugguuacaguuugguuuuuauguucuacuuuuuucuuuuugguauugauguauuuuguuuuuuagguuuugggguuauguuauuguauuggauuuuuuguuuguuugguuuggcuuuuuuguucauuuuuuugagaacuuagaaaaaagagggcaggacucucaaauaugaagucaaagcuuggggcuaugaauucuaguaauaaaaucauauggaauagagagugaucaugaaauuguuacucaaauuauaaaauacuauaauuaaaggcaccuugcaagacuugaguaaacuuagacuaagacaaaagaaguauuucauguaaugaaucauuguaggcccuacuguuuugugaaauaguuugauaauuauugaauaucaagggaagaaaugacuuuuagauuuaccaucagggaacauuugucuuuaucuacauaaugcacuagacuuucgugaagauugaagaguguacgucuggcugggcucugggaaagaacuagccuagcagauugguuaucucguguauaguuguuauacauaguuauggaauagaguagcaauauguaaaaaauguauauaaugugauccaaguaaaugguauauaaccucuggcauuuaucauuuuuuguguguguguuggaaaucaaaacccuauuagcuauuuuagaauauaaaauuaucagcauaguuuccuaguguggaacauuaagagucauucuuccuauccaucuacucucaauauucauuaaccaucucuuugcacuucauuauuuauaugugguuuugcucuggauuuuuguaggcugaguacaacagugaccgucaucaguuuuuugaguuucuguacaaccagggaauuggaaccaagucaucauauauauacauguccugggcagggcaucuggaagcccagggagagcugcagcaugccagugcuauuuuucagacaggaauucacaaugaggcugaaccuaaagaacuacuacagcaacaauacagguaguuucaaaguguuuaacucuuuccuuuuccugucuguaucuuuaugugugucuacuuuaacuguaagucuuacuguaguaucugugucguaggucugaccacagauagaaagcuuuauauuucucuuagaaugcuauguggcagauuuuauaaugucacuuuaaacugcagcauugugaggcaacacagaagagcacaagaagggcaccuacaagagacaaaacaaauuguccccucaaaauaacucauuaaggcacagauagaauuauccguucaugaagacagaguccucuuaaucuaaucacaguuuggagauaauauuugauaaaucucacaauauggguuaaauaucagcauugguggcuauucaaacuguagugaacuaucauaaugaaucccuuauuuuucuaugcacacauuuuguuuuguuacuuuucaauuauuaaaaugccucauuugggaaaacuugaaaauacagaaaacuuuauuuuuuccucuccauaguacagaauuacaaacaugcuuuacaguuaagcuauauauacacugcaugucaggauuuuuccuugaaagaaauauauuucuuacauuuauacaaaguauguuuaaacaguuuuagggcaugugggacauacaaccaaaccaucuauucaaaaaauuuuuucugcauucucauuagaagaauuggggaccuuccaugcacugcacaccuugccagcauucaacauauucacuuauuuuuucaguuuuacuauagcauuuaugcuuaaaaaaaacuuuuaugagaauuuucaaguaaacguaaaaagaaaaaaaucaguauuuaauaaaauguucauuuauauucuuuuaguaauuguuaacaguugauuuuuuuaaaauuuaaauauguaauugcuugccugcauauaauuaugugaauuguguauguacuuaacacccccagaggucagaagaggacacuguaucccauugugaaccaucauguaggugguaggaaucaaaccugaguccucuggaagagcagcuaguacucuuaacucugagccauuucuccagccccuucaacuuuuuugguacuaaugauauuucuuuaucuuuuuuacuuguuugggccaagcacaucacuuugagugugugcagaucagagauuaaaugaugguggucaggccuggcagaaucaugcuuaccugcagagucaucucauuacaugugcugacagaauuuuuuaucucaaacacgacuacaauccucuuuuaaaaaaauguuuccuauaggcuuacucuauguugccugauaaaguuaaugauaauucuuuaauauuaucuaacuuugcuuuuucaaaccaucauguaaaaugguuuuguuaccauuguuuccuuuaaauuuacaucaagcaagauuuagugcuuaguuguauaucucuucucuauaauauacacucuuguuuucauuaccccaaaacgucaggcuuggaaaugcacaauuucuaauagguugaguugguauggaaaagugcuaugaaaugauguauguguaaaauuuuuauaagacaugagugaugcaacccacuguccuuugaaacaguaguuuaaguguuauauuuugauuucuuuuuuuuuuuuuuuuuuuuuuuuuuuuuuuaagauuuauuuauuaauuauauguaaguacacuguagcugucuucagacacuccagaagagggagccagaucucauuacagaugguugugagccaccaugugguugcugggauuugaacuccggaccuuuggaagaacagucgggugcucuuacccacugagccaucucaccagcccuuugauuucuuuauaaucauuuuguuucagauuauaaaauaugugaaguuguaguugaggcaucuuugaauuuuaacaucuucagaccuaaugaagaaagaauauguaugugcucaacaaauuugaaaaauauugacauaaucuguguaaaaggaagacuuuucuaauauaaacauuuccagaauuuuauuucugaguuuaaagcaacuuugaaauucaguuuuuuuucuuuuucugucuuuauuaucuguuguauuaguuacauuucaguacagauguauacuaaacugugaaguuaaaaucuguauguaccuucuauuauguaggcuauuccaagcacgccuuacuggaauccauuugccagcucaagguaaaaugauacuuuuuuuuuccauuuuuuauuagguaaaaaugauacuuuuuuaaauaucuagauuguugaaaauuuagucuguaauuuucacuauguguuuuuuguuuuguuuugcuuuuuuaaaagggccuuauguaguauucaaugaaaaccaaagaauuaccaaauuacuguuuugugugaaagggaaagcacucugauaauaaucucacaaaauagcucaggacagcagaggagcuguguccuagcacuguaaaucagaaaauaugcaagcaaagcuuaaugacuuuaccaugugugaagaauuuuuuuuuuaaaagcuaacaucuagauacacuugugacacacaccuguaaucacaggacucagaaggaacauaaauuugaggacaaccaagacuauauaacaguacacuguuuuuaaaaagacaaaauaaagauuguuccaaagaguaaauacugcauuucccgucuguucugaauugaaucaaauaggugcaauacaacuuuuaaaauguggccuuuucucuuagauauaaagaucacauuucagcaauaguuacugucaucuuauuuaaaauaaccacuuaggcuuuauaguucauccagguauuaucuuuuaggguugaucagaaaauuuuuucuauaguauuuuucuuaauugaaaauuaguccauuuucugagacaguuuaaauggguugauuuuuaaaauaauuuuuguacuaaugauucagauauuuuauauguaugaauguuuuucuggcauguaugucuacacugcauaugucuagugcccacauaagucagagaggacaucacauuuccuagaaauagaguuguggaugacuaugagccacugugugaguagugggaauuaaaccuggguccucugugagaacaaauguucuuaacugcugggccaucucuccagccacaaauagacuucuuaaauacaauaaccuggacaaauagaggaauuuauuaugugcugauuuuauuuauugucacuuuucacuuauuucucauuucauuuuucccccauagcuacaaccucagaaccuuugcauagugcacagauuuuaaaccaaguuaugaugacaaacucaaguccagaaaaaaacucagccuguguuccuaggagucagguaacaaggacauuuauuguaugcuguauagaaauuaggaauguugcuggacagccuuuauggcugccuuugcucucguccauugacacuguccccugugcuugaccuccauuccaaccaccaucccaugauagcucucagagccuuucuaucaucucucugcucaacucuuauauaacuugucagaccuagggccucucccacacagucccaucuuuaacuucuuucuuccuaauugccucuucauaggcccaggaaaucccuauuuuggaucacauuugccuggagguuuuuuuguuccugcuuuugaaaaaacccagaaccucgaacauuccugcacauaaccucaaccaaagcacuaacacuuccaggcuuuccuucccuauguuccaugccauggcuuacauuauguguuucauuuacuuaucaguucauccuuuaguaccagauuauuuugaugaauagaauuuauugugauaaaccucaaauuugggaugccucugucauagcuauaaaaaaaauauuauuucugccauuucuaugggggaaagcggcuucauccuugugccugcuuuucauccccauaaauguuguugauccaucuaaaucucuucuuccuugcuugcuuauaaaaaugcucaaaucuccucuucugcuucauguuccuuagcaucuguacuggcuaguuuuaugucaacuugacacagcuggaguuaucacagagaaaggagcuucaguugaggaaaugccuccaugagauccaacuguaaggcauuuucucaauuagugaucaagggggaaaggccccuugugggugggaccaucucugggcugguagucuuggguucuauaagagagcaggcugagcaagccaggugaagcaagccaguaaagaacaucccuccauggcuucugcaucagcuccugcuuucugaccugcuugaguuccaguccuaacuuccuuuggugaugaacagcuacauggaaguguaagccaaauaaacccuuuccuccccaacuugcuucuuggucaugauguuugugcaggaauagaaacccugacuaagacagcaucuuucucuuucaaaguaccaucauucuuuagaaccuccuuauggcuuaaucuaauauaaagauuucugguuuuccaauguagcaagcacauuccuagaaauagaacauauaugucuuucuuugauagauugugcaguuuguaucuuacaaaguuugccacccucauccuuucuacuauuuuacauuuuuauuuauuuauuuuaaagacuuauuuauuuauuuuauguauacagguacacgguagcaguacagaugguugugagccuucauaagguuguugggaauugaauuuuuaggacuucugcucacuccggucaaccccacucacucugguuggcuccacucacucaggucaacucugcucacucagucucugcuugcuccgccccaaagauuuauuuauuauuauacauaaguacacuguagccagacgcacaucagaucucaugauggaugguugugagccagugcucuuaccugcugagccaucucgccagccccauuuuaaauuuuagaugaaaugaaugucacuuuucuuuuggucaaauuccucagaccuagcucauuguaugauaagugugaaguaucaguaucaguauuugcuuaguggauuauugcuacuauuggaaauuucugagaguaaaacaauaacaaggaaauuuuaauuuuuuaaauuuaaauuaguugcuuucuuuugaggaaaccucaguuugaaaaguuaacuaaaaauuaugucacuuaaagcuccagcuauuaauaacuuacauauacgugguaaauauacuugcuguuaaaaggccccuucccacagggcauuuucauauuugugaacuaauuuguaugaaggcuucucugguaaaugaaugcucaaguuuguuucugucuuuuaggguucagaauguucugguguggcaucuuccacuugugaugaaaagucuaauaugcaaguaaaaugaguacauuauuacauaaauuucauuaaaguuacuuuaguacacuguuauaaauggugucuuucuccccaguagggaacaaagggugaucaugauuuccaagucagaaugcucugucagcucaucuguggcacccaagccugaggcucagcaaguuauguacugcaaggaaaagcuuauucguggagauucagaauuuucuuuugaagaacugagagcccagaaauauaaucaaaggaagaagcaugagcagugggguacuuacacucuuauauguugggauuuuuuuaugucauuuuaaauaauggauaauuacauaauugaaugaaacuugagaugccuugagcucauuccaucagaaaccuuagauacuaaucucgcagcagcgcuuguccauaggcuccuuugccgaacugauagcuggccauugaaacagcgcuacaguaaacaaauuguuuuuguuuuuguuuuuguuuuuuugagacaggguuucucuguguagcccuggcuguccuggaacucuguagaccaggcuggccuugaacucagaaaucuaccugccucugagugcuaggauuaaaggaaugugcuaccacugccuggcuacaguaaacauccuuucugguguuucuuugcauuagugaaauaguguuuccauauuuaguauguaaauuugaaccuguguauauaguaguccuaaaauuuauagggcauuuauuuauucugugaaaggauuuauugagaacugagguuagaaaagauuucccaagucugcaucuacuuuaaacagaacaugcugaaauaguuuucugaucagcaugccaaauuuauguuugugaauaaauacuuuuuguuccucagaaggaaaucugcauuugcacauugcuuuuacuauaacagcauacacucuagagagaggaaagcaaaccuuuguuccacucaggguuuuauaccaucuagguuauuuggacuagaucuacuaugugagucuuuuauucauuaccuuuuaaaaaagauuuuauuuaaaguuauauaugaguguggguuuuugcaugugagugcagugcccucagaagaggugauugugagcugucugauaugggugcugggaacccaggaacccagcuuaacuuuauaagagcagcaagcucucuuaacugcugagccaucucucuagccccuauauucauuacuuuuuauauuuaaccagcuauagagaaccgucaguauuuguuaagaacccauuuugaauuguccauugauaguuuccuuucauauaucacaaccuguagucucuagccaaaaaaauucugacauguuuggagugugccuuuaugugauguuuauaggaaauagaacuauccaaaguuuuacuugaaauucugacccuuaguacacuuuauuuccuagaaaguuggcgcuggaaggguagcucagcacuuaaagcugguaguguuuugcaaaggaccugaguucaguacccagccgugucaggugucucacaacaaacacccugauaucacccagcuccagggaaucuaacaccucuagcuuuuuaaggcacuaucacacacauguacauauagaugcagacaccaauuuaaaaaaauacaagccacuagcaugaguaccugaguucuaucccugagacucacaugguaggaagagagccagcuucugcaaauuguccuccaugcuccacaugcauaucuugggauuugugcccuuuauuugauuuugguuugguuggguuuuguuguuguuguuuauuuguuuuugagaagugccuacaguuacauuuuuaaaaaugugaaauagaggaugauggggggaugagagauagcuuaguuaguaaagugcuugccauacaauaaugagggugugaguucgguuacuaagaaccacauuaaaagcagcaagugugagacagacaguuguagucacagcacuccgguggcaaaggcagcuuagacuacucagcuccaggccagugagaaucccugguuuccacaugcacauauguauauaggcacaugaccacaaacacauaaacauacguaagauaaaauaauuagaaaauaaaaacaaauggaaaaccacuuucaagugauuugcagcacaguaugauuauuuuauaagaaauguuuaguauuaaacuuugcuguugcugaauauaauugauucuauaacaauuuuguuauaagaccuguauuuaauaguaacuauggugaggacagguaaagguuacaauuuaaaaauaauguaaguuuaagcucugaaauuuaauaaauauggaaaacuuugauuuaaaaauuaucuuuccuagcugagcgugguggcgcacgccuuuaaucccagcacuugggaggcagaggcaggcggggauuucugaguuugaggccagccuggucuacaaagugaguuccaggacagccagggcuacacagagaaacucugucucaaaaaaaaaaaaaucuuuccuaaauugugacaauuuauucauuuugcauguaauucucugaugaaauuuugagagcaaaccauguuuuauuuuaauguucuuaaaguuagugaagacagaaauuauaugaaaaggaaagaagcaaaugcuuuugaagagcaauuauuaaaacagaaaauggaugaacuucacaagaaauugcaucaagugguggaauugucacacaaggaccuuccugcuucugagaacaggccugauguauguccauguucuucacuauguccauuauucccaauacuacuagcuauuguuuuucucugcuuuguuuuuauugcuauucuuaaaaucuagcuagaaaucuuacugaauuaauaauuugguauauaaaggugugaaauuuuggaauaagcaaagaaauauagggacugaguggaaauguuucgcucaagcuagucuccacagacguccaaaguacaagagacccugagaucugugguacuucuuaguuggguacuugaucugugcuaugacuucccuuucuccauaguaauuugcuaugugaagaaauaguguaaguuauuuaagucacuguuuuagggcaugguuuucgcuuuuuuuuauauugguuuugagacagguucuuaauuguuauccuugcuggccuggaacuugcuaugucaaccaaauguaccuugaacugacagagaugccccuguuucugccucugaauaaaggcaugugccaccauacacagcuuauguuaacugucuuacuuuuuguaagaaugcuuccauaagauaaggaauuagggcugggcagugguggcgcaugucuguaguuccagcacuugggaggcagaggcaggcagauuucugaguucgaggcuagccuggucuacagagugaguuucaggacagccagggcuauacagagaaacccugucucgaacacccccccuccccugcaauaaaaagauaaggaauuagccuuuuuguauuuuaaaaguuuguucauccuuccuauauuguaccacauguuuguggaaauuaauauaaauauauucugccaacacuggagaauauucgguaacauuacuuuuagucuuccuaaaauuuagguaaagagagauaagauacuuuuuguuuuguuuuguaauucacuugucuuuuuuuuauaauuuaacauaugaaguaauagguuucauuauugacauugucauacuuuguuuuuguauucucaauucccuuucucuggcccuccuuuuaccauguauccuuuugcuccuaguagccuccuuuccacuuugauaucacacguauuguuacuaaugccucaguuuuuguuuuauuagacaggguuucacauugguuugggcuggccuggaacuugcuagguagccagaucagccucagccucacugcaguuguccugugccuuagacuccugugagccucugaguuacuccuuaaauacugaucucauagaaaccaauuuguuuuucggugguugaauguuuaagauacuggacuggagagauagcucagccaguaaagguauuugcuauacaauccuaaugaccugcguauaaucccagcaacccauguaaaaaggcagauaugguaguacacaucucuaaucccagcccucauauagugagagaggcagagaacuagaaauugccuggaagcuugugagccaacuggacuguaauaugcaaugcagagaauugagacccuggccuaaugaaguaagagggaaccaaccagcuccuaaaaggugcccugauuuauacaugugugcacgcaaauaauaauuuaaaaaauaaauacaagcuuuugguguguccauguuuaagaagcuacaagaagccaucauagaggcuagucuuuuuguuguuguugcuauacuuugaaaaguucuaaugacuugauuaguaauauucaggacuuccuaauuuuguuuuuguuuauauauuuuuguuuugcaugaaagguuagucuaguauguguuggacaaaauacuugcucccagcaggaauugagggguccaagucuuucauccaucagucaucagaccucagagaguucaggagagaaaccacaggaagaaccuucuguuccucuuaugguaaaugcuguuaacagcacuuugcuguucccagcugccaaccugccagcucuuccuguuccuguaaguggccagucauugacagacuccagguaagcuaaguguccugggaaugguagagaugugaguggcauguaucauuucuuuucaugaucugcaaugucauguuguguaagagaugaacaaacgguucugguuuuuaauuuguauguuaaaaaaaaauuaaauauuggcuccaaaucuuucagacuaacuuccaagcuuauuuuacagcauuuguuuaccuuuuuacuuuuuuauugcauuaaaaacuuucagcagucucucuguaccuucagaauauauagcugaaaauggaaaguaccuuuguuuacuggcuuuaacugcauacuuguaggcauuauuaaugcacagaaagcuaauugacauguguucugauguuuccucugucuuccuucagaagcuauuugguauaagugucaaugauucuuugugccaagaucuaucuccacacuauuccccaauuuagaaggauuuuucuaggcuucaaaaaauaguaauaccaaauuucuuauuuguuuuacauuuuugucuuugguuauucaucucuuaacuugugauuugauaggaauuuguaaaacuacaaguaauuuguacuuguuuaacauuuuaauaugguuccuuaagagaauucuagcaguauuagacagauguggcugacugccccaguguguuuaaaagcaagcuguuauauaagugguuugcuaccuucccuugucauuuuaaaauggacaucacuaaugguuucagguucaucacaagaaauguacuaauuccacuaacacacacugccugaaacuaggucuuaggccuuuaaccugcaccauaaaugaaguguguuugaauuugggaagccauucuguccugccgaauggagggguguuauuacugugcuagcauaauaaccauugggucacagagaaacauucaaugguuaucuuuaugugaacgaaucaguauucucaaaggcaguaaauauuucauuuacuuacacuauggcccuaagcaguuuuauccucaaccuaacaaacuuaacauuguuugcaauauuuuacuauuucaugagaguuuguuuaaaauucuaauauauaaagugcuuuuauucuucagugagucucaagaguuuucucuuucagaugugugaaucaaaguguucaugaauucaugccacaguguggaccagaaacaaaagaagguaguguuucauuauaauaacuucauccaguuuauuuagguguauacucuuuuggguuugcucaguguuuguacugugacuaugguauaggaagaauguggaagagaaagaaugauuuuauaaagccucagacuauuucagacaaaaauagaaaauuauuagucacaucuuccuaguucagaauccuuuggcauuuuucuauuaaguuucucaauguauuaaucugaaacgucauaauuacaaagguuagucuuacauucuguuugguaguauagcggaggcauuuacauagaagauaauuuuguccauuaaguaauaaagacacaguuggucauuuacuuccccuccucauaugacuggcaucuuucccacuaacaguaggaacagggcuauuugaaauagagacuuacugcacuaagacuugguucaugcucacuaauacaaagcauaguucuaaguaguuaaaaagguaguuguggagaaaagggugagaauucguacaggaaaagagguauuacuauuaggguggagaguuaggauucaaagaaagugaccaggaaggaauguuagaguaagauuuaaguaaaagggagaagggaacuaccuaugcagcaaguuuuauugaccuuuuuaggcagaaugaaugacaagugcagaucuuucaggcaucaguaauccuguuaauguuccaagcaccuaagauauuuucagugcuuucagaugagcagugggagagaaagagaaagaaaaagaaagucugagcaaaccaaagcugaauaaaaugaaaagcauccugaagauuuauaacauaguaggaggaaaagauuuauaauaugaccagaagcagguaguacuugguauauuaugagcuaaggaugcuauucaugacaacuaacuugguguaaccuuuuuuuuucuauaaaaggauaauucuuuaccuuacuucaugauguuauuacaaagauaaacaugaauauaugaaagcccagucaaugauaauaaaaguagugaucauuauugacauugguaaacuuuuaauuguaauuacuacaaucaugugccuuccaaaguguucuaguuggcauauuguuaguacauuuugucccacuccuuugcucuagugugugaaacaaauaaaguugccagcauuaaugauuuucauacaacuccaaacacaucauugggaaugguucaaggaacaccaugcaaagugcagccaucaccaacuguccacaccaaggaagcauuagguaaaauauuuugcuuguauauguagugccucccauaaauuaauaagaacugauuugcagccuguugacacauuucuuauguucuuuaagguuucaucauggacauguuucaggcuccaacacuuccugacauuucugaugauaaagaugaauggccaucucuggaccaaaaugaagaugcauuugaagcccaguuucaaaguaaugauuguuuaaaagcuauucaguacacaguaucacaggaaguugcuauggucauuauaaaaaaguaaauaugauccugcuuugaauagugugccauauaagagaagggaaugaauaaauuacguauaugacaguuugaaaagguugcaguguugugauaauugguuuguuuguuuuuguuagguuggauuauuuuguuacuauuuaauagugagugcuaaaggacaaaagcuucauugguaggaaugguaggggaaguaaguucuuagcacaagacuuaaguaccuccugggaaaaaugucuagguagaauuuggaacucagcauugcuggaaguagauucuagauaaguagauucuaguuagaauugagaaagcuagaaaugaaaacucagggguuaauuuuuuucuuagaggacauaaacaacaacucaaaaguuuuuugguuucauuauaggaggguggacacugcucuguagugacagaucucuacuaggcccugagugcaagacccagugaccauaaaucagucaauucaccucgcugcaaaguaccuuaugucauuaucuaggaccuagguuuuuauuuuauuuuuuuuuuagagaguucaggauuuuagagauuuuuuuuuuuauagguagcugauguuuagcccaaaggauaaugccuuuuaauaauacaauaaugagaugcuauuuuguuuuccugcagaaaaugcaguaucuucgggagauuggggaguuaaaaaaauuaugacuuugucaucugcuuuuccuauuuuugaagauggaaacaaagaaaauuauggguaaagaaaauaucuauuuuaaaucaaccuggaagaaauacaugucaccaaaauaccauaaaaugcugaaaguuuuaaggcaguaaggagauaggguggacugcucaguagaugaucuggguuggaguuccaaugcugcuaccaauaagccuuuuaaccacacagugagggccaaugugcuaugcaugaguuccaagacaacagaccucccauagcagaagcacagcugcaaaagaaaugcaaucuaguuauaagcugccaaagaacagaugaauucucuggauuugaaauuacauuaaauauggaugacucugccaguauacucauaaaguauagggccaauaaaguagagccuucucugaagguccccuaaagagaaaauguuuuaagguagaagaaagacaucagggcauagaaugaaguauuuucaggaauuuucauuguuaagugaguuacagguaucuuugcaugcugagguagaauggagacagcaugaccagguugcagaaguggcacuagagauaagauuuaaaaauguuaccugauaccugagacaucuuauggucaagguccuuguuuucauuugcuucuaaaacuuggaacccaguguacuaaaaacaucuucuuuuuauaguuaauucaguuuagacacauuuuugcuuuaguugcuaugaaaguaaagaaucucuaaaaccauuaacucaauaaguaggauaagugacaaauuauucuaacacuuuuagcuuauuuauuucaucuguauauuuuaugauuuguauuuacacaaaucuuucuuuagcuuaccacagccuaaaaauaagcccuuaggagcuaggaccuuuggagaacgaucucucaguaaauauuccucgagaucaaauguaaguaaaucucugcuucaucagugaaauaugucuuauaaucuguucuucauuuuacuaagugauuaugcucaucacauggcacaagguguacacaacuucuagaaaauccaguguuggaugaaagaaaauguguucaucaacagagcugaauucuauaguaagcagagaaaauaaaaacaguugugauccuugccccucaggagccauuccuuuagcaaggaggcaccauccagggguauauauuguuucuuagacauaagaauugagaccuacaguggacuauuagugagaaaccuagaaaauugaauugaugaaaaugaagcaucaacagcauaccacagcagagaagguucucauguucauuggcacauagcauuccuaagugucagcaaccauuguaccuagacuuucauugugacccagaguguuccccauguguauuuacaauucccuaaaaugcuggccuggaguuuagauucggugccacuacuuuaaaacuauguuuuguugaacuauucugcuacauguuuuaacaaacaagguacauuuucuauauauacugaugcugagcagaaacuggcauauuuauuaccauccaguuuuucccucaauacuggaaaaggugguaaaauuuauaaacagacaugauguguagaauguguaugcaguauuuuaagaacugagaggauuuaucgaguuugguuuugacuaaacuuuaguucucuuuucccagggauucuaaaacucacccuauaauuacacuuuuaaagaaaugucugauuuuacaggccaugucagugaaaauagaugacccuaugccagcaauuauggaugugauuauuuugguuuugucuuuuuauaaaggggggagggcacaagaaccaucuugaauaagucaggagucagaccuggaacaauuugaaagaauaaguaauauuguauuuuaacccaagaaauaaaaugaauacccauauucauacaauaggggagaggggucagaucucccuuacagaagcauuccaaggaauguagaaggucaccauuagaacacuuaagauaguaacugcuauaggcaggguucauggaugacuacugacgcuaucgagaagaagcagugucuacauagcuccgaagcuucuuaccaaaauuauuguuuacuauacugguauaacauuucaccaggagggccagaaagauggcucagcagguaaaggcauuuccaccaagccugggacccacggacucccaaaguugucccugaccuccacaugugagccuugguacauguguguaccaaguacacacacagauaaguuaauguacauuuuuccauugguucuuuugaugaagcccuguggaagguagaguuuaccuuccuuucaguaugggcaagauauagugauuuauaucagaaaagacaguagggagagggaaaagaauucaguaaggaaaccuuagagauaucugaccaagugguuggguuaaugucaccaguaauagguugaguuuauagcacauauccucaaaguuacucccuuauagucuucucugaaaucuauagauccugaccucuauucaaaauugucaguggaauaaaggguaggaaggauccacagguggcuguagucagaagcaauugaauagacagggcagccaugugcaaugugcugacuuaugcugaaguuuggaaaggaaauagaaaaaccaaauaaggacuccagguacuaguaucauuuuuaacaauaaaccacauuuugguuaagauuacuguuaaagggaacuaacaaagaagaacucuuuacuaucuuuguaauucuuuucaaguuuaaagaauaauauacaagagaaaaacaugucugauuguuaugcauuugcauugacguauucuaaaaacaguuuauaucuauuuuccuuuaacuuuuuuuuuucaaucuuaaaauguuugagguuuuguuuugguuuuugagaaaggagcuaaaggagcuugcuguauuauucaggauaauuuugaauuccuaagcucaagugauccucuaccuccgcacccuccugaguaguuuguaguacagggcuauguuaacugcuggacuucaaguguugauguguuaaauuucaucaacaaagcagcaaauugccuuuuccaauuugucuuuggcuauaggaaaugccucacacugaugaguuuauggaugauucaacaguaugugguauucgcugcaacaaaacucuagcucccaguccuaaaaguauaggagacuuuacaucugcugcccaacuuucgucuacaccauuccacaaauuuccagcagauuuaguacagauuccagaagauaaaggugaguguucagcuaucuucugcaaaaauauacuguuauuauaguuucuuuuugaaaauucuauagaggaagauugaaaauuguaaagacacuuaaaaugcauuuauguguguguacauguuuuuguuguuauugcuguuguuuccucguuuuugaugguuugucuucaucgucuauauuuuuaaauuuuaauaaguagguagaaagugaaaaaagcauguguagucacuuauagacauauagccaguaggccuaaguuguauugugauagcuaagaaaaaaacaacuacaaaaagauuaaguuacuuaacuauuagaaacaauguacuuaaauuuccuaaucuaaugaguaaccaguuuuauccaugauccaucuucaaauguuacuuuggaaauguagacaaguauacauacagagaaaagcauuauaaaacuaccuuuaguccucauuucaaccucaaaccuaauguaaacuuuauauaaaagauacacaugugugggcuguccagacagcucagcaguuaagaacacuggcugcucagacauccaggguuugguuccuaauauccaccuaaaaauugacuaaguaguaaggagauaaaaauauauauauucuaauauauguaauauuagaauauuuucuugaguacuaauccaauauguuuuauuucuuuuuuaaaucuuagaaguuaguucaaaauuccaacuauuuuuaaauaccaucacaaguuugccacucauaaaaauuuugaaguuuuacaaauuaaggaaaauuaaucugugaagaguucuucaaagugucaaaaguaacuguucuuaggauagugauuaccaccuuagccacugugauccuauaaauagaugcguauguucuaguacuaaauaaguaucaguacuuguuuuaagcaacaaguuaauccaguauaacaguuggcuaaguuuagcccauaauucugcccugucuccugucaauaaagauagauuaucuuguuuuguuuuuuuuuuuuuuuuuuugguuuuuuuuuuuuuuuuugagacaggguuucucuguguagcccuggcuagccuggaacucacgaccaagcuggccucgaacucagaaauccgccugccucugccucccaagugcugggauuaaaggugugcgccaccacaccuggcuuuguuuuguuuuuuaaguuagaaagaacagugguuuaugugcugccaauaccuaaauccucuccaguuuguuaaaaagacacacaaaucucuauauaaauccuucuggaaggguugcggccuuuuauucucccuuugugucuuuaucagguaugugcugcccuuguaccagugacuuucuuuagucugcucaucaugucgguaaccugcuauuuauucuuugaacccuaauuauaauuauuuuuauagcacuucuuacuaugugacacuguuuagaaauuguagugaaagucaguauaaaaaagaauuucagccuuuuuaaccuuaucaaauguuugcuuguaucuacauguguauauaauaugucugucuauauauuuuuuuguauuucagaaaaugugguagccacacaguauacacauauggcuuuggauucuuguaaagaaaacauaguggaccucucaaaaggcagaaagcuuggguauuguguuugucauucuccucuuccauuguagcuuuucucuuuaagauaucauaaauaccuuacuucaauucaaugguagcuuugagucagaagguacuguuuguaauguaaaccuaaguacuuaguauauuaaaacagcuugcuaacagaucccugagcuaacauuuucugaaauucauuucaggguucaaucuguaaguccucuuauaauaccaagacuccaauaugccaacuguugcaaaacugaggaaacacaaauugugcuuuauauacccauguaauugagaaaaacagugccuuuuaauagaagguagaauguuuaagcuuuuuuagguacugguauauauaacagauaaaaaaaaguagcuaccaguuucuguuuauuguaauccagucauagugguuaugcuuucugugugcuguauccuuuuaauccuuugaacaacuugaguuauaacaguuauuaaauauuaaauauuauuaauauauuauuaaauauauuauuauuauuaaauauuagaauuuauuuaacauagaggcaaaaaucacacauacaaaguacaugaaugagaauccucauguguguugguuugucuuaguguuagaaaaagucauuuagaaaaauauguagucuugauuaugacagugcuauuuagauguaacuuuggggaauaaacucauuccuucccacaguuacuauuaaauaacaaauauauuauccuaccuguuuaccuaagauauuaagugauuuugauuauauuucuguugauaucuauaaaguagcugugucuuuauuuuuacauauuuguuuaaugaacauuauugaucaacaaccuuugaguuaauuuugaaaugcuauucauacaaugaaaagaugcuauuuuacuuucaucagaucuaauaggcuucuaaucacauaaaguuuuuguuuucuccuuuuuuccacauccaggccaauucaagagaaaauuucagcaucuuuacccuguccuagucagccugccacaggugguuuguucacccaggaagcaguguucggccuugaggcuuuuaaaugcacaggcauugaccaugcgacaguggaagaccuauccgaugccaaugcugggcuccaaguugaaugcgugcagacacuuggaaaugucaaugcuccaaguaugcacucaugcucaauuuuaguuuuuccauaagaaugauagcauugaaaagccauuccaugaaacaaccaagugggagcuuaauacacugaauagaaaaauaaacuuagacaaacuugugacuguaucacaaaguaauucacuacuaaacagauuugagauccaucaauccauuuuaaucuugacagacaagaagaucauacuauuacaaaaaggaauuagggaccuggagcgaugguauacugguuaagagaacuacugacuucuuccagaggacccagguuugguuuucaacaccuacaugguggcucgcaaccaucuacaauuccaguuccacagaaucugaaacccucaugugaucucucuaggcaccaggcauaaauaaaucuuuaaaaaaaaaaacuuuuuaaaaagaguucaaaguuaagaguuuacuguguguuaaauauauaaucuaauauuucccucugcccuguaaguaaaagaacagucggucaagaccaaauauuaagagauauauuaagagguaucauccucugucccuuguuauacagaaagucuugcuugaaaacacagacucuggugauagacuaaguucuaaggcuagguuuuacuuaccagcuccccaaccaacuucaugcuuguucauuaaacugagguuagguggagagaugauucagggguuaagagcaauggcugaucuuccagaggacccagguucaauccccagcaccuacauggugucuuacaacugucuguagccccaauucuaagagaucugaugccauuccuaucauauauguaucauaugcauacauguaggcaaaacaauacauauuaaaaaauuaaguauaccuuaaaaugaaggucauacuacuagaaccuaccuuugaggcuugccauaagaacuaaaugaguucauaaaucucagaacuuuguucuguguguacuaaguaguaaccauguuggagaguagccuuuucuaaccaccacggauagaguguuuuauaacacuaaauuggagaggagacuuugucuucccuuuaggaauuguuucccuaugcaaauucuuugaaguauuguauugucuguguauuaguaggggaaacaaugaaagaauaugucugagcacacuagaagcaguuaauguucauguguaccuuuaaggugugcagcaauacuuuuuaaaggugcaaauccugcagguccagaugagucaaaaagcagcuaguugauucgcuuugucacaacuggauagucaaccuccagugucagagcugacagaacuacugacuuuagcuucuuuucuuaauuggaucaaugcucuacauggguaagaguuugaaagcauacuuaaugaguacauguacuuacuuaucuaagauuucuguuaaaauauuugaaagcugaauuuauguuucuuccucccccuuuaaggcuuuacuguugagaacccaugggaugacgaauugauucuuaaacuucucucuggacuuucuaagccaguuacuuccuauucaaauacuuuugaguggcagaguaaacuuccagccaucaagaccaagacagaauaucaauuggguaagaauuauauggguaauagaauuucgaauucuuguaagaaacugcuaguaacucugagauucuccuacccuuuccacuuucaagaaaguuaauuaucugccauguugagaaauuuuguuaagcaaugauauucugauugcuguugggacuuuaauuuggcaauaauuuaucaaaguuaaaaauacacgugcuccuguauagagauauucagagguuaagaacacuuucaggauaccucauuuugguuuacagcacccauguugggcagcucacaacccccaaagucaaaaacuucuaaaaugcaaaauagaccugacuauucuaaacuauuacagauauuuaugcauuuauccccccccccccugcgcacgccagacaguuucucuauauagcccuggcugucuugaaacucacugcugggauuaaaggcgugcaccaccacugccuggccuugcuuuacuuuuuuuauuguccuauaaaauaugcacauuuuccaaaaagcuuuacagaugucuauauguucuuccugguaccucaacaauugcacguaggaaguacuguagguaauggaaaggccaggacccaaggccacacaucucaguauacugaggcaucagggcucuuucacuccucguuuagaauuugauaaggaaguucuuucuugguaagugguauguuuuacuuucauuuaagucugggaaaacuucugccagauuauacccauuuuuaaaaauguauuuauguaguucaggcaccaggaauucuucacuuuaaugaagucaaaagucuuuagggcuuuuugucaguguuuuguaucauuuuccaagguucuuugcuggucuaugugaaucaccuucuuggagaaggagccuuugcucaagucuuugaagcuauucauggagaugugagaaaugccaaaagugaacagaaaugcauuuugaagguaaaugauaugaauaacuucuuguauaauguagaugugaauuuuuggaaguucuuagccucccuugcugacuccccuuuaaauacugaaaucaauaaagcccuagucaacaguuaaacacaacuagccuaggaagacuaagaauucucuuaccacuaagauuacccugcaagcuuuauacugcuaaccauugcuuagcuuauccucauuuuuuugucaauauccuuacugggaggaauugcuuucuugcuauucuuuuauagacacuggguaaggauauguguauuacauaccugauuugauuugcaggugcagagaccugccaacuccugggaauucuacauugggaugcagcugauggaaagacuaaagccagaaguacaucacauguucaucaaguuuuauucugcucauuuauucaagaauggcagcauauuaguaggggaacucuacagcuaugggacguuacuaguaaguaucuaauuuucauacugugaacaugaaauguaugugcauuucuggguuuuaucuacacuauuuuucacaguuggaaguuuuguuggaauagagagcagggguaaaggccuugacuugaaauuucauuaaucuucuacaaccaacuuaggaugccauuugccuuauuuuuagaaugucauuaaccucuauaaaaauaccucugaaaaagugaugccccaggcucuuguccucacuuucgcuaucagaaugcuuuacaugguugaacaaguccacagcugcgaaaucauucauggagacauuaagccagauaacuucauacuaggacacagguaaguccgaggcauuucacuuuguccauccuauagguauuguuuuguuauccuuuguuuuguuagguauccuuuuguuaaucugugcucauagauccugguccuuguuuguauuuaauguagauuuuuggaacaggcugaugaagacuuagcuaccggcuuggcauugauugaccugggucagaguauagauaugaaacuuuucccuaaaggaacuguauuuacaggaaaaugugaaacaucugguuuucaguguccugagaugcucaguaacaagccauggaacuaccagguauggaaagaaaacaagagguuuuguuucauuuuguuauuguuauuguuguuggcuuuuuuuguuuguuuguuuuugaggcaagauuaaucuguguaacccuggcuaccuggaacuuacucuguagaccagcuggucuugaacucacagagaucgccugucugugccucccaaaugguggauuaaagccacuugccaccaucaccuggcagaaaagcaaaagauuugaaaacauuuucuuuauuacacuuaccagaguuuaaagggccggguaguuugaaguagucucuugggcacugaaggaaagguaaaauguaagucuuaaagaggaagaggaaauucuacuucugaacagacuuccuuauuaguucagauucuaucaacagagcaggaaaacaaauacauucugugggaaaguuucagaauuuucaacaaaguagaauauuagcuggcaaguaaagaagauacuacuaauuaggauaaauauaaauguuuuaagccugaguuaauaaaacagcugcccaguguccagauauagagcugugacuucccauaauaaagggagcacaacugagggccuuauuucuguuugguuacuaacauaaggcuucagguagaugaaugcugauauuaggauggugaauggauaguuugcuauccuacagauuuggaccagacuagaauauucuauuaugaacauaucacacagagacacuggugugcaguuauacaauaaccaccagagucccagggaauaggauuggaagaacugccaagcuguguuuguuuucaggaagugauagaacagaggacuuguggaagacauuauuuaaaugaugguagagcuucccaaaagguuaccucagaggcaguaguguuuguguucauagaagccucagugagagcuugaacaggcauucagugaagcaaaucauuggcuuuuggaauucuauaaaccuaaaauacugugguuauuuagcuucuaaguuagagacauauuuuaauauacuuacaaguaagcuacuguuuacaaugcauauaucuguuuucuuuguagauugauuacuuuggaguugcugcaacaauauacuguaugcucuuuggcucuuacaugaaaguaaaaaaugaaggaggagucuggaaaccugaaggucuuuuuagaagguagguuauuggaauuggugcuacagugaaaaaaacaguaacaguaaaauaguauauuuuauuagccagaaaaugagcuuggacaguauugucuacagagcauaauccuggcauuaggcacugaacaaaucuggcauucagugugccuugugaaaccauugagaauuccugggcaugcagguagcauccuguuuuugacuguuucuuuuuaagugaaaucaauaucagugagccuugcaguuucauuuguuuauuuucuuguuguaaaugagaguaauaaugauccugcuuuuucaaauuuuacaagcaaaggaaauaacacaggugaagcuguuuuguuaauuauaagaaggaaguaacuucuauuaagcuccagccaucugugacuuuaguauaaaaugcuuuaaaguuaaugauuggucuggagcuugugucaguauuguuuccagaguaacacucuguaaacauaacacuaaugauaucaaauugaagcuaauuauucuauguaugcauguuuccauguaucauuaacuuuuuuaggguauaauaaaguauauaaaaaaaucacucguuuauagccuaauggaauuuugcauguuuauuccuugagaaaauucuccccacaccuacuuccaaaguagaaaagggaaacaguugguagaaauuugauaaacaucguguacaguagguucaaaacccaaaagaaaacuuacaacagauauuuuuauucuucauuucacuugguuacuucucucgcucauuaucaaaggacagaggguucagaaggcuuccaucuauugccaggagcauagcccaaagcuuccuucucaguuggcaucuagagugacauuguaguauguucugcuuucucucuggggucuucuccccagauuuuggagggguuucaguuaauuuaaccacuauaaauagcaaggacccgggacuggagggauggcucagcaauuaagaacacuguucuucuagagguccugaguucaacuccuagaaaccacauggugguucacaaacaucuauaaugggaucaaugaccuuuucuggugugcacggagagagugacaguguacuuguauacauuaaauaaauaaauaagucuuaaauaaauaaguaaaucuuuuaaaaaauguuuaaaaaaaaaaguaguuaggacccuuaagugugaccucuauccuaaauaguucaggcuaucuggccaaucuugucacauauguaugcaguugagcuuauuaaaaaccagauaacuagauuacuagauucuagaaaugugcuauacacaggaagccaaaagaagauagauuauucuuuaaaaaauaauuuuucuaccaaagaacuauugcaaaaaggcuauuuuaaaucauauuuuuagaauaagguguauuuagacaugucguuggauuuuuaauuucuccuguuugugauggauucuugauuugcuaagauacagguagaugacaguuguuuuuuuaacauguccacaccuauacaaaguagauggaggaacucguugcuaugaacguuaagguugcauuuuauccauuguaauauuuugucucuuuauuaggcuuccucauuuggauaugugggaggaauuuuuucacaucauguugaauauaccggauugucauaaucuuccaucuuuggauuuucugagacagaauaugaagaaauuacuugaacaacaguauuccaacaagauuaagaccuugcguaauaggcuaauugugaugcuuucagaauauaagcguucaagaaaauaaaaugaauauggaccuucuccaaaacacacuuaguaaauuuaaacucucacuuugaauccuauuuuuuucauacuuacuauuuauguauguuuaaaaaaaauaaagcccauaugauauacccaugugaccuaguuguucuaaauacucuaacaaacaaaguaaggagaccccuguaagcaggcugaucuauuggguugcucuuaguauacaaaucuucuugagaaugauucaaauuuagaugcuuuauagaaguuaccucccugcccccaacuccaagacaauuucucaguauaaccagagcccuggcuguccuggacuuggcuguagaccaggcuggccucgagcucauagagaaccacccgccucugccucccaagugcugggguuacgggaguaaccaccaugcccugcuagaaaucaccuuucuaaacacugaccuauuuaaguuaaaaguaagccauaaaaagaguuauaaauuauguuuaguuagcguauguaggauuagguuuccuuauggcauuuuaagaaaaaaaaauguuuauuuuucuuccccauacuuuugacccccuuuguucucuuucacaccccauagcuuacuuuccacuuccaugucucaucugucaauguccccuccuccuuucuuaacaucuuuuucccuuaaggucuuuacuuucuaaccccauguauuuuuauacaaauuucaugguguacaucugaaaagaauuuuauuguguaugauuccacauugucauuauacaaccaucaguugauugauaaacaucugggcugauuccauuucuuugcuauugugaauagaggaacaauugacauggaugugcagguuucucuuguaaaagauagaauccuuugugugcccuggaguaggaagcuaguucauaaacaguucuaguuuucuggggguuuguguguguguguguguguguguuguuuuguucuuguugugagaccaccauacugauuuccacaaugaccauacuaggucgcauuucaacuaacaaugaauaaagaauuucuguuuacuca

SEQ ID NO: 1071 - RNA, 3952 nt, Mus musculus
ucagaucuagaaaaaucauccuuuauuuuggcuucuugcagggaugagugggcgggucgguacuggcaucuaaaucauagaaaaugaaauagaaacacagcccuguccugaaaccucccucccuucuucugggaagucuguccugauggaccuccacugccuagcagaguggauggaccacucguugauucugcgcaacuggagaggccggaaagugauuaacgccgagccuugguuuguuuggugguccgcagcagucucugaaacccuccuuacugccuuccagacucuguuggcacccuucuggugagacgaggcagaucuuuucaauggcucaucuagucagaaguucucgucaguugccucugugcaccagaggguggcacuccagagguggagaggaagggcgggaagaaggaaggaaugaagagaaggcagcauuaauucucagagcuaggucucuaguuaccgaaguaucuuagcaaagagccgcuacccucagucccuuaccggggguugggggggaaaaaccccucuaaguuucgaccggaccugggggucagagucuuagagauuuuaaagaagucacagcuuguuuagaaacaauaacuuucuguguuguggggaacccacauuuucugcacuucugaggggcagacgacaaguccuccuugacugcgcccacaucugaccugacccucugugccauguuuugcaguugcugaauuugugcgaguccgugaaggaugacgcccugaaggugaucucugccuucaacauuccacacaucaccauccgugcaccaaaaacaggaauccccaaccccggggcugccgaggccgccuacccggcacccaugcaaccgcucgugcgggaugcggcgcgcgcucaacuggccaagcugugagccaggcgagaaauuuagugucccaucuuccaaguauuuggccagagcuggagcagaggccaaaguggcaggugcagggcagccaccuuggggauuuuggucuggcagaggagguccagcuaaggcuggcgaggagcagggcaaguuguccgggagagggagccauagauggauaccccacuaucacagugacuuagccugguuuguagccucgccuggccuuuaccuugacuucucccagccauggcccuggaucccccagacaaucgucuucgcccaccgcauggugccaccaaagaucucuacugucaguggugacucauauucccagagacuucgaaaagcucuggcgcuggguuaaaaaaaaaaaaaucaaaacauaaaaaucaaacacccuuaggcaaaagggguggaggaaagcuccacccucuccaagcucgggcaaaaguucagcgagggaugauucgugaaucaggcuugcuccagcuuugcgaggaaaugcacuggcgagagcggagagcuugagccugcagucgcccuagucucaccagguaggugaucuccggaccgcacgaccaugcgcgacaaacgcuccuccgcgcuaaacuguuaccaacccuucagaaaagcauagaugugcaaagauuaauaaauaauagaaagaugcucccgcggcuuggagagguagggcuggcuggccuggggaauaauuggaauaaagugauuuuggaauuuggagagauuacacaggcggaaaugaauuucucauuuguguucugacuugguguugcccaguuucguucucaucucuagccaucgacucgcuccccucccuccauauccgcuggcagccucaguaaggcaccagugacccacuggcccuucccacgcugcucuucucugcugucaaauccggucccaggaguucuuccgacacagccagagaaagcugaaugggcccaaaggcccgcggcuaccugacuugaggcacuugguggaagcuccccugacugccuuguucccuggugaugcaagagccuccgccuccaggccggcuuccuaauuaggaccuaaaaaagagcacauagcccaacccguugcuuuccccagugccuguauauuuucuuuuagcauguccaggguugcagaaucggaagacuccagagcagccugcuccuacaaagaaacaccagcgcuuccccacccccaccucccaccccuguaugguucuuuucuaguccaaguaugaggcgccuagcuccacgcugagggcgcagaauacuugcugcuggcuuuggacucccagaguagcaguagcagauugggcugcaugggugggaugccgaguggccaaggcacaguacugcuucacagaccuuggucaggacagaccuggaucggcgguguacuugacuucauccacgcccuugcccugugcgcucuuguagcgaucaccccugaccuccagcaggagcaaggcuuugccuugaacaccccagcuucccugggaaccaauggcuucuuugaucucacucaggauucacuugagaagcuagacuuuagcauggggcugugcugugucaccgugacguuagauccgcauacaaacaccaaaaugaccaagauggcccaacauugauugggacggcaggucgcaacacuuguucugcaagaaaaggcuacguccuacuuacugccagccuggaugcagguuggguagcccauuaauagaguuuccuuaaucucguguggggagugggacguuccauuuccagagcagcuuuuuugggccgccgcuaugagagaaggggcuggggguggggaugcacauggcgccauugacuuccagacuucuguuggaaucacaaaggccucaggaagaucaagggauuuuuuuuucgacccccuuaugguuuucccagcucggccugaacuccgcugcuccauggucgccagcaucggcggaccgauggauagacaguuccuggcguacacugugagccccaaacauuucgaggcucccaacaccgcucauggcacaaccgucuuuccuugguagccccccuccuuuuccuuguaguuauucuuuuccagcuaacuuucucauuccccuauuuuauaugcuugucgugcccgcccaucgcucccugaagcuucccgcuucucuugucucucaacuguccuucucaccaccaccucugccucuuaaguaacugggcacuagggaaacaaacauauaaaccacaacaacaacaacagcacacacacacaaacacaacacuaaggagagccuaaaggaggacagaaggcagaaggcggcggcgacgaagaaucucgcuugaggcgcagacgaagaggggugagcaucuugcugaucugagucccccggaggucaggaauucuaggaaaggacagucaaaggccagugcccauccuugcaccaaucuaauccucaugguuuggggcugagaagcugugcaaagcaagggcggagggacgccuucugaggcuuccaacuggcgcccgcggccgggcuggacacagagcaguguacccugagcgcccccuaaguuccgcucugcgagguggccgccacgggcggacggggaggggcggguacauucugaguggaggaugggcgagcaugcagcugcccgcaggccaagacacuaggguaaacacgccggggugggcggcgcacgcaaacugcaggacagccggcggggccacccuccccacuaccugucgcagccugcacgcgccagcggccugggggccgugggggguggggcuuaccuuccggcuugccgggggccggacuaaacgggggcggagcccgcggugauugggcgcgggggcgggggcucaacuaccgcagagucucaagagcaggcugcuuucacuucgcuccccgcaggcacugggucaccagcugguuggagcucugcgguccuugccaucgucgccgucaccggauuccugcagccgcucugcgagcuguguuccacuuggauucacaccaccuccgcugcucccgccgccacc

SEQ ID NO: 1072 - RNA, 915 nt, Mus musculus
ucagcuggacauaaagcaacauuuauuaaauaucaguggcucccaaaggagccaagcucacuugcucucaaacggcuaacggguucuguucucacaguuguacuguucuugggcaggaagugauucguccugggagagccaacaaggcaggcggcucuuccacugcucgguuccgucauccguagcacuggugucccuucuccaacuugucuuauaguuucaggaaggcugcugaagcucugggaaucaucauugcauugacaggaggaaguggggaggggaaaaaguuaaucuuaugggugucagcauccuuuaagguuucccuaaaauccucagcaaacaugcucgacugaauuuuacugucacugucuacaaaugcauaggugaaagaagauggggggggggugagacuccccaaaacagggcucacaaaaagaggacaagggcuccugucgcauucauaucauauggcucucucuggccccagaggugauggggacccaccuauuucagguccucugggguuaaucagguaauuucaaauaaauagagccccuggccuuagggccauaccucuuuugaugcucuaagaaaagucaccuuugcugggcaugguggugcacaucuuuaaucccagcacucgggaggcagaggcagguggauuucugaguucaaggccagccugggcuacaaaaugaguuccaggacagccagggcuacacagagaaacccugucuugaaaaaaaaaaaagaaagaaagaaagaaagaaaagucaccuuuguuuccaugcugggcaccagccuggccucugaaaccagcuucuuggcugccaucugugaccaggugcccuguccugacuugggaacaagcuucaggagggaaggcucccuggugugucuuccuggaggaaggaa

SEQ ID NO: 1073 - RNA, 7027 nt, Mus musculus
cgugauuccgcgcggcgcuaagggcaggucugcggguugcggcggcaggagcucccaagcagggcccaccagggccgccccgccacucaguguguggccggugacaugggucucaaguguggcugcaguaauagcaaacugcgguggagagaccaagggaaauaauuccagcugcgccauagcccgccaauaucccuuuccgcccucugucugggucuuccaccaaguucaaaaucagauuugguggaugaaacaaaagauccaggcauggguguagcucaguugguagagugcuugcuuagccagcacugagcucuggguuugaucugggugcgguaaaaucggacacaugucaggagccauaaugggacaagcuaauaacuagcaggugaucauccugaaguagccugccuuggauuauuauauaaucugcgacagugagcccucauuaagcaaggcuaugagggacucauuuuaggaaagauuccugcugagauagaacaaaggcuguauugcuuaauccuccccugauaggcuacagguguuaaucgccuaagccagcaagcaagcccucagaaagagcaagaaaguuuuuaggacuuuuuagaaguuaucaucagcauuucaguauaauuagagagcuagaaagccccaagacccucagacguuaaagccaucaccagaguccuuacucugugacuccacugcuaccccuggcccgggccaggaggcucccaauguucuaauuuggcacccgaacagcgacauugaauaagguaaguggacacagauaggacucuuaacugggucuuacaaauccauuggacaaggagugugcaguuaaauugucuucugccaucaguagaggcggauaguuggggccaucaguuccugguuggguaccaucagugcccauguuaagccaggagccaucagcucuggcuuuuauugccugcugccaucagcagaggcugauacuaggugccaucagugccuagcuguucuguuggaagcuaucagcacccgucuuaggucagaagacaucaguucuggguugugugcauuucauggguaucucucaagaugggacaaagugaaucuacagauagagaguucuuuacagauauuaauaaguauacucuuaagaaaagagucuuagcugggcaaugguggagcacgcccuuaaucccagcacuugggaggcagaggcaggcggauuucugaguucgaggccagccuggucuacagagugaguuccaggacagccagaacuauauacagagaaacccugucucgaaaaacuaaaccaaaccaaaacaaaacaaaaaacccgaaagaaagaaagaaagaaagaaagaaagaaaagucuuuaagguuaaaacuagccaucugacugacuuucuucaguuuguacagucagucccuggcucccagaaaggggaaguuuagauguggauacauggaagaaguuaggguuagauauuaaaaacugguuuauagagaauggaggaaaaggugugccccuuacagcauuugcucuucguuugcuauuuggaauacacuugaggaaacauuagcagaugacagaaaggccuuaggcgcccaagcagcaucagauucaccucaugagcagacuccauuacuacagucucacucaggaucuaagaaaaauguuuauuccucaacagaaaagucugagaaaaguaguucaggagagagucguggugaaucagaagagaaaaaaaccaaccucagaggaggagucugacuucugaaaagaaaguaacaaaauaucacaaacacaagugacccuuaacaaauguaaacauugaagcagcuacucugcugguggaagaacaacuucaaaaaggccacauugagucuuccacuagcccuuagaacacuucaauuuuuguuauuaagaaagaaaucaggcaaauggcgacuauuacaggacucuagagaacuaaauggcaccauggaaagcaugggagcccuucaaccuggguugcugucuccuucugccauucccaaaaugauaauguuauuguuauugaucuucaagauugcuuuuuuaccauacugcuguguccuugugaccgucagaguuuugccuuuaguuuaccuucacccaaccuuuaaaggccauaccagagguaccaguggaaauuccucccccaagguaugaaaaauaguccaacuccuugucagaaauuuguggauauugcuauccugcagguccguaaaaucuauucugacauuuauccuguucaucauauggaugauauucuacuuucucauaaagauagagcuuagguacaagagacacuacgauuuuuagcugagcgguuaaacuuauauggacuucaaguggcuucagaaaggguucagauucgacccccauucucauaccugggucguguuauucagacaaaacuuguuucuccucagcccauucaacucaggguugaucaccuagagguaaagggagauaugguuacuccuuauacugcagaccaacauaauauuuugucuuaugaauuugagcaauggcagauuguacaauuaggauauacugggaccuauucuuaucacuugccuaaucaccccuuguuauauuucaugaaagggcaucgagucaucuuuccucucagaacuaaaucagcucccuugccuccuccagcagcaaugguguuuacugauggcucggcuucagggcugcuuugauuuuugauggcaacaaagaaucuuucccuacacaagaaacuucugcacagcaaguagaauuaguagcaguaauugcugccuuuaaaagacuuaaaaauaaaaccuuuaacuuauguacagacucccacuauauugucagauuauuuucuuauaucgagacagcucuacugccaucuagccacuccacaaucuuagcucuacuuucaaaacugcagguguuauuucaaucuagagaguguccuuuuuuuguaggacauguucgaguuuauacaaugcucccugguccuauucaugagguuaacuguaugguugacacucagacaaagguuguugcucucucaauggaggcaguagagaggauaguucuuagcucugaggcaaaagguauuguuuugaaacaacuggccuuugagagugcuacauccacuugucaaucucuucgaaagacaauuuaaaaaucuggaaauguauuuaaagcaugugcugagguugcuaguucauauuuucaagguguacccauuacaacaaccucacaaggccagagcacuguccaaaaucuuacuaauaagggcagaaaacauuuaauaaaucaggcuuggcucgcaaaaguuauucaaguaagaauucuggacuuaucagcaaacaacauccuggcaaagcaagaggugccauaaauuuuaauucuccuggccccacucaaagcagaaaucccacugggugucacuguugucugaaaggguacgacaggcguaaggagcgccagccacacugaccuucacagaaauggcacugccuuaucuggugcuacuguaauccuuaauaauacagaaauuuuaucaaaccagggaaacugugaggcaccuaccucagaccccucaaacaagagagguaauucaacagccucaggugaccaauccauuugucaaagaaggacuguccaacagcugcagggagcaacuccaggcagcacagggcugugccuccacaaaaauauucacucacggcuucuccucaaacagguuaucauaacuuuuaagaucuuaaaagaaauuuuccucacacaagaaacauuugcacaaccaacagagcuaaugacaauagccauugucuuuuuugcgacaggguuucucuguauaguccuggcuguccuggaacucacuuuguagaccaggcuguccuugaacucagaaauccgccugccucugccucccaagugcugggauuaaaggcgugcgccaccaccgcccggcgccauugucuuuuaaaugugaaggacaagccccuuuuuaaagaauguuuuacagcuguuguaccguuuuuuuuuccuuuuuuuuuuagccccaacuuucagaauuacaagucuuacuucaauuuaaaaauugccuuuucucuauuggacauguucaaguucauucuaugcuuucugguccuauaaaugaagguaaggguuaguuucuuaacaaaagcuuguugcuuucccuacaaagguaacuuagcaugaucucacaugacaaaucaccauagcgcucagagaaacugcuccugcauuccugcagagcugucagcuaagcuugggaauuaaccacugaugagccugugcccuugugauuuaaaacagacaaauguuacaaauaccugucuuuuggaaaguuagccuuuauuccuguacguauguacacuuaauucucauugcuauuuaugucuuuuccuaacucgggaaaacuuccaaagauacgauacaguauuuguuucauuaguuuauaauaccaagggcuuaaugucuuuguuuaaacuuacaaagccuuuuaaauuugguguuugacucuaaguuucucauauuccacugauauccccuauaauucacagggacaugcuauuguagagugaguucaucagacuuuuaaaagauauaaacaucugaauuaaaaaaugaaauaaaaaaaaugaaaucauaauuauucaucuccuuacaauacuuuauaaaaaauaguccauuuuuaaaaacuuuucuagccccuaacaaaauaaagaccuacuaaguggauaauuaaaaaagacuggauuuuuuuuugggagaagcccuguuucuacauuuacaggacccuauagaugccagaccagcugauugcgccaguccuucuccacggacagaggcuuccaaaccugccccuuccgugccuacuuuagagccaacaucaucugcagacucuccacuggcgccagagaccccagcaaaagaagauacugaaaauaugguuccugauugcaucugauuggacuuuuaauucuauacccaggggauacaggggauauaaaacugguaaauauaaaucuguauguaucauuuccuaccagaaugcaauuugaccaauuauauaacuuuuccaugagucauaaugcuuuuccucauuguaugcuagcuaccuuauguuuugucaccaauugcuugcucacagaucugauauaaugcucuugcuuuguuugccuugguauauacuguuaguucucuuucaugaccuaagagauuuauaguugaaguaaucuuagacauuacaaccuuaauugcuacuuuagggucagcugcagcuccugcugccucccagcccagguucacacugcuaaucauguuaauuccuugacaaagaauauuccuuagcacugaucacucagggcagaauagguagagguuugaucaugcaggguagaauaggcagagguuugaucacucaggguagaauagguagaggucugaucacgcaggguagaauagguagagguuuggucacucaggguagaauagguagagguuugaucacucagggcagaauaggcagaggucugacaggugacagucaaugcuuuagagggagccguccuuuacguaggaaccgagguucaaagauuuaaaacauguuuaacuaccucgucucaugccaauuuuaaauggauuugugucaccccucuguccuacugugggucagaaaugcccuaggaacagauacaagcaccucuacgugguguguggaacaauucacaacuugcuauugacauggauacguuacguucagugccgucagccacgccggacugaagaguucuucagcaacagaauuggcugauuauuuuucaaauucaaucauaaauuuuguuaaaaauaauuccuuauggaauuuucuuauaacguugggaauuauuauaggauugguuauucugcuucuguuucuucuuccagucaucuucaagcgcuuaggaucugcucucaggacugcucaaagggagauauauacgcuucauuuauauuauucgaaaggaagagaugucaggagccauaauacgacaagcuaauaacuagcaggugaucauccugaaguggccugccucggauuauuauauagucugcgacaggugggcccucauuaagcaaggcugugagggacucauuuuaggaaagauuccugcuauuaauauguuuuuccuguuauauauaacauauauaacaaucgcuaaguaguaacacaccccuuugaagcugaucucugcacauccacaaagauguacuauuuuguagugaugcuauauagacaaauagaugacuuaagucuuaaugaugauccuauaaggauuccuaaaauuauaucugugauuauuaagcucuuuuuuuuuguuuuucgagauauuaagcucuuuuuuaaugggacugcuauuagguccuuuucugauagucacagcugcaaugagaacucugucaaucucccaagugucaccaguuaauugcucuuagauggaaaccagacuuucuccuacucagagcacauuccaagagauuguaaaacaauuaaccaaaggucauuaaaagggaacuaacaauuuauuauaggugucaggacagaagauaaaauaucgacugaguuuaucuauauaaaacuucacuaauaacuuaguuacgguuuuaaaccuucagugaaccugugaagcugagacaagugauguuuagccacauaauuacuccuaauggauaugcauguaaacauucgcuguuguaaacuucuauuucaauuuaugauuugauuuuuuugugugaacuugugaugagcuuuguaacaugugaucauuauucugaaagaugcauaaguacugaggacaaagagaugagcgagaaucaauagaggagacuuuuuuuucuucccccacuuagacuagaaucuuuucccuuuccccacuaaggaucuuuugcuuuuccccuuaaauagcuuucauaggaaacuuuuuacaacuuaguaauaaacucuauaaucacuuc

SEQ ID NO: 1074 - RNA, 3198 nt, Mus musculus
aagagucuugagucucaguuaucuuugguuuaaccagaauucugaaugccgcuuugcaauuucucuccccuuuauccccccacaacccccuccccccaccuuugaaccuuuguagcaauccuuucugggagucagagaagguagaauccuuuuccucacacuccucaccucauagcucuccccaugcggggccuccuuggcuccaagggccucugcaggagcuggagggccagguuccauuccagaaagggcccagucugcauaugcauguaagugacaggagagacgcccucucagugagggugugccugccugagugagaaagaaguauuuuuggagcucugcacugcuucuuuuaaguguccacaaaaguguaccaugagauguuguuucugggucauggguccauucauauuuuauagacuucuagggagcccgcuuccaugguggugucaggaagagucucguguauucagggugagcgugugaacaggcgcuucugaagaguguccuggaaccacggcagacgaagcgaaucugcccuucuccccagagcacaguguguucuuugcugguguaaccgugugcgucuucauuugcauuuacuucguacacucuacagucgagugaaauguccacagaagaccugcugaagcaccucuuccucagacagggugaggugugggcgcuugcggcgaggaaaggaaagaugagacaauuuuagaaugugcaccaguggguggcagcaugugacaguauuuacugaagcaaggaaaguucuaacucaugggagccuggaguuagagggcaaaggugccaggguuaccuggaauguggguaacagaggcggcaccaagagcaaaguuaaacacucaguaugaaaucaguucuagaggcccagcacagcugacggggaguggucugagaaggcagugugcacacucacuuagaaagggaggggggugcuggguccucggcuaggcuaggugggcugguaauggagaaagcagggaggucuguggguucuuggagccaaaucacagggacauucaagaguguuuagcuguuauggagcuggaaaagcagaugucaguaaaucuuuaugaauucugacagguuuuguaauaagccuaaacaaauccauacccucuguauaaaggaagugagguguuacaaagugggaaggguugaguuccuuccucacauagcuucaaccauuuuuaugcauuuccuucccaccaaguaggaagaucggcuggcuuugagccguuucauaccauuauaugguaucccuggcacagauggccaugccuggccucccagucacucuucauggucaguugguguaagugcugcccaucacccaggguugggggguuguuuggagaugccaauuccacccauggcacugucauuagacugcacaaugucacacaagccaaauaacccacugugccuuagugucucguggaggagacauuaccugacccaggggcuaccucagggagguuuugugagaacaaaagagaguaaguggaagacucaggggccuuugguaccaagguucucaaugccgaccgcaugcuacacucuccaugaaguuaaguaaguggcuaacccuucccaccuguggcuaauugaaucagaaccucagguaacaguaugccuugaggugccuugaaccauugcuuugggaaagagggcaacacauuauuaucuuggaagaaucacuuaaggauuaggcucaaaaaaaaauacucuuugaagcaagcaauucuguaagaacaaucagaugcugauauguguauucauagucuaaauauuauccaagcagugucucaguuugcuucucguccaggcaucugaaaaaucaaacaugcguucauuuaccuaagcaguagucaaguccuugguagcaaauguacacagacacuaaucuauaaaucuaaucauauauauuagaguuauccauuaauuaugggagaaaagccccuccccucacacuugacuucaauggcaauuauaaaguccauuuugccaagaauauauaagugccucuguguugugaaacagcauggagcuggccugcacagcagcugacagugugugucaguagcucugugggaugacacaugcacaggacaucggggagcgcugggaauggucugugacccacagggccagccagugauagugaugcuauaagguauucuuauaaacaggcgugguuguguucuugggugaacucaguccuaguaccaguguggcagggaggggacccaugaacaaaaugacaaggugccaaaguggguugcauguggguugugggugcuguccugaggauucaguagccgauguaugugccuccaauccuggacacagagccugcaccgaagagggcauuucugaaauaaggcaacuauauugaauguuuuaaaugccuggagcauuaaagauauuucaaguguuuuguguccuuggguuugguccucuuacuguggggguugacgagccuuuggcuaucacugguuauuucaguuuaugauaccacccagaggaaggcaggauuuuccuagaaacagcaagacagcaaauauccuuaccucuugucagcuaccuggggagucucucuugccuaucccuuauuauucccuaaacucugcaaauggauggccgugauucuaaauucaccuaccauccagagccaagucagauaugacuauaguucccuaaacaaguguuauauauuacagaagucagcaggugguaauuucagcugcagaccccaggccaucccuucucggugucuugugcccccaucugaaucauggcacgauggucaaguggaccaguggucaugcaggaaagccaugugugcuuccagcacaggguaaagaugaagcuauuugcuagaaugccuuacuaaucuuguggcucuggcugaguauguagauaccugucaaucuccagaggauguccagacacuacagcacuuuguacaagcagccccacaagguaacuagucauuucucaggcuuugagguugcuugcacugaacuccucggugcaccuggccugccuucgggggcuaccugcaacccauuucugugacucacauuagcuaucgggcuguuggacuucaccauaauuuuuuggcuauugguuucuaggaugaccacgaagcugggaaggcaagga

SEQ ID NO: 1075 - RNA, 6965 nt, Mus musculus
ccucauagcucuccccaugcggggccuccuuggcuccaagggccucugcaggagcuggagggccagguuccauuccagaaagggcccagucugcauaugcauguaagugacaggagagacgcccucucagugagggugugccugccugagugagaaagaaguauuuuuggagcucugcacugcuucuuuuaaguguccacaaaaguguaccaugagauguuguuucugggucauggguccauucauauuuuauagacuucuagggagcccgcuuccaugguggugucaggaagagucucguguauucagggugagcgugugaacaggcgcuucugaagaguguccuggaaccacggcagacgaagcgaaucugcccuucuccccagagcacaguguguucuuugcugguguaaccgugugcgucuucauuugcauuuacuucguacacucuacagucgagugaaauguccacagaagaccugcugaagcaccucuuccucagacagggugaggugugggcgcuugcggcgaggaaaggaaagaugagacaauuuuagaaugugcaccaguggguggcagcaugugacaguauuuacugaagcaaggaaaguucuaacucaugggagccuggaguuagagggcaaaggugccaggguuaccuggaauguggguaacagaggcggcaccaagagcaaaguuaaacacucaguaugaaaucaguucuagaggcccagcacagcugacggggaguggucugagaaggcagugugcacacucacuuagaaagggaggggggugcuggguccucggcuaggcuaggugggcugguaauggagaaagcagggaggucuguggguucuuggagccaaaucacagggacauucaagaguguuuagcuguuauggagcuggaaaagcagaugucaguaaaucuuuaugaauucugacagguuuuguaauaagccuaaacaaauccauacccucuguauaaaggaagugagguguuacaaagugggaaggguugaguuccuuccucacauagcuucaaccauuuuuaugcauuuccuucccaccaaguaggaagaucggcuggcuuugagccguuucauaccauuauaugguaucccuggcacagauggccaugccuggccucccagucacucuucauggucaguugguguaagugcugcccaucacccaggguugggggguuguuuggagaugccaauuccacccauggcacugucauuagacugcacaaugucacacaagccaaauaacccacugugccuuagugucucguggaggagacauuaccugacccaggggcuaccucagggagguuuugugagaacaaaagagaguaaguggaagacucaggggccuuugguaccaagguucucaaugccgaccgcaugcuacacucuccaugaaguuaaguaaguggcuaacccuucccaccuguggcuaauugaaucagaaccucagguaacaguaugccuugaggugccuugaaccauugcuuugggaaagagggcaacacauuauuaucuuggaagaaucacuuaaggauuaggcucaaaaaaaaauacucuuugaagcaagcaauucuguaagaacaaucagaugcugauauguguauucauagucuaaauauuauccaagcagugucucaguuugcuucucguccaggcaucugaaaaaucaaacaugcguucauuuaccuaagcaguagucaaguccuugguagcaaauguacacagacacuaaucuauaaaucuaaucauauauauuagaguuauccauuaauuaugggagaaaagccccuccccucacacuugacuucaauggcaauuauaaaguccauuuugccaagaauauauaagugccucuguguugugaaacagcauggagcuggccugcacagcagcugacagugugugucaguagcucugugggaugacacaugcacaggacaucggggagcgcugggaauggucugugacccacagggccagccagugauagugaugcuauaagguauucuuauaaacaggcgugguuguguucuugggugaacucaguccuaguaccaguguggcagggaggggacccaugaacaaaaugacaaggugccaaaguggguugcauguggguugugggugcuguccugaggauucaguagccgauguaugugccuccaauccuggacacagagccugcaccgaagagggcauuucugaaauaaggcaacuauauugaauguuuuaaaugccuggagcauuaaagauauuucaaguguuuuguguccuuggguuugguccucuuacuguggggguugacgagccuuuggcuaucacugguuauuucaguuuaugauaccacccagaggaaggcaggauuuuccuagaaacagcaagacagcaaauauccuuaccucuugucagcuaccuggggagucucucuugccuaucccuuauuauucccuaaacucugcaaauggauggccgugauucuaaauucaccuaccauccagagccaagucagauaugacuauaguucccuaaacaaguguuauauauuacagaagucagcaggugguaauuucagcugcagaccccaggccaucccuucucggugucuugugcccccaucugaaucauggcacgauggucaaguggaccaguggucaugcaggaaagccaugugugcuuccagcacaggguaaagaugaagcuauuugcuagaaugccuuacuaaucuuguggcucuggcugaguauguagauaccugucaaucuccagaggauguccagacacuacagcacuuuguacaagcagccccacaagguaacuagucauuucucaggcuuugagguugcuugcacugaacuccucggugcaccuggccugccuucgggggcuaccugcaacccauuucugugacucacauuagcuaucgggcuguuggacuucaccauaauuuuuuggcuauugguuucuaggaugaccacgaagcugggaaggcaaggauggaagcaggacaaguuaaaacaucaggaagcucaccguuuuuacugggaugugacugcuuucuggguugcugccagcauaggcuuaacaucuagagcacguuccugguguucuuagugguuuuguggcacagaggauuuucagggguucuaccucugcccuucagagagagaagagcauucguaggguaacagguguguucugccacacccuucaugaacugcagcuucauuaugaagaaaaaaaaagagcuccugaugauacauggacccagcccgagagaaguccuucagugucauugaacacuaccccucgggggcugccgaguggcuaucugccuggcggccugucugcucagcacuccaucuuugcugugggcauagcgugucuguguguuguuaucauuugacuuucuguuguuuguuuguuuuuuuguuuguuuguuuuguuugacaggugucucuuuguauaguccuggcuuccuguagcucacuauguagaccaggcuggccuggaacucacagaaauccaccugucucugucucccagauccuacgacuaagggcaugugccaccgcauauagcucauuagacuuccugguaggucugcaacaccucugcuuccagggauuauuuuaauuugauaugacacagagcuugcccagugcaaacauuuucucccaguguucuugucaaaagugauagcaacaguuauuuuacaucucagcuuccuaaggucacaauaccucuuagaacaaacaaaaaugaaaaaugaaaagcgggcaggcugcugcccaggaucaccucagaaggccuugaaagacuccacuauauccaugagaccacaggaggucauagcacauagggcugugaguacaagcagggaaccccucuaacauccccguuaucgcugauguucaggcucuauacaauagaaagugaauaucaaggcagaauuguaaaaggccugcacagguauugaagucaccaccaccaaacuggaacagaacccucagcaaaggugguuauuuaagaaaaucuuggcucgaucauuaguugagcuuuuagcuaaugaggcagaaacacauuacaaagaacauaggcuucacagugaauauugagggugaucaccaacaacagguccuagagagagcagagucucuaguuuccaaaauuaauuaagauuuccuaauuuuugauacuaauugugggguauaccaagagagagaaggaccuacauggcagauggguagagaauggacccuaucccugaagaggcccgguguuggaccuucuaagcaaacccuugaauucaccgauuucaaguguguuagagaacugaaggaagcagagcacgugagaccagagaggauaucagucaggagacaggauggaauucugaauaaaagcaaguggaaacacuggaggcgaaaaguuggcuuagcacagugaaaaauucacuagaaaugauugggcauguuugaccuggccaaaaggaaucggcgaauguggagucaaguaagauuuuacgucugaugaagaacagaagaauaauuuacaaagcaguguuuuguagaccacaaagcacaccaacaugcacauagcaggaacaguugaagggaggguaaaggaaaauaggaacauauugggagaaacagugaccaaggcacuggagagagcucagugguuagaaguacuugcuguucaaccaugauguccggaguucagaucccagcacccaugguggguaauuaaaaagugucuuuaacaacaaagaaaagaaaaaagaaaaaaaaaaccaacaacaacaacaacaaaaugucuuuaacuccagcuccaaggaauccaaccccuggccucacacauauacauaaauaaaaaauaagagguuuucuuuaaaaaucaugaccaaaaucuaccuugcuuuauaaaaaugaacaaauaccauuaaaauguaccuaagaggcuggaagauagcucaguugguaaaguguguuccuugaagcauggggaccuguuuaauagucaaccuucacuuaaaaaaauuccaggccugguggcacauagcuuuaacccuagcacgggggggguggggggggggcggaggguagagccaggcagcucccaggggcucauuggccagccuaacuucuucaguggcucuaagcuauugacagucccugucucaaaggaagacagagccugccauccccuggccuccacacauaggauaaauacauacacguuccuguucauaccuguagauacaacaugaaaacacagaaagcaucuaaaagcucaacaauucucagaaagggauugauucccuucacguuuuucagaggaaauaugccaucaacccuuaaacacaugaaaugauauuugacacuauuauccucuaggcccuggagucuaggaaaaugcuaaccagggcucacaaaagauaccauugugcaaauaauaagauugcuauaaucagaagauaguaccagguacuaguaaugauguugcuaaggggaaaugugaaguuguacagcucacuuuaauaguuucacagggcuucagaaagguaaacauagguaauaugacacagaaacgugguucuuagcucugauaccuaagggaauugaaaacacacacauagaaaaauggauauuuguaaaagccaaacacuagaaacagcacgaauucugacacuauccaaccaccuuccuaccucuugcucuugauugcccagaagcaggcugggguggcuuccuuucuucuggguagcauggccugguuacugcuugccguccugcugaugugcuucaugcauuaagaguugaguagacauaagcacagcccacagaaucaauuaagcagggcucagaggggcucacagagacugaagagacaguccuggagccuguguggcucugagcuagguccucggcauucauguuauggauguauagcuuggugcucuugggggacuucuggcaguaggagcaggggcugucuuggacucucuugccugcucuugggaccccuuuucuucuauugauuugcuuuguccagacuugauaugagggauugugccuaguguuauuguaaccuguuaugccauguucaguugauauaccagggaggccugcucuuuucugaagggaaauagaggaggaguggaucuggaggagaagggggguggggaggaagauugggaggaguggagagaggggaaacugcaguuggaaugcaauguaugagaaaaacuaaacaaaaaaacaaagacuugagaaagagggggcugggggugacacaugccuuuaacccagcacucaggcaaagacaauggaccucugugaguuccaggccagccuggucuaggacagccaggacuacauagagacccugacucaaaaaacaaagaaacaaaaauaaauaaauaaauauuauuuuaauaaacagacaaguugagaagaaaugacagguuggugccccacaccuccauuuuaguugaagccaagaauccagagucuccugaggucugcaucagggugcaauaggaaaacuccagaaugggacagaagggaaccuuuaaagauacgucuuguaucagguccuaauuaacgaauuaagcuaauaugggucacagaggucacacacuaaaguggagcaggauuuaguaugguuugcagguuacaaaacagcgaagccucuuucucucucuccacccccacccccacccccacccccaccccgguguuucaagacagcucuguguaacuacucugaaugacuuggaacucucuuuguagaccagacuggucucgaacucacagauaccugaccuccugauugcugggauuaaaggcgugucuucaugucugcgcguaguuuuaaccggucuaaucacgccaugguguaaguuuccagucgacucugagaaaag

SEQ ID NO: 1076 - RNA, 25754 nt, Mus musculus
acgggguaggguggcugugggguugguccggccauuccagccagccacgaguagcguccuagcuccggucucccguccgggacuggcagaagcauggaugucgacggccgguggcggaaccugcccagcgggcccagccuaaagcauuuaaccgaccccucguacgggauucccccagagcagcaaaaggcagcuuugcaggaccugacgcgggcgcacguggacuccuucaacuacgcggcgcuggaggggcugagccacgcggugcaggugagugccgugcacugcgcuccagagcucuacccuuggccugggggguccuggagcgucccugcgguugggagaaguggccggggggugggggggugaggggugccuacaguaugaccacaaauagggacgugaacucacccugcauugcuuuggguaguucagagaaaaaaagcaacucauaagccuagugguguagggaaacuuguauuugugacuccuggauuuauauaugaguacgagucugguuuggggcgaaccauuucuggguacugugagaugagagugaggaagugaucuuuuuggaacuguguuuuccaccauucccagcacucgcgccuuuucacaccuggagucuuacguucuaaaacuaccucacaagguuccaagcugaucagacagacugcagcaagcacauccuucaguuugcuucccuuaaaguuuucuuuuuggggcgggagaauggagacgguucgagauaagguuucucuguguagcguuugcugcccuggagcuccguggaccaaggcuggccucgaacucagagaucugccugccucugccucccgagcacugggauuaacagugugugccaccaucgcccgcuugcuugcuugcuugcuuucuuucuuucuuucuuucuuucuuucuuucuuuuuuuuuuuuuuuucuuucgagacaggguuucucuguauagcccuggcuguccuggaacucacuguguagaccaggcuggccucgaacucagaaauccgccugccucugccucccgagugcugggauuaaaggcguucgcugcccgcuuucuuucucuuuaagaauuugcaagaggaaaacuugccaccuguucugaguuggucauguugaggaagauaaaaaguccaggggaaucauuguaacagugguagcagaguaaggacggggaaggucucuuuuuguuggcaucuuuaguuuuuccuggcacggcacucugagaguaagacaccucucagguguaauugcuccucacuuuggauguugguuguguaacgguagcaggcaccagcaagcagucagugccauauucuuugagaacugcucuaagauguggcgcuuucugagucaggaguacaagggaaaugcugcgacuaauccagguguuuagaaagcucugcauuagauaaggcuaagggaagaagauggugcccucccucaggaggcaggguagguucagggagagaaauauguaguagacaguacccugagcuuucguuaccaaacaacuguauugugagaacaaaggauggggauauguuggagagcuuugacugccagacugagacuugacaauauggaagccauuuagaacucuucgaacugccaggcuucagugugagggaauaaaauauacaaagcugagcuuuuagaugagaagaguuucccuauacuugccccugaaaagcagagaagguagaugcuuagcucagccuuuucuguguccguagaaccuacugcaaaucaaauacauagcgcaccauccaaaaaguuaaauaguuggccaaguuaccaguugguuguaacuuuaguugucccuuuuggauuuguugcauuggugugguagaugucagugaguguagaccacaaguggugauuucggggagucuuagugaaaagugcguugaaaaaugcaagugauuuagcagcgugaauugucuuucaggccauaccucccuuugaauuugcuuucaaagaugagcgcauaucucuuaccauuguggaugcugucaucaguccacccucagugcccaaagggaccaucugcaaagaucucaacguuuauccagcugagugucguggccgaaagagcaccuaccgagggaggcugacggugagcauuuagugacauagugacagcagguggcugucccugcacacuucugagacuagggcuggugccacugaagugauuguaucuucaucuaaagggacugugugucauccaaaacaugaagucacuucccuguggccucuuccuccuuguaacaugcucuuuugugaggcuggggagauggcucagugguuaggagcacugccuuuucuucuagaggaucaggguuugguucccagcaccauauggugguucacagcugccgguaacuccagucccagcagauguaauacccacuucuggccuccacugguucagacacacaucuggugcauagccauacaugcaggcaaagcagucaaaauauaaacaaauacagcuaaaauuuuauuuaaauauuuauucuuguaggucaugauaucuuuuuuuucuuuuauucccauuuaggcugauaucagcugggccgugaauggaguccccaaagggaucauuaaacaguuucucggcuauguucccaucauggugaaguccaagcuuugcaacuuauacaaccuuccuccucgaguccucauugagcaccaugaggaggcagaggugagugcagggaucgaggcuguggggcagcagcgaaggugaggaaacaggaggcuggaccacuggugucaucaugucuguacugugcguggcucuuaccacagucuguugaagccguguugagccugugcaugugugaaacuuaagucugccgacaagcuacacuuucaacucaaauucucuuuuauugccuuccuuccauccuuuuuauuuugggaggugggaugcgaggggucaugcuguauagccguggcuggccugaaacucacuguguggaucaacucacagagauccacuuuaaugcacgucguccaccccacccugggauuaaagguguauacacccaagccuggcuaugucauuauuguggguggccaagggagguggggaggggggucaguuuagucacuugguauccucugaccacauguagaggucagaggaucagaggacagcacgccagguguuggucagggcguggacucagguugucaggcuccacagcaaauuccuuuaccugcggagccauguuucugguccuagguuuccgaguuauccauagacauauuuacaugaauacugaaccaccgaagcauuguagaagcugccugcaaagcucccugagcugacugggugguuccuguacacuuuccuccguuuuagcugcgaagguagcugugggcuauugaggugaaggaaggaagaugcaacaaacucugcauauuccuaagaagacugucaggccuugggaagaaggugugggugucaaaucaggaugugacacucagccucccuguuugccaguuguggggcuuuggagaauuuaagucacccuaagccuccauuucuucuagugaagcaggccuaccuaucacuagugaggcaggcauaccuaucacuagugaggcaggccuaccuaucacuagugaggcaggcauaccuaucacuagugaggcaggccuaccuaucacuagugaggcaggccuaccuaucacuagugaagcaggcguaccuagaagaaccaugugcuucguucacagagcugcagcgggggugucuguuugauagcagacuguuaguauauacucuuuuuuucuuuaucguuaaacguauuuuccuaaauuugucugguccggauuuguaguuagcagagcucuuggguagucaaccucuuccuuugucauuauuuucuuagcuuacccgggagcccauuugaaagcaaaagugguuaguauuuuuaucuuuagauuuuuggagcaaguuuuauuuguuuaaauuaggaauugaaauaaguugggacagaaagaaaaguguuacugagccgucugguuggaagggacggcccugucuuccugacauccuguucucugugucuauuggaucacacucguguauuugacaagacuuacccuggagcuuguucuguuuccagagcccggcacgugccucuccugaggguugcacuuuguuggcaagaaauacugugucuaguuguuuaacagcugacaaccaugucuuuggcaggaaaugggcgguuauuuuauaaucaauggcauagaaaaagucauccgcauguugauugugccccggagaaauuuccccaucgccaugguaaggccgaaauggaaaagcagaggacucggcuacacucaguuuggugagucuuagugaacgucagaauguugcuuuagacaaccugaaaaccauuaacagcucuacaaaauaguuguguuucccuuacauuauuuuuguuuuuccauuaagcacuucuaugauguucagggugaagguugggggggggggggaguguugauccauguguaaacuuuaaguuacaggcuaaggacagggcugggaaguggcucagugggaaagcauggggaauuugguuuggguccccaucacccacauuuaaaaacagcagaggggcauagcagugcucaucucugauccuagcacuggaggggagagaacaggagccccaggcaggggcuacagcuaauuuagccaagguagaaaguuugaggguucagugaagacccugucucaaaaaagcaaagcggagaagcgagugaggaagaccccugugccugagugggagaauaacagccccccacaugugaacgaacacacacauacuugaauacaaucuagugcuaguguacagcacugggacuguaguuaaugauacuguuuugcuuuugaaauuuaaaaauuaagauuuuuaagugucuggucccacauguacagacaugcacaguuggugacuauaugugguaauugauauuuucaucaguuugauuauggccauugcuaugcauguuucucagcuagcaggguucugucuucauaagccuggaguaaauugaaagcagagugcuuuaaaaaugcacuuaaaggggcuggagagauagcaguuucagagcuuguaaucuucagagaaccuuaguucaauucacagcauccaugucugacagcucuaauuuuauuuauauauauauauauauauauuuuuuuuuuuucuuuuuuuaaugcacuuagagccaggcacgauggggcacaccuuuaaucccagcccuagggaggcagaggcagguggaucucugaguucaaggccagccucgucuacauugugaguuccaguacaggaccgucaguguuucauuaauagacccuaucugggguggggugggguggggguggggauaauguucuuagaggcagggacugguuuggugguagauagcuugucugaccugcagaaguuucuggguucauuacuugacaccgcacacauaauaaugcacucaguacacugaccugcacacauaguagcuuagcuuagcaagcccagaugugauuagaacaguuauuaauacagcagcauacacuuugaaaaacucgacuaaagcaaagccuguuuuaugagcgagugucgaugaaaaacucgacuaaagcaaagccuguuuuaugagcgagugucgaugcucuugugcucgcacacagauuggcuuuuuguacauguggcgagccuguguaaacacuguucgaaacacuggcgaccccggagccugaagagugucagcugguuuucuuuuccaucucugcgcugguugggagcuuuggcucagcgcugcuguccagcauccugagaaaauacacagcacuguuaaccuaggagcaggucucaguucagaagugaacugugguuucuccugaguggaucaugguuaguuggcaccauuguauauguguauaaauuggcgcccuuuguauaugugcaucaaauugcuuuacuauauauaugcuguuuacuaagaaaacuugagauauaacccagagagugauuucauaaugaaaauccuuuguauauuuuucaucuggaagauuccauauauuuaugguguuguuuuugaagacgaaggcuagccugacugaguaccugugaacaaaggccucagaggcccccugguucaggcugccuuggcauaaccucaagggggacuagucuguguucaaaugcugccugugacagugccuggcaccauaagauagcauauggcauucucuauaaaacuuuuauauuacauauauaaaauuuauuuuuauaguugagauaauaaucauccuguaauuguuaccauagauacaacaccuaggagagcagcaucucagaaugucaaaacauguagccacugguccuuuuggucugauaaaguaucuauaaaccugaacucuugaguucugcuguucuccaucaagauguuagauaagcaaccaugucuggaccagucccacagggcagugaggauaggaagugcgcccugccgggucauccaaauauaaggugcuauaggaaaugggccccagcugauggaaaccuuggaaguucggccaaauucacagcuucauuuauuucacaggguaaaccuguaaacauuuggcaguggucuauagacauuuuugauugccagccuugguuaauuuaaucuaauuaauuuaaguuuuuaauuuguuuuuguuuuuuguuuguuuuguuuuaaacagguucucuuuauguagcccuggcuguccuagaacucacuauguagaccaaacuggccucaaacuuacagagaucugccugcaucugccucccaagugcugagacuaaagguggugugugcuacaacgcugggccuuggcucaucuuaacaagcgauuugccuuugguugugguaguggucagaaggaaaauuaauacuccgcuguugcuugaacaggggucuccaugcgcugugugagagaagagcacuccgccgugaacaugaaccugcacuauguggagaacggcacgguuauguuaaacuuuauuuaccgcaaagagcucuuuuuccuuccuuugggauuugcacuuaaggugagaugagaugaaugcuugucuuuugcugugaguagacucguugggagcuauguccugcacauggcauggcaggauaguuucucuuuguuaaaagcuacacgugcauauguguuacccaagcauuuugguagucugagacuggagguugcgagauccaggccagcuaggacaacauaccaagacuuugucuucuccaacuuccucaucaaaauccaaaccaaaccaaaccaaaccauacaugcgguuuuacuuaauuagcuccugguccauccuuaaaaucaguagccugaaauaucaauaaacaucuucucucaggguuucuggaguuguggaaccugugaguagccugauuccauggccacauugaaguguuugaggugcugugggccucugagauggcuccuccgggaaaagcaccuggcacgcaagacagacaagacaaccugaacucagcccccagcacccacagcggaaggagagaccuggcuccccagagccuguccuccuucaccuccggaugugugcuauggccuguggaccuacacacauacacaggcauuacauccucucccucuuaaagaauuaaaacuugauagcaaaugaagugguguaaucaucuggacugagcgugcuuccaggacccagugcccagcuagcuggcucacuuauugguggcuguuggcaggaggucucuguuccuugucccuguggagaguuagcucagagaaugggguugaaggcagucuguuuuugaccuggcccugggaaucuggcaucucucuuuccuuucguaucucucuuggugauguaggacaggccuaauuagucaugggaggagaugauuccaguuuugaauacccaguaggaucauuggacuuugcuguuuggccgauuuuaaaaucacugcuuugcuuuggagggcugguuuugcuugggcauuaagguuaugagaggcucagugcagcguguguguuugguuugauuuuugguggggguggcgagguugagagguagcucaguaaauuaaauguuugguggugguuaaaaaggaagguuuauuuuuuaaaaaaaaaaaaaaauguuuguuuuuuuuuucuguuucaggcacucgugagcuuuucugauuaucagauuuuccaggagcuuaucaagggcaaagaggaggacucuuucuuuaggaauucuguuucucagaugcugcggauugucauagaagagggcugucacucacagaagcagguucuuaacuaucugggagaaugcuuccgagugaagcucagccuuccugauugguacccuaacguggaagcugccgaguuccugcuuaaguaugugugcucuuggggcgggggggggggggggggggggggggggcggggggggguguucaugcggggcagugagccuggugggaaggugguccuagccgggaaggaggcuuugcuuuuuccaaguuugcaacaguguccaaguaagacaauagacacuggaagucacuaguguugguaauuuguuacauuuacaaaaugcucacuuugucuguccauagauacacauuuccucucuguuccuuuguaaguuguggggcccuauuucccuguagcaguggguuuguauuacauaaacacgguauuaaaggagcaggguuccagcaauugagguguggccauuguugcugaaaaaaauuaagucuuauuuuuaacugagcuggaguagcucugugugguugcuuacucccuaccauaugggugagcacagcuccagacuuuguggcacuauuccaucaagguugccagugaagguaaaaagaaauuaggggaagaggaaauguuacauaagcgcagacuagguccccggucccuggaaauggagcaggacaaagcagagcugcucuaaggugguuucucucccagccagugcaucugcauccaccugcaguccaacacugacaaguucuaccugcucugccucaugacccggaagcuguucgcuuuagccagaggggagugcauggacgacaacccugauagccuagugaaccaagagguccucagcccugggcagcucuuccugauguuucugaaggugagugccugcgugcccgcgcuguucaggggccacugugccacugucugcaggcugaugauuccuagugugagcauuuuacauccucucuucuuugcuuggcagugagggacuuagucaaaacuggagcuuaugccaggccuggauaucugggugucaucuguauguaauuuuguuuccauguaaaaccugggcuucccaaauaagaggcguuuccugagacugaccugguuggcccacccucccucucuucuuucccuuccuucuucccucccucccucuccuuuccuucccuuccucccucccucccucccucccucccuuccucccuuccucccuuccucccuuccucccuuccucccuuccuuugguuuucaagacaggguuucucuguguaguucuggcuguccuggaacucgcgcuauagaccaggcuguucucugccucccaagcacugggauuaaggguguguaccaccaccaccugacugauuuagguaaagauuucuucaauuggagcaacaagggcuccaccuaagauucgcuuaaucuuagaagccagggucaagggcuucaugcccuugccauaguuccuauuuuagucuauuguauaguccaccuuccccuuaggccauuguaaauauguguguguauggguguaacucagcuauagucugagaagccaggugugaugucuuuacucuccuagggcaagggcuuucacacccaagucaugguucuaacuagggaguuccguucuagcuaaccaucucgugaauaaugcaauacucuaaaaccacagcccgaucuacuuccuaaaccauuguaaauuccuguauaugggugaaacuuggcuuuuauucuaagugauaguguaauaccagaggcuauucuaaaugucacugaauagcaauauucuuaccgaauuucaagcccauggucuugcucaaggacguucuaggacuguuagaacacuggcagaaggcuuuagcuaugucagaauucaaucuuaaaaggcacuuauaauaggauaauacuaaaagagagcacguggauccauacacuagacuaucgcaggaauggaaaauuaauguauggguuagagagaacgccagacuccaggagcgaguuucugugaaacucuuuugccucgugacagccugucaagcugacucgaccggagagcguugcauuuucccaacaauaaaauuucauuccuuguagcuaaaacuccuucugcuauaaauacuuacaguauaguuuccuuauccauuccucuguucuuggacaccuaggcuguucauagcuuagcuugugacauugaugugcaggaaucuuggugacacgugggaccacgaggaaugguaggccuguuuugaguuuuuaagacagggucucacugaaccuggagcucacuaauuugguugggcuggguggccaccgagcuccagggaucuaccuguuuccaugucaacagugcugggauuccagguguuugcugcugugcugcgcugugcugugcuuuguaagcggcugcuagggauccagacucaaacccccaugcuuugcagggcuagcacaccaccaacugagccaucuccuauuucauuucuuguuauucgguguuuugacagggugucucuuuaccagcucaggcuggccucgaauuuaaauggagauuaguuauauacaaccaagccuaguuuaauuuauauauauauauauauauauauauauauauauauauauguuuauguagucuaaagguaacaucaaauuucggucauagcucugauuaccaagaaacaacuguauggacugauauacccuuggauacaguuguuagucuuugguuuuuuucccaugucuuuaaguucaucugcuuaucugcuugcuaaaauuuauuugcaauacuuuaauuguuuuguuuugguuuuuuuuuuuuuuuuuuuuuuuguggcucugacaaaaugccugacagaagcuaacauaagacagagaggauuuacuugggcucgugguuuuggguacuaucaugugucacaguagaaaggguuccuggaguuucuggauauaguguaggaauaucaagugggagcagagccagcuccuggggucccagguccacuaccaggucccacuuccuagaggacauggauguuggaaacugauguuguggccuguguaagagcaggguaugcucucaaacacugagcagucuccccagccccugaucuagacuucuuccuguccgucuuuagaaaugccugagcuucaguguacauugaagggcugucuuucaggaugugcuaccaauguguucuuugucacaugcagaaacagcgggccuugacuggaccguaucuguagauacagcauuugagauaauuaaagcaaguacuacuuuaaauuuaacauuuucuucuuuuaggaaaaaauggaaaacuggcuagugucuauuaaaauaguuuuagauaagagggcucagaaggccaauguuuccauaaacaacgaaaauuugaugaagauuuuuaguaugggaacagagcuaacaagaccauuugaauaucuucuugcuacugggaaucugcguucuaaaacagguaaauuaaacagauaggccauuuuuauuuucaaauuaccugccuauauuagacagguauuauauuaauaaaaauaacuuacugaggaauuucagaguuacucauccucacuaaagucagauuucacgacaugguaaauuuuggcaaaugucugccacccugaagaguucagcgaggugucuugacuguguaaucuagugcuaguacacagacacauucccaugacuccuagaaagcaggugaccacuuaugucuggagcagaguuaccggauguuagccacaagaguuuggauaugugccacucccugagccaauuguauuugaauaaauugggaaaauaaaaagaacaguugggauccagaaaucugcuuuuguuuuucugacagcugcuacuaaugcugcuucucucugagugugccagcuuaacucuagggcucucagaucagucuaacucaguucuuuccguucaccugaucuauguugcgauaaucuacuuuuguguauggugggagaacugggaauugaauccagggccacucggguguuaggcuaaugcucuuagcaccgagcuacaucccagccccugaaguuuuaucauuuuaccaaaaaucagaaacagacaguuugggguuuuuaaacaagaguuugccuuguuuugagugacuuuuuuuuuuuuuuaaauuaaggucucggcuuccugcaagauucuggccuguguguuguggcugacaagcugaacuuccuucgcuaccucucccauuuccgcugugugcacagaggggcugccuuugccaagaugaggaccaccaccgugcgcaggcugcugccagaauccuggggcuuccucugcccugugcacacuccagacggggcgccuugugggcuguugaaccacuugacugccgugugugagguuguuaccaaguuuguguacacggcaucuauuccagccuugcucuguggcuuagguaggaacagugaacagccuugcugggcuucaccacacugaccagcgucaagccgugaaguuacucuggggauucagcagggccguuucuucacuccuccaugcaggaguugggcuacauucugagccucucucucgggcauucugagaugcuaaaauacguuccauguccucaguguugucccuuuuuacaaagugaaaagauagaaagaugugaggugggauggaggguaguauucaaguguagaugcgguugguugucuugaguuuuggguggcucuccuuugucccugguggaccuuugcauuucucaguaaaaaaacggugguuugggggaauuccauuaaaaagcggcuucugcucuguagcugaugcccuagaucagugacuguugccccugggaacuuguagcugcugucucugcuuugggggaaacucagucauaggcuucuccuaggcuugcucguugccuccaguuuguuuucucaauuaaagaugguggucuuugaguauguuauaccaguuaguccugggcucuuccaguuaagauauaaaaaccacaguaucgugucuuuauuggauugcggucuccaguggauugagguuuaugaagugcagcuuagaacucaugagggucaggugauagaugcuucagguaaccagagggcagugagucaaaaucaagacuuuuuauguaaaauacuucacccagcuggaaaguaaccacugagagggaacuucagagaaaaagauaaagaaauagccaagagucaggagauagaaaauggaguaaucuguuuauuugcugacugcaaggcaaagaguaauguuguucuaucacuaauuaaaaucaagccaggcagaguggcacacaccuguaacccagcacuugggugguggaggcaggaggaucagaaguugaaggagauccaaagcuacauaggaagugugaggucagcuggguuaccugagacccugugucaagguccaaagaaagcaaagagaaaaggugaauguagacguagauaguacauccgaccauggacgaagagacgggaggcauuugcucuggcucugaggaagagggcagaauagaagacuguccuugcagggugagggcuguugugggugacacgugaagcccuaagugguagccuuugacacuugggaaaaugcuggcuauuuucacauggcaccucugugugccaauguucuuuuucauuuaacuauaguugguucucauuugcagcccuguaguguauucaguuuacugccaaugcugucagcccauacugaaccauuacuucugggggaacuguagggcucagcacucgcaagucuaaccgugaacucuaagccugcagccccaagcuuauuugacuuucucuuaggccugacagccauguugcacuuaggaagacuaggcagcccccgguacuaaguguugguguggccuugaacaaacauugaaagacuuuccugcaguuggagcacagagcaaaaauggccaaauaucuacagcgggacacucacauuucugccauguuaccucacaaguagccauauuauaaugucuaagagguguauguccaaguauggaaaccgcagauaaggagggucggcauuauuagguuuuucuaggggaaggguauuaaaugagcaggcuuuaggaauccgcgugugcccagccaucuucucacaggagaugggugcuuguguguucuugaugaaacaauuuacaguuguacaaacaauaccaaagcauuuguguugucccaaauaggacaaauaggacaguuggacagcuaagcugagaaagccguuacugaccgcccuuuuuuguccuuuuucccccaggagucacuccuguugauacagcgccaugucgaccguacagugacugcuacccuguccugcuggauggcgucauggugggcuggguggauaaggaccuugcuccugaaguugcagacacucuccgucgauucaaggugauuaucagucucugaggugucuuccuuacccuccugaguuugguucucagccuuuccuaguugaugaaguguccugguuaugucuacaguggucaagcaggcagcagguggaagcuaauuccagaagugccucacccuucuucuggugguaucuugccuugugugaggagucauugacagacacgugaccucuaagcauuuauuggucauuucugaggucccugucugcuuauguaaccagcuugacuuccuaggaaugucaccaguugguuaccgugacugcuccccaguugucugcccugggagguauucaucugcaccucuuagguuggucacguguaguuaguuuuucagggguaacuuguggacccacagucugaugguucucgcugacugauuucugauuuccacugcuccuuugguugcucuuugcuaaguugcuugugacuguggcgguuggcugcacucacucuaguucacacaggccuuggccgucuuccugcucagucccaggaagcuaggguuacagucagaguucuuuauuucuacucuuccuaagcuugcagccucuacugaggccugucuuagugaacacaauauuuuuaucuugguuuuuugagccaaugacuuuaacaguuuucucucuauaguuuggcuuucuuuuuucuguucauuauuaacuuuuguguuaauuuaauucauggacuggugagauggcucagugggcacaggcacacacucagaccuagugaccugagcuugauccccagauggcacaagaucccagggaagagcuggcuucccagacuccuccgcugcucucucacuuuggcucucauggaccuguacacaugcaaacacugaauccauuagaauucaaggcuuggagagaugucucagugguuuaaagcacuggcugcucuuccacaggaucuggguucaauucccagcacccugugguuguccacaacugucuagcucggguuucaggggauuucacuccuuccuuugaacuccaugggcaccagacacaacauauagacauuugcaggcaaccuuucauacguauuaaguaaaugaguaaaucuaaaacaauuaaccaaucaaagaauucagucuggucuagacaugguagcuuaaucccaagcaaugaaaggccgagacagggacaacuauaauuaucaauuuguguuucauucuuuucucuuucuugagcuuucuuuggugucuguggugagcuuuauccucuucccagacaucagagaugugauguggcuguguuaacugagguugaagacagcauggcuggucucaggacucagugcugccagggcuagaaugucgccuuuuaaugucauuuccucccucugcgcagucuccauucgucuucacugauaaugugcugagauguggaucccuuaagcauauauaguuuuuagaaucuuuuucaaauuauuguuuugguuuguauuucucccuuuacuuaagaauuuuaaaaauaauuuuaagauuuguuuuuuaugcaugcaugcauugucugugaaggccagaggagugcgcugcaucucugggagagcucuuggcaguuauaagccaccugucaugggugcugggaacugaaacuugguccucugugagaccaguaagugcucuuaaccaccgagccauuucuccagcccuguuuuggguuuguuguugauguuguaugugugugugugcuuugugauuuuaaaaauauauguguguguguaugugcaugucugcauuuugguaugcacuugugaauacagugccuacuguauguauucuuagcuguguagcccuuucugcaucccuguugcuuguuuguucauuuccaaauauaggauucuuuucguguaauuguuuggaaggaaauuuauuaacucauguuucaaacaggagaauaacuugccuuuuugaaaacacuccuuugccauuucgcgagggcugaguggccucgucuguggcugagacugggauggacaacuguggcucuggagugcuagguuuauuacccaaugacgucaucucuuagaucuuuuucuuuccuguucugccuggcuucucgugacagggaagcugagauaagacauacauuuauucuucacuaaacucuguuuuguuaaaccagguguugagagaaaaaagaauuccucccuggauggagguggcccugauucccaugacaggaaaaccaagucuguacccaggucuguuccucuuuaccacucccugcaggcuggugaggccugugcagaacuuggaacugggcagagaagagcucauuggaaccauggaacagguagggaccagcugcaguguugcuuauggagaacagcuuucagaggcucgguaucgcguuuuaaagcguuugcuaggaggucagacugacuuuccaggcucucuuugcccggcucuaaguagucuugcugucuugccacgcuuccaggaaccugcgggaggcgugguguucgcaugacugcccuucaugcugcccagcguucacgguucuuuuucacuuggcucugucacaguuggugagaccaaggcaucccguuaacucaggucucaguugucaccugcaucuuugccauugacaaauagauuugugccuauuuuuuaaaaaauauuuauuuauuuguuuguuuguuuauuuauuuaaugugugugaauucacaguugcugucuucagacgcaccagaagagggcaucugaucccauuacagaugguugugagccaccaugugguugcugggaauugaacuuaagacuucaggaagagcggucagugcucuuaaucgcugagccaucucuccagcccuugugccuacuuuaaaacaaaagaaacuggguaucacggugcacuuuaaucccagcaccggggaggcagagccaccagggagggcuacucagagaaauccuauccaaaauaaaugaacauuuauccuccucucuggccccucacauuggacaggguagaugcgggaugagugucuuaggggaaagcguucgggagauagcucaguggcggagugccuggcauucacaggcucuggguuccgacuccagcaccuuaauagcagcgagugggacauuugucuggauguuccccaugcuucuggcagaggucguuccuggucugggugauguaagcacugugcagccucgagggccagccucugggaagcagcaagaccaccacaguuguuccgugccucucuuccugcccucccucugcuccagcucuucaugaacgucgccaucuuugaggacgagguguuugguggcaucuccacacaccaggagcucuucccucacagccugcugagcgugaucgccaacuucauccccuucucggaucacaaccagaguccucggaacauguaccagugccagauggguaaggugggcggggugagggucggcacaugagagcacagaaagcacuuguaaauuacauugaggugauuucagacuuacaguaagcuucaagaauacuacgaagaaugcccacagaugagacgucuguucuguuaccagcuugcccaguugcuuuuucaagcgugguggugcccuccuccacaguucagugcgugucccccacuguuaggacuuucuuaggauauuuaucagaauuaggaaguuuagcauuaacuggguuuuuuuuuuaagauuuauuuauuuuauguaaaugaguacacguagcugucuuaagacgcaucagaagaggacuuccggaucccauuagagacggcugugagccaccaugugguugcugggaauugaacucaggaccuuuggaagagcagucagugcucucaaccucugagccaucucuccagucccuagcauugacuuccuuauuuuaaaaaaaaaaucuuacuuuaaauuacacuuauguguccacaaguggguacuguguguagaugcaggugucugcagaggccaggggcauugagugccucuggugcuggaguuagucaguugugauccuggcguggguacuggagacugagugcaagagcagcaugcacucaauguuuucauccuuacucacuuugaaguggggugaagcaccaaaggcccauggccagucaccuguguucuacuagugugucucccuugaugcagaggaacucuucaguuuguuugugacauuuacauuuuuaaagaaaauggcuugucugagcuuuugugacuuaggccauuauagucaaaucacguaccuucucuacucuucauuucgucugagucacgcucugagcauuugacauucucauggccuuccuugagcuggucuugaaucaguauccuuuggccucugucugucgucacaggauuacagguguacaugucccacaucacguccugcauccuugugacagauuuguuguuuacugcauggguaugugacuacagauccucuuguccuuauucugagaugucuuuuucacacucaccugaaggaaaucuuugcuggcuguauagugcugaguggacauauucuuuuauuucaguguugcuuuagucuguugugucuaacuagaaggcagggcuuguaaaguacaguuucccuguccaguguacuguuuuuucucucuuuaagacuuauucuuaagcuggacgagauggugcacaccuuuaauccuagcaguugggaggcagaagcaggcagaucuuugaauuugaagccagccuggucuacagagugaaucccaggacagcuaggacuauacagagaaacuuugucucaaaaauauaaaauaaaaagacuuguacuuuauuuuuguuuucagauugacuguaugucuaaacaugauucuuuuuguguuccaauagcauuuacuggucuuuaugagaaaaaaaagugaucaacuuuggagcauuuucaagggcuuccaaacuugcuucuuccucuuuauuucuccuccucuuuaaagacuugcguuuucauaaaagucccugugguuauucaccuugcugugugugcagguuauguguguggguguacacgcuguggcaugaugguggaggucagagggcagcauaaggguggaggucggagggcagcaugaggguggaggucagagggcagcaugaggguggaggucggagggcagcauaaggguggaggucagagggcagcauaaggguggaggucagagggcagcaugaggguggaggucagagggcagcaugaggguggaggucagagggcagcaugaggguggaggucagagggcagcucuguggaguagucucucuuccugacuuuaugcugguucuggggccugaacucagguugucuuucagucuaggccuucugcuggguggguuguuuguuggguuguuuguucuugcuaccaguuuaugcguuccagguauuuguucuguauucacuaagguauauuuuccugugucuguugagcuugauauagcgggugcuguaaagcuacuguuccagcaucagggcguccugggguugcuauccauugacuguaguguuucuugagugaguuauguuugcuguugugucuccaguaauuacugugucagcucuuagcacugaugggccucucugcaugggcuguugcagucuugacugcuguuuaacuagguucuuagucucaguuaagcuacuuggcucagucucaugcaucaugagccauucaguucccaccaaaggucuaaacucaacaugugugcagaguaaaggcucuucuugggugguccccacuuuuuuuucuaaaugccucuuacuuuccaguagcugccaugcugugaauucuguucccugauucuucaaaacaguaaaccacggggguuucuaaaauaauuaaaaacugauuuuuuauuuuuauuuauuuuuuuuuacuaaagugauugcuuuguuucaaauauaauuccucucaguuucugacuacuucagcaaaccccaguccuuaggcaguaagugggcaggccagccgacaaaagcggccuaauggaguguccuggugcucugugcugugaagaggcaccgugaccaaggcaacuccuacaaaagaaagcauuuaauuggguccagcuucaguuucagagauuugguccauuaucaacgggguaggaagcacagugccccacaggcagauacgggacgggagaaguaucaguguacaucggauccgcaggccgagugaacaagcagagccaguggaccugcacccccagugacacacuucuuccaacaaggccacgaccaccccagcccuagucccucuccagccguaccgcuucuguaccgcuucuaaugacuacgcauucaaacaugugagccauggggccauucucauccaaaccaccacacggaggggggccugguuuggcuuccuguaccagggagugcagucuguccuggcaggaggugcaggggcagcuggccacacagcauccgcagacugcacucaguuugcuuucuccucuguauucaguccaggagcccagucuguguuuguucaccucaccuagauaaucccauacagacacguucacagauuuguuucuauguaauuucuauaucuaguccaggucacauuucuguacacauuuuugguuuuaaaucaucuugcucugaaaggauuccuuguaaagggauucacagauguacucaccuguccccagacuucacaaauacugacauuucuguguuugcauccacacaagucccacacuugucaauauccucuguggcuuucaguguuuccauugaauauaaaagauaguguugcuagcuguguguuacaagugucuaugaguguauguacauuaaaugcaguucuuccuagccuguucucucauagucuaggcgugaugauguucuuggguucuugguucuuuuuuuuguuuguuuguuuguuuugguuuuuuuuuuuuuugguuuuucaagacaagguuucucuguauagcccugcuggcuguccugaaacucacuuuguaaaucaggcuggccucaaacccagaaaucugccugccucucucugccuuuccaagugcugggauuaaaggugguccaccaccaccacggcgacgaucuugguucuuuuuuuuuaacguauuuucuugguucuuaaagcuaauguuagucugauaagcagagccgccaugcuuaauuuauucguucugugguguguauuuaguucuuugcaguuuuaggaagcacauugagaauugaggauugaaaacaagauauaaaaacuuuuuuuuuuuuuuuuuuuuuuuuuuuuuuuuuuuguagguaagcagaccaugggcuuuccgcugcucacuuaccaaaaccgaucagauaauaaacucuaucgacuccaaaccccucagagcccucuagugagaccgugcauguaugauuucuaugacauggacaacuauccgaucgggacaaacgccauuguagcugugaucuccuacacuggcuaugauauggaggacgccauggugaguauucuaguuguaacucugcaauccuuuuccauugcuguuugugaacuuucuuacugugagaucacugaaggaauguuuguguguccucacggccguaauacauuuguucuuuaaaugguuaauuccugcucugagacgaauggagggaaacauugaaaaauagccaguguguauaucuuccauauccguggacacacuauggguaaagauugauuugagguuuuggcauuuucacccuuuauguuuaucuuugauuacaucuuaagccauuuaugagucuggggcuugauagcguugguaauuuagaaauguaguuucaaaaucaauugcugguuacuucaaaccaaauauuagugcagccguaacugguugguuauauucugagagucuuugcuugcucccagucucauacguuaacuggacucuuugacuccacagauugucaacaaggcuuccugggaacgaggcuucgcucauggaagcgucuacaagucugaguucauagaccucucagagaaguuuaagcagggagaggauaaccugguguucggggucaagccuggugacccucgggugaugcagaagcuggacgaugauggguugccauucauaggcgcaaagcuggaguauggcgacccuuacuacagcuaccucaaccuuaacacuggggaaggcuucgugguuuacuacaaguaagucuggggacauguuggacugcugguugguuagcuaguggaaaauuguaucacugggaaccugauuggucaggaggacacuguguugaccagccuggcccugauauaaugagugaugccccugccucuuaagugacgggaguauaggccuaugcugccacacuugccuucugugcugguuuuuagggcuguuucuuaguaaaacuacuggaggucaaugaaguugucuucaaacagaaggaaaaaauauagguaguaaucuaguuauuguuuuuaaucucugcugugcuaaaaaagucagacuggaaauggaaaaaaaacucucuguucuaaggucuagggcauucaggguucaggcacugacggguucacuaaggugauugucugguggcccugccuuaguguccucacauggggaagaugggaaggcagaugaagggaacagcucagaccccuucugugaaacccuguccauuaaugaggcucccucuucaggacuuaaaucuguccuuggguuggagagauggcucagcgguuaagaacacugacugcucuuccagagguccugaguucaaaucccagcaaccacaugguggcucacaaccaucugcagugugauccgaugcccucuucuggugugucugaagacagcgacaguguacucauacacauuaaauaaauaaauaaauccauccuaaagaccugacuccugacaccccagcagcagaggugggguugggcgugacccgguggugaacacagaugggugaugucauucauggucauugcagaagugagcacugugcuguguuggugucuugcuuuugucguagcuuucuaaggucauuuccuucaaacaugcagcuagggguguuuccuagccaaaauacuggguucuucggccucuccuuaaaagaugaaugauugacguugcugcuuuacagggauggcuucaguggaccugccuaggaguuuuucauuugcuaaucuucucucagauaagcguaauuaggacuccuagccagcaucuauuuauauugcugagcagauggggaugcaguuuacacucuuuauaaacauuaaucauguugacagggcuuggcuaggcucugugucacaugccucuguuccuagcacaugggagacagaggcagggggaucacugcaaguucuaggucagccagggcuagagacucagcaaacagaacaaacugcuugacuucuuauuucaugcauuuucuuguaggaguaaagaaaacuguguuguggacaacaucaaaguguguaguaacgacaugggcagugggaaguucaaguguaucugcaucacaguccgcaucccccggaacccaaccauuggagauaaguuugccagccgacauggucagaagggcauuuugagcagauuguggccagccgaggacaugccuuucacugagaguggcaugaugccggacauucuguuuaauccucacggguuucccucccguaugaccauagguauguuaaucgagagcauggcugggaagucugcagcuuugcacggucucugccaugaugcuacacccuucaucuucuccgaggagaacucugccuuagaguacuuuggugagauguuaaaggcugcuggcuacaacuucuacggcaccgagagacuguauaguggcaucagugggauggagcuggaggcugacaucuucauuggugugguuuauuaccagcgcuuacgacacauggugucagacaaauuucaagucagaacaacuggagccagggacaaagucaccaaccagccccucgggggacgaaauguucaggguggaauccgcuuuggggagauggagcgggaugcucuguuggcacacgguacgucuuuccuucuucaugaccggcuuuucaacugcucugaccguucugucgcucacauguguguagaguguggcaguuugcuuucuccgcuacuugagaagccuccuccgucuuggucugcgaugcgcaacagaaaguacaacugcacugucuguggccgcagugacaccaucgacaccgucucugugccguaugucuuccgguacuuuguagcugagcuggcagccaugaacaucaaagugaaacuggaugucaucugacuugauccccgccaucugagcuaggagauaagaacaggagguguccuguauaacacaagugaggguauuaugggcucacucugggucuauacaagaauuucaguacugaagccaagaacaggcaggugaaaauucaagacuucugagucucuguaaccuacugaaguugguuuucauaucuuuuucaagacaggguuucucuguguagcccuggcuguccuggaacucacuuuguagaccaggcuggucucaaacucagaaauccaccugccucugccuccugagugcugggauuaaaggcgugcgccaccacgcccagccucauaucuuuuuuuaaaaaaguuauuuuugugccuuuaaaaaaugacuuaauugauaauagaucaugcagggcagggcgccuucuuucugggcccagguucacugcucccugcuuucaguagcagagggugucuguuauccagagcaggccaguacaauaaacagaaaauggaagccauaugugugauuuuuauuuuuauauacauagaaacuaaagcuaguucauguauauaauuugauggguaaauuggaauguagguguggucugugaugucauuaucacagucaaggugaguaacuagaucuguuggucaguguugagugcugcag

SEQ ID NO: 1077 - RNA, 4439 nt, Mus musculus
agccaugaagguuggaccaaugugggaugaguggcagggacgcucgacgaccggaagagugaggccaggaggucuggguugggcgccgccauaacaaccugauaccggaaaaggcgggucucuucucccugacugaucggcgcuugaauucgccuggagaugugaguuacaacucccuauaacucuagaucaugcuugucagacugcacgguccccaacgggaaaugacugaauucaagacuccaggccugcuucacaauagccagacuuuuugucuuaggacuuccacgaucucccgggaaaucccaccuuguuccacaacgcgcagggaucggcgcuuauuucugccccucguugguugucccuaucacaggaucuuuacaccccccacccccaauccagacuaguccaaucacagaucaaaaucagaacucuuucuugccuucucuugagauuaucuucaguuuacccugucccacaggcaggcagcccuggaagucacugcucgauacugcagccgagagcuggaucaguauggccaauguguggcagccaagccagagucguggcaucgagauugucaccaccuuaagaugagcauugcucgcugcacguccucccagugaguguacaacugggggcuagagggugccaggcaguaggguuugaaugcuucagggucuaaaaugcccuaccccccacagcccgaucauccgccagauccgccaggccugugcugagcccuuugaagccuuugagaagugucuucgcuugaaugaggcagcagugggcaacugugcugaacacaugcgccgcuuccugcagugugcagagcaggugcagccaccaaguucacccacaacuggagagguaaaggaggcuaacuugaucguagcuuuuuccuuucacaacucccuucauuuucuaguuuaaauaccuuccagaaccagucccagccccauucccauacauggccuuggcuaugcauccaagaaucuaaaaaccaugguucucuguccccgaguggacaugccucugcuugucaccaccuuucacacuccccucugccagggcaccugccccagccuuuccccggcuugccagacccucuguguuccauauaaugaccuggauucuaguaaugauaaucccuugcuuaaaacucucugguggccaccaauucacacuggaacaaagucccugauucuuacuggauccuguguucuuccuuuccucagccacuguguccccuucacuacuuuccagcugugcugguaggggugagggggugagguggaggggugcacagaaaaggaucuugcuaauguauacaauacauaaauacauauacaauaugucugaaauacuaaacuguuauugauguagccauuaggaaaaagucuuuaaaauguucuggauuuggcagaaauggaggaaagcgugagaaacccucccucccuugcugcucuugcuggaucucuccaagggaaaguucacaccuucgaccgcccucaucugagcaccucugggcucucugucccugcagcucugccuuuucuuucucgccuucuuuugggcuaguguguuggcucaucuuguccuuuccaguccuuaugugauggucucagaauggacucagaggacaucuuagcauguuggcuucugcauagaaagcucuuugugguuucuguucuaccagaccagcucucaccccagugcagccugcaucccgggugaccuggucccaccucuccacucuccaccucaaacuccauacuccauccucaguggacaaauguacgggugcucaggagcauagcugcuuugcuuauccaucuccugucuaauucuuauucuguguacaggauaugucuccccaaaagcuuccucuguccccccauuccugcucccuggcucuuaagcucuaucagcucccugcaucccgggccacacccuaucauuucccuuagaucucaugcuucaggagaguucuuggcuagagguuaaccucuuauuauaucugauauucauugacuuuuuguuugguuuaguuugguuugguuugguuugguuuuguauagaacagggguagacgaaagauuuagguuaugggagcagaaacugcccagaaggacuuuuaauucuccacaggaaaugcucagggaugguugcauauuguuuauacuaauuacuuagccaucucauaggaacauuuauuucuuucaagugucuuuggcaucuggacauuaaagcucuuauauuccuuuguuuuuaacuuuaguuuuuuauuuuucauuuuauguguaucaguguuuuuccugcacguauguggacugugugugugugugugugugugugugugugugugugugugugauguccauggaggucaggagggggcuucagaucccugagaguccccugggguuagaguuucugugggugguugugagccaccauccgggugcugggaacugaacccagguucucugcagaaggagcgagugcugagcaaucucuugggccccucuuccuucaagguugucuuccuaggcaagaagcuguucucuucuccgucuccugcgaccccacaguuccucuucccugcaacugaaauugcuuuugaaaauggaaauuagggcagggagguggcuuggcaaguaaagacauuugcugccgaguuugauaaccugaguucuaucaccgacuccugcaagguugcccucugcugggcaugcacaucuccacgcaagcauccccaucauaaauuaguaaauguaagaguuaaaaacagaauggaaaguagggucuccugucuccucuccugcuccaggcucucuagggcaccgggaagggcaaacaccaauuucuccaccguccuguuucuucaugccuaugacaucacaaugcuggcuuuuccuucuaauuggggacaaugagauguaggccuccucuguuuucugaucuucacaugaaaaugcccucagcuaccaugugacaugaaagccuucauggacgagcucgugguucuguugcugacagucuggaagcucccuguucccgcacagacuaacgcucuuugccuuggugcauaggauuuccuaccagcugacuaguuaguugucuucuuugcaugucucucccuccucuuuugaaaggaaguucucuagagugagagauguuuacccacuggguccccugcaccuguaacaaugcuggcacaagccugauuccuagcacuuggaggcugaacuaggaagauugccugaguuccauuaagugaguuauagaucagccugggguacuggugaguucuaaacuacccugggcuagaguuaagaacccugucucuuguccuccaaaaaacaaaaaacaaaacaaaacaaacaaacaaaaaaaaaaaaaaacaagaacaguaccuuccagcuccauguuucaauuauccuggucaaauuguucucauggcaaguggccaaggccaccacuuggcaccuuuucccuccagacacccgcuguguuaccucauuuccccgucagaggucucaaggccaguaacugcggauauguuuucuccacaggcacagccccugccugccuccugacaaccccuuggacuuugagaaaaccgacaugauugaccgucccacuugauguccucgccuagaagagugacaagaguuuuggagucuugagggcccugcugugugucuggcgcuccuggacaucaggacacuaaauaaauaaagacugaguacugggcucugauuccagccuucaguauugaaagggagaagagcgaugagagaaagcuuacucauccaucccccggcuuuccuuggucugccaagugagcgcucaggaggggccugggugcucuuguucuaggcucaggaguaggaugacucagccagcccucccuggcccugcugucuguguguuggagguaggcuucccucccacucguagucaaccagauaaauguguaagucuaggcaguccugaagcucacuacguagaccucgauggauucagauucaacagccgucuccugagugccagggcucuaggugugaaccacaaugcccagcuuuccacacacaugccagugggcuaugccccgccuaccauuagugcccacagccuacauucacuacaccguaacacuguucucuugagacguggcagaggagcaauaaauagcacauuucuuccacugcugaauuagaaccaguugagcaguagacauggacuuugggcaguggacauaaaaauacugaucuuauugaaaacagcagugcggagacagaagcagggaucaaaaggucaaggucguccuuugcugcaugguuugaggccagacugggccaccugaggccccuucucguuaaauaaacauuaaaaauugaaagccggaaagcuauggcuuggagaccuccucc

SEQ ID NO: 1078 - RNA, 2706 nt, Mus musculus
guuuuuuucucuuuuaauaagggguuuuacucaaaaggguagcuuugaaaaucucuagcuuguugugaaccagaaagccaggggccaccucauccugacaccacuggagucaguguaccucugaaacaaagccacugugaaaaacgaggaggacucgaguccuacuuugauuuaaggaaaaggacaaguuuuuaauacagcaaaacagaacacaaaaaguaaacaaauccuuagaaaucacuagauauauguguguguuuauauaauuaggaucaucaucaacauuuuaagccauuaaaaaucagguugccaccucaccuuuucuuuugguacuggggauauucuuauuaagaaauccagccucuauuucaauggccuagcccagcuuucucuccacugugccucaucuccaccauccacuccagaguccagccucaacucugcagccagaggcagagccagcacucauucuggagugaggacagcaggccugcgagcauagcugagcacggaccucacccuuuccuggaggagcagcaagugcccacagcuggucugcagucguucaagggugccuccucuccucuccgcugcuauucacuacuuuuuucugccuaaaagcaagauggcaaucuuaaucaaauagggaagcuagaucuuuaaaauaacuuaaaaaucacuuuuauauaaagcagcaaaaacauaucuuccucucugcgauaagaaaaauguuaacaaggaacauggugauguggugggcuguacaaaacuucugcucgacuggaucccaugagcaucucaaaaucgcuccuucaccuuggccaugcugccugaagacucuucuccagucacguuuucacuuucuucugggcuuaagcuuucauuuucagaccuggucccauuagggaucaaguuuuccccauugacaagcccauuuucagcagccuugacuuugcugacagucucugugaggcucagagacuccugcacaccugccuccuccuccaacuuucucaggaccagagggagccuugagucccccacaccacccuccaagagccccaggucacucuccucguaucucugcgguggugcccucuccuccauguguuuacgguaguacucccaguucgcggccgcacucuucacugcuuuuuccaaaaucuccuuuucacccaagcacaauuugauggccauuguggcccggacagagaggucaggauuuuucaagacgaucuuaucuuccucaauuguugucuuauauguuuuuaaaagaagugaggcucuaucuuccagaaauguccaaaguuugaccucauugucccagcugacaggaaacucugcguuccccagagugaagaucuugucaauggcgcuguccccuagcaaaugcucuuucagcuccucuucagucaugcagaauacucggagaaaagcuagaagcugggcagagauggguggcucaguaaaaugcaaugcaaaaacacuggauguugggaugccagcccgagccaggaccucagccuucauggcgcagagccugucacuuuuauucacccccagcuuaauuuucacucugucgugggaauuauugucaaagaaaaaaaccacuguggaucacaaacucugcauuugaccgagugccauaaaaaauguaaaucugaucuccagccugaaaguccugcagagccacacacucacagcggucaucuuccagguuauagccaguugugaucaggccauugguaggauugcacaugucccauaaaggaaucagagccaaggaucccccccccccaccccgaaccauccucuguaggaauuugguuuugccgugucauaacugaugagacggcccaccuguaguccucguaagugaaagacuccuucaagggcaguuuguuggcaugggucuggaugacuuuauagaaauaggcguacuggcgugcuguguuuuuauacuggcugaagacaucauggauggcuuguguugacugaagacacauuccucuucuucuucgaaguagagaggggugucauauucacuggggagggucugaauguauggcugccagaaagaguuggggcuggcucgcucgcacagcagaugaaaggccagugcaauguuucccauagcuuggagaauucggucuugggaauacaggggccccaauacugaauucuuagcagauucaacagucauuaguaacuuucguggaacccauaaaaauaauucuucugccuugaugucucuuguugcucucaaaccaaagcccucuucuuugaaguuaaccauuucaaaacccucgacagacgccccguuuucagaggcccauuucauuagaucagggaaguaaucuucucuuuucccaucaaaaguaacagacagaccuuuuuauuucuuccguauuuucucaaccagagccuggaucugcguguacucuucccauucuuucccugggccgggugcaggacugcuacauuucugcaacaggucacuugucagguucaaaauuuccuuuggugacacaguggcuguagccccaguaccugauuucugaguuuucacucgacucuucuuacccauuuucuaacugcccgcuucuucuccgcgcagcggcggugccacacucuggcagggaccccaccguccgccucaaccaacccccagguggcggcggcgguggcugcagcagcggcggccca

SEQ ID NO: 1079 - RNA, 1043 nt, Mus musculus
uaaggcccauccagguacaagagcagaauccagagccagguuugccagaugugaaggcaucacugugguucagggagaguauaguauuuugagacuuggcuuuaugcuacuuuaguauccauguauuuucaggcagagacagauuucucugucucuagagaguccuuacugucuugaaaucaaggaggggggaugugaugguuggucagaugguuuuagauugucuuguuuuuuguuugucuuuuguuuuuguuuuuguuuuuugagauagggugucacuguguagcugucugguuguccgggaacuuacuguguaaaucaggcuagccucgaaaucacagagaucccccugccucugccucccaagugcugggauuaaauucaugcacuucuauacuugguuaccaguuuuaauauucaacuugacccacucuagaaucaccuaggaagagagucuuggugaaggcuugucuagauaggucggccugugagcaggucuguaguggacugucucaguguggaacgcugaagucugaaaguauguggcaccuuuuccugguaucauaguuaggguuucuuugcuauggugaaacaccaugaccaaaaaggaagcuggggaggaaaggccuuauuuggcuuauacuuccauguuguuuuucaucauuuaaggaagucaggagaggaacucaaacaaggacaggaaccuggaagcaggagcugaugcagaggucauggaggucugcuguuuacuggcuuacucagccaguugucuuauagaacccagaccaccagcccagugaugucuccacacacaaugggcugggcccucccccaucaaucccuaauuaagaaaauucuuuuuggccuacagagauggcucagcgguuaagagcacugacugcucuuccagaggugcugaguucaauucccagcaaacacauaguggcucacaaccaucuguaaugggacccgaugcccucuucuggugugucugaagacagcgaaguguacuccuguacauaaaauaaauaaauaaaucuuua

SEQ ID NO: 1080 - RNA, 1945 nt, Mus musculus
aaagaccauucccgcgcgcgccugccgaggaccgccgaaaaggcccgcggaagggcgcggcgugcguggggaggcgggaggaggacagcagcguagcgggguccugcagccugcaucccacccccgccagccagcuccccacacccgagcccacuccagagaagaaaggaccuuugcaccaccggugccgcgccgccacucaccaaaggaaacugagggccgaacagagagaccagaagaacgagacugaggcaggcucgagccacggucgcacaacccaggacggcaacaccgggcacagcacggagggacucucuacccacucgugaagcagccgcgggcgccucagcaggcgagaggugaaaacacgcaacgcgcgccggcggccaucauauagagagcaugccgccggcuccuauuuauagccgguucugcgccccacgugaccugccgagccucgcgcccgcccgaggucccgccuccgaugugacgcaaccacaggcuggucgggcgcgccuagccgggugagcugggcagcggcgcugauuggccuggacguccccggggccccgcccccaacgaggagcugguccacgugggacuggcuggccgccucccugcagccucgcccggguuauccugucugcgcuggccacgccggguggcugcgggcggggacugugggggagucucgcccagacacgcggggacugaggccgccaccaaggucguuccgaguuucucccacgcgggcccgggucagcucgguggcgacgcggaagagcgggugugcugagacuugcccuuggccggacccgaucuguaccucgcccggagaggguggagggaucucacguggccaccucgcucccgcagucacgcacuugugugaaaacggaaagauucgggagucacgaggauaggcuugcguucccagcuguggcacugcgcugagggagagccaugggucauuaguuucccggcgccggaccuccguuuuaggagccccggcuauggcgcagcggggaggauguuacuuuggauucgaauucuuaacucauauuugcugcagugugucaccuugaacaaacccuaggucuccucaagccgagugcucuggaacgagaaauaauagcagagugagagagacuggaggacggguuggaauuguguguaaagcacaacaaagaugcauuuccugucagcucaucggggcuaguggcgacaggcaguacuaauucagguauucugguuacaaguucuuacccaguaaggagaaucauauuagcuaagauauaagcaugugacuggaacucaauagauguucaggaaaugaaccuucauuuccucguuacuuuuuuuuuugaaugugccuguuuuagaauauaggaaaagguuacagaggauguccucauccugaaaguuuucccauccccuuuugaaauaaagauugcuuccugguccccuacaugguauaagguuguaguucugacaauggauuaguucguuuuauugccuaagcucagaacuaacuagucaccacuccuugggagauuuaaguuauguggguuauaaagaaacuuaagaauuccagccagaaauacccgguuuagaacgcucuaaaacgcucucugcucuccaaagguagggcaacgaauagcagaaacaaacauguuguaaauuauaacuucacaggaguguccugugaccuauaauuugguagacucagaaucucguauagguuauacaggucuauugaccucaaggucauggcuggaaaacaaccuucauguuccaggacacugaccccaguguguaauucuggcaucuucaaaugcaacacucuuugcccuuacuucuuuccaaggucauaaaacauugaauaaaaggacugguuuguuaaaagguuguuaguguccugccaauuaaaacaauuuuugaagua

SEQ ID NO: 1081 - RNA, 12856 nt, Mus musculus
aaauuuuucuaaaaacuguaggcuuuuuauucaguuaagagguagacagaugaacauggaaggcugucccauugaauuugcccaaaguucacauuccacuucauucacccaucccacacugccagaaaucucagaagaauaaccacaaccgccagggggcuuugucucccugcuucuuagcaacauguccgugaacuguuugcaaagagguuacuacaaacuuauauuuccacugugccaaagauucucggcccucuaagaaguugucacacaucaacagaaccugccacuagugacagggagcagagugccgugacuauuucuaugagagacuaugagggagggaagcuucaguuacauguuguuaaaucccugugcauguuggggaagaagcuggugaggccgacaaagcaguacaugccaucaaauggcucugccuggcuguuuaaaaagaacccaccuaaguuaucucacagacaacauuaaaacauacuggaauugaggccugauacaaaaguagagaaauauguacaggaauucauagcccaggagaaaagggaccuuggaaugaaucaauggaaaccuggcuauuuuacauagcuaauuuugagauaagucauauuuagcacaaaagcaauuauaguguaaauuacacuuccuucccacggcuccuuuaagacccuugccugucuucagcaacacugugagcguucuccuaggaacaggaauguguacaauggucccagacacugacacagcuuucaaccccagcgucacacuggcaggaugauguacuugaauacugccaugauagcggcacugauaaccccagagauggggaccgugacaaaccaggccauaaaaauguuucgaaacagucgccagucaacagccuucuuugaucggagccagccaacagacacaacagagcccaccuaggagagaaacagaccagacauuacucagcaaaaagacacuugggacagggaacccagacaagcgaugaacccagcaguuugucuggaaaaaagacacaguuguucucacugucaucuaaacaggauugaacuugugauccuccuacuucagaaucccaagaggugaaauuacaggcaugugacacaagccagaagcuaacuucuaacaagcuaaaauuacccauggcaaggugaagaaaagcgauauaaauauucagccauuagaucuguugcuaaaugugcuaaaauaugacaaaacuccuuuucccugcuuuguguaagcuaaauuucugauuucucaacaaucacucuagagggcggcugguaugugacccaacaccaccccagcagagagagugacuuggcaggcccuagccuggaccagauucagcucuuccaaggaagucaguuuguucuuuauccaauaacuauguuauacguucaccaagcaacuuccuaaaguucaaugucucagcacgacaggcccaagaggcccugucuauaugcuuucaccaagagacugcccuuacaaauaagccucacaaacuuguuaaaaccaguguauuuacuaccacaaguaguaggaccccacccccaccccccaccccccagauccaccugaaccauggacauccccaagcuacugaucggcuucaagggcccaugacgucccgacuccacuuacuuugcaauguguugugcugaugggaaggccaauguuugaugcgaugaccacaguuaaggcagacgccaguucaauacugaaaccacuguugauacaaagggauguuugucaacaauggagagucuucugagaaaccaacacuagcuaaagccaucaguucuaaucucucuuuguucuacucagugacaaagccuggucaucuccucuaaccccaaaaaccuacuuaaauugagccaagguccuaacaucugaggauuaaguauuucuggaaugauuuauuuaaaagcuggaguaugcccagugacacaugccuuuaaugcuaagacuuggaaagcagaggcagaugaauucugagaucagggccaguuugcucuacauagugaauuccaggccagccaagacagagacccugucucaaaaagcaaacaaagauguuggaacuuuuauucugaauaaaguauaaggucuuagcucccaaaucaaagccauguauauaauuauuuacuccacuauaucuuucucagaaaauuuaaauuacaugaucacuagagcugagcagacugacugauuuacaagucagacaguaagugcagcagaaacguucagaucaacugagagaagaacagcagcagcugccauacacuccuuuagcuggagacccgcgugcugcccuccacacaacuccaucuccugaaaagcuugagcucuaccgagggcgggauucacuacucaccuggagggugugauuggggucagguccuuccccauggucuggauaacucuucuuccccaaacccacaggcccaugcaaaugccaacaccaccauaaagcagaagccauauggguguugccgcuuuuguagaggcuucuuguuuauaaacaagauacaaagcaaccagagggccgauggcauugcuggaagaaaaaagggggcaccgaugacuuuuuaggcagaaccacuucuugucgagacccaaucuguuaagugacugaccacugcacuuagcaaaccauccuacagaagccaaacacagcggcuaugacagaaggcacauacauguaacugguagucucguuccucucacguguagcuuagagcaagucucaggcuccaaugaagcuuucuggccagagaaacaaggcuaauaaccccuuaagucuauucucagggcuguccgugauccuaaguuuuucaucacugaagucccaauuuaccaaagucucauucucaucuguuuaucuugucuagaaauaaagcuaaaaaaccacucuuacaauccaagugaacuuccuguugcuuuauuacuaccacuucaucccgucuagauuacucaguguccccccagaaguagagcaguacacacaggaggguaagacugucuaaaaauaguaacacuaagagucauguggacuaaccugacgucauugccaccaugggcaaaugacccaaagcaggcuguaaggaucugcaggaacuggaagagaagggacacuucaggcuuauccuggucauaccauucuucaagagagccacugcuuccuuuucugucacccaggcccaucucagccuucacacucauguccaucucagacucggagugaaggucagacacggcauugcaguaacugguguaacuguccauucgaauccgcuucuugguaucugcauuaggccaugucagcgucuccauuucaucucccuuuuguucaccuucuuuggcacggaaugaauccaggggcaugccacauauugccauaguguaggaaguguagcuguuguugcgucucaagggcuuguccccagaaucucccaugcagucucccaccuuggccagauguaacuuauggagcagcuccuuguacaagccagaauccuugugcacggugugauacugauaguggccacuggaguugaucugguugcugacaguuugacugaacugaacaagguucccauuaggcaacugcacugcaccuagccgagaccaaaaagguaacauucaaugcaaagugcaucagcccagaguagcagccuuuccaccaccacgagacacuggaaacccuggaaaguuaacucaccauugauggugcugucuaugcuggucuccuccuucagguccaugggaagccgcucucgcuccggagccuccuccaggucaccaaguuugaaugacaccguccucuccuccaccacagcccggaguggcccaguggcacacacuaccucagacacaggauuccuaugcucaacgucuccaggagccaucuuuguuucuucauggucuucuuuuaaguugcucuucuuuuccauuaagggacuuucagacggacuagacuuuacuucuccuaaaacauaaagaggauuugugauuugacgauacuaucuugcuccacauuccucucuauccaccccugaaacccuucucaaaauaacagguauaaauucuaguuaaaauucaagcuaacaucgcugcccucuuuauuauuugaggaauauaucuuccccuugaggaggagcaagacagcccagcccugcaguagcacacggucugcuugcagaaaugggggcugacaaacugcugucaacugccagguauuaaguauuuuaggguucugguccauugcuggcuuuuucuuuuuauaauuacaaguguaaaaccaucuucagcucuuggucaugaaaugggggcucaagcccugggguggcagcugacuaaacagucagccuuccuaaggaaucuccuaacucuuagguccugaguacagacaacugagcugcaaccggcaggcuuaaacacuugcauacccgggagccaggcaguauuucugccuaacggccagcucagcagucaccuacuggcucagacaccucacacuagcacagcauuaaagugagguuugucucuccuuccagacugagacaaaaaugaggucagaguccuggaagcuucauucccacugugcgugccgcacagcugacgagcacagagcucugggcggcuccucagaacugcaaugacgcagcauucuucuaaagccacugcagucuaugcauuccuguucugcuguguauccacaaaccaacauuccacacacugaaaggcagaaggggacucugcuaaacuaucuuaacgacugacuaaaacagacacaaagacuaguaccaaauaaaacuuacuugguauuaaauuauacugcaaaaacagccuucaaugacuuaagguuacuucuaagaguguuuacuucuucauguguuguuacagcucuagcacaaggauagugugcaaaagugugucugcauuacacaguguguauguguauagacacugucacacagccaucugaguaugcaaagguaccugaggcaaaugcuuccucuauccuaaaauagucugauagggagagagggggagagaggggaacagaggaguagagggagaggggaacgcuauuaaacuguauuacuuacguucaauuuuucucuucauccugggacauacaaagaaccagacgauaagggcacagaaaacugcacaucccaccgagaugaggaugguaccccacagaggaaguuugucaaagcccagcacuacgagauaaaauggugcaucuugaaaaccccagggcaacagcccccugcaacaauguguaaacccuccugaggggaaggagggcuuccccaagccagcccgucaccgucacccguuucagcugcugccauuccagaguuucaucaggcuacuggcuaugcagaccauggagaaaacgugaaugaacaucuuaaacccacagcaaccaaagccacugaaacacuugcuggacucaugugcuaacuuucuucaagaaucgcuacaguaaggaccuauaacuauaaaaccaaucacagcauccuuuucugcacucagcuccucauccuaacugccccacauuacauuuacauaugacuuauuuuaauaaagggagugucucaagucagugucacgcagacaccacacacuguaaaggaaaguuacuacacugacuguaccaggcagcucuugggggaacugcaucucuccacaaaagcaucaucaagcuaacagaaaauaggguuauuaacuacgggaagacacuugcuuaaauguugccuuucacacaggacaaguuuagugguaguucaguaacaaggcagagagaccuguccuccaguucuuuccccuuggcucaaugaccucaggaucagcaguacuggcaagugucagcuugcacacaggcaacagggacugcuggcguauccuagaguggagaccauucacagcacugaaucccaggccacugucugaaugucccuucccccagcaaagucacuugugcuugucucacuugauuuugcuuacugcauaguaagucacuuauaaaaugggaacauuacuguacugucaaaacuauuuaugucgggaccgcagcucagccuagcuugcacaaagccuuagauucaaucccuagcaccguaaaagagacagaauauacuaagaaguagccuuuaagaaucaaucagacauaagcugaaauccuucaguccugaaguucuuucuaucugccggucuuuucauuuuaaguucugcuuucaacugugacuaggcaguuauguccacaaaguaaaauauccaugaggucuaauuaguguuuaucaguuuaaguuugucuacauuccaagucaaaagggggaacgaaaggacuggguuuucuuagaaacaaucuuauagggcaaaaaaaaaaaaaaaaaaaaaagaagcaaggcccccccucccccacaccaaggcuggucccauccuguguuucuuuaaugacauuucaagaacgacaaugugagaaauacccugcuguuuuguuuuguucggugacuuacuacaucauuucagugguaauaauacacaggucacaauccaugaaccagaggcgggaccuacuuggcggucacaagcaugaaaauccuuuaagaauugaggaugagagcacacauaacauaaggacaaucacuuugcuacuucaguccuguuuacacagacacagugugcccugggcagcagucagaggaaugaguguagggacgccucggguccugcguaguuaagacccagcaagucacaugagcccagaugccacaaccgugcugcucugccucacgagcuccaaucuauccaucucucaguagacaacugaauccuugccuucccuuaguccccauaugaaagcaaucaacaccagagccuuuauauuccucucaagugcuuucuccuagcugcggacauucuucuuccaaguguaauuaauuagaccaggaguuacacaucccaacucuucucguucaagucaguuuaggggggcaaacugagaacuuuagaaaacgaaauggcuccaacugggagagaaaaaugacaucuaacaagcggcucuaaguggcugauuacugaagagcagauuuaacuaaugacucuucaguaguugaggccagcaucauuuccagcauuguuagcauagacacaagaaagggagggagaaggucauauuaucaguggauccugugaagacuaaggaggaaaggucuggagugauuuagaaugugagcaggucucucugguugaaaaccuaucuagguuaacucagcauacacuagccugcagccuucugaaauggaugcaggccagccaccuucuaggagauuucagcccuguaaagcaaaaagggguaaauugggcauuuaaugaaaguuuuguaaauaaccuaaaauucacauuuaagcaucuugauuuguacuuacacggugcuccaguauacauaauggaaaagagguugauuccgauugugcaggcauaaaaaauugguaaagcucguaagccauuaggaaccggaucugccuguaagacaugaagaucaguaccuuaaaaguuguaaauguagaucucuuucagagcacccuguggcaagacaaacuaggagucauggugcuagcaacagccucccaccauaauuucuacaaagccaacuggacucuguccuacauuugcuaccuaaggaagcuaaugccaccuaccaucauaggcaacaguuucucccuauucuuaguaacaaggauauaacuaauaucacaaauaaccaguuucucugaguuacccaaaguccaucuguaaaccugagcacaggccccccagggucuacuauacuggagaaaaacagacuaagguaaaaugcuuauuuccugauguccugccgccuuaaauuuaaaaaucugcagacuauacacaaccaucuuaucuauauauccgaucaaugugacagaaggcuuuaccaaagugcaaaguuaaaucaacugugaaccucgccaucgauccacucagucuagugcccgucaagaacuuuuuagggcacugaaauagagcaggggccauacuaaguccccguugucauagaacugaguaauuuucuacuacacaauaauagacugggcugacaaaugccuuaaaaggaaaaacaaaaacaggcaagaggauguugauggggagggacauuuuaauaaaaugugggaacgaaaucaguugagcugacauaugucucaggguauggaaaguuuaagccaccuguccacuggggggggggggaauggacagaggcauagcaaguacaaagacccccaaggcaaagcugugaaauguuuaagaaucaccaauggugggccggguguggucguucacgccuuuaaucccagcacucgggaggcagaggcagguggauuucugaauucaaggccagccuggucuacaaagugaguuccaggacagcagggcuauacagagaaacccuaucuugaaaacaaaacaaaacaaaaauccauuaauuuuaaguuuuacucauuguuuaggaggaugcuaacaguaagacaucagaucaaaagcaaccugacucacccugaaaaacuaaacagaugcagguuacaccuaaaggcagacaagagccugagguacacaagcuaauccaaggcuucaagaauauucuguaggcacuagguagggacucuuucaucaauuuucaaaugcuauuuauauuuaguaauuaaaccaucagguaaaaagcacucuacacucauuucccccgcuuggggccuaaaauucaauauucccugaaguaguagcauggucggggacaccguggacacaguguuauacaccuguggucggggacaccguggacaugguguuauacaccuguaauaccaguguuggcugaagcagaagaccaccggagucaaaggucaaccuaggcuacaaagacuuagucacaagauauauuugaaaucagaguacauagcuugggauagguagggaaugacuagccuuaauacacgaugauaaagacuuagugguuuaaaaccaaaacaaaccacaucauaacuucguaagagucaaggaaaaugguaaaauaggaaaggucucucccuuccagccuccucccaggucuucauagcuaggcuagggauuuuauuaaaugcuuuucucaucauguaaacucuuuaucuuuuauauauagugauaaagaugaaaaccaaauaugcacuaggucuuucugucaagucaacagacuugcaggaacuauucugggcucaauauaggaaggaaugagacaaagaaguuaaagcuuuaguuagaaaggaugugaaccucucacucaguuacauggagacaggaaaggaucccucaucuguuacugagggauuagugagcaagugagagacagaggggaagagccuccaagucagcacuguauuaaauaucauccaugacucuugaccaugccugucccacccauacucuuuaagcugggagugggagcacacaucaguaauucaagaacuugggaugugaaugcaggaggaucagaaguucaaggccagccugggcuacuugagacuguacagaauaauuauuaaacauacacaacuugauauuccaauaacacagugagaguaaagauacuuggcauaugucaaucagagguucugggcacugagaaccccccuuugcaucucuguucccccuugcaggaaugaccacuaaacaguuugcagaggcucuccagaaucagaaugaucgauuucccaauaaucaaaggggucagaauaaaccuuuaaaaaccaugaaaccaaauagcauccuauuaguuauucugguuuucugguaugucaagagaugcacagcucuaacagcaacacuaaaaacuaugauuccugaauccuggagaaucagauuacccuaugcuacagauaaggggggggggagggucaggggaacucauagcauaccugcuugcuagaugaaagaauaccauaucuagagguugcacaucaaugaacuauuuacucagucacacugugccaagcuagagauauuuauaaugcuccacacgugaaacacauucugccagacaccuaaugguaaguauaggaucaggaaggagucagggaaggacuucuauugagagaagucauuccccagagacuccgagaacuagaucaagaagcagggagucuaaacacacaccuuccauuaagauaagguaccuaucuccccucacucagauuucugcuguuuaggggaauuuuaaaagagcuuaacaaaggacuguuaagagccacucacccuagaaaauaggacaacucugucuccugagaaaaauucauuuauucuuacuguaauucagcccagagucaacaaaaucccuuguugucgacuuuuuuuuuuuuuguguggagccaggcucagucuccaugauaaaagaaauugcacuaagucucucaaaagggguuuucaaguagucaggaaacucaauggcuuccuguuuuuuuaaagcaaaaagaaaacaaaacaaccccccccccaacaacucaucccuacucuucuuacugagaaaguggagucccuacaaguagaaagccuccucuagaaacuucuauguacuugacaaucaacaugggagaggaauuuaaaaaggauucugugaccuguugaacuaaaagguuacaauuccacuuguccugaauguagugaccuagacagacagagccaccuuaaacaauguucuuaguuuucacucccagucucuuuauuucuuggcagaccauagaacuacucaaguuuuuccuuccugaaugcccucuggggcauuaaaaacuugcuucuuucacagaacuccacaacauacaggagguauacagaacaaagaacuuuuuagcuuuucaaagccacauacuuacauaccagucacaucugagaagaauaccagugaguuugaacaagacugaaugugacucaugaaaggucgcaaguagaaagguuaccuuacggaggaugaacgcacgaacaaggaagaauaaaauuccagacauaauaccagaaagcagcggagagacgaaccacgacaucacuggaauagaauacaaaaugaagugucaggucuggaaaguacguuuuuguuaacaagaccccgaaaugguaggugcuccauuucugauacucuucaacuugccccuccacuucacucccacuccacgacacacagcagcacacaacgaaaauaaaaccauuuaaaauucaacauaccaauuuuuaucaguucagaccacuugacacccuucugcccauuugccacaagggagaaaccaaugguugcaccgacaauacaaugggucccagaaaucggaagcuucaaaaacgaagccacgagcugccacacagcagaaccugaaacagaauuaaucagauuuugucagguagauggcaaaacuguuacauaagcagugcguccuugcggagagaagguucaagacuggagcgaacauaagguauaacuacaacuuaccaaacauagcacugacggagccagccaugagcagaucuugaguuucguuguacagcuccacaucuaucaagccguuccggaugguuucgcucacuuuggcccccagcaaggcggagcccacaguuucgaagaugcuagcuaagaugcaggcuugcuucagggucacuacaccugagccuacagcuguaccgaacgaauuugcuacaucauuggcucccacggagaaugccaagacaaaugcaaugaugaagcccaggaugagcauccauagauugucauacuucgguggagcggaagcaguaacagcagcuaggguacuaguaaucguugccacaguagauuccauucucuaguguagugguucuuuaaauaauaagagaauuacuaagcggcuuuugagauguguaaacggaaugagguaucaaaaugcuauaauaaauaguauauauuauauaaaauuaaauacuguaaacuacggcacggaaaccgagcuggggaguuacugcuauacgcugcugcgucugggcgucuguugucugggguuucuuuggcucuggagggcuaaaagcacggagcagaauuccauggcggauuagagaaaggacgcaaguucauccuggggggacgaaguggaagaaaauaacaauagcggcgcaucucugggaagagggcagccugggacuccgcauagucccccccccccccgcccgucacuuaugucuucagucccccaaacgcugugcaagguggggcacagggcgaucucugugcucccccaccccccaccccgucccgccccgccccgccccacgaguucuguucagucuccggccgcuugcccgcgcgcgcccuccguggaugaucggaaaaaagaccauucccgcgcgcgccugccgaggaccgccgaaaaggcccgcggaagggcgcggcgugcguggggaggcgggaggaggacagcagcguagcgggguccugcagccugcaucccacccccgccagccagcuccccacacccgagcccacuccagagaagaaaggaccuuugcaccaccggugccgcgccgccacucaccaaaggaaacugagggccgaacagagagaccagaagaacgagacugaggcaggcucgagccacggucgcacaacccaggacggcaacaccgggcacagcacggagggacucucuacccacucgugaagcagccgcgggcgccucagcaggcgagaggugaaaacacgcaacgcgcgccggcggccaucauauagagagcaugccgccggcuccuauuuauagccgguucu

SEQ ID NO: 1082 - RNA, 29005 nt, Mus musculus
ccagacgggcgcccgguucucguacuagaacaaggcgcgcccuuugaaggaagaaacugucgccguagagccaugguggggcccggccccacugccagcgcagccgcggguaaguguggucggcagccuccagaagcugccaggccucccccgccugcuucagucucccccgagcucaguuagguuaaggacgcuggacccgggccacggcgaggagcggcgcgcuccguugccgcagggggacaccccugcauugcuaguuauggccagaacuuugacagcagucagguggcagguucggccccaguccgagucucugcagguucacugauaaaaugugcgcugucuggagguugauugauaaacugugggcugaggcuuaaggaugcugugaacccuggccuccgagggaccuggagcccuuucuaccucuccaguaugccccucccccgugucaccuuugagaugcacacucuguccucacuuaugggccugcgguucugcgcaccguccuaggcacacaauuuguaacucaaggguuaaaaaaaaaagucuugauuccaaauccuggcuuugcugcacauuaguggguaaauuuaagccugucacuucaucugaguuucaaacagccaaauaccucauaggauugaugguuaguguaaacagcuuaguaaagagcuuggcaccaggcugauaccguugguauugaaagcaagcauaacaggacuggugacuuuaucaaagccaaaauagcuacagggaaguaucauauuuaaagauauaaaggguuuucuguaauguuuuugguguuugcucguguccauguuuuacagaagaacgguggcagaagcuccaggaguaccuggcagccaagggaaagcuaaaggaccccaacgccaagugaguuuaccuucccauaguuacacuggcuuuguugccccgguugcuaacagcaaugaacggaccagcccuucuguuuccagucuguuugacuugcaucauggugaauccuguaauaacaaaaggagcauuucaguccuugauuucaggcaugacuuaaaaaacaaaacaaaacaaaaaaccagcaaccccuaggcagugcugucuauuggcagaaauuuaagcauuuuuuuuccuaacagucuccaaaggaaggaaggcucuacacuacacuguuacccacaucucuggaagcucuucugguuccuucuuucuccugggaaaguugguucccagcagcgcagauuuugaucaagaaacuggagggcauuucuauggugugugcuuacgaagacaggagaguugguuauggucaguccacaacaguggcaugccagcguccucccaacuuguccuuugguguucccugggcauguauuugagguggacagaacauccuuugcuuuucucagcacuguaccaucuuugcccuguuauuucucucucuugcuuagcaggguguauuugccucccacuugaguagcucgguugguguguguaugccagagggggauuuugggugucuugcucuaacgcuguccaccuuauucccauaagaccggauugcucacugaacccgaagcucacugcuuagguuaagcaggcuggccagcacucucucucccaugauccacucaucccuguccccuagugccuaggguuagagggauacucaccgugccugauuuaauguggaugccggagaucuuccuagcccaggucauuuuaccuuggguuuuucucaccucuacuuccuggauuaaaugaaccaaaauuguuuucucaacauacccauaaugucucucuccucccucccucucugugucuccuuuucuucucacuccucuucuuccuuccccucuuccuacccuccccuguccugugaguggaacucagggccugucacaugcuagacaacaagcacucugccacugaccuacauuccccaggccuguccgucacuccuaaugcguaaagauacaggacuuacuaagcuagagacgugccugcccccucacgccuucucucguccaagucucuguuagacuugggaucugguccauggagauggaauccuucuaaacugagcucuguucuaucucuccuuuuguuucacuagcuagacuucaacuucagauuacguccucguagguaucagaauccccagauguuccaugaaauacaauaguguuuacguguaaccuaugcauacauauccuuauuauuauuauuauuauuggauauuuuauuuauuuacauuucaaauguuauccccuuucuucaccccccccuccagaaaugcccuaucccaucucuccuucuccugcuucuaugagggugugccccccacucacccacccacuccuagcuccccaccuucucauuccccuacacugggacaucaagccuuuacgggaccaagguccucuccucccguugaugccacauauacggcuggagccaugggacccuccauguggacucccugguuggugguuuagacccugggagcucugguugguugauauuauuguucuuccuauggaguuguaaacccccucaacuccuucaauccuuucucuaacuccuccauugaggaccccaugaucaguucagugguuggcugugagcauccaccucuguauaugucaggcucuggcagcuacaucaggcuccugucagcauaugcauauccuuuuauaaacuugaaaucaucucuaagcuacuuaugguucccacuacaauguaaaugccauggaaguagucuggcuuagagaauaaggaagaaaaucuacauauucaguaugaaugcaguuuuauuuuucauuuauaucuauauuuaauuuuuaauauuuaaaguauuuauacuguuauuauauaaauauuuaaauuaaauauuuauauuuuauuucuaugucuuuaucaaauguugguuaaaaauccuaaguguaauacccaugaucuagagaguugguuugguuagguuugguuuuuggguuguuuguuuguuuguuuuuguuuuguuuuguauuaauuagguauuuuccucauuuacauuuccaaugcuaucccaaaagucccccauacccucccccccaacuccccuacccacccacucccacuucuugacccuggcguuccccuguacuggggcauauaaaguuugcacaaccaaugggccucucuuuccacugauggccgacuaggccaucuucugauacauaugcagcuagagacacgagcuccgagggguacugguuaguucauauuguuguuccaccuauaggguugcagaucccuuuagcuccuuggguacuuucucuagcuccuccauugggagcccugugauccauccaauagcugacugugagcauccacuucuguguuugcuaggucccugcauagucucacaagagacagcuauaucaggguucuuucagcaaaaucuugcuaguguguacaauggugucagcguuuggaagcugauuaugggauggauccccagguauggcagucucuagauggucccuccuuucgucucagcuccaaaauuugucucuguaauuacuuccauggguguuuuguucccaauucuuagaaggggcaaaguguccacacuuuggucaucauucuucuugaguuucaugaguuucacaaauuguaucuuauaucuuggguauucuaaguaucugggcuaauauccacuuaucagugaguacauaucaugugaauucuuuugugauuggguuaccucacucaggaugaugcccuccagguccauccauuugccuaggaauaucauaaauucauucuuuuuaauagcugaguacuacuccauuguguaaauguaccacauuuucuguauccauuccucuguugaggggcaucuggguucuuuccagcuucuggcuauuauaaauaaggcugcuaugaacauaguggagcaugugucuuucuuaccaguuggaacaucuucuggauauaugcccaggagagguauugcgggauccuccgguaauacuauguccaauuuucugaggagacgccagacugauuuccagaguaguuguacaagcuugcaaucccaccaacaauggaggaguguuccucuuucuccacauccucgccagcaucugcugucaccugaauuuuuuaucuuagccauucugacuggugugagauggaaucucaggguuguuuugauuugcauuucccugaugauuaaggaugcugaacauuuuuucaggugcuucucagccauucgguauuccucaggugagaauucuuuguuuagcucugagccccauuuuugaaugggguuauuugauuuucuggaguccaccuucuugaguucuuuauauauauuggauauuaguccccuaucugauuuaggauaggaaaagauccuuucccaaucuguugguggccuuuuugucuuauugacggugucuuuugccuuacaaaagcuuugcaauuuuaugaggucccauuugucaauucucgaucuuacagcacaagucauugcuguucuauucaggaauuuuuccccugugcccauaucuucgaggcuuuuccccacuuucuccucuauaaguuucacugucucugguuuuauguggaguuccuugauucacuuagauuugaccuuuauacaaggagauaggaauggaucaauucgcauucuucuacaugauaaccaccaguugugccagcaccauuuguugaaaaugcugucuuuuuuuccccuggaugguuuuagcucccuugucaaagaucaagugaccauagguguguggguucauuucugggucuucaauucuauuccauugguuuacuugucugucgcuauaccaguaccacgcaguuuuuaucacaguugcucuguaguacagcuuuaggucaggcauggugauuccaccagagguucuuuuauccuugagaaggauugagaagaguuuuugcuauccuagguuuuuuguuauuccagaugaauuugcagauuguguuaucuaauuuguugaagaauugaguuggaauguugauggagaauugcacugaaucuguagauugcuuuuggcaagauagccauuuuuacuauauugauccugccaauccaugagcaugggagaucuuuccaucuucugagaucuucuuuaauuucuuucuucagagacuugaaauucuuaucauacagaucuuucacuuccuuaguuagagucacgccaagguauuuuauauuauuugugacuauugagaaagguguugucucccuaauuucuuucucagccuguuuauccuuuguguagagaaaggccauugacuuguuugaguuaauuuuauauccagcuacuuuaucaaagcuguuuaucagguuuaggaguucucugguggaauuuuuagggucacuuauagauacuauuauuuuaucguuuuauuuuucauuuauaucuauauuuaauuuuuaauauuuaaaauauuuauauuguuauauaaauauuuaaauuaaauauuuauauuuuauuucuauuucuuuaucaaauguuuuuuaaaaauccuaggugugaucuagagaguugguuugguuugguuugauuuguuuugguuuuuggucuuucaagacagaguuucucuguauagcccuggaacucacucuguagaccaggcuggccucgaacucagaaauccaccugccucugccucccuagugcugggauuaaaggcauacgccaccacugccuggcucuagagaguuguuucugugcaacccccccuccacgucugaaaaacacugaagguccacacagcagagaaggaagcuucuuuacaaggcagucagcugucuccucucacgucuggcccucaguauucuagagcugacacuuacauaaggcuguagcuaugaagaggccauauacauuucaccaguauuagaaugcuacacuugucccuaggauagcccccaaaaaagucacaaaaggaauugguaagagcggcugugcucauggggaggggaccacagggcaaagggaggaacagugaggauguuucuuauuaaguaaguuguuuuguuuuguuuuguuguuguuuucccuauauagaaagucuguugguuuaaaauccuaacccuaauguuuuaacacuauucuuuccaggcuuuccugauucuucuguaccaaggauugauuuuauuuuuaucuuucauaggccuuaucuaaaagccaagaauaucugccccaaaccaccaccaucuaaauauguaaguaaacagcccuguauuuuaugauuuaacauucaaaccagaaugcuuuaagaauaaaauaaaaugcuggaccaagaagccuaaaucaaaacuaucuggugagacccaaauaccuaagauaccccuccuaaaaaaacaaauaagcauuacuguuauuauuacuguugugccuauuuauauaugagaagugggauucaaagagauuaaguccuuggccuaauuauacaaccaguaagagucagguccugucucauucuaguaguaaauuauguugaguacaugggccacuuaaagaauauacugaaaaaaacaaaaaacaaaaacaagccgggcgugguggcacacgccuuuaauccuagcacuugggaggcagaggcaggaggguaucugaguuugaggucagccugaucuacagagugaguuccaggacagccaggacuacacagagaaacccugucucaaaaaaaacaaaacaaacaaaacaaaaacaaaagcaagaauauacuggcuuuugagaaauuaaucuggaguuuuaaaccaucaaagaaauagucauuaauauuuuuuccuaugauggccccuguuucauuguaucauuacuuuuuuuuuugcuuacaucuuuucuacuaagaguccucagaaucaucuccuagagucuagcaccgagccucuccagucaaccuugaauaaaucucucuugagccaagcccuccuuauauucuuugugaauucucuuccugcagaugcccagagugagugaaaguaaauuuaccuuaaagcaauuauuccugcuugcuuuauuuucuuuuuaacaugaucugacaguucugagguggcuuaaaaagaauuaagagucagaaacugaaguucuaaccuuaacacagagucuaacucccucccugccuugcuuggcuagcucacuuugucuacuaggugaaggaguugaguuuaucucuaaagucuccuuccuccccaccccugcccucaguucuacuguccuagucucaguauaguauagcuuuucucucucacuggagggcuuuaaacugaauggccaguucuaccacuuguaauauuuuagucaggucaggcugaugcaaaaucaaaauauagaaaaugucaagagaacauuugcaagucacauauccucugaggaucuagugcccaggaugugugccugacucuuacaguucaaacaauuaaagacaaaggacuuaguuuugaaaugggcagagucugaguagacauuucucaaaagauguugaagacaagaagaaauggucaauacugguaaccauuaggaaaauguaaaucaaacuaacagugagagguggggcugguggaccaggcugauaaucccugcuaaaagcaggacagcugaagguucaaggccaggcugggcaaccuaaaauaaaaggcaaaaauaagucugaggaauauaggucaguagaaaaauguuacaugcaccagacucuagguucaauccccaguaaaacacacacauacacauucucauucucauucucucucucucucucucucucucucucucucucucucucucucuccucacacacacacacacacacacacacacacauaaacuaaaagcaacagcaaagcaagcagacaaacaaaaacugagaaacuccauuauacuuacuaaaauaacuacguucaaaaagacagacaguuuuaggagaauguggaaaaacugaaaccucauacaugguagauaagaacauaaccugauauagcuacuuuggagaaaacaagguaagcauagaguugccaaaugauucugaaagguauauaccccuaaaacugaaaauauaugcucacaugaaaauuguguaugaauauucauagugacaguauuuaaaaaccccaaauggggaagcaacccaaauguucauuaacuaguggaugaauauguauagcuauacaauuuaauauuauucaaaccaaagcaaguaauggagggcauauuuuuaaauaagguuuggugcaaacaucuguacuucaugccuuuuuuuuuuuuuuuuuuuuugccuaagaacauaaaacuuuucuaaaaagaagccuacauaagaagccuacauauuauauuuaaauaacaaguucugagcuggagguauagcuagcucaguugccagcucagaacacacaaagcucugaguuuaacuccagcaucacauaaacuaugugugacagcacaugccuguaauccuagcacucuggagaaggaggugggaggaguaauaguguauccuugacuguguaucaaguucaaguguagccuaggccacaugagacucuuucagaacaaaaguaauaaaguacugguuccugguacaacaugagugagucuugagaauguuaugcuaggaaggaaaugaaaaggccagauagagccacacaacacacacauacacacacacacacacacuuacacacagugaauucaccuaguuaguaguuccagcuacauagguaaaguauaccuguguauccucauagcucagugguugcuaaaaccuguggagaauaggagcuagggaaugacuacugacaaaucucuuccaguggugauacaaaugccuggcaggcuguggggaugguuauacaacccuguaaacauucuaaaacccauucaauugaaggcuuuaaaauacuaaauuaaauggcauguuaaugaaauugcaaaguuauuaaauauauaagaaauguaagccauaaaaauacauguagacauuuucauaccagcauccccacuuccccuguaaaggaugcuggggagcucugaauguucaguccaagugguaacccaaauguaaauacagccgugugggucaccaucucacucugccucuaucucaccgucaacaccacacacugggggccauaugguucuuguuugagacuuccuuuguguauuuaucuagugauucuucaugacaugagcaagagagugguaguuugaaccuuucuguaucuucucagagagauacauguucuuuaauuugucaaauucuccuuccugaggaauugcucacacuauggauccucuagugcccuccucccauuacuuaccaggaaguucuccccucccuaguuuuuaauuuccuguaaccaauucucuuuuuauccaaaacuaagucacuugacuaaaacaucugccuauuguucuaguuucuuuucuguugcugugauaaacauuuuucccaaaagcagcuugaaguugaauuggcuuauaucuccagguucaucacuaagugaagucaagccaggccugaggcagaaaccaugaagaugcugcuuuccagcucgcuucucugguuugcucugggaaucacgcuuaguucacuucugucuucuuuucuuuuccuuuccuuuaucucucucucucuuucuuucucucucucuuucuuucuuucuuuccuuauuuauuuauuucucucuuucucucuaacuuucuuucauugaacaggccaaccuugaacucagagaucaccugcuucuaccuucagaguacuggaauuaaaggcaugugccacuccacccagcuaugagcuagcuuucuuagaccacucauggcuaucugcauagggauaguaccacccacagagggcuaguccaccccauaucagucaagacagucucucacagacauggccacuggucaaucugaccggggcaauuuuucaacugauguuuccucuuuucaaguucaaguuaacaauaaaaacuaaaguacuuacuaaccuuaaaaacaaucuaaccuuaaaaagcugucuugugugugucucugcaccuagagcuuuucuugaguauuuucuuuggcuauuguucaucuauuugccuuauacuaguucauuccuuuuuauuuuauuuuauuaauauuuucggaugccuguuuguuuucuaacucgagagaaaggguaaagauuuggaugggaagaaaggugggagaaccugggaggaguugggauagggaaacugugauuagaauuuuuuuuuuuuuuuuuagauuuauuuauugauuauauguaaguacacuguagcuguccucagacacuccagaagagggagucagaucucguuacggaugguugugagccaccaugugguugcugggauuugaacucuggaccuucggaagagcagucaggugcucuuacccacugagccaucucaccagcccaauuagaauuuauuauaugaaaaaaacucuauuuucuauagaagaaaacauucuaucuugacuuuagaacugugaccucagauauuuuuuuguuuuauuuuguuuuucuggacuuuggcaauuguugaaguuaggagaagacuccccauguugcaauguucucucccccuguguuuaaccacugauaacuagacagcacugacuuccaggguuaacaaguuccccagguaaguaucaaaaaggaaaacaauguuuaguguggcuggaagcacaagggaggacuugcugagauaccuacuauaaguuauuauguugucauacugugguauaucucuccaggcugcuuagaaguauucuucguuggaacaugaguagcauuaaaaauacgaaauucuuuuuugaaacaacuuuuuuuuuaauugacugauaaguuaaaaagacuggcauacuucuaauagaaacucagauuacaaaagccaccuuuacaauuuacaaagucaaauuacaaaaggugagccuuugugucccacauuuaucuuucuuaaaugacauccuaagaugguuucuagcauguguuucaguuuucaucauuuuuaaaagugagccauugcuaugaauuuuuaaauauauuuuucucuuuauguuuucagacuccuggaccuaaaaaagauguuuccaaucauguuuugccuagcaaaacuacaagacccaucaacauuaaauuccagacuaaaccagccaguaucacagcaucccagaagccagagucgaagccaccaaaacuuccaagcagaggacucacgucaagauguuuuucuucuaacacagacuguaaacaguccagcaagccucagcagcaaccuagagcagugucauucacugcaggacugucaagaaaccccaggcagugcccugauauacaggaacuaaaaaccaaacagcaacagcaagcacauggaggaaaugcuaaauguacacaucccgagacuaacacccacgcugcaaagcaaccuguggauggcuuuccagaugaaacaaacaaagaaaacuugccccaggcccugccaaaaccugagaagccagauccugaguuacauucuauaagaaagccaaauacuggcucuucuaaucaaacucagaaaggucuggcuccuaaacagaucuugagcaaaaguucaguuacucagacugcucugaaagacagagcuaacaaacaguucauucgaaacacacaaaucagaacucaagcagugaagucucggccacgcccuacaguugcagauucuacacgaccaagagaaaaacccccacaaacagcucccucucauuccguuccagcccauaauaagacucagacaucaaagaaaccaaugaccaagaacacacaggacauaacgguuaacaggguuagauacggaaaaccaaaugaaacuaagauagagucaugcccugcuacugaacagaaaguaaaacacacuaaaccuaguucccaacucaaugugcuucagggaggacauaacaguagacaucccaacaugagacaggaucagaagccuguacagccucaucuuggaccccagacgucaugcguucugcaaaaaucaagagccauaagccagaggccuaauuugacagcuagaaacuuuaauucagucaucccaagcacgccuaacaugagagcaaauaaaacacuuaacaauaaguacaauaacaucuuucaacaaaaggcacagacauuggacuccaaguucagaaaguuuccuccccagagccauuuuuugaacaagacugcucccaggacucaagccaguacagcagccgcaaguaggaagggagccccaagugcgacccagacucacccacaugguaaaaaaccagaaggagaggaucggagguacuuugccuuaauuccaagaucuuacugauagugauugggguuggggcuauaguucagugauagagcacuuaccuagcaacagcugaggguaggugagagugucggcucuagaacucucaaccugggucacagaugggcuuaugacaguggcaugugguugcaaagagaagaaagucuguggaaagacuuacauccacccauuccugaugagugcuccgucauugcucgcaucaugccagguucaagugagcaaggaaggcuuagaguauacauggacaguuuagagaaauuaguuguggcauugaaguucuagaacuacacugauuuuagaaaagaacguuuuucuucauuaugauuagaaggagaguaggaagauaagaaugcuagggacuggagcagugguucucaaccugggagucgcaaccccuuugggggccacauaucagacauucugcauaucagauacuuacauuguaauucauaacaguagcaaaauuauaguuaugauauagcaaugaaaguaauuuugugguugggggucaccacagcaugaggaccuguauuaaagggucacagcauuaagaagguugagaaccacuggauuggaggaaacaaagaucaugugucucagcuuuguuauuguggaagaaucaugacuauuguaagcacugcauagauuguaagauugccugucuucuagauagagucagaggaaaaugacaguuaagaacuuucauguguguauaaucauugacauuugggaaaggcagagcagucaggaacuagagguuaaagguaagcuuugcucucugagggguuuggggggccuguauuauaucuugauuguagguacagucaaauggucuugugaauuuacacccacagaauuacgcacuucuaaaagguggguuuuacugucuugucauugaaauccugcguguaucaggcacugugcuaggcacugaacauccagcucugccuucauagagcuugggcccuguuggaggaggcagaauacaaacacacugauuaaugagacagaauaauugcagaucauuauucuucagguaaggauuguuugaacagaggaccaaagaugaagagccugaggcaggauugagccugaaucaggacugaaccuggaucaggauacugaaaggcugccaugagggaaagggcgagggagaggacugugaugaaggucggaaaggauggcaggacagccacagagaaccguguuaauuuuauuucaacacagucuacucuauauguuacugacagacucuaaggacagagggugacaagaguuagaguagaugcuucauauuucagacagaagguaacguguggcucagcaucgugaucauguggacagaaccaaucaauacagugauaugucagacacaaggaaaagcaacuacucaaagacagcuccugaguuuagggacuauguuuaucaaaugagggaaauauagaagggauuuggagguaaauauaagagcuuuguuuggugugguauugauauaaaauaccugcuagacaaccaaugcaagguacaaauaggccauggguuuagugugguuuggggcuccagggagugaucugaaaugcugaaaugagcauuuucugaucauuaguaugguugugauguaagaaagcuagacauccuccuccugagcacuugugucuacauccacccccugacuguguuuaaugguuuauuuguaggaguggaaaauguaagcgguggcaaaaagccagccuugggacuuggcauugucagagacugguugcuuauggagaagagaacccuaagauuaucaauuaaugauaaaagggagccgggcaugguggcgcacgccuuuaaucccagcacucgggaggcagaggcaggccggggcucguguggucaggagaucgaugaggaacuguaggagaguggguugcuuugagcacugagacccuguugaagacagagugcaagcuugggucugaguggugagaaguuucuggggacagaaauggaguacugaggugucuuaagggcagguggcacuuugcccagggcagcaggugaggaaaugaagacuuagagaaaaacaaugcaaagcaaacaagggccaagggauuuuuuuuuuaaagauuuacuuauuuuauauaugugaauacacuguugcuguuuucagauacaccacaccagaagagggcauugguucccauuacaggugguugugagccaccaugugguugcugggaauugaacucagaaccucuggaagagcagucaguguuccuaaccacugaacucucucuccagcugcaguuuuuaaauuccuugacccuuggggcuagagagauggagugguuaagcacacugacuguucuuccggagguccugaguucaauucccaguaaccacaugguggcucauaaacaucuauaaugggaucugaugcccucuucuggugugcaaguguacaugcacacugaacucuguauacauuauaaauaaauaaauccuuuuuaaaaagccugaagcaccagucagcccucgguaauccuagcaaucauaaguggugcaguaaacccagcguggacacugccccucuauacaccguucuucauucuguccccugaccuuguguguaguagaagguuuaguuaugcagucacugccaggcauguguuuuagaagcagacauguuaagaaggaaagaaagaacuaaccuccgccccucccccaucacauuucagaaaacagcuggaagaauggcagaaauccaaagggaaaaccuauaaacgaccucccaugaaauuuaaaacaaaaagaaaagucauagaggaaaugaacacuuccuucuggaagagcauugaaagagaagaagaagaaaagaaagcucagcuggagcuguccaagaaaaucgacagcacucugacagagugucugaggcucauugaagaggugagugagagggagagggugcggagcucggccgcacucaguccuggcgcuuaagacagguuccucgggagccuccaccucugcagaaacccagccacucuuuuuuuuuuuuuuuuaagauauauuuuuuuaaagauuuauuuauuauuauacauaaguacacuguagcugucuucaaacacaccagaagagggcaucagaucucauuaugggugguugugagccaccaugugguugcugggauuugaacucaugaccuucagaagagcagucagugcucuuacccacugagccaucucaccagcccccagccacucuuaaacacagaaccacagugauagcaacagcuacaugaugccaugcacucagguggcugcucagaucuuaggaaacuaacccagaccauuuggcuccagaaagagacagcagggucuuucuucugccauaaggauccaaaagaugagugacauuugcacuggaagcauuuccuagaugcuaaccuuuguuugaggggugcuuuaagauuuauuuauuuuuaguuuuugcaugugaaugcuuugggugauauauauauagagagauagagauagauagauauagauauauagcuucaccauguguguucaguaccaauggaggccagaaaaaggcauuaaaucccccagaacuggggaauuacaaaugguugccagccaccaugugggugcugggaaaugacccugguccucuggcagagcacucagugcuuuuaaucagugaaccaucucuaggcuccucugaguaauuuugguagccagaaauggcauccuaauugugucuuggagucuacaccaggauaaaguagguaguagacaauggguaugugacuagugacugccauacuaaacagugcaguacuaaacuaucccgugcuuaaccucuaggcaggaagacugcaccuacaguggaaguaagcuugucugcuggugcuggaccugggggacgcaggggaacauuauuuuaacaguucuccuuugugcaauuaaacuucagaguuuuguuuauuucuuugauuuuauuuuguuuucauuaaaaaacaaauacaggaauacauuauuuugcgggggguggggggaagggguggguacacuuagacuuaugugcgcauuuaugugaagaccagagggcagccucaacuggcuuccuuguugggggaaggggagacggguuggauugacuucugucaucgucguccguuauuugguuuguuuugaggcagggucucauaggccuagaacucccuaguaggcuaggcuaaaggcugacuggcuaguaagccccaaggaucucaccucccuggugcuaaaauuguaagcauguacuaccagucccagcuguugguagguuucuggcuauuacacaauguccuuuuauuugcagaacagcacuuaccgacuaaacucuuucugcacguaccccucccccaaucaguaccuuuaauauuaaaauaauuuuaaauaauaauacagauuagugaccagaccuccaucccauucugcucccugaaggguggugaucacccauuguuggcuaucccucccgucuuuauaugugugcacacaguguagauagaagugcggcagacugguuuguuucgcagguugcaggacuugacauuuuuauauguuuuccuaguuucaaucaaaugacuuggcuguuucccuuucugucuacacccagacaauggccuggacaucuuuucacauucuccuguagucgauaaguguuuuuuguuucuugggcugaauggauagaauguaggcuaaggugaguagaucacagacucaaggccagccagggggacauagaaaguucauagccagccucaaauacauagugagcccugucucaaaaaauaaaggggggcaaggcagggcuaucagauuuauugaagauuuuguaagaccccugaaacuggggagaccuccgcucaagucccgggaugagcuggccggcaccccaauaacucgagagaaaaccacaccugaugcaaacugcaagaggcuuuauugucagcuagcugagaacaaacuccuuucgcugcagagcaggggaguucgacccugagugguaacaguagggggcuuuuaaaggaaaaguaaggaguugggaggaguuuggcuacagcucuucucuggcggugucuuugguaaaaugacaaggcaugaggaguagggaguggguuguagcucuucuuuguggaguuuaucuccguguccuuggcacagggagccaggcaagcgccugacuagguccuuuuacaauuaucgcaucucuguuuguaagguauagaaacaaaaaggcuuuuugcuggcuauagagaacauagagcuucuuucuggcuguauuuuuagagaucagggaaaacaagcuugggggaacguuuaggggcuuuaccuuuuagggagaaacgcuuuaagucagggucucacaguuucucuaggaucuuuuuaaagguuauaaaaccuuuucaaguccaguaacuucccucauuuguaguauuuaugucuguucuguccauugauauuuucuuagcuuucaguuaaaaguuuggccgguuucaucagucuuaauuucucaugaauauggugaaugcuguaaacuugccucgugguuuuacugucugauaccugccauguuuaacaaauacuccucagccagguuaagucacaaagaaaagaauagcuuuguccagcucggcccugcagaaacccuccuguguucuaucaagaaauucucugaaccgugucugguuugggauuuuauggagaccucauuacauaggcauaauugauaacuuugaucuacauuagaccauuagguuauucuucagucccuccccagagguuguggguaggacuggagcccccuacuugucugcuugucucuuguccugugagcagccaccauccugaggcuaccaggaacugccagucaucgauuuguuaucaugccaaagacuuuggagaguacaaggauuuuaggaauuauaugccaggaaguggaggaagacuccauauguaauucacaguaucucauuagaaaaggugaacuugggagaaacuaggacuccaacuuccaggaggguguacuacccaacaaaugcuaguguuuuaaggucgagcggagggacccugugggccuggaguugagacuuugagaaaaguccacuacccugugguccccuaccucuucuggggcuagagccagcugcugucccuggugagagacuguugcuagggugaugaaagcggaugaaagaauucuguccuucaccuaggcagccuuccucuguucuccugugugggcagggcccagccagagccaccgccaggcagaaacuuuacagaguuccagcugguacuucucuggauuccgcuuaguagaauuuguugguugagcuuuucuuuguugucuuaaugacugauccuuuuuaguaaccauugaaaaaguguuuaaaacaauguuuucuguuuguuacucaauggcuuccuuucugaaggaauuaugccacaguguuccaggaggauaaguuaaugauaguuccuccuuauauuugucaauguuugcucucuaguuuucuaaguguuacacagauucacgacuugcuuugauuucucugauauuaauauugcuaaaccucuuucuuccuuccuuucuuccuuuuguucuuuuguucuuucuuuccuuccuuccuucuuuuuuuuuuuuuuuuccuuugugaguuuccucaucccuuugguuuuaaaccccugggcugguuuauauuaggguguaucccagguguguacagacugagacacucugcuuuagacagcaggccuugcccuccacaguuagcaauugcccauauauauaaacucacuccugacacuugacuuuguaauuccacuuagaggguucuccuguguucacauucuuuuauuucuauauuuacuauuguuuucauguuucauaaagaaaauuauagggcuggagagauggcucagugguuaagagcacugacugcucuuucagagguccugaguucaaaucccagcaaccacaugguggcucacaaccaucuguaauacgaucagauguccucuacuggugugucugaaaacagcuacaguguacucauaaauaaaauaagcaaauuuagaaagagagaaagaaagaaaggaaagaaaggaagaaagagagagagaaaaaagggaaggaaggaaggaaggggaaaggaaaggaaaggaaaggaaaagaaaauuauaaauuggugaaacaaaauaacaugauagauguaaauucaaacauguuuacuaaugaugcaugcaaacuuaugcuuguaaagcaccauuauuucacccuugugcuguauucauaguuugggaagaauuucuaacuacaaguuauugucucuaaaaauuuagaagcuccugcuuuaccuuuuuuucuugugucuggaauuacugacuuauugagucacaucuaucugagucucauucuuuauaaguaaucccuuaucucuucugcuucucuagaugcuuguuaguuaguuaguuaguuaguuaguuaguuaguguuuuucaaaacaggguuuuucuguguagccuuagcuguccuagaacucacucuguagagcaggcuggccuugaauucacaaagauucaccugccucugccuccuggugcugggacuaaaggugugcgccaccacugccucugccuggucuuaaguuauauuuuuacguuauauuuuuaucuugguuuuccaaauauccauauauuuauacauauauauguauauacuaguuaacuccaacuauacauacauauauacucuaaauauauacacauagauacauauauacauauacacuaguuaauucucugaaaaccuucagugcaaacaauuguuuaucugucuagucuuaaacuuuauucuuuuguuuuguuuugguuugguuugguuuuugguuuuucgagacaggguuucucuguguagcccuggcuauccuggaacucacuuuuguagaccaggcugaccucaaacucagaaauucaccugaacuuuauucuuguauaaagaauuuuuugagugugucuaacuuugcucucaaugcucaagaaacucuuuucuauagauauugaaauuggugaguaguagguaagaccguaggaacucugaauuugcacuuugcaccgcuuguuucuuuguugugucucacuggguucugggagagucccucccucguaaccaccuaugcucguucuaugguagggaguuugccacuuggcugauacugucuccuccgcccucacucucugugccgcguucauucuuuguugaguugauuguaccuuuauuaucguguagcuuuccugggccaguggugauucuugauugggaggguacaguugugucuuuccaucaccagaggagcuucugagcauagccgagccuggacuucuuaguuuguugggucuccuuuucuccuaguccuugucacugcccugccaugggcccaagccagaagccauuucuaaguuccuuugcauggaauugacccucuuuuauaucugccugcaugaaucuccaguacaucuacacucacuuugcauacuucugcggcucuucaugcaugcugugguuaaucauguggaaaguagccuugagucacaguucauaauucuauuaauaugugguacucugaauauuuuuaauauguuagaaguauuuacuauauuagaucuugauccuguuugugucguucaucccauaaagauagagaacauauucuuuaccuuuuguugugguacauuuuugucuuaaaauuuaaauugugggggacuggagagauggugguuaagagcacuaacuguucuuucagauguccugaguucaauuucccagcaaccacaugguggcucacaaccaucugcaauggggauccgaugcccucuucuggugugucugaggacagugacaguguacccacauacaugaaauaaauaaauaaaucuuuuuuuuaaaguucuuuaagacuuaaagguucauguuaaaaauuauugaacuguauaauuaagauggggauguuuuuauauuuauuauguauuuacuauaccucagcaaaauugaaauuuuaacuucaaugagugacuauaccuucagagauauaggcauuaacagugacgugguaaaaauuauaucuggcauuucuuuuuccaggguguacuuccuaaugaaauauucaccauaguauccaguauuccugaggcugaaaaauuugccaaguucugggugugcaaagcaaaguuacuggcaagcaaaggcaccuuugaugcuauuggacuauacgaagaggccauucagaacggggcaacagugaguaucugucuuagauggcugaugucaaauucuccucugugggcuuccuuuguugcuuacaguuaugguucuacacugcacuguuaagcuuccauucauagguaggguaccgcaacagggugagugugaucagagugcauuagacacaccccuggugauagcacagugaagccaggguuuuguacaguuaacacacuagcagaaacuuacuucaccucaaaaagcagucacagaaucucagguagaagguauuggcuuuguaucuugauuuguuuuguuuuguuuuguuuuuucaagacagggucugccugcuuuucauuccaaauacugggaauaaaagcugcaccaccaucaguuagccauagaauguauucuuuacuaaugcaucaauuacgucuuagagauuacauuuauaccaguagaauuugggugguguuuguuuguuugucaaguacccuggucucacuuaacacuaauuacagaaauaaguaguuugggaaauaaauguagaaaguuauaauaaagaaucaagauucaauaguuaaaaagaacuuaaggcauuaaauucagaacaucauuaaugcagagucauuacaucaagcaccucccuaauucuaaaaccaaagagaaagcaccuucugcagauuuauuuaacaaagagauaugacuucacaaugacuucauaacccuuuucacuuaaaugucguuucucucccuuccucgcgucccguggugcucacuuccaggauugcucacaguguuguacuuaugcgcaguuuggucaguuucacucaguaacgacuuuuccucacauuugaucccuggcacccauauaaagcagccaguaguggugaaacacaccccagcacucaggaggcagacaggugggucccuggagcuuucuggccagccagccgagccugauugauggucccagaaaaugagguagauggaugguuccugagaaacagcaaagguugaccccuggcuccuccauauauauuuaugcacacuuguguacacacagauauguacacacuuaacauguuuguacacacaccaaaaacaagcaaaggcucuggccacauguugugggguacucaguagggugaucuagcugcagugguugguagaaagcccucuacuagaaccaguaaaaucuccaggucucuccucuauagcuggucagaguauuugggguggggaggugcgccagacuccuuccugugagcuagaaacuguucuggaguggauagacauugaggagaagagaccuggcaaucuccuuagccugcagauucugauuuauccuguuuucuaguaggcacccauccaagucuucgucagaaauaugccccaguuuucuguuaggguacagaggggcagggcacagucaccaggcugcauggggccggagguaucgggucuggcugcagaucugacuccucgguaggugcuccaggggccucaucuccuguuguugaguuuggaagcucugugguacauauaauuuccucagccacacucccagccugagacccagcuuucugaggggccgguuggcaguccucuccagcaguccacucccaaaggcuucucauucucuccugugcacuucuuaauccuugacucucauuucaguagacuuucaguagaggucagaacugaaugagaugcagucuccauuuuuaacggaaagcuguacaaaugcaaaacaugcuucaucaagcugggauuauuacuccaguaaucccaacacuugggaggcugaggcaggagaguugccaugaguuugagacuagcuuugucuacauagccugacuuagcuuagccuagaguacauaguaauaccaugucuuuaaaaauuuuaauaacaaaauaugcuugaugcaaauauuuuauaauucacauucauuacaguauguguguauauuuccaacuucagacgcuuacaacuuaacuuguuguuugguuggcuugguucuuugguuuggguuuuguuuguuuguuguuuugguuggaguggaguuuuuguuuuguuuuauuuuguuuuguuuuguuuuguuuuuguugagacaaauguauggugucauuauauagaccaggcuagccuggaauucauagaucuaccugacuuuaccuccaaaaugcuaggauuaaaggugugaauuaccguuguuggccagguguguguguguguguguguguuuguguguguacaugugugugcuuuauuaauuugauacagaguaccaagucaggaaaaaaauucuaaaucuaacaucccuacaauaaaauagcagcugaccuuguggugugcugugauggaguuugcaucuucuucugggcaauggagcuuuuugucuuccuuuccuugguuauuuuuuuuuccugcucuuuacauacaguaacuaaauaaaagugagaaagaagaggccaggaaagauacagaaaaagcuuuaaaaacgccugcaugaugggacugugggggucucccuggaguugaaccuguggcucaaucuuugugaacuacagugcccaaauuuuaucaugaaagcaaggacuaaacagacagcagggugcaugguguguuuucugucugucuagcuuuauaucuuagaggcagguaugauaugauuuaaugauaugauauaaauuauuaggaaaaaagaauuugguuuaaagaaacuuugaacacaucuuuucacugaaauuagauaugccaguguuaaauugacauguucaguuucuucauuuuuuuccuuaugaaucuuuaaaacugaaucauuuuaaguguuuaucacugaauaugggauugaaaaagaaaacauuuuuauugcagaaaguuuauuugauacuaagcagaaguccuuagcucagucuuuccaugaaugcuuuuaaugccguuuguuuauuuuguugccuccagccaguacaggagcugcaggaaguucugaacguucuacaagacccaugcaggagcacagaagguaugguuacuuccgcguuccaauucaccgccuugagacaugcaaguaaaauuccuguggagcacguagaucagagggaugaaacacucccgccucuugcucucuauggccuggccuuuugagcuguaaucauccacugauugacuccuauaauuacaguaaauaugugcucaauucugagcaaagguuauuuuccccacagcagccuggacuagugugaccugcuuucuuggaaccuucaggaaaacaaaauaacaguuuaucaaaagagacaaagacaaaaggaagagaugcccugacauguuaauauguuuaaucaucauaaguguguuaguuaggguuuuauuacugugaagagacaccaugaccaccucaguuauaaagaggaaaacacuucacuggaucugacuuagugucagaagucugguccauuauugucauagcaggaaacauggcagugugcagccagaaguggugcuagagagggagcugagaguucugcaucuuaauccauaggcagcaggagauugucucacugggcaugacuugaacauauuugaccucaaagcccaccuccccaaugacacacuuccuccaacaaggccacuccuccuaauagugccacucacaauggcauucauagcauucaagcacaugaaauuaugggggccauaccuacucaaauuaccacaguaaguugcuaucacucaucuaaguucauguucuuucaagagucucucuccuuacuuaauugacagucacuauuuggaaccuuuaaagaaucugucuagcugggcagugguggcgcacgacuuuaaucccaguacuugagaggcagaggcagaggcaggcagauuucugaguuugaggccagccuggucuacagagugaguuccagggcaacuaggacuacacagagaaacccugucuccaaaaagagagagagagagagagggagggagagagagaaagagagagagagagagagagagagagagagagagagagagagagagauugaauaaauuaauucuaauaaugacaagaaaauugauccagggcauggagaaggagagugauuagucucucagcgcucuccugagaguaggagaugagaauguggucagugcuguaaggggguugaggauccaucuucaauuggcaaauaugcccagaaggaugucaggaaggcugccugguggggcaccugaugucauaggccauugcaguagggcuuggcaagaaggaggguggggggaugaggaauuggagggcaguauugguggauggauaugaucauauguguuuuaucaauauuugaaauuucaaagaauaaaaaaaaaugcuauuuuguaaacuauagcaaggaagaaaaccauauaaauggcaguuggagucacaccuuuuuuuuuuugguuuuuuuuuuuguuuuuguuuuuuuuguuuuuuuuuuguuuuuucgagacaggguuucucuguguagcccuggcuguccuggaacucacucuguagaccaggcuggccucgaacucagaaauccgccugccucugccucccgagugcuaggauuaaaggugcgcgccaccacccccggcuggagucacaccucuuucuuugcucuguggaguccaugaggguuacugggaaucgcuggccacauugccuugcuuuauugauuuuuaguuuaacuguuaaauugcuucccuuacuucccuuccuggccuugugugcacagcaguaaccucugacaccucagcugcuggaacuaauaccacaucugcagaggagcuggccaaggaggaaucugagcagccuugcccaucucuaacagaaauggagccuauugcagcagcagcaccgcggauaccuguuucagagugggauaaccaugguaucaaauuacagguugcuccgaucccuagguaagcagaguccagcagacuucugaccuguuucuggucgaguucuguuucuuccacacaucccgagaagcaguuuagagaccucugcuucagguguggugaaaaggguaggucagugauuagugucagagcucuccagacugcaaaaggucugugcugagaggagaucugggauccagccuccauuggcagaaaugcccagaucacggucucuggcucucaggaaggggcugaggguaaguagagguuagaacuggaaagcggagcagggucuuucuuuuucuguguguauacugcccuuuccugccgcccuaagacugcugugaaggagugcugcagucaggcuguguuggcacagauccacaccccuccuucaugcaguaccuccucuccacucauuuguccuaccagccugacaccgaggggagccgaguaguacuaucucccaaauuagugugggagagaaggaaagggcagugaccagcccugggagaacauggaggaggcaacagucuguuacagucagagccuucuguucucagcagaacuacagucauuuuaaggcuguaugacaguggaucagcauuguuuccaaaaagugaguuuaauaucucuguccccuguucaugcuucuggaaggacuauacacaggagagccagggcagcaguucugugccuuccucuaccuggaagcacagcuagccugaccccuuagccuucauuugccuacuguuguuagcucaugauacaugaaagcagucagucagccccaagcucaccuccacgggcuccaagugcaggccuauaagcuuuucagcugaccugccugcuaguuucccauaagcucaugcggccagugguuuugugaauuuuaggucaguuguggaaagguuccuaguugcauuggcaacuuuacaaagaagauagauguccagauguuccuguuucaauacauguuuggagcggcaucuuaauagguuuugaguaauugacagucaacacaagaaggaaucuuagaagucauuagugcagucaagcucuguguuaggcccgguuuccucacagccuguaaauauuuauaagauaaacaaauggcaacuguaaagcaguugacuucacaucaaaaccaucuucaccuucauucauagcuuuguaauguuaacaccaccauccugggcuuccugagcaccaggggaaagccagcguaggcucacacugaaguaccagcuaugcauaagaaacaaaguacaagagcaggauguuccuggagccgagaagguuuugaacaccuccuccuucggucucuuucagaauaugcgggaugccagaagugcaagacaugaagcuuaucacucccgugaggcgcucagccaggaucgagcgcacgguggcucgcuacccagaaaugcugcaggagcaugauguggugguggcuucucuuaaugagcuacuggaaguggacaaaacagaguguuucaucuuccgugaaaaugaggcuuugccugugacacugggcuuugaaguccuugaaucaugaucuuuugauauuuguggguuuuguuuuguuuuuuuaacuuuaagugagguuuuuuucagagcuugcaagacauaaaugcccuugucaagaugacaugaaauaaauguuugcugagaccucaccaugcaggugguagacucuuuggucucagaaggaaugcauugaguuuacucucagauuguauauccccaugagaaggcuuuugguucauguauuuguuauauacuuuauaaaaguuuuauagcauaguuuuucagcauccacacuaccuggagggcaggcuucuagaguacaaaggguugacuuuugacaccagcucaccaggcggaaagucaaacuccacagauuacagagacguuugggcuagccacaucuucacucagaucccagaagguauuuguggagaccuucagcuucuaccacagugacccuaaagaugagggggacgcuuguccucucuggguggcuuuccucuagugaagcacaguccagaauugagguggcagcccagguuuuauuuacaguccuccuuuugcacuuguuauugagaaaugcuucgaguaaagacaaauauggggacagagccugcugcguccauuccucucccuaccagaggacugguagccugaggaggccacgagcaccgcagagacuauggcaggggaucuuuucugcaccuuggacaacugcuccuggaaaggaaaagcagcguuguuuuguaaauguaacauaggaaagccugguuggcaauuuuuaaaccuuagcuuuguuccuaugauuacuaaguacuaaguaauaucuaaaauaaaaaccacugaauucucuucau

SEQ ID NO: 1083 - RNA, 5854 nt, Mus musculus
cagucuagaagcagauucugggccagguaagugggugcucugguugcucucuguugacuucugacaccuaaauucuagacuagcagaguuagcuaaagucugagcucucugccuuugcuuccaagccagacuuugcaaaagagucucuuauccuguccauguggaaguuuuucuuaccauugcaucuguaggagucccuguagugacagcaccuaagucccuagguugggcuugggagugaagaggucagucuuuaagcuagguugcuugaacucugauagccacugaaggagaugaguuggggacucucuggccucugaaaguagauagcccuccauuccugaaagcagagugcuggauaugugaccacucuccaguacccacugaccugucaaaagguggcauuucacaguugaguucaggaacaguugccauagcugcuucagacaccugugugaagaaagaaagugggugggcauccagcguuagcuccccgaggggcguccuucauauguguuucucuuagcucuaguucagggcaggcaugcuaaacuggucucugaggaaugaaggaacggaggagccguuguauaggucuagaacaguggcccuuuuggagucaaguggcccuuucacaggggucaccuaagaccauuggauaacacagauauuuacacuucauaacaguagcaaaauuauaguuaugaaguagcaaugaaaauaauuuuaggguguguggggggucacuacaacauggggaacagcauuaggaagaugcucuggaaggaagcaacagcagagccaaacccuaauaaagaagcuuuccuacaagacaggagcugccuuuuagaugucagcggcuauacagacaguacucauuuccagaguacuucacaaaccauggagguacagcuacuuuuuauaaauaaaaagcccaaaguccaucagugggggggggggaaagagagagagagagagagacagagagagacagagagagagacagagagacagagagagacagacagagagagacagagacagacagagagagagagagauagacagacagagacagagagagagacagacagagacagagagagagagacagagagagagagauagagagagacagagagagagagagacagagagagagagagacuuacuugcacaaggaagcuuggcuggagaggaucccagaugagccuauuaggccucgaaccacugcaggguuuguuguccaacuuguuuucccucccuuguuuuauaguccuaaaaagcagaagugaagagcugugaaauuuucccuuggguuaacugauuucacaacaaaacugaagggugggggaggggggagaagcuugaugggaauucuuaggggaagaggcuauugcuacccugaaauaauuucuaaucccuggaagucaagggguggcagauagugacacauucgcaagugugucaucgugguggaaaugggcauuauuucccccuggacaauugugcagauggugucaauauuaaaaauauuggguuuuccuggguuagcuguacauuuuaagucaggaugugcggaacaaagguaggcacguagaugcacacccagaagugugucaccucucucgccuccuugugcuuaagcugagggagcuuugcaguuggaguuugguaacuggauggugcuucugugcucuccaucaacuguguuagcaggggcuucuggagagacacgcacuuccuugugugggucagggcacacacaguaugcagguaucaguguagacuuaucauagggucagggaacucuggaagcaagccuaugcagucugauaaugccagggugcuuauuuuuuucuuuuauuggauauuuucuuuauuuacauuucaaauguuaucccuuuuccaggucuccccuccggaaacccccuauccucucccccuccccugccucuaugaggaugcucccccacucacccacccacuccugcuuuccugcccugccaggguacuuauaauaccauagccagucucauguugaaaccauaucagugcuaggugaucagcagaaugagccugaauuaaguugcacagugcaaagguggugaacgaggcaucugccuguucaugagcacaguccaucuuaaaaagugaagagauagucuuugccuaaaaaauuguuuuggaaaauucuuguuucuauaagaucuggggagaccaagucucuuggccauaucaagcaucacuagacugcuaacucagagagcccagggagccuacccaggggagcucuucuugcuuggauggaaugagcaaccaggccauaugaaugcugcauacagucucuugggcacaucuacaguauaguagaauccucaguggaaaccuaacuccuuugcugagcccucagagagucuguggacuccauuagagccaggucuccacagugccuggcagauggaugcaggcaguaggagcuagcccgggugaguaggaauuuggcaauguguucauucagaugaguuuguaccuaguauguuuugguuacugagcuuauucugcagcacugaagggaaauagacagacagaauuggaaggaggaauagacaaggcucuacuaugaaacaagguuuacuuacuaggcagccuucuuuugccuaauuugguucacagcaucucgauuucaggaaggcaaacagaagaauccugccuuugaccagcuauauguuugauuugaaaucugaagaugguucagggucucaguugcuuuugaguuuggugagcaauggucaguucucagcacuaaggucuuauaagauguauuaucuaguucugcagacaauccagagguccugucugggccaucugguucauuuuucuguucugccuucacaggguccacauuucaaacuaugccuggagggacuaacaccuuccucagagccugugugcagggcuggaaggucugaugauuuuaugggcuguccugacagagauuauuggagacuccuuuggucugcugaugugaguugaaccagggauggugaaaaccaggggacagagaaggguaacuaggggccugagugucagcuccaagucccuucucccuggaugauuuuucaggagccuugagcucagucuaguuacagaaucuucuucaccaucugcuaguuauaacacuccuaaacccuugagcugaugccugagaggagugguugucugggaggauuuggaggaaggcacaugcaugaagacgaauggccauuuaaucgugaguaagagaugaagagaugggaggagguuugucugggaggaggcaaugaucugguugaugauucuuuugcuucuagagggagauuuuggaacuacugggcaaugccucugguacucuauuguucuaucaaaccucauccuggcccugugacuugggcuccaaauuuccuccccuugucguuauagagcaggcaaguugcacaacauguauaucaaacccugucucucagaccacacuuccuuuuugguccccaaugaguagaagaaauaacucacuauagaaauuguuaugcuggggguguggcauagugaugacgauacugaugaugauguuggcaaaggaaaugaacaaagcaaaagaggaagucggcaaagccaggauggugacgggcacucuagcuuuuggggaacuuuucagcucuugacucacucagcacuuuuaagcuguaagguucccucuguucugacaucucauuccuccaagauggaggcaggcauuucuucaaagcugaaagugccuugcuaccuguuuuacuuacuuucuauugcugugauaaccaugacuacugugcagcccagacuggcuucaaguacaugacaauucuccugcauuugucucccaaggacugagauuacaggcacgagcucccaggcccaguugauguauguguucuacaucuucuuuacuuauccucuugcucagaacagagcuaagcaaugacuguccucauuacuuucuccagaccuugucuuauuccuuaaguugacgacuuagcacaggccuuaggggucuguucuuucccucucaucuuuucuguccugguuaguuuuaugucaacuagacacaagcuagaaucaucagagagaagggagccuuaacugacaaaauacauccaaaagaucugucuguaggcaagccuguaggaaauuuuauuaauugguauuuacuuggggagaaaucagccuguuguggguggugccaucccugggcuggugguccuggguucuauaagaaaguagguugacaagccaugaggagcaagccagugagcagcaucccuccaugaucgcugcaucagcuccugguuccagguuccugccuugcuugaguuccuguccugacuuccuuugaugauaaacugugauguggaaauguaagcagaauacauccuuuccuccccaaguugcuuugaucauggaguuucauuauaguaauaguaaccuaaaugaaaaugaauuggcaccaagauuuacugugacaugacugugacagaccugagcauauuguuuuggaaggacuuuguacaagaaaacccauagaguggucaauucuuggugagcuguuccuaggaacuuggaagauagggacguugagggcaacacaaagauggaggccugacuugugaagcuucagaaggaagcuuaaagacuucuucagggccauuuguuauauugaauuaagauuccgugauaacauaauaucucauuagcuggggcugaagaauaggcaucgauaaacaagauuccagaaccacuaaaaaugaaaccuuugcuuugcuuagauacucagugcuggugagcuggagcugagaaauuagcagugacuaagaaaaguccagcauuauugaggugaaaucuucugggaaguguuuucugagagcacacagaagcuguuuuccagagauggccaaaguuguauuucuccacuggcagccaaauuugguccuguggaagagccacccaggugacacugguucauggaagagcagcugagucuuggcacugacaauacagccucaguggcagcugaaggcccaggauugaaagggucauacagagaaguugaggcuugucaccaugaagagagcccaggagaguacugguauaaguccagcccaguugcagcagaagaccccagcauuuuggagaugcaaguaccaugggaugaccaucaagaacagcagcagcaguggaguggagccagccaaauccuaaaagacaagcuguuugugcuacaaagggcugagcugcagaaguaacucaagccccuuagaggaucccagaagaucuugagugcaucuuugacguuggaacaugcacuauuuacauuuuuggaguuugguuuugcuuugcuuugauugcgauuuugaccuaguucuucucucuugaaauauaauuuauuuuugauuuuacagaaguccaaaguugagagacugaauuuuaaaagagauugauuauuuuaaagagagagaacuuuuaauguauuugaauuugugaggauugugggaccuuuaaguuguuaauguuuuauauugugauauaaauauuaacauaacaucuuggggauaaaugagaaaagaaagguucuaauuaaaaagugauaaguugggccuugagcucagcaauuuagagcacuggcugcuuauccagagguccugaguucaagucccagcacccacaugguggcuaacaguaucuguaacaguagucccaugggauuuaauaaacucuucuaguguguaggaguacaugcagacaaaaacacccauauacauaaaauauauaaauaaauaaaucu

SEQ ID NO: 1084 - RNA, 3125 nt, Mus musculus
auuuaagaaucaaaugugaaaguauuuuauuagcuaauucaacagcugcaggggacucauaccucugagccucugggguucaucaccaucucuguaggauuguggguaccaggguagaggacaacuuuguggaguugauucucuuuucaccuuuuugucagcuuggggggugggguggggauugaaaucaagucaucagguucacacugagccauuacccaggcuguuuuacauucuaauagucucuuuaauugaccaagguuaucucccuggccacucuuguacuugcugucucuucucccugcaaugccccaccacuaguuguggcaugacuggcuucuugcuauucauuacucagaugagugucauuuucuaaagagauugcugccaacugaauugugguccuaccucagaaucauguguugaaccuauaacccccaauagguuaguaacaauauuugaagaugaacccuuuaaagaaauuuaaguuguuuaaauugugagguuggguaugguggugcacaccuuuugaucccagcacuuggguggcagagacaggcagaucccugaguuuaagaccagccaaagcuaaguagagaaacccugucuccaaacaaacaaacaaacaaacccaaccaaccaacaaaacaaaaacaaaaaacaaaaaacccaaaucaccaccaauuaaaaaaaaaaaaaaacccaacaacccagcaacaacaaggaaaagaaguaaaggaguuucgguuaacaacgaggcuguuggaauccuuauccaauaaggcuaggugcugaggacucguauauuggacuagaagagaaaggaaaggacaaucgguaaaccuugagauggcauaguaaacaaaagcauggcauuguucaugguucugcacuguauugagagugugcuagagaguaucuuuguccuugggaaaaaaacacacacacacacauauauuuguguguguguauauauauauguguguguguguguauauauauauauauguauacauauauaucuuauaaauauaaaaggauuuacaacauguauacauucauacauacauauuugugcacagaacaugaaaauauagcaaaacaauguaauucuggcaaaaaaaaagaugagacuuuacuauucuuacaccuuguguguauaugugaccacuuacauacagaaaagcuauagaaauucuagaaacucuuguuuauuguuuuacauuacauuuaaucugucuuguguguauuuuaacacuguucuaaguacuuuaacugugagacaucuacgaagacacaagguugacugucuccuccagugucaagagucgcaauuaaggcaaagacugucgugucuacuccuuuuuccccagacuuaaaauaguguguagcagaaacucuaguuacuguccuucaauaucagcuaacaaaauacugggcaccuucuaggcauuggaguacaaagcaggguacaaaauacuuuaaaaaaccacgccuaggggcuggagauguagcuuuguaaagugccugucuagcaugcacaaaacccuuggauuccuagcucuguacaaacaaauaggguguauaaauugggugugguggugcccgccuuuaaucccauuacucgggagaugaagacaagaggaaaaguucaagaucauucuuaacuacacagccauugugcucccucccaccacaaugggcggccggggugaaggguaucaaaauccaagcccaaagcagcuuauaucaggcacucaauuagccagccaucauauuucacuugguccuuugcaaccuuggaagugcggaccacccggguuuggcagagaaggauacugaggauuaagugcggcugagaucauuggggucauuagugggcguggagauuagcguucuaacccuggucucagcugugaaucgauuacaccuaagccauucccccaaucagcaucaagugccgagugcgggcguagagguacgaugcaggucaaguccggaaaggcguuugcggagugcaggcgccucgcgaaggcccucgguacaaaucgcgggauuuuggcgcgcucuuuuuguuggcuggguguucucgccagugauugguuccgggcugucgcggcggcugggucuaccucggcugcagagaggcggcgcggcucuccgcuggccuccugggggaugggccaccaggaaucuccgcugaccagagcggcggcgggaggugcagcuuacauaaagagguuacguaaagugcucagcuggcgugaacucggggacggccacgggaaccuggaagccgaggccucccccgggagcguugcugucaucacaagagcagcgccgcgacgcgcuacacgcucagccaggcuccccgccucgcgcccuacccggcucugcagacaagcccggcucggaacggaccauccuccggcgcgggcuccaagggggaaccgguucgcccggaagaggaacagcgccggccagguaagagggaguggagggaggaagggagggccgaagcgggagccccggcgccccaccguagucccgggggcgucaccggggccuccgccugucguccucggaagccgaucuuuuagccgguuucccuucgcccgcuguccccgggggucugggucgucccgccgggcucuccuggguuugauucacgggacuguuuacaccgggagaagcccggguaggacguggggaggggccguugagagggggcuaagccccaggaaaguuuaagccggccgucuucgauggggacgaucccuacggcuuuauuuauuuuuucugcuccugacggauaagucggcgagaggggacgguuugcgcuucgguuuccgguccucccucgguacuucccggugguuccgucuuucccgcuuuccuuucccuucccccguucaauucgagacgguggcuccuucuuaaaggggccgcgaccggcggcggaggugggacgccggacgcuuuaaguuccucaucuacccuucucggcccgguggguuuuaacuucucccucucgcccuuagaucaccauccaaggucccgcuccuccacaucucggggcuagacggagggaugaggcaaggggggcccgggcggcgccguugcug

SEQ ID NO: 1085 - RNA, 3125 nt, Mus musculus
cagcaacggcgccgcccgggccccccuugccucaucccuccgucuagccccgagauguggaggagcgggaccuuggauggugaucuaagggcgagagggagaaguuaaaacccaccgggccgagaaggguagaugaggaacuuaaagcguccggcgucccaccuccgccgccggucgcggccccuuuaagaaggagccaccgucucgaauugaacgggggaagggaaaggaaagcgggaaagacggaaccaccgggaaguaccgagggaggaccggaaaccgaagcgcaaaccguccccucucgccgacuuauccgucaggagcagaaaaaauaaauaaagccguagggaucguccccaucgaagacggccggcuuaaacuuuccuggggcuuagcccccucucaacggccccuccccacguccuacccgggcuucucccgguguaaacagucccgugaaucaaacccaggagagcccggcgggacgacccagacccccggggacagcgggcgaagggaaaccggcuaaaagaucggcuuccgaggacgacaggcggaggccccggugacgcccccgggacuacgguggggcgccggggcucccgcuucggcccucccuuccucccuccacucccucuuaccuggccggcgcuguuccucuuccgggcgaaccgguucccccuuggagcccgcgccggaggaugguccguuccgagccgggcuugucugcagagccggguagggcgcgaggcggggagccuggcugagcguguagcgcgucgcggcgcugcucuugugaugacagcaacgcucccgggggaggccucggcuuccagguucccguggccguccccgaguucacgccagcugagcacuuuacguaaccucuuuauguaagcugcaccucccgccgccgcucuggucagcggagauuccugguggcccaucccccaggaggccagcggagagccgcgccgccucucugcagccgagguagacccagccgccgcgacagcccggaaccaaucacuggcgagaacacccagccaacaaaaagagcgcgccaaaaucccgcgauuuguaccgagggccuucgcgaggcgccugcacuccgcaaacgccuuuccggacuugaccugcaucguaccucuacgcccgcacucggcacuugaugcugauugggggaauggcuuagguguaaucgauucacagcugagaccaggguuagaacgcuaaucuccacgcccacuaaugaccccaaugaucucagccgcacuuaauccucaguauccuucucugccaaacccgggugguccgcacuuccaagguugcaaaggaccaagugaaauaugauggcuggcuaauugagugccugauauaagcugcuuugggcuuggauuuugauacccuucaccccggccgcccauuguggugggagggagcacaauggcuguguaguuaagaaugaucuugaacuuuuccucuugucuucaucucccgaguaaugggauuaaaggcgggcaccaccacacccaauuuauacacccuauuuguuuguacagagcuaggaauccaaggguuuugugcaugcuagacaggcacuuuacaaagcuacaucuccagccccuaggcgugguuuuuuaaaguauuuuguacccugcuuuguacuccaaugccuagaaggugcccaguauuuuguuagcugauauugaaggacaguaacuagaguuucugcuacacacuauuuuaagucuggggaaaaaggaguagacacgacagucuuugccuuaauugcgacucuugacacuggaggagacagucaaccuugugucuucguagaugucucacaguuaaaguacuuagaacaguguuaaaauacacacaagacagauuaaauguaauguaaaacaauaaacaagaguuucuagaauuucuauagcuuuucuguauguaaguggucacauauacacacaagguguaagaauaguaaagucucaucuuuuuuuuugccagaauuacauuguuuugcuauauuuucauguucugugcacaaauauguauguaugaauguauacauguuguaaauccuuuuauauuuauaagauauauauguauacauauauauauauauacacacacacacacauauauauauacacacacacaaauauauguguguguguguguuuuuuucccaaggacaaagauacucucuagcacacucucaauacagugcagaaccaugaacaaugccaugcuuuuguuuacuaugccaucucaagguuuaccgauuguccuuuccuuucucuucuaguccaauauacgaguccucagcaccuagccuuauuggauaaggauuccaacagccucguuguuaaccgaaacuccuuuacuucuuuuccuuguuguugcuggguuguuggguuuuuuuuuuuuuuuaauugguggugauuuggguuuuuuguuuuuuguuuuuguuuuguugguugguuggguuuguuuguuuguuuguuuggagacaggguuucucuacuuagcuuuggcuggucuuaaacucagggaucugccugucucugccacccaagugcugggaucaaaaggugugcaccaccauacccaaccucacaauuuaaacaacuuaaauuucuuuaaaggguucaucuucaaauauuguuacuaaccuauuggggguuauagguucaacacaugauucugagguaggaccacaauucaguuggcagcaaucucuuuagaaaaugacacucaucugaguaaugaauagcaagaagccagucaugccacaacuagugguggggcauugcagggagaagagacagcaaguacaagaguggccagggagauaaccuuggucaauuaaagagacuauuagaauguaaaacagccuggguaauggcucagugugaaccugaugacuugauuucaauccccaccccaccccccaagcugacaaaaaggugaaaagagaaucaacuccacaaaguuguccucuacccugguacccacaauccuacagagauggugaugaaccccagaggcucagagguaugaguccccugcagcuguugaauuagcuaauaaaauacuuucacauuugauucuuaaau

SEQ ID NO: 1086 - RNA, 32259 nt, Mus musculus
auuuucaaauagcguauggcuuuuugaccccaucaaauaacuuuauucacacaaacgucccuuaauuuacaacguuucagucauucauacacauuagggggaauccacaguguucaaggaacuuaaauauguuaucauaacaacccaaguaagccaaguacaaaaaaauauucauauaaaguucacacauagguccuauauuaccagcuucugugcaaaaaaaaaaaaaaaaaggaaaaaaauuggauuaacuaguauuugaaacuaaccuugugccuggcuuuaaaccucuuucaaaaccaaguuugacccacaugagcauuaagaguaacugaaauauccuccaguuuugacggcaaggagcccuugggguaaaaguguugggggggggggggggaaguccccuaaauagguuuccuuuuuccuaugaucucaucuggauuuuaaaaggcgggggggggggggaaggcccacuuguucuggcacucuccccaauacuaggggcccuaggcaaugaaugguagcagacuuggcccucaguaauggcuguggauaccgacaucagccaagaugccaguaccuacuggguucuccuuccagagcauguguccagacaaggcuccuuucccucaaagucaggccugugcugaccugugugcaugagcucggaaucagagaaggcagaagccucagccuccagagucugcuggccuggagggccgaagcagcaaucucagccaauucggagguagacucccagcagcugucuuguagggagagagauccagucacagggagggguaacccaaagaccugccuagaguugagcccccccagugcccccagauggggugggaggaagagagauggaagagcuccuggugggcagggcagggcaggaaggggcacaucagaguaaggcgagggccguacagucccuccugggaggacagcagucaaacucuugcucuucccacucuucaagauaccuaaagguuaaaagccauauucauccaucccuccgagcuaucuucucaaacaguaaacagcuaauagcaucaacagauucccacaaugcucuuuuccucuucuuggaauaagauucacacaaaacaauauaacuuuauugcugcaaaacacugguuuucuaaaauagugauauguuagagcugagaaucuuggaggaaggaaaugacaccauggggauuagugaggcaaaaaggcuaugaggaaaacagggaguggucucagcaccacaggguuaggaagaggagugagucaagagccucugcucccuccgggcuucuccgccuucaccaccacugcaguuacuacuggcagugccacaaaggaggccaggcccuauccagagucagaccuucaccuagugugagcguguuucuccuccagcuguaaacaggguauuuucuuuaaguaaacauuaaaacaucccucaggcagccaaagggcaaacccuacaaggugggacuggaguucuuacucccugccccagugccccauaagcuaggugaggcuagagcccgaaccuuggucuccagugaccagaggggguuagcuggugccaguuuggauggugcagucagugucguccuggcuagagcuaagaacagggaggaacaaaggcagugugcauaugugggcagcagcauuugguccuggucuaaagcugcugugagggccacggaggcaggcgagaggggugugugucuggcuauagcccacaggagguggcugggggcucagguuuccuucuccuguggcuauauacaggugggagacugugaguauaagugacaaaaugagccagaagacagccaccugcuucuggcugagucuggacaggggaagacaauggaauaaguaaggcacuaugaucuaucuauccugcgcucagaacugagaacugaggccaggcuagucucccaacaggcaauccucaccaccacccccaaaaggacaaacguuaagaguucugcaaacuucuagaaugugaacagauuuaacaaaccuggaggcacccaagaucagaugccccagagcuucuacuggcaagucugcaccccagacagaggcagaagagggaaguaacagaggaaaaggauguccaucuccaagagggacagggagcuggacucugagaagacugcagagcccacagggguccugacccaccagccacagcacagcaagcauguccuggggccagccugcagcuggcuggcaggugauagauagcagggacuacagggagggaagaaugaaaacagcaggaggaggcacuuggggcucaagacauggcucucacuggagccagagaaagaggugcaaucuccaggccagaagcagcugggauucauggaagagaaggugcagggaagcaggcuaccccucacuaggcuacccaccugcaaacugcagaggcuacacugacaccaagaaaaguacggugggaaagcacuauaacccaggccuuguuagagacgggaaagaaaagaauaagguagauagugagccuuuaucaggaacccagagcaggacuagagcaggaagagucgggguccugagcucagagacugcuuuucccaucugcucaggcacaaagagauugcagcacccaaggggagggagggcagcagaacagaaauggaauguaucuugcacuuaggggacgccgcuguucccacucucccaggggccacucugauuaggcucaggaggcugcuuauaaagucacucaaggagacgagaugcuaucacagugcagcacaagguagggcucccaccugcagucauguacccacaggaacagcagcugaccucuggccaagaggagaaagaaacuuuggugcugaguugccuaccagaaggcuggaaagagaaacguggacagcgcugcuaagcggggccagcugucagggucagcugugcuggccuucccccacgcugcaggaacaagggaccccugcuugagggaaagcucccccugaccucuuauaucucuauccacccugugcuaguuuaggaaguauaaacaagaaugaacacagauaccuucuuuccuuguccagagaccccaucccacaaggccagaacaaggugaaaagucuggaaaaguuuuggagcaaccaaaggugcgucuaaguagagggcaacaccagagagaaugguggguccaugaggcagcuggagggaggagaucuucccucaggaggcugucagaacacugcaaggagguacaagucaaaaugugugucgcagugcuuuauauggcuagcugcuacaugggccucuauuagccaccuggacacucccaucugccucagaccucccucuucaaggcagguccuuucucugcuuaucagacaacagugacauggagguugaucaccuaacaugaagucccuggggguaagagagauggcgcuugacagugucacccaguggugacacuagggauccugguacacagggcacaccuuucacugugaggaaaugaugucagcagccaguuaaggguacucugcaaggaucaaaacuggaucuugagaccuagguagugucugugacaggcuggacuuguagcacacagagaagacaauccaggagaggaugaaagguacuggucucauaguagugacaagaggccaaggaagaccaaguuugacaggggguuggcacaacaguccuaauagaagauaggcuugugcaaagaguggggauggagucucaauccccaagugaugggaugaccacucuugguuucuuuccucagggacucagggcaaaagagggaagcaaugcccacuacagggaguccugguguggccuggggcucucaagaacuuaacgagaaccaaacccaugguuuaggucuucuuucuagagucccucgggccaaccccugguguuccucuucugagagguucuucaucucugauccugucugaggccaggaccaaccagcccuucccaggagucagcagcucccacaucugggggaggcaacucagaggcugcuuccuuagcucuuuguucgcaucccuuuccaggagaaauaccaaacucuggggagacagaauucugugggaaguggggugcuaaagcagaacugagauguguguaaagaaagaaaacagaacgugaaagagaaaaccaaaacugcuuccuaacuuaagaacucaacagauuaacagugacuauaugcauaagcuuuguccacauucaauguucuuaaaaaaaacaaaacaaaacaaaacaaaaacaauaaaaaggugccuguccagaguguagccuucugcucuucagaagucuugaugguuuaauguuuagaaaaacaauuauuauucuacugaaggagaaagagaaggguagagugggcagcccaagcgugagcuucacauugugggagguccagcugucaggagaucaccaccaccuguacccucugccauccuguccgagacacgaugagacugugggucccgaaggaucgaccuggaagacagaaggcaggcaaggaauggacacuugaucagugggugaauggauagagccaacacccaaaccaaacugagcccaaagcacuguauacuguuuucuaaauacuuucaugaaguaagcugagcuucuaccuaccuucucacguaagaaaacuggugucuccaaggcccugugacuaagggaagauguggaagggggaaccuaaggcauguuggcuccagcuaccaagcugaucacaaauccuauaccuuuuuccuaacuccagcuucccuguaccccacaggacccauuccagacaggccauucucccagacauggagaauggucuugguucuccacucucaucaauaacugcuguuacagccuugaagcacccacuguaagauuuugcuaauaguguucagcaucugagaaccuacauacacuacauuaagcaacaaguuuuaaagagaccacauuacaucaucccccucuucccacccacccaccccuuggucagguagacccagagcaagguuucccagaaccgagugauaggucccacucugcccacagcaucaucuauugggguuauagcuaaguaaguguucuggagacaaaacugugucuuauuauguucugccagcugacuguacaaauucaagcccuuuguucuuuagucuuauaaccuaugucacaagagauuuuacaaaucacauaaacuaagcugugcauagcuuaaugauacaauaaauguagagcugucugaauaucagaguauacuuauuggaccaccauuguauacugucugcuauuaccugaaacaucauuacauauacuguacacacacacacacacacacacacacacacacacacacuacuuagaagaaugccugauccuggucccaugagcacuggcuguuauuugggaagugcucugaugugaggccucaggaauaaaacaagaaagcugcccuucaaggaaaccuagcacacaaaagccuauagagauuagccuugggucagccccauauucuaagccacuuaagaacauagcuaaguauagcucugucuuagagcaggucaucaggguagcaaugucugaaguuuucaaacucuuuacuuucucccuagacgacugaccuacacagguccuuuccuguacacuugccacccuucaguggcuuccuuguucucuagacacaucaagccuacugucugcagcgucagggaaagccaccaacaacccaggguauugccaaggauauuggaugcuuucuacaaacugaugggaaggccuauugcugaaaauaacacuuacauaucucugugaacacaagccaagcugugccugccuaacuagaaccuucaccccuaaacauggaaaacagacaaguuuucaugauacucagcaugcuaccaaagcagaaagagaagcacaagccagcuacaaacccuguuaucuacaaugguaaccugcuugcguaauacacuugugcgacaauugaaugaacacugugggaauaaccacauggacuaaaagguccaguccaugagauggaacccaagccugacacuucuccgguggccaagaagcugggaauagauaggcagaccaugggccuagaggaaaaccaaauacuauuguucugcuaaagaaaugcagcaauaguggcacacgccuuugaucccagcacuugggaggcagaggcaggcggauuucugaguucgaggucagccuugucuacagagugaguuccaagacaggacuacacagacaaacccugucucaaaaucaaaaacaaaaccaaaaacaaacaaacaaagaaaugcagcaauaacaugacuccuaacaacuuucugcuaugccauagaucaguguuuugcucagccucaccagaaaagcuuucuccugaaguagucgggaaccaauaaagagauucaaaucuggacaauaagagacgucagagcagauggaugucaccagggccuccuagacacaacaggacuguguuaccaugacagguccacacuugagagggucccagcacugagagaaaaccagacagcuucaucaauaaccaagaggcuaucuucauuugacaacagguagcaaaaagcaaaccuaauuuucugcaacauaguaaccauacucaaggacaccccacccuacgcccagcaguaaauagccaauauaaaacaaacucaaugguaugugaguguuuuguuguugcuuguuuguuuuuucuugucucauguugcuuuguuuaggcauuuuuuuuuuaccuuacugaucauuugcuugcauauuauggcuuccaauuuuguuuuuuuauuuuguuuuuuuuaaugagcuuuguguaugucucuguauguauguguuucuccuguuuuggguuuuguuuuguuuaauuaauuaauuauugggggcuggagagauggcucagugguuaagagcacugacugcucuuccaaagcuccugaguucaauucccagcaacuacaugguggcucacaaccauuuguaaugggaucugaugcccucuucugcugugugugugugugugugucuguguguguguguguguguguguguguguguguguguguguauaaaaauaauauuuuuuaaaaauuaaugggguuuuuuguuuguuuuaauucgccuguuugcuuucuaaggcgaaaaaaaaaaaaaaagcaguaguaguuugguagguagagauggagagaaccugggagaaucacaggggaaaauagucagaauauaugagaaaauauuucuaauuaaaaaauaaacaauuuuuuuuuugguuuuucaaaaauaaacaauaaagccaggcgugguggugcacgccuuuaaucccagcacucaggagacagaggcaggcggauuucugaguuugaggccagccuggucuacagagugaguuccaggacagccagggcuauacagagaaacccugucucaaaaaaccaaaauaaauaacaaacaauaaaaucagcaugcacaaaauuaacuagacccaaagucuguauguaaagaguaugcagucuagaaagaaaacucuuauuucugaggccuacucuuucaugaaugcaucugcuccccuacuaacaacaggaauuaaaagauucccccaaaaauccacuuggggauuucuucccaaguugacaaacuugggcaaaaacucauacucccugaugacuuggcagcuaugccagcuucgguagcuuuugccuguugcuguugucuguguucaguaggugaaacaagacagacaggugcaccuugcccagcgagcacgcacagcacagcaugcugacaggacggugcagaagcacauuuuaccaccucaacagaacagugaaggccaugugcuuggacucaaagcggcccugaaugccuguuagcugaugagcagugcaggucccagcgugugggcccuugcuuagcuccuaucaucuaccacaugccauccuuggcuccccuggugaccaggguuuuccuuguugcugucagugagacucauggcuagagcccuccugaaagucaaagccauaucugcuaagcauaaugacaaaugguagccaucuguaauagacuuuacaguuuguaacuacaucccacaauucaugucaagaugagccugaccacuuuucccaaagaaaaggugcagagagaagaagcaacuggcacacaucacaaaagugagacuaguaggucuaacuuaaccagaaccucugcagccuucccacuagaauacucacugugugcuucaacacuggugaagccuaauagcuuacauuagauucggcuugggauagaaggagaucuaucagguuuucuauaaauucuuaccuuuguuacuucacaucuuugacuaaauuucuuuguuacaacucaauuucuauauaacacaucuuuuguuuuguuuuuguuguuguuguuguuguuugguuuuuugagacaggguuucucuguauagcccuggcuguccuggaacucacuuuguagaccaggcuggccucgaacucagaaauccgccugccucugccuccugagugcugggauuaaaggcgugcaucaccacgcccagcucuauagcacaucuuauugagcacuugcaacuugauagguaacccagugaggugacuuucaacccuccugcaaagcuuuucaauuuaaauuugcauucuccagcaacucugagguaggagguagugucauccuggccuuaaagaggaugaugagcuugaaacuaggagaagggcugagucagcaguuuauacagaggccagucucuuuccaaagccucuacuuuuaucauauaaccugcauucuuucagagacaagagccaaguguuauugcuuaaaacacauuuaguccuuacauuuuuauagagagagcucagcaaagagcuuguggguuaggcaccugucuuaggcacuugucauaugcccagggacagccacaggaacuccagcagcuagcuccccugccagccgagcaguaguuugcucuacucagugagcuggggagacaaaucauuccuauuaaagccaucagcaucuuaagaguacagaaacuagaagagcaggugaauaaggaacagaaagacgugacuagagaugggacagugucgaccucccgcccuccccaugacagccucucguccugugugucuaagugucauuucuuuaaauaacuguaauaaguagagaucccucccuccucuggccccuaguuuauuaauauacuauauuaucuuaugaaaugugcuuagaaacauggcaggucaaauacaacuuucuccuccccuggcuccaugaaggaaaggcacaggcuucacaggaggcacccgaggcuucggagccagacuaucuaguacaaccaugacgggcgccugccucccacccuuuccuguuuuggaaugcagacagugcaaugcacacugaggucugcugugaggaaggagugagacuccaaucaacugccagccacccaucuucuucuucaccuauacuaccuggcucacauagcgacacucaaauuacugcacugucauguacuaguggucacuuuggcucuuagggugucagaccagacuaccuagaacuuauaacuuugcuuuauucuguagcccagacuggcuuagaccucagauuggucuuugagucaaggcaauccucagacuuuagccucccugagugcugagauuacaagcccaagucaucaugacuaacguggagucaaggcuuaauucaggaucuauucuguaucuucucuaugagcugagagaauaaauggugguaaacuccauucagaggauaguaauuuuuaccauaauggucccagagacaauucuccugccucagccucucggguauuaggauuacaggcauacagcuuggugucuagucagccuucuccucaggcgagagccuccuuccugcuucaggcuucggcucccacuguucugcuuccuucgccgucuagcugucaccuuagccuucccaaucccuugcuguaugcucccaggacgcacguccaaagaacagucuuugcaacgacucugccuuguggugaguggacgggccuaacaauuagccucuacuaucuacacuguggucugcugauucucuuagggcuauuagauuaucaaaugguguuggacgcuacaaugagcucauauauucaaugacugauagaaauugucaaaucaguauauacagcaauauauaauuaauuacaaacuucucagagauguuuaaaaggacagcaucuuaagggagaaaacacuguuauaaaaucuucugccuuugacuaaguuccuaccucaguacucaguacucacaccaagcuucugagcagccaguguaucgagggaaguguauucacaccuaugaaaacugggcuaauucucuucgcugacaucuagcaagaggcagagcuaccaugaagccugugcuguucuggcaccaagcuacacauuccuaggcucucucacaccaucacagcaggacagguaaaugcagcauauggaaagcauggacucuucugacaguuagacagguuagaaagagggggcuccugucuccuuuuccucccagcuucucagcaugagacccccaccccccaaggaaaagcggauucuacauucauguggagagagcuccugaagcccaaacguggcaaugcugacggggcuggcugcagauuaugucccuuggguagaagucagguaaaguacaugauucaugucaagagcagaauuagaaucuggcaaauaucuaucuguaaaauggcaaauaaauaaauaggaauuacuuuuuuaaaauggcuuuacucuccuuggcuggcaagcagcucaggagguaggaguguaguucuggugggaguagaaagacucagacuccgcauuccuacgucagugucagggggguugcguggaccgauagcagcucucaaaggaaacaagcaguaaauauccacuaguagccagggagccaugcucccauagucuacaucccauccaccuacuuuguucagccaucuggccugacagcuucucaaaaaagcagaauaccaccugggcugaaacacaaauaagucuugggcagauucccacgugcuggccuauucaaaagcaacaggaaagaccgacaucucuacuugacaguaagacgagaggccuggcuuccagugccacugcuucuuccuguagagacuucaucccgcccccaccccacccccagccccaagugcucagugaagaacuucauaagauggaaggucauuuauuccaaggcucuucuaaucucaggaauguaguguaaguucucaaaucccugaaaggccuuaaacucucacaguacauauguaaugugcaguuuuccuguagaccaucucccugcucagauucugagaaguacccacggcacaaugaguaaucaaagacaggcgcuugauuuaugcagacaaaaacuaaccagaggcagcacaugaacaccaagagcuugcagguaggcacagguaaacagcacaaucuguguggcugagaugcagggaauccagucagugaaaaacggugaggcagccucaacucaacaugccagagccuuuccuuggcuccaaagucuucaaguagaaccugcaacccuccuucaagggcacaacaccauugagagauaugggcuccaugucccaucgucugaagcugcauccacagcuaucuuacucccucagaaacacauuuuuaaagaaagcacagcugccaggcccaauggacaccugagcaagaagacucaguaagaacagcacacugcuagaaacaucagcuuuuccucaacugugucagaacacgccacagggcagugagugagucuauggcaacagcacaaggaggggcuuuuauacacggagccuacuucaucuuaguacgucagugaucacacuguacuacugacaucagacuauuuuaaaccaucugauuccuuuaaguguacugccaaacuugcuaguauuaaaaaguuuaccaaaugcacacaaaaaaauuacuggccaggauggaagauucuagacuuagaaggcuccaugguaaccaacaguaggcagagcugccagcugagucauucugacuguguguguaagagcuuggaaccacugagaccucugccuggccuugaaggaagacaagaggucuuagggcuggggcuggaguuuucuuuagcacuuuagcuguaaguggguccuauauuaaaaaagaggacauuuuguuccuagaaauagcucugauaaauagcucaguuagauaaguggauaccauaacaaauacccuucccucagccuauuaagugugggguugaaauaaaagcugcucacugccucaguggguccccacagaaccagguucaacuguagcugcuaugauuagcagaaaaaaggcuccagggaaaagucagggauccugggauuuccccaaaggacacuuucccaccaggaggaagccaucuaaguccuuguuacuaaaggagaggucacucuuccauguggugacaggacaauuugugguuuuaaaaggaaaggcucaaggccagaaugaucugggcaaaacauugucugguuacagcucaaagccgagcaugccaagggaaacucuugggggcucuugcuaaggagucugaggcuuucuuaggggaaagaagggcuccacacaucacgagauagagagauaaagucaaauucaugcuuagccuagaaagguuuaugaaaaaccagaaccacgguggggguaaaagggaacauggcacuucugaauucuccacuugcugagcugcaaugaagaccauggucugagcaccaccccacauuucacacagguaaacaacccagagagagaugagcuauccaaagccacagaggcaaaauggguagugugguuuaaaugcagauuccacaaaucccuaaaugucaccacugugaaaacacagggcuuccuugaucuuggcugucuucccuccuucacaugggacuguguaguuaguuucaggcccuccauacaaguauccugccagauguggugcuguagcuccuucccagaaggucugacccacccuccuaaaauauuagaggcacuguuccacccacucuccaaccccaccuuauaugcaagaugaaguuccuccuccuuaggcugacaucagagccccuggcagcucagagauaccugaccuuguaugagccaagccaggccuaagcucuuugcauauacauucuuggugccccgccaaugcucacucugacuucugcucaggaucccggcugauggucuuucuccaagucuaucuagacaaauguuccugucaccuacuucaaaagacaguacucuuucucuaagcuucuaguggccuuuaagacccuuggguugucuacaugguccucucuuugggagcucaauggagaggacccugggcuagcucuagcacuugagcuagcagaugucacccacauggccaaaucacuuaacuuccucucuggaauggaagagagcagugggagaaagggcagccacagcaaagauacaaguaagacuuuaacaagcuaaccagugggaggacagaacauggcacacagagcaagcugaagaagcagggguuccuuucacaccccacuuaagaagccagcuuguuccaggccagauccucugcaacagccaacagguaagugcagggcuaugaacgcacacauguucaucauguacacagaaagagacccacagguuccuggguuccguugcaaacaugugccuuuccuuuguaccaucggccauuuaaaccaaggugugaaaggauacugaaagacagaagucucuucuuuaccagguagaggucaaguuaaggcuacagagcaucccuaagcuuuugauaauuguacucagucuuaaaggcagcugaggaggacugugacaauggcuugaaauucucucugaugggaauuacaauucuugcuuauggcugucguaaggucuugacacugcuaaauuggaaucaccuucuaacacuguaucccccaaggccaaagauagggacugcagaggacucucuuuagucugccuacagcaucacaccagcucuaugagcaagugcucaaguggaauucuguaucagugggauggagcugcauguucuccaaagccuuuuuauaccacacuagaaugaagcugggcccugcgauggucaaggggccucuggacuuugucaguaguggcagcugcgcuucacuuucaguacuuggcuuaaaccccagaacaaguuucauaaagguaaaaagucacccuguuguuugucuggggugugguauuuuucacacccauuucugcugccccaugcaaaccgagaguucuuuccaaacauucaccagauccaaacaggcaaucugguuacuaacaacaaaugagucuuuacuugugacuuccaguuuucuuuaugucugguacaagggguuggguccugcuggcgaguguuugugcagucugccaagaucccacagcagcacccuccuacuccaugccugaaaucuguccuagaucgagggcaugucuuuggcauguccaauagaaagcaaaaaaggaaaagcaaagggcuguuauauguggaugcuaaggggucccucucccuggaggauggagcuagguacaccuagcuagaaucaaccagcugccucacaucaccuugguaauuuuacucacuggacaaaaugauaaauacuaaaacccaaaaugauacagccaaugguucucccaucacugcuuuaggaccaugcuucugaguccaggaaaaaaaauucaaaccaucauucauaagacuccuuccuucccucagcuucaaaucaagauuaguuuuguagcuggaaaacaagcauuucuaucuuccuuacuauaccuuauggggugccaggguagcucuaacacagucuucccaagucccuaggcaucauuuucuuuaacaaagaaacaaaauacagaauucuuucugaccuguuuauguugcaggcugaguuacagcuuucccuugguagcucuuacugaaagugaaauuccuuuaaaguugggaaauucauugcaguguuuuauaguauugauuuauuuuaaacuugguuggcauuuuuaagaccugccaugccucugagcucuagaaaugcugaaagaaaucuauuuuuuuccuacuuuuuacugugaaguauuaguugagaugaaaaggggcugacaacuugucuguucuuccuuacuuugucaagacacaaucuuggguacucuccccaggccugaaucagcacuugggaauggcaccuuucccuucucgacagaguaguccugaguagccucuucaguacaugcccaaguggucuccucacaucucaacuaugauaaguuauuccgaagucccucaagaaccaguccuaacuacuccuccacaaagacuucccugccauccacugagucaucaccuauaacuaaccugcaagcucucaggagacagcaauaacaucuaaaugaccaaugucaccaauggacugcacugccugcuugccuuggccccagaauuuuucaacacgggguugcaggcagccccacccauaagagcagacauucuugaggacaucgcagcuuuagucaggauuugagagaauuaagagagcugucccugagaauuacagcaacccugcuguucuguucuggguucuugucuaccugaaacuucuggcuaauucuugagaaugggucucagaaaggauguuauggcagcuucuccucuuugcaagcugguacugcacugcuccaaugaagacacuccuugguuauaugggugucuguucuaggcugccuucccugccaaugucuagggcagugucagaguaacucaaaaggaaucuaucuguacacaggcugauguuaccuaaagcaguggcugggcuggugguccuguugugguauacacagccaagagcagcuguugcuguggaggacacccacaggaacuguauauuauauggcaggcaaucaguguaguuuuuuuaccugcuucaaagcaugaacccacacaggugugguuuucaagagacugcagaaggcagaauggaaggcuggaaccuccaaccgcaaacuugcaucaaauucugacucucagugaaccacggcucucucauguacagaaugaggacaaauagcauaacgagauagaugauguagagcagaaagcacauaacaacuuaucccugaauaaguucacucagggcuagaaauaaagagacagggccauuggccccaacucacaggccccucaaacaggcuucucugauagcaugauucuauuccuuaggucacugggaauaucuucauguccucaaggucccaagagauucaaguuggaagaaaaccaaacauucagacagcuuugcuggcagcugaacgauuaccaucagaggcccgagauuugccgaagggaugaaaucucugcuggguggagucaaggaugcuagagaaagcccuaggagcagcaucugggccuugcuaccaacagccccagggcaagccugcuccuuccugaugcuagcauaaccgaggaccccuggguggguacacaacuguuaacacaacuaacacuuagguuuccaccugucugagagcaggagccacaagaggugacaacaggaucccccaggaagcugccuggaccugcuaucagccuuccucaucuguggaggaaaacuccaaaacaccuagaaagacaaggccccaggggacauguauacacugguaccuaagccaaagucaucacagucaagagcaaagcuucuauuuccuggaacaagggagaaccaaauauggcaucucccccaacguucucucuugguguauagcugugaaauacuggggacacacagcccugacacaaucuauacagacagggacucagaagagacuaagacagagaggacaagucugccaaaacaaaccaucugcuaacugucauggucugaauaggcuugugacucgagugucugaaagcuuggcuauggagaguggcucuacuaggagguguggccuuguuggaggaagaauguugcugugggaggugggcuuugaaacucuccuaagugccuggaagacauucugcucuuagcuuccuuuggaugaagaacucucaguuccuucuccagcaaccggucuguuugcaugcugccaugcuuccugcuaugauacaggacuaaaccucugaaucuauaagccagccccaaauguuugccuuuguaagagcugccuuggucauggugucuucacagcaauggaaaccuuaagacacuagucaauggauccccuguggccaagugaucauucuacuuaaauaaaagccucguucauagguacagcagucuaccucaggccacagagugucaagucccuccuucagcccacacaccugaagggggaugugcauuguggccaauucaaugcuacacagacuaaagcuaaaaacaacuucugagacagaaaccaaaggccuuggcccuuuagccaccauaccuuuccuugagacacugcuugaaccaggacacuaaaucucauugaagaaacucuaccaugggaaaccuaccaaguucucuagccccugucuacacuccaaaaugcuuagagcuaggacagcaaaauucaggcugguccaugcuaaauuauucacugaauucgauuaugaggauuucuuaaacuuacagccuaaacuauacacuauuagcucuaugaucuucaucaacaacaaccaggucuaguucuuugauauuagauaacuacuaagacuucauauggaguaaggcucuauucuaugaccccaccccuccacagacacuucaagucacauuaacaucugauuuccuucaacaggcuuuagcugcccauuccuaucacccaagagcuugacuucaaaaggucccacugauagaaauguguaugcuggaccucaggcuuggcuauuaaggcagaggcccucacucuuaucacagcacccuccugguaaaguaugagcuauggcacaggaccaucaguuugacuggauaaggauuguggcagauaguauucauuagauauggcuccgaaaagugacaaaucggcuguauugagcaauuguuaaaugcagauaugccuuucuaaagcaaucaacuggacaagucggcuuuguuuuuaaaggcaaaccucccaacguaaggcugcuaugcaucaguaugcuuccaucuccauaaguacacaccuaaaaccuacugcuucacuaaaacaauuuguuuggggcacuucacaacccuuauaaaauauacaugguuaaauccauuuugugaguaauaaaaccaaagcccagaguggugaaauaaccaaccugauuaucacauagccaauaaaacacagaaauaagacacaaauccuauacuguagccaauuaucucugcauaggaauucucccuucucccucuucucaccgcugcaagaacaacugcucuuugggcacauacccaacuguuaugugaugggauuguucauguuggacuggggcuaggcaugcuuaacauccccagcaaugacacgucugauagcaaguuaccuagaauccagcauauucaaguucuaucccuuaauuugggacaauccucaaauauauccuucucuguguaggauucuaacuaguacaugcuucucagauccuuccgcaacacaguuccucacagagccaucagcauugcugcuucucuaccugcugucugagacuuagaaagcuacgcuuuucaugauaacaggacacuguuugcccuuuucacuguccuucucccaauggagucuuccagaaguacacaaugagcugucuaccauauuacaaugaagaacccaaugagauuauuaaggcaagaauuaaacagguuugcaaaaacauugcuagccacccuuaauuuuuagaaauaguuauuuucauaaaauaugauuacuuaugacaaaaacugguauguuguuauuaauucauucaucugaagaaaacauuaaaaaaaauuguuucuugggguuggagagagcucaguaguuaaguggcuugcugcucuuccagaagaccugaguuuggguuuuaacagcuaaaucagguggcucgcagccuguaauuucagcaucaggggaccuucacccucuucuggcuuacaaaaugccuuaacuaauaaacuccccaaguuucgccuccugagcagccguguguccugagguaggcagaauggggacccacaaccccuuccaacucuagccucugauucucaaaacuaagcagcagcuacagcucaucugacaacugaagccugaggcaccaguuacacagcuggggcccaucccacaauucauagugcucagccaggacagggcaaaacaggccaguaaaacuggcacuauaagcccagcaccaaccaguugucggaacuacagaaugaacggacaggagcgcuugcggcacauacccaaaacccaguccccuccucucaagcucaccuauuucuuuuauaucaaguuauuucuugaggcuggagagaacucggagguuaaguggcucgcugcccuucuggaagacccgaguuuggguucuaacaccuaaauuaguuggcucacacaaccuggaauuccagcuucaggggaccaucacccucuucuggcuuacaaaacgccuaacuaauccaccugacuucauguuuucuuuaggugcaacuuuguccuguaaacaagcacaaaucucaugugcugaaccaaauagggguccagaucucaacucagacaaucccauaauccuaaccuaaauucagguccuuuccccaauggcaaccuuucucuuauguaaggaaaaauugaauuccaagaggucuuucagaaacgcaaaggcuaggauggaaauggaaagcuacagucagggaacuagccagccacgucuacuaagaacaggacagacgcaagcggcccagcuaagcacaagucagcuuugcagagguucagaggaagcagagucccgugccagagaguccauccuaugacaggaacaccagagcuacccaacccgagacaucagaccaagagcuacagcuuauuucuacccuaucaucuugauaauccaggaaaaggggacagguagauugguuaaggccuuaauuuaugagauaugauauaaaacacuuauaauauguguaaagauaccuagcauauaugaucaauuuguaauguccugccuuguccaccacaccucagacuuugguacggucuaacuccuuugaacagaaaagucaaacagggucuggagaggugguuuagugguuaagagcacugacuacucuuccagagguccugaguucaguucccagcaaccacaugguggcucacaaccaucuguaaugggaucugaugcccucuucuggugcaucuggagacagcuacaguguacucauauacguaaaauaaauuaauaaauauuuuaaaaagggaaaguuuaaaaaaaaaaaaaagaaaagagaagucaaacaucucuggauacuuuaucuguucuuuauccuagcugguccauguucucuauauuaucuguauuccacacuaagacaaauuggucuauucucuauacauccuaauuuccuccaauaucaggucccauguggacagaacuggauccaugaacaagcaagcacaguugggacaaagugcuuucucugaaaacuguauuccucucagcaccauuuuauauggagaauucauugauaauaagaaacaguuucugaagaacuugaaagauucagccucauauaguuuccucuuaaaacacuucucuacauuucuuacuuuguaaucagauaaucugaccuaucucuacuugccaagacuucagagccaaucugugucaacaagacuuacuuccuggcccugaauuuucucuacaacuccagaguccagcccagggaguguguaaguacaauaacaaaagagcacucaccuaguuuaaaaacacccaagacguucagcccuggaguuuaagcagcacaugugaccugguccauucggguuucaaguucaaaagcaucaggucgguccuguggguuagcagcuaacaugucuuucaagagcugcuugacccccucagacauggaaguccuacguuucugggggauaugcaacuccaucuuuggguuuucuagcagcgccucaccaacagggacgaucucagucccuugcuuaauguagguccccaggagcuccuucuugguuucagagucaauaaagguaauucuuucuaucauugcccagaugauaaugcccagagcaaagauguccgccuuggcuguauagugucccucccagacuucgggagccauguagaagucugagccacaagcugaggacagccaguauuuauucacauucacauuuuuguuaucuugauugcccucuuugccucggggugccagcccugcacagaccuugcucaguccaaagucugccaccuugaggaugggggugccagaccgcucugugaucaggauguugucuggcuuuaggucccugugcacgaugugguuuuuaugcaggaaggcaauggcgcuuguaagcuguagcaugaaacuuuuguugguggcugggucaggucuccgggacaggacauacugauugaggucuccaccuucacaguacuccaugacaaaccagagauagcagggcuccucagcauagcccaggauccuuucuccuaaaccaaaggacaggaaagagcuugaguggauauucagauacuaucucaaucaaagaaagaagacggcgacaaauaacugugccaugaggaucuacacaacuggcaccaagcaaagucuaugcccgcaguccacuucuacccauacagacuaagucaaaguauggcagaggcauucgggcuggugucaagcaccugggguuugaauuuaagacucuacauuugcugccaucuaguugacuuugaggccuucuuguguauuuuuauuuuuugaacugguguaugauucuauccauucucuguaaggcugagaacaaaaagcaaacgagauuuguaaagugcgugcugguucuacuauuaccauuuagcuaucgcucuagcuucuaugauuccuaaucuauucaaggcauauauguucuugcucuucuuuccugaugcaccuaagcauuuuuauuaacaugaacaaaaugacauuacaauuuuauuucagaggcacacuccccuccauccauaucuucugcuuguucaucauaugccuacuccaagcucggucugcauuacacccccagcucuaugaaccuugguuuaacagguaccuaugacagcaauuaucuuaaauggaaugaugguaauaaggucaacuucuauagaagauuggcacacacaugcaagaacucuuaggcugagaugaaaaagauaaugggacacaggacaaguggaccaggagguguaaggaaaugggggaugcaguugggaaaauuuaaccugauggacagugaaauuugaaguagaugcauaaggcagaauuagguuauacaaauucaaaaccaggaaagcugguaacuuuuuccaugucaaaucaaucccaacgugccucauaaugcaacauagagcuuaugugugaguuacuggaugacaagugcccuauaagcuagguccaaguaggcaaaugucuaguuuugacaauagaaagauugauaccgugugugcaggcacgugccuuuaauucugauaauugggaggcagaggcagguagcucucuaggaguuugaggcccaccugcucuacauaguaaguucuaggacagccagggcuacauaguugagaccuuaucuaaaaacaaaacaaaaauggaaggaagaaaaaaaaaggaagacaaacuauacauugacuggcuauuuguuaagugaaucaagaccugaaaacaggucccuuggcucagaguauacuaugucccaaaagaaaaggcuagcacuuccucagccucuagaaggaggcucuuuuuccuagccauuuacuacaauaucauacuacagugauacaauaagccaaaugaaucucugcuuccccacuggcccuuaaaucacuaauguacaaacaaaaucuaccaaagccagagaggcaggaagagacauggcaaauguuuuugguuuuaaacacagaccuaccuucccuuguaauuguacaauuuauuuguuuauauuacucacaaaguaauacaaacagaaccaauucagggcauauggcuucuucuuaaaaucaguguugagcuguucccucaacccccacucccuucucuagaauccucuuuuugguugcuagcaagcaggcuaagucuaccuaaaacaaaacaaaacaaaaccaaaaaaacugaaaaaugaagccacaaccugaggccccaccuagaaacaaacagaaaagggacagcaagaaaaguuccaaaacaguacagccagggaggaaugccaucaaauuccuucuacaaagaccacauuacauagcaaugaaacuucuaaucugagauaugaauagggaaauuauuauuuuauacacaaaacugguaacuaugguaacuaagaggaauaaaagaaaacaaguuggccaaaggaacuauaacacagaucuagguuguaagaacuggaaaaaagagucagguaaaaagcacacuaagcugucuacagaaggggcagagagacucuaaagaugcgagagaagccccaggacacaugccaacagaagcagcaggcucagagcccaucaacaucacugagcaaacauagaacacugcagaaugacuucucuacgcaggcaaggguagggcuuccuucagggaagagucugagucccagccacccacccagagcacaggagagauguuaguuaggguuccaguccuuccuucaagugacuaccugccugggccucugccagcuccugcccaagaccaagggagaagccaaaacagugaagaaaccaggaggagcacagagaaggaagcagucaagugaccacagaccccucucccaaccuuuguucuaacggauuguuagcucuuuggcacaaacagaagguaaugggaaccuugggaaaauccagcauucuuagacauuaaauaugagaacuuaguauuaugcagagcauaaagagacuuuuuggagaauuaucuacugaccauuacuaacauccucaucaccacccaaaacaagguccuucaaaauaaacuggagguuggggggugauggugaauccagaaaagggcaucagauccucuggagcuggaguuacaggcagcaguaagccaccuaacacagauguuaggaaccaaacuaugguccucuggaagagugagaaauccucuuaaccucugcacuuucucuccaaccccuaauuuuuuuugguuaagacagucuuaauauguaucccaggcuauccccaguacuggaauugcaggugugccaccauacucagcuugaagaucauugauuucaauaaucauaauugauuucaauaacuauacagguuacagaauguuacauguugagcaaaagauaaaauuuagaacaaaaaagaaagguauauugcuccgucuacaccacauuuuuugggcugugacagcugaaguuagaucagcauagguuaacaugcaagggcaagucuuggucacuggauaaggaaguucccucuggagguugagagccagggaagacagaugagcaccuaagaagucauuagaagguucuguaacagagugaagacagucaagcggggaagcuagagggggcagggucaaggauuugaagguuuauaucagaauuuaguaacuaaucuccuaugauaauuaaucaaagaauuaagagcacucuuccugucucugccccaaacuguaauucugacaacugcacccuuaauccugacaauuacaccccaauuucaggugagacgacugaagcucaaaacaaaacuauuugucuguaaucuuaaagcuaaugccccccccccccccacaagacucagaacucuucacucaaagcucuauugcuucaaggugcuagcagcaacuuuacucuuggauauucuaguucccaugcuacacaacacauguuccuuauaugcaggcucuugcauacaccaaacaauuuaagcuucaagucccuagugcuggauuauccaacuauagaaaauacagauuccuuuuuaugguacaggauuuugauuaacuuaaaugugcuuugugaaagcuacucaacaggauucaacuaaauaaggaugagaauuugagucacucaggaggguuccugcccuaaggauagggcuggagggcaaacucaaggugaacugauacucuacuggggaaguuaagaucucccucagaguuuacacuauaaaaagccuuccccauugcaaccccaauuaaccaauguucucaauuaagacagggcggcuucuaucuccuggggcuagucccuaaaaucccuacacauagaaggaaaacacccaguagcaaagagugugcaacugccccaaggcauccaaggacagaucagaagcaggaacggccucucuggcugcuaugcaggauggcaccaaagaaagcagugcaauaagcacugauaaagcauaaggaaacaaacagcagcaaucaggaugcaugacugauguaguaguauuacacucuauuaguaacauauaauuacauauauuuuacaagcaaaaacccaaaccaaaccaaacaacaaaccacaacucuaaccuugaagccuuguacuuaacauacaccccaggcaguuaaaagacaagucagaauccuggcuagguuauguuuagcuauuuuacauuaugcaacuucaacaguuuuggaugucuaaccuucacaacacacucauaguauccauuugaaaagauggccaugaaggcugaaugagcuaugguaugaagccuuuacaauagacacauauauaucaucaagguguuguuucugagacagggucucagucuggcugaggacucacuguaguccuggcugacucuguacucaaagcaaucuucuugucucacccuuaaaaagaugggcuuacaggugggagccaccacaacuagcuucauccaaauuaggaauaaaaccuuuggacucuaaaucauuguucuauuguuuuccauuaauucugaagguccccagugccacuuuaucuacuucaagauagucaaagaucauccaauucugccuaaauggagggucucuaaauuccaaggcccaagccucaguaguaaaggggaagccuggguaaaagaugacuacacugcuccgagccccuuagguuuccuuaggcacuccguagccaggagucuacaguuaagucacuucuagguucaggcucccuugugucagcuacuuuugccugcuuuccuaggccacuaaggaaacucucaaccagaaccuguuuaauaggaugccaccacuugcgaccuugcagcauaaucgcuuagguguccccucuuaggaaggaaagccugcaaagccucuuaaguggcauccuggcucacagcagcacaggcaugugcugacucacagcagcauggguaugcagggaagagcccaggucaagcccaucuggagcuaugcaaacacccugaguaacaucagggcucaccaucaaguuaagcccgucucccagcuuuuccacauuucuagcuuuaugagagcuaacccagaauucauguguuugggguacauaaaggucaaucuuuuugucagaaagauuuagacuagggcaacaaauuucugagugcuugcuauuuucuaagugguaaugaccuuagacuuugucuuggguacauucaggaaaggggcuuuuagggauggaaaacaagguggcaaaagcaacuguugauaccuuaauuccccuuuuccuugaaggacuuuaaguugaagacaucaagcuaauuuguaggcuuuguuuuaagcucuagagcuaguuaguguugugccaguauuucauuuggggcaaguccugucuccuuccagagcuccuauuucucucuuugugaaauacagacuaagggcugcggacagaacccuguugggaaaguguuugccuagcacauacagagcccuagguuuaauucucaacagcacauaaaccaagcaugauagauuggggcuaaaguucucaaggcagagaauccuuaguucaaagucaucuugggcuguguaauagccugagcuacgugagaccguaucccccaugauauuggccccacauuguuaugagacaggaccagccaggcaugguggcacacgacuuuaaucccagcacuugagaggcagaggcaggcgaauuucugagcucaaggccagccuggucuacagagugaguuccaggacaaccaaggcuacacagagaaacccugucucaaaaaacccaaaaaaaaauuaaaaaaaaaauaaaaagagagagacaggaccacacuggacuucugagggcagaaaagaugaauuugaugcacagaugcuaauggacuggggauaugaucaagaacauaguuuuguguucuuuuuuaaaauguauuuuggaaaaaaaagagagacugauaaaugcuagugaugaagguuagaggauguaaaggaacuuggaugaugaugauuuaaaaauaaaaaugcuucagaucaacaaaaauguauuuuggauacuuguuuguauaucaaguuauuucaguaaacccuaaaacugcuuucugcauauucacuagaagcugaggugaggaggagguaacugucgucaggcacuguccucucaagaucaccuucuuucuaaccauucucuucuucucuuaaaucucucuccaacccucugguaaugagcuaaccugucacccuggacagugacccuaaucacuauuuaugccuuuaaacuuuucaauagccauaauguguuuuguuuccuuuuuucccauuccaauacuaccagaggcaugcagugaaucacucugaauuacaaggaacagggcagaguaugguugcaaaggacuuugggguuaaggaaagcuuugguaucgcuggacaucaauagcaugcuauaaacucagggcccgaucaagacuuggauacuuaagucaagaaaacguacccuggagaaauuugagucucuguuuuccacuuuaaugcuagcaagcuauguauguauuauccacuaagcagacguaugacauguaagcuuagcugucauuuucuagaguagaggcaauacauauuaagacucugaauuaaaacagggaauauuaaguauguggcccacaggggaaaaaauucacuaguuuuagcacacaaaggggggaugaaaaaacuaggguagcuuucaaccuacuauuccggccacacaggcaauguguuccauagucaaaguuugggaaacuacaguaagaacccaaaucucuaagaagaugaagauggaagaaauucagaaaguagucugaacguaaugaggcaguggauucuuuauagauuaccgacguucccaacauguacaaccucuuggcagagauccccaucguaggauaaaggcacacacacucccuguggguugucaacuugccauguuagcucagaacaagcaacgacugcauguaagucccaaacuccagggaguuaaacacuugcuacucugccacuauuuacuguaaaauucuuuuuaaaaugcugucugugaagaaaguuuuaaaguauuuguguauuggaagaauuaacaaggacugcuagcuuaaguuccaguuucaagcuggcaacaucaaugaacugagguuagaagauacuguuuggcaaugcaaauucacacagcccaaggcaguuauugaaauaucaaccaaacauuugcuaagcauguuucauucauuuguacucaaguaaucgguguguaaaagaacuaagaaaguaacugaugagacugaaggcaaaguagaaggugcuaccuaggaaaucuucaaggauccacccuccuggaaaugaugacaagcaggaugggaaaggcccccagagaauuccaucacacuauccaauccacuguuaaaugacuuuaaaacucugcaaggaguucuccugggaccuuacaauaaaaucugacaggugcuccaaaaagacuuuaggaaaucuagcccuaaaucccacccagucugcuaaauucaaccucagauagggaaggaaggcagcaauauaucugcaaagaucugugagggccaugcuggcuuacaaauacuucaaggacacaggaauuuggaggccggagucccacucuuucaagcugauuaaccuuaaucgagcuguguuugugcccacuaggcugaguuccucuauuuauagagcagaagcuuaauuuacuguuacagauauuauccaaaucguagcgcucagauuauauagcugggauugcgacuguccaauuucccucgcccuacccccugccccaggaacucaagacacuugcagcccacugccucuucucuaguuuacacaggaaggcaagguguuuggccuccuggagccccaugguucugcaacaaucacugcucagacagccccagggguuaugaaaacaacugagauuguaacagggcagggaaagcugcaaccuguuuuguuaugcgacagcucuuggcccaccugaggggguuauuacugggugcgugaguuauuaaccuguggugcccucagggacuaaaccaagaaccaacugaaugauugucugcucucgggugaaggguugggguucucggaggaaaccucacacuugaagacaagguuugggaacagaauuggaagaaacuagaaaucaggaaaggagaauggcaugggugggucugcuacuuuuuuuccccucuagguucugaugagaaagaggcaugagggggcuucugcaguucuaccaacuacuuugaaucccaccaggacuacucuucauccaucuuuuaaaaugcuaggcuuguaauuauggcucacaccuacugagugaguacuuaaaaagaucaagguuagcacuuggugagcuuguuagggaaugucagcuaacggcuggggaacagacugauuuccuagcaagaaagaaggucccaaagccgggucaaggaccuuagcgagccagagacaguuauuagaacugagugguucugagaacaaggggguccaggagagggcaggacugccggcuguagucuaccuuugagcgaggucuccaccaggcgcagguaaagcugugaguucuuguugccgugacucaugcgcugggcuaacccguugcgcuguaggacgcacuccucaaacugcacgauauucuggugccgccgcuugagacuggugagggcccagaauucugcuagugccaacuccacguucucgggagcgucgcagcggaucuucuugacugccacccuggccccacugcgcccagccacagccucauaaaccacgccguagcugccgcgcccgaucuccgccaagaggcuguagcgcggccgugcaggaacauccccgccgccgccauccggccgccgccgggccaggaaggccucgcccgggaccucggccccagccggauccauggccugggccgccggccucagcuucucgcacaguacccgcuggacugggcuucgccuuuuccgcuccgggcuuuuugucccucugcgggcuccguucucuuuccccguuuccauggcugcggggggcggggggagcagcaacggcgccgcccgggccccccuugccucaucccuccgucuagccccgagauguggaggagcgggaccuuggauggugaucuaagggcgagagggagaaguuaaaacccaccgggccgagaaggguagaugaggaacuuaaagcguccggcgucccaccuccgccgccggucgcggccccuuuaagaaggagccaccgucucgaauugaacgggggaagggaaaggaaagcgggaaagacggaaccaccgggaaguaccgagggaggaccggaaaccgaagcgcaaaccguccccucucgccgacuuauccgucaggagcagaaaaaauaaauaaagccguagggaucguccccaucgaagacggccggcuuaaacuuuccuggggcuuagcccccucucaacggccccuccccacguccuacccgggcuucucccgguguaaacagucccgugaaucaaacccaggagagcccggcgggacgacccagacccccggggacagcgggcgaagggaaaccggcuaaaagaucggcuuccgaggacgacaggcggaggccccggugacgcccccgggacuacgguggggcgccggggcucccgcuucggcccucccuuccucccuccacucccucuuaccuggccggcgcuguuccucuuccgggcgaaccgguucccccuuggagcccgcgccggaggaugguccguuccgagccgggcuugucugcagagccggguagggcgcgaggcggggagccuggcugagcguguagcgcgucgcggcgcugcucuugugaugacagcaacgcucccgggggaggccucggcuuccagguucccguggccguccccgaguucacgccagcugagcacuuuacguaaccucuuuauguaagcugcaccucccgccgccgcucuggucagcggagauuccugguggcccaucccccaggaggccagcggagagccgcgccgccucucugcagccgagguagacccagccgccgcgacagcccggaaccaaucacuggcgagaacacccagccaacaaaaagagcgcgccaaaaucccgcgauuuguaccgagggccuucgcgaggcgccugcacuccgcaaacgccuuuccggacuugaccugcaucguaccucuacgcccgcacucggcacuugaugcugauugggggaauggcuuagguguaaucgauucacagcugagaccaggguuagaacgcuaaucuccacgcccacuaaugaccccaaugaucucagccgcacuuaauccucaguauccuucucugccaaacccgggugguccgcacuuccaagguugcaaaggaccaagugaaauaugauggcuggcuaauugagugccugauauaagcugcuuugggcuuggauuuugauacccuucaccccggccgcccauuguggugggagggagcacaauggcuguguag

SEQ ID NO: 1087 - RNA, 3337 nt, Mus musculus
ucucuagucuuucccuguuugccuuguaggacagagcaucugcuagauccuuggauuuccuuucacagcugcugcuggccguuguuggagagcuggacuacagacuuggaaggugaagcuuauuguugaagauggcagacccagauguucucacugaaguuccggcggcauugaagcggcuagccaaguaugucgucaggggcuuuuauggcauugagcauguguuggccuuggacaucuugauccggaaccccuguguaaaagaagaggacaugcuggagcugcucaaguuugaucggaagcaacuucgauccguuuugaauacuuuaaagggagacaaguucgucaaaugcagaaugaggguagagacugcugcagaugggaagaccacccgccauaacuacuacuucaucaauuaccgcacucuuguuaauguagugaaauauaagcuggaccacaugagaaggaggauugaaauggaugagagaaauuccaccagucgggcuuccuucaaauguccugucugcugcagcacguucacugaccuagaugcuaauaggcuguuugaacccacgauaggaacuuucugcugcaccuuuugccacacagagguagaagaaaaugaaccagcaaugcccaaaaaagaugcccgcgugcuuuuggcaagauuuaaugaacaaauugagcccauuuaugcauugcuucgagagacagaggaugucaacuuggccuaugaaauacuugaaccagaacccacggcaaucccagcccugaagcugagcaaggaccgagcagcaacugcuucuggagcugcuggccuggcagguggaugucaccgggaggcgcagaccaacaaagcccccuccuaugaggacuuguauacucagaauguugucaucaacauggaugaccaagauguuaugcaucgcaccucgcuggaagggaaagcugccaaacagagacccguuugguugagagagagcacggucccaggggcguacaguucugaagagaugaaggaagguggcauggauguggacacaguucaggagcacaagcaagcccacgcagggccugaugacaaugaggcggucaugcgcguucuacguauucaugagaaaaagacuucuucggcgaccacagcuggcucggugggagcagaggcucuggcgagggcugcuaauaacagugacucugagagugagaccagugagucggacgacggcuuuccaccccggccagcagcugcggcuccuccucaucaccaugaagaugaggaagacgaagagcuugaggaaguagcaggugaccccauuguuaugguggcuggcuguccauuuuccuucagugaaguuagccagcggccagagcugguagcccagaugacaccagaagagaaggaagcauacauagccauaagucagcgcguuuuucgggaucucuuugagugagcuuucccugcuuuuuccugccguuagcccauuucagagagaaacuucccaucaagugcuuuaagggccuucccaccucuuuauguaaagcaccuguuaaucuaauacagacgcauaguaagagaaaauuugauuuaauuuuauuuauuuauuuauuuuuacuguaaggaacaucccagaaagguaggaagguuauauucaguucccuuuuauuacuaaaguauuaauaucuuucucuauuuccuuaucuauuuuuuuccuuucccuuuuaagacauauuuuucucacucugacuaaaauguuccugucucuucagaacccuacuuuggauuaaacauuuccuagucuuguagcugcacuguggucaggcauuugagacaauuccuuauauuccugucaaccaaagcagcuaaccaagaaacagaccacugcuuaggggaacacccaaacaugucaucuuccucaaaacugagugugggguccacucuccuaggaguccaggagaaaggggugccugaaucucaggguuguguguaaacuagaauccaugucuguaaaacacauauggcugguagauuguuucauuuucauagaccuuucaagcuauacuuuaggugacagauaacaaagcagguuagguaaggagucuccaguguugaagaacagagcacugggaacugugccuuagagcugccucagagcaacuuggaagucucagauguaaagcugagacuggccccacuucucccacuuauucuguagaccuaugcuagugcucugaauugaagagccuuuccaguccagagcaguagagaagugcugauugccccgcucuccucacucuuccaaaggucaucaaagccuuuauuugucucuccuucaaacauucagugccucuacugugugguugagcauuguaaccucaaggaauguagucauuagcaugguguuauuccugaaggcacaacuuucaaaauaaagguuuucauauaaggucuacaacaauuaaauuuuguaguauuuucccuugcauugggacguuuaguuaucauuuuguaguauaugugugaagcuaagagcgaagaaucugagccuuguguaacgagaugacauaauuacuugguuguuagaugacuauugacagucuacuaacugcaggucaaagcuaguuaacuucuagcucuaacuucuuggagcacaacuagaaugagcacucuccauugaaagauauuagaggcuucugacuggccaucaucuaagagcauaggugcaauucuaugugauuuaaacuuuuuuggcaaugcauugccuuaagaaaaccuuuuuauguauuuauauuaaauucacaaacuguuaaacuuuaaaguuuuguuuuuuaaacuuucaugguuguagaaauguuaauuuguaaaacauuaauuuuaaaacuaugcucuuuguugcauuuuaucucagauuguauuauaauuauaauuauaauuauaaauguauuaacaaaggcacucauuccucauuaaagcugcauuugaaauagaaaaaaaaaaaaaaagacagcaugcccaaggccugugcaggaucaggucagacaaacuuucuuaaugaagaggggaagugagcucaaagucccaggccuagcuaaggagcuauagagagaguuaguagcugcuggggacagagagucacuuuuccuuaagggugcagccccuggugaguagaccacccuccagugagauccauacauccaagacuauauggacagcaugagcuauacuugauauguuaacaaaagaaaaaggacauuaaauugggaugagucugagaggagcuguggaggcuaugagaaaauacauuguaugaaauucugaaaaaucuaauaaaaaugagaa

SEQ ID NO: 1088 - RNA, 689 nt, Mus musculus
ugucuaacauguaacagggcaaauggacucacuuucaaggaaauuaacuuuaaucaacuuucuugauaauuaaaauguagaccaggagugggaacacuuugggaaauucauauucuugauuucuuuuuaauaaccacaaaucagguagucaugacuuagaguauauggaaauacuuuucuuuggauuuuccaaauuauuagcaguauuucugauuuaaagucugguguuagaaguaaggaaauugcugaguccaggcgcaccuaccaguaaucuaucucaggaaugaguugcuuaugggaagagccugcuuugagaggaacaaaaugaaaggggaaauuuacacugaauaucauuuggagccuuuuaaauauguacauuaccaaguuuugagaaucagaugcauuuaaaaugaugaacuuggaaaguccagauccaccaggaggcagcauugcaccacucugugaagaagacuuggaccucgagugugggccuggaugccaggacuuggaguuugugucugucuccauuucucucuucgucuuuuuuuccccuccacuuuccuuauaacacuuuuucccuugcuuuaggagucagaucuguagcuuuagacuuagcuauggaguuguuuacucuuguguauguuauaucuuucuuucuguuuaauaaaccaauguuuagcugggcauca

SEQ ID NO: 1089 - RNA, 7777 nt, Mus musculus
auauaucaacuguauguauaacagucucuuaguuuauuauaaaccagcuucauaggccacagagaaaaaggacuauguacauacagccuuuugggaaggaaacaggcaaggagcugaggagaaccaagaugagucuagggccuuggagggcacauuucccagggagggagcccugaaagggaaaccagacaauccagggagacuccaugaacugcauaacaaacaaacaggucugugguaaccugacccuggggaacaggguccacaucgccucugagcuacugacauaaugcugugugaagaucaaagcagaccuaaagcaagagaaacaaguuuuuagucagugccugaucuauaacucaagcccccaacuucccgacucuguaaguagcuaucaagugacuacaggaacauagagagcuauuuggagacauuccugaagcuacgucuaaaaaaacuacaaaugcaaaaaucagagacauaaaaguaauaaaauuugaccacuacuuaucuuaagaucuacuaugaagacuucauagaaagaacacagggcugguagucaagaugcccucugggcuuucuuuuuuuggggggagggggugagaaagucucacaaccuggcugaccucaaaaucagagaucuaucugccuccugagucuuggaauuaaaagcauaggccaccaugaccagcaaaagagauacuccuaaauuagucaagggcaucagacagucucuacugugaucucagacaccuucaucuggggugagccaugaacacaucucuguucuggaaacaaagccaaccaguuaaaugcuuaccucuccucgauacuuucaggacauagcuauccuccaagagcucacuucccugaauuugaggccccaaaauggauguggucuaaagcaaaccuccaguuccugcccuaguaaauucuaggaaaagcagccaaacucaguguuuuaggcacuuaccucgcaugccuggaggaggaggccgcaugccaggagggggcaugcccauuggaguuccucggccaggagggagccccauugggggacccaugggaggccgcaugccaggaggugggcccaucauaccuggaagagaagagcucaggugaccuucuaaaagauggaaggaaacauacaaagcugucuaccaagucagaaggucuaguccauccucucagccucacaagcaaaauggcccuugagccagaguggaguuccuaauggcucuuguccagcuaguucccaguucagucagccaggcuggaucucagaguaauccugcuuaauuacacagacgcaucaucagcuucagucaaggaucuauuucaucaugaauccagcuaaggcauugugugacuaauuagugcuaguguccuuugaugacgauacucaccuggaggaggggcuccucggcccauagguggaggaggacccccacgaccagguggguacugaguuggggcuccugcaauacuggcuguggcugcagcggcagcagcugcaacagugccucuuccuuguggggucaucaccuaaggaaauauagaggaaugaaagcaaucuucagugcagcuuccuacucuucucccaaacugcacugagcaucaucaaguccuagagcuacagcucaugccauuacuuuccauguacaagucuuauguaucaggaagccugagugcucaauguccagucucuuggccugauauuaauauuaaggauucccaauccaacuugggaaaagcacuuguacuuuuaauuaaaacuggugacauggaaaaagaaaugucacgggaacauucuccuaauuucaguugaccagaauaccuuuuguacaucucuucauauagcaauaacugauaaucgugccauccacgagacuggucauucuggacucuuccccaagcuguggguuugcccuuauccuuuuggcuaccagaaacuaguaucuuccuccaauaccucaccuguugggauggcccuccaacaccucggacuggcccagcaaguccugcaggagccuggggcauaggaacaccagccgggauuccucugccagcagcccugccgaugccuggccccccagcagcuccagcaaguggcacucgggcaaugccagucugaaaaagagaaagaaagaugcuguaaugcucagugucuucaagaauucuaaguacaucuuuggaauagcacugccuaaaccucucagaucuauaaggcauauaaacagcacuaacuguauaaccuuaacaucauuccuccuccaugcaaaaccaagaaaccuaucaacccuuaaaaaacuagaucuuaaaucuagagaagccugucacucaauaccugcauucauucccaugagaauaaaagccggagucagagcucaagacucuauuuguaaacacagaacuugagcuggccacagacacauacauaagugacaguggccaaauaauaccucuuauacacauuuaccaaugagaaaagcugcacuguagaguuuaaaauaccaaaaugagugagauaaacuacucuguacucacuggagaggcuaucucaaagucaucggcagauguaaagcaaagcaggaagguaacugaaaauauuuauaaaaauuaaagggaaagacaauaauuuuucacguguuccacaccaaccaugugugaauaaaaauaaacacaggagcugaagcuacaacucuguggcagagugcuuacccagcauacauggcacccugaguuaaacccaagcauggcaaaaauuaaaacagaugcacacacacauaaauacaggcuagaaauauucucccgguuggcagugucucaaagagaaaacgaauuggccagguucuuuuuaaaagagcucuauuuauaaauguauuugguguuuauagaaccaagaacaucugggaucaaaugucagguuuaccauuuacuagcuaugacaucuugggugagcuaaaacucaguucauuucauccauaagaugaggugguuuuuuguuuuguuuuuguuguuguuauuuugucuuuuuuuagagcugaggaccaaacucagggccuugcacuugcuaggcaagugcucuaccacugagcuaaauccccaaucccagaugguaauuuucaaaaagcaaacuaaaaaccucuuauaaugauuaaauaaaaucauuaauuuggaauagcacugccuguauaacaucccuggugcacagguaauaaauaauaauaaaugcuaauauucuguaacuaccaaauaaagcauucauaaauucuauuauuuggagcuguuuuauuguuguuuuuguuuuagacagggucuuauacuauguagcccugaaaucauagauccccuugccucuacugggacugaaggcuugcaccaaaguacccagaaggacuguuaauuuuuuugagauaauuacaguugccccuuucccuuuccucucccuuuuuacuaaauguuguugcauacauauacagaacugcuggguaaccaauauggccucaggccauauugauuaggauuccucugggcaugggcguuaaagucacaaauucuagcugucucuccacucacuggcaagguagcuguuuuaagauuucauuuacuaucuguaaagggaugcaaagccagaguaccugacagagccuggcucucauaagggccucccuucaacagguacucgggaaggacuuacaucuuugggaggagguccuucuacugucauggagaccagguucuccccucgaagcaacaccagaccaaggacucgcuucucuucccuuucugcuuguuuggaguucuuuggccuaaaguugaauuuuuagaagaaaaauaagcaaguuauuagaagguagggaacauuagguuuaccaagguuggcuguguauuacguaaucugacaaauaguauauaaacuuucuaaaacacgucaguaccccaggcuaagugaucucacaugaauauagauagcuguuuccuaccaagccaaguagacacgaagaccaggaaacaggacaagcagcaagacaccccagccauggcaaagaugcuuccauagccaauggcaaauccuuuccuggcugucucagcuucuaccuuguuuccucccuucagcuuuagacuucacagaaagaggcaggcugaacaauucuuuaucagaagugagugauacuggcuccacacccacgcaguguacaauucaaccucaaggccuacuacaauccacccuucaccuuauaugagaaacagacggaauaaagggaagagauuccacacacacacaggcugacuuuucacaagggugaccucacgccagagcccaccccaaacaaaccaccaaagucgaugaaugggaugagggugaaccaggaaaacuaacuacaagaugggagcaggaagcuauaaagacaaaauguccugauuuuuaaaaagacaacuugauuuuauuuucuuuuuuagcgcauacuggcuuguuaaauaagccuauaguggcuuuucauaauggacacuaauaagcagucaagcuuuuuucucauuaacuuuauuuaaaaaacauuuuucaacauuuuuuaaaccagaaaaucaguuuuguuuuuaaaauggaaguuccacacugaucugcuggucccacucuaacaccuaccaggcacucagaaaucucugcauuuuuauucuauacuugaucuugggccacaaaagaaaacaaucucaaaaagaacuuaagggaauucagucaguccauaauaugaaugcugcauaggacaagagugucauaugacaaggcucaccaucuugcugagccucaagauguccugaauauauaaaacaggacugaaauagaccacuuuguuuaagggccugaguuagcuuguaacuuacagaauugcagcaaaccagaaaauaucuccauuuuuuaauuuuauuuuuuuuauuuuuuagaaaaugucaacaaaaaugacuggccccaaacccacauggggagcagagcacuuacccugaagagggucagaggcuucuuaaagcaguuucagaccaggccgcauuaggagagcccuguaggcuacagcuuuacaaauagguaaugaggccagaaaaucaagcucuccccccucacacaccuguggggagaacaugagagcccuuuaccccaguacccaggggcaugcaaaucagaguaauuaaaagccuagcagcccuccucaccucuuccacuuugcuagacucagagagcaagguuugcuggacgaaggaagauaugucuugguggccaacggucccauuuaaaucaaaagcaggagagcaagagcacuagcauguggcccgcccaucccauccacuuccuccucaguuccuucucccgcccaacagcccucuccuuacuugaucuuccugaacucaucacagucacacaggaucaaguucaugugcuugucaaaggcuuugaaggucccgaugaagaugcggccguccugcaggaugcaccucauccuguagucaaugugcugcagcaucuugcugcucuugcccaccgucugugaggagaacaggcaucagggaggcucagcucuucugcacucucucacuucuggcccucccccaagucuuccaccagacuaaucucucaacaauuuccaacugucuuccacacagucuuuaccugagacucuuccuaucgcccagcuucagccuagacuucugccagguaaccugcuagucucccuucccuuaaaaaagucaucuuccucagacuauaguggcuuugcuuauguugugucugucucgggggacuguaaguguccacaaauuaaccaaauccacccauacuaaauggcagacucagagcuaugaacauauaaauccaucaaaacaacuaagaacuggaauuugacuggcaccaaaaacccacuuaaggaaaaguguauuaccagaaagugaaucaagucugaagcaagaauggaguccucaaaccaagcacugguuagcaugccuccagggcuugguguaauaggguuaacuuuacugggcuaguguuaauuaguuuggauacuuaauacugauauauaacuuguuauccuuaauuuuuaauuaaggcaacaacaguuucuauccuggcuuccaauauagcuuugcaaaaauaaagggggagccucuacacaucccaagguaaacagaaguaccugucucucucagaaacaugcccccccacccgcaucuaacuggcguuaugccacccccaaccacccaaguaucaucucugccaggaacugcaagugcuguucacucccguaagcauuaccccauccuaaccuaaagauccagauuguguuuucugcuuaauccccuuacauaacuguucacggggaucagcauacaucggucccuuugccuaguaacagcuaauauaccuuauuggauacucccuguauauccaggcccuugaaagggauuguguauuucauuugauccucaaaauuggacccagugucauucauuuuuacugguaaaauaggcuacuccggcugaagauuauguaaggacuugccucagucaacucuuggaaaaaaagaaaaaagaaaagcaauauccuguuugagcaccucggguuucuucagccacgcaacuagaguaaucuuuuggagagauucgagguauuuauuacauguggucuguagccaaaacuaaauaaaauuaggauuuugaguacagaaauuauaacaaacugagauuucaagcaaagaccacuuucccuggcugaccuuuaagaacuuaaguucauuaagccugggaaaaaucuugcagcgaucguucacuaccaacaggauaaagcaagacugggccuucagcaaccagacuccuggaaaguucgugccaucgacugcuuugcucucucaguuuuccagauugcuaacccucccucccaugggggagccgggugccccgaaacaaucauuugggagucaccuccuggagaaaacguucucguuccucccacugccguuacuuuugccuaacgcugagcuaccacugcgauauuaguuauauuguagcuauauuaggacugccuggccagaaacuggcccaagugaagacagaacuuacuuuagggugcagccccggcgcccgacacagcccaacaucaaaauacgagaagcaaggucgcgcgcgcucugcuggcaaacccucuccuccagccucccgcucccuccgcugcucgacuccgguuucgggccgugaccuccgcuacuccuccgccucgcccggcgcugcccggucggcccgaggccugcgccagcuccaaaagcccgggcacacacugacgcccaaguuuaaagcuacggaggccgcggggccgaaaccgccguggcuccgggacacgacguuugacggccgcgcaucggccucuguaccccggucggccuuccccucuacccggucgcagccucacggcaaguccaggccuuuggcgcugggaugaagcggcuuccaccccgaccuccuccgccacgggcggcucggcucggcuccagcccacggacgccgccagcuaccgccccguuccgcacccccgagcgcccuacagccagcccgcgccuucucaccaugguggcggcucggauggcucagauucccgccggauucucugccacagaggccuagucgccagccagccagccgcuggauucccgccgccgccgcuaacggaaaugcugccugcaaaaugccgccgcuagugaagcuacuuccgguccggccucggaccuggaguuccggu

SEQ ID NO: 1090 - RNA, 5987 nt, Mus musculus
agcacaagugggaaggagaagggaagggugggaguguuuugguuggauucucagcuucuccugucuauugccagucuugaguaucacuccagcaugauugcagaugcagugaagaaagugaucaaagcuggcaaggugaguuucaaaaggcuucaggggcucggcacugcuguugcugggaccugagggaccucucuccuccaggccccaacaauaccuccuuugugaccucggggcuguucuucacuuccccucucuuggcuguuucauccucuuggucuucuucaccuuaguuccaucugcuguuacuuuucccaaaccauccuuugcccuucuugggccaucugauuacagaccuugcagcuuugucgggguggagauuacaggcaggguuagcugccugcuuucccucccagcuggucucauuucuugcaagguaaccucaucucauccuuugugauaugcucuucuccccauccugcugccugcucggccuccuguacucccuugucugcucgagugggcaggcccuugacccccacaccugcucacuuccuuccauucuuucuccacugcacuguaucuuucuuggucuccaucucaucaugcugucccaucuccuucaugggcucucucuucuuccccacggcuuuugcuguugguggcuguagguacggacucgagacaugggaggcuacagcaccacaacugacuucaucaagucugucaucggccaccugcacccccaugggggcuagagcccuuacucccuccaauuucaaaaggaccaugcuucguauacaucccuucaguacaauggaccagaagagaacaucuagacaguagacuauaauagcuuuucugaggcuaggcuguccugggggcugguguuaaggguaucucaaaggguggguuguugcgacaaggcccagacccuaagaugauaacuuuuucccacagguucgaaccucagauaugggugguuaugccacaugucaugacuucacugaagcugucauuacugcccugucauaaauccuauacaugcccaugaaaaaaauagucaauaaacaaaauacacacauacuaucugguuuuguguuuuuauugggguuuuaucauucaugggcaggagcugccacaagguaugccccucccaccaagcagguccguucuaauccuccugugcuuucugggacuuuuucuuuuucuuugugcugcucuuugugaaguuagcagcaacuucaggcuccucagaaaauuuccuuuucuucuuaggggugguggggcuugcugccucuucugguucacuggccacuuccuccuuaggugaggacuucuuucucuuagcacugcuaguggccaucucuucaaggucacuggccaacuccuccuugggagcuuucuuuuucuuggauuuagguagagagacaggugggucuuccauuccauuuuccugggguuuuaacuucuuuuucuucuuagauuuuucauuuaccuccugaagggggaaucagacacgggacauugcuuacaauuguuagcagccacagcucccauuagaauccaggcagaagagcaaaccuaguacuucuggugacuuaaugaucuaccuacucucacauuuuauaauuucccuggcccucuuaaacccuagagaaaacccccuguaugcugcucacgauggauaucaugcagagcucccagggaacacugaaaugaaaaucacuaauagcucaagauuuuaaaaaaaagccuaagggacaauucuaaacugucacauuggugaccucccugcccccaccccccaucaugagacacuaucaccuccagacacagaacagggagagcaggaauucacacuacccccguugaggacuccugggaggcagccgaggacagagcacacuugcccauggaaugggccaugugcuacaaccagcauucugggcucuugucaaguucucucagcaccuaucuccucccuauagaaucaagagguaguuuuagguguuuugguccaaagagcccaagcucaagaccaugguuugauguccuguguucuacgguugagaagccuacaaccugggauccacacaggacugaccucacacuccucugggguacugcuguuuucugacgaggccagggccagugcagccagucgcuucuuuuccuucuucaagcgcuucuucuccuguuuuuccagcuuucuggugauuucagcagccgcuuccucugccuggcaaaaaagcaaggcgcugaaaacccagaagaccccugacuugccacaacacuccuagucuugcuggaucaggcucauuaaaucaguuguauugccuccauuucugaaggucaggccaaguucguucauccuuuccaacagucuuucuggcacucagcuaccacaaccaagcacacacugaccugaaccacagcuuccuucaugacauccagguucuuccgugggaucucuccagucucauagaaagacagccguuccucaacuuguucucggaguuuuuccccaaauacacuuguggggaccucuagaugugugugcguguguaaacaaagucaauuacaacccuugaaaugacaaacuacuccccagcugcucuccccucagcuucacucagacccaaggugucaacacucacuaggugaacucuguugacgaaaaauauuaccaucauuguagaagcugccaagguagguuguuucccccccacuguaaccccuucaacucaaaugccaacuuccccauccauaccagagaagcaaucaauucuugaggcaauacugcauuuguuugcuagguaucgggagauacggccuuuguucuuugcagcugcucggccaaugaagguggaaugaaaaaugaguccauauuuugguguguuaccccuugucuucagggcucugugagaauauucagucaauaguuuagucaaaagacuugacccaaauagccaaguuccccucuucuaacaauuucccaccaggcuuggcugaacuuucuaccucaccaagugccaaccuagcucccagaggcagagagggaaggcauccaauuugcugaccuggaaacucgguccccuuuugcugggcccugggaaucacucagacaccaggacuggccaucacccccauagcagaggccuguauaggucagguugcccuggucagccaucauuguaauccccaaacaaaacaguggacaccagaagcagcaccugacaugagcaggcgcccucacugguaccugaacagggccuuuucagccccaaggaucuguacuguggacgcuggauacuuggccagguuggugaggcugccagcaugagcaaugaggcgugcaccuaccuggagaaagauccgaggaggaggucaggugaguaagugggaaccugaccucccaggcucauccccucuucucuuccccaccaugcaucaacuagggacaacaugcuagccacaaggauagcgguacagaaugcugaguuucacucccccacuuuguguuccccaugacgcaccgcuuccccaauuaaggcugacaggcugggggcuacuuggcucaucuuggagcgaagguaaguguguaggcucuggcgauacucugacaaagacaccacacgacuggagaagcucucgauguuuaucaagucgauagcagauauguccaugccuaggaaacaccuagugugaacagggggaccagauacucaaggagucucguaccuuauacaggcugccgcgcuccgcacugacccauggaggaccgagaagcauccaagauggccuuagccuuggccccguccaucguaauuucuuccaguuucucuaacuucucuucauucagcucccugcgguucccaaugaacugagccaagcgacaguauguggcguugucauugacgaucuucaccagcucuggaaagugguacccauaccacucccuguagaggaagucauucucugauccagcuaucaaaccucaacucaggucccaagcucucucaggcccgugucuccccauucacaauacagaccaggcacaguggccuaggcugagguguacaugggguagguuuauucugccuccucuuucuauacagucaguguaggaacacagccugugguaagcacaaggaggccuugcuuugguccaugauuuuacccacaugaaucaucggccaugcucgacuucuauaccuuaccugacgcgcaucgagaagguauugauaucuuuauccaguugguccaggaggcuuauggacugaauaaucauguuguccacucgguucacauuaaauuuaacuuuggcacgagaguagcugugucccagcccuagcugggccuuacaagcagaaagaucugucagacccuucaccagauuauggaaaugcagacgaacuccuaaaaagaagaugggacuuuaagaauagauccuccaggacccaaguaaccacucacagcagaucacaucaccaggcccguaggcccccugcuggcuucugugggcacugcauccacgugguggacagaauaaaugaaauaggacucuuaccucgaaggaucucagcuaucacaccaccagucuggcaguuguaccccaacucuuccuguauugcagcaccaaucuuggggucuccaacccccagaaguacuuucuucuuuuuagauggcagguaugucuccaggagcaggcggagguccucgugaacaacaccuuugggacaaagaaaacagcucuaaaccacacauugcagauuggagacugucuccaaucggauuaguuaacacccauccccgcaggcauugcucagacacauggagucgucagugaucucucaggggauugacagauauauaagucaucauugcaaagccuggcucuaccacagguccaggagcacaauuguaaagcauuuaagugcuuuuuaaauuacaagauuuauuuauuauauguacacuguagcuaucuucagacaccccagaagaaggcaucagaucucauuagggaugguugugagccaccaugugguugcugggauuugaacucaggaccucuguaagagcagucgcgcucuuaaccgcugagccaucucuucagccccugcauauuaauguuuuaaaaugccauccuguaggucucaaauaaucccuagacuguaucaagcuuagaagaaaaucaucuaagaacaucaaccacccagaaucccauguuccggagggaccgacucaccuucagacacagcauuggcauuuuccaaggccaccugggaugaagagaagggacagaaggccaccagacgaacgacauuguggaauuugccaagguuaagcacacauuccuccaccuggagagaaggaugaaugggcuuucuuugaauuuggcuucuacagcgcaguaaggcagaagcaccagcuguuguagcaauuggugccugggccccgaaucuuaauucucaagaaauggaaaugagauguuuaucuccgaccgcuuccaauuauauagauucgcguuaaagaguccccucauucuagagcuccccccccccccgccgggcccggugcggucggccacgugggaacacgcggugcaugcugggguuuggcggccuuaggggcugcauugcagcuccgcgagcccaccgagcucacccaccugcggcagcagcaggcugaucuccuccacuuccuucagcgccaacagcgcguagccgaccgcaugcucgaacagcacgugcagcagaaccugaaaagaaccggcgcgcggccaucagucaaacuucccaguccgcggggccgcugcuagagcaggcccuggcucagacccggagcacgaccccgaaugcaaacccagacgcacgcuaaggccuucacuacgcaaauaccccaccaccacuccucaccauggcgccugcuccgugcccagcucgcaaugcggcuagcgcgcucuggcgcgcggaaccagacug

SEQ ID NO: 1091 - RNA, 5665 nt, Mus musculus
uccaggaugugguggugcacaccuuuaauuccagcacuugggagguggaggcaggcgggucuaugaguuugaggccagccuggucuacagagcuaccucaucaacuccaaguuaguuuucuuaucauaaccaguuuucuuuguaaucugaauuauuuuaccuauuuaaaagaauucuaagugacuaacagugaguacuaguuaagagaauaacgcauaacagaacauucaaacauucacaaauucccaagacuucucaacuuauuguuaaacucacauccuuguucaauacuuggccauauauauuuggauguuguuuugaauuuucaagagaaauuaaaucugacgagugaaaacaaagcaaacagacaaacugguuguguguccugugacccuacauuaccaaacagaaggagagaacucaagugaauccguacacaccgccgauugguacgggagaaagaaccgccaagcucgccagggcugacaggaaguccagcucccacgaccgcgcucgcuuccggcgucacuucccccgcgacuuccucggccgaacauggcagcgcugagcaauguccgcuggcugacccgagugaggcccgggacgaccugagcggagggugggcgggagaacagaggguuuguccgcgguuuccaaaagaaggcaaggucaucgcgguguaaggggccgcgguguccccgaucugaccuugugucugucgcaggcggugcucgccgcucggaacuccggggcauggagaggucucggaacaucuacggcucacgccgcuucccagagccagguacgcuugaguccagcuucguucucgcccauccuugucgccuccuugccgcuccccuggguuuccccuccccaccucuuucccucugacucccacuucugccccugcuccaucucugcuggccccacucacaggcacaagaugugaggguggagggugccuuuccugugaccaugcugccuggagacggcguggggccagagcucaugcaugcugucaaggaaguguucaaggugaauagcccggggcgggggauggguggcggaucaggcuacagggauggauggguuguuggaaaguucagaccugacccagcccugugcuuggacuuaucccugaaggcugcugcugucccuguggaauuuaaggagcaucaucugagcgaggugcagaauauggcuucugaggagaagcuggagcaggugcugaguuccaugaaggagaacaaaguugccaucauugguuuguauggcacucugucauuuaagagcaguguucauaaagccccucucucugcaguguguauauaucaguuuuccagacuggccucuacugacauuuaggaauuuguuucuucucaguggcaaaccaggaguuagugaugucaggaagggguugggaccugcugaggcugugucaccggggucagacccuguuaguugugucugcgugcccauucuuuuuugguuuguucauuuauuguuuguuguuguuguuguuguuguuguuaguuuuuccagguaggguuucucuguguagccccggcuguucuggaacucucuguagaccaggcuggacucgaacucacagagaucugccugccucugccucucugcucucugccucugccucccaagggcugagauuaaaggcacggccacccuaacccagugugcgcugaucauucuaaccacuccauuucuucucuugugcuguuuuauuccccauauuggauuuuuaaaaauuuauuuauuuauuuauuuauuuagcuuguagguuuccuccuauagacccacuuucuuggacagccucacuugcagggccagcuuuugcagaggaaagucaguucuuuauaaucuggccccugauguuccuguuuuccuuucuacaauuuguucugugcguugcucacaauccgcuguccuaauuguccuguauaugucacugugucaccuaucaggaucuccacucacuuguggcauuaguuuccuaugacugccauuggaugcuacugaaaauaacauauauaauucaguuccugaagcuacagucccucuaaguuccuuggggcaaguuugauccucaccagcaaaauacccaauuuccuuuucuuguuuuuucuuugugcacaacuacuaucaaauggcaaucaaccaacaaccccucucugcuucucaggacccuaacauuucuauacccucuugaaaagcucccacaauucuaaauguuacauaaucacaaaaacuaccugaucccaggcaaaaccacacccggcaugaggcaaaucuuagucaacugcugugaagagucugaagcagaccuguaucccacaccugggaauaaaacaaaaacauagucucauaacauuucaguggauuuuuuuauaaagaaaccaaaauucucacuauaaaauccucauuuauaguuucucccugccgccuccccccccccccccccaaauaaagucauguuuaugguuucuugguguaagcucaugggccuaucauuuggggccuaucacuggucaacucacugaagguacuuaaccaggaacuaacuacaguaaguaccagcuuuucuguaacauuucauaugaccagagggcuuccucuucuguguuccuaagcuuaguuccugucaucccuacagaacuuauguugucuuucucguugagggcaggaguuugugguuuugacugauacccuguugccuuacauacauagucaguuuucaguaaguaguagcugagauaaugcagucacuagacacccuugcuuuucagcuuggcauuaaaccagguucuuugauuuaaaaaaaaaaauagcucuuaggucauuuaggaauuucaacauaaugucuaaaauuaaagcauuaugcucaguucaucuaauuuucaccacauuauucuccuuugccucuugccacuagaaauaaaaggguugagggguuugggaguggaagaugggagucuagguuguaugaagucaguggggagacuggacacuagucuaacauuacuucuccucuacuuuguugucccaggaaagaucuauaccccaauggaguauaagggugaacuagccuccuaugauaugcagcugagguagguagauggguaggugugggucugaggagugcugggcaccgggcacaaagcagaugauggcugucuacucucaggcguaaguuggauuuguuugccaacguaguccacgugaagucacuuccuggauacaagacucggcacaacaaucuagaccugguuaucauucgagagcagacagaaggggaguauagcucucuggaacaugaggugaggcuuagaaacuacggaggacaaggagaggcaagugggaggugggcuuccuugcuucuucccuagugucacaagcuacuucccucucacccagagcgccaagggugucauugagugccugaagaucgucacucgcaccaagucucagaggauugcaaaguuugcguucgacuaugccaccaagaaagggcggagcaaggucacagccguccauaaagccaacaucaugugaggaaggccaauuuuuuuguuuuuuugugggcuggguuccaucccuugaacccuauugauugcuuuuuguccucuggccugugaacaggaaacuaggggauggcuuguucuugcagugcugugaggaaguugcugaacuguacccuaaaaucaaguuugaaaccaugaucauagacaacugcugcaugcagguaaggcccuuugugaguuuccagagagcagggaguggaagccaguccauucaucaaucucucucucucuguguggaacuccuuucucuauucucauaucucacuccuagcuggugcagaacccuuaccaguuugaugugcucgugaugcccaaucucuauggcaacauaauugacaaucuggcugcuggccuuguugggggagcuggcgugguuccuggggagagcuacagugcagaguaugcaguuuuugagacggugagcaagauuauuuuucccccggggaugguggugcaugcuuuuaauucaguacuugggagguagaggcagaggcagguggaucucugaguuuaaaaccaaccuggucuacauagaucaaggacagccagagcuccauagugagacuuugucucaagaaaacaaaacaaaacaaaauucuguuagucaucuguaccuacccuuuccugaccucagguaguucugcuguauucuaucccagugccccacuuggaaaugacuauggcugccuccucuccugcccuacacaucuucucaguccccuuagccugcccuccuucugugccauaauacauuuuguauauaccuguaccucugcacgugccugucuccuuccagugauucuggcuugcuuuuucccacagggugcucggcacccauuugcccaggcagugggcaggaauauagccaaccccacagccaugcugcugucggccaccaacaugcugcggcaucucaaguagguuacaggaagcucaagcugggucguggguggagaggguggguguuggaacgggaagcacaagugggaaggagaagggaagggugggaguguuuugguuggauucucagcuucuccugucuauugccagucuugaguaucacuccagcaugauugcagaugcagugaagaaagugaucaaagcuggcaaggugaguuucaaaaggcuucaggggcucggcacugcuguugcugggaccugagggaccucucuccuccaggccccaacaauaccuccuuugugaccucggggcuguucuucacuuccccucucuuggcuguuucauccucuuggucuucuucaccuuaguuccaucugcuguuacuuuucccaaaccauccuuugcccuucuugggccaucugauuacagaccuugcagcuuugucgggguggagauuacaggcaggguuagcugccugcuuucccucccagcuggucucauuucuugcaagguaaccucaucucauccuuugugauaugcucuucuccccauccugcugccugcucggccuccuguacucccuugucugcucgagugggcaggcccuugacccccacaccugcucacuuccuuccauucuuucuccacugcacuguaucuuucuuggucuccaucucaucaugcugucccaucuccuucaugggcucucucuucuuccccacggcuuuugcuguugguggcuguagguacggacucgagacaugggaggcuacagcaccacaacugacuucaucaagucugucaucggccaccugcacccccaugggggcuagagcccuuacucccuccaauuucaaaaggaccaugcuucguauacaucccuucaguacaauggaccagaagagaacaucuagacaguagacuauaauagcuuuucugaggcuaggcuguccugggggcugguguuaaggguaucucaaaggguggguuguugcgacaaggcccagacccuaagaugauaacuuuuucccacagguucgaaccucagauaugggugguuaugccacaugucaugacuucacugaagcugucauuacugcccugucauaaauccuauacaugcccaugaaaaaaauagucaauaaacaaaauacacacauacuau

SEQ ID NO: 1092 - RNA, 818 nt, Mus musculus
cugagagagcagauuggauguuguauuuucagaaggcauucagcuuuaggagggcccucaggcccaaggauggauacagaaagcuaggcccagcauggcuaaggguauaccagagccucccaagaacaggcgcaggcccaggaacagcaggagcagcgcauccugcaggcugagcagucccgaggccaucuuuguuggagagaggggagcugcuugcuguccugggccuucaccagcccccuggcucugacccauugggagaagucugugucguggcagguuggcaccugugggccuguggagagagaagauggcagcucgaggcaauugcucauuuguguuugugacaccuaucugacagguggcacuuacccauagagcaggucaaaaacaaggaagcuggucagcaacaggagcagcagggcuaggccagccguugagaagaugguucgaauugucacuccuagugcccccagcccuaggauacuguccaggagcugggccuggcugaagucccagggggggcacaugacucgcugacccuacucagucccucuccaggauccagaccccugggaaggagugggauggcuuuagaagggcaagggugagcugagcuggguccuagagguuauuaggaagaccuagugcuaagagauuagggaucagggaagagaggagggccuuggcagacacucaaggguuagcucugugaguaaggaacuaagcuuuuuggggaucucccuccccccacucccaccccacaucuucaccaacucuccucaccuccucccacuugggugaccauucuagauuug

SEQ ID NO: 1093 - RNA, 2064 nt, Mus musculus
aaguugucacugauacugagaacucuggcaacugcagagcucccccaagaccacagcagggcagugcagugcaaggaaaugguuugcaaaucuaaaguuuaaaguagccaggaacuccaaauuucuugcaucaggucugggaggguagacaggccaucggcgggccagagagccccagagccacacacuugggacgguguccaaacuugugaacaagugggcagagcguccugcgguguagcugucuuuagcgggcgacgcagcccagcaagcugugggucuccaaggugccccucgaccccucccacucuacccgagaguccggacgugcauuggaccagacagcaagagcuccgcccaacagggacgaggacaggaggcucccguggugcuccgcggccacuuccgggccgggcgcaggcgcaggcgcuggcugucauguugcgcgcucugaaccgccuggcggcgcggccggagacucggcccccgaccccgcugcuccugcccgugcgcggccgcaagacccgccaugacccgccugccaaauccaaggucggacgggugcagacgccucccgccguggacccugcggaauucuucguguugaccgagcgcuaccgacaguaccgggagaccgugcgcgcucucaggugcgugugcuugugcguguggagggcagacgcccuucgggaagggccggggccgagggugggugcugacucgaagcccguccuccccaggcuagaguucacguuggaggugcgaaggaaauugcacgaggcccgagccgggguucuggccgagcgcaaggcgcagcaggccaucacggagcaccgggagcugauggccuggaaccgggacgagaaccggcgaaugcaggagcuacggugcgagaggcccgggacugggugggcugggcuaggcucaucuguggccccgcucacccucggcgucuugccccucgcaggauagcgagguugcagcuggaagcacaggcccaggaggugcagaaggcugaggcccaggcccagagggcucaggaggagcaggcuugggugcaacugaaagagcaagaagugcucaagcugcaggugggcaugcaggaggucauggggaauguggacauuggagaccccagcaagggaggcugggggggggggggggggaugacagcacugggcgucaagugaccagagucuucaggaggcuucuccaucagcgcagaggguaugccucgcaggcaauggucaguaaaagguuacaggcuaguauugccuugugaaacuugaagucagggaaaccguaagugagaauggagcgcuuuuuaacacguaagagggauucaugcacuugagagaguccacccaccucuaaucagguugucacgauuuguucuuggguuguggccgagagaucugaugggugauuguccaaggaagagcaauaugauggucgaggucaccuaguacaguugugcuggacgauuggugggacacucaaagagacccuggguucuuuugacacccguggacuagagacagugcaggcagccagcucugggagagaucccacaaagccaaccuuucucuuccuguaggaggaggcaaaaaacuucaucacucgggagaaccuggaggcacggauagaagaagcguuggacucuccgaagaguuacaacugggccgucaccaaagaagggcagguggucaggaacugagcacagagacuucugggggcccaaauaagcacagugcuugccuagggucuguguacugggauaggaauugguacaucccaggaggauggcucagccguuuccagagcaaccucagucacuccaggcucggcacucaccaccugacugggaacucccagaugucccuguucuggcaccacagacaaacucagggcagcauuaaacucugggaaguuccuaucgcacagaggaucggacuggacuguguccccucuagaagccaagcuugucuuguaagucucuuggagucgugugagccaaauguuuccugcuuuuauaaauaaaguauuggagcccagucuugccca

SEQ ID NO: 1094 - RNA, 8264 nt, Mus musculus
guugggaagugacaaggugggccagggagaguagggaugucuuccccagcccagcccuauggcuuuauuauccuguuguugccuaagcaggagugggaugucccuacccagucuccauaacacaccaugagguauucaagcccaagagagaacagaggcacugggguccuguucuugcuuccuccaccuucaggucucccccaaaauggggcuucuccaguugaggcucaucacucagaaauggacccgcagcacauccuggcuggugacuggcugccgacaggcugugcacaucaugggcugggaacguugcuucucacucaggcagggucggcacagaaggugaccacagggcagcugguacacaggcucauuuguggaguaggaagaaaaugcuuguuugcaggaggcacacucugggccagaaacacuccuuggaugcucuagugaaucagaaaaaugagguaggguuaggugaaguuguuccucagugcaagcuguguuccugggagcugaaacuucuuuuuuuuuggggggggggggagugguucaagacaggguuucucuguguagcccuggcuguccuggaacucagaaauccgccugccucugccucugggauaaaggcgugcaugugccaccacggccggcuaagcgggaacugcuuuaucucuaucuuggugcugugcaugaauguucaagaacugacuuuuggggguacggggggagauggcucagugguuaagagcacugaccacucuuccaaaggucuugaguucaaaucccagcaaccacauaguggcucacaaccacccauaaugagaucugaugcccuuuucuggagugucugaagacagcuauagcaagcagggccagagcgaacgggccagagcgagagcuggagaguuggcucagcaguuaagagcacugacugcuuccagauauucugaguucaaaucccagcaaccucaugguggcucacaaccaucuguaaugggaucugaugcccucuucugcugugucugaaaacagcuacaguguacuuagauauaauaaauaaaugaaucuuaaaaaaaaaaaaaacaaaaaaaaacaggccuguccccuggucucccccgccagagccagcacaggcacaggcuuccucugccaagagaagcugugaggaagcauaaagcagaugugggccaacucgcaggacagucagaauggucgggguggagggauccucagaggggcaaccucuaucuuucaguggcugccuucuaaccccuugaucucuugaacugcccuggccuuggcccuccccccacccccaccccacuacaggauuuaugguaagauuuccucaaggccucuaagugagggcagcucugguccacaggccccuguggcucgcucuuccuuuuaguuugaaaaagguuguccuuucuccucaacucuaggacagaggucagccuggccuguuuucaaagcucacuccccagugacuugggggacccccaaguugucucacuuuguaaaaauuccuugguuuugucuuuuuuccagguugauccugaacuuaggaucaucuugccucagccccuugugggcuugggacuacagcugcaagccuacuccugccuugggaauucuuaauuccagcccugcuuucuuuaaaaauauuugguuuuacguguaugaguguuuugccugcauauaugucauuguacugugugugccuggugcccacagaaggcaaaaagauuaucagaucaucuggaaccgggcguauagacgggugugagccaucacucaugcuggcaacugaacccagguucccugcaagcacgagcacucuuaaccaccgacccaucauuccagccuaugcugaucuuuuacaucuuuguaugugaguccugguauauguguaccuuggcuggagugugcaagucacaggacgaccucaacuguugguccaggcccuucagccuugacacagggucuccuguuugccucugcauacaucaggguguuagucuacaaguuuccaaggguucuuugggaaugggcuaaguaggcagaaguaggagaacugccuuuaaacucaaggauuacauagcaaguaacauaguaucuagagcgauguaguaagauaggacaugucuaucauccuagcacaugggaagcugaggcagaaaaaucacugcaagucugaagccaaccuaggguucauagugagaccugugaugguuugaauaugcuuggcccagggaguggcacuacuaggaaguguggccuuguuggaggaaguguuucauugugguugugggcuuuaagacccucauccuaagccgggcgugguggcgcaugccuuuaaucccagcacucgggagacagaggcagaggcagaggagcagaggcgcagaggcgcagaggcagaggcgcagaggcagaggggcagaggggcagaggggcagaggcagaggggcagaggcagaggggcagaggcagaggagcagaggggcagagaggcagaggggcagaggggcagagaggcagaggggcagagaggcagaggggcagagaggcagaggggcagagaggcagagaggcagaggcgcagaggcagagaggcagagaggcagagaggcagagaggcagagaggcagaggcgcagaggcagaggggcagaggcagaggggcagaggcagaggggcagaggcagagaggcagaggcagaggggcagaggcagagaggcagaggcagagaggcagaggcagagaggcagaggcagagaggcggaggauuucugaguucgaggccagccuggucuacaaagugaguuccaggacagccagggcuauacagagaaacccugucucaaaaaacaaaacaaaacaaaacaaaacaaaaaacaaacaaacaaacccucauccuagcugccuggaaggcaguuuucuccugucugccuuuggaaugagauguagaagucucagcuccuccugcaccaugccugccuggacacugccaugcucucaccuugaugauaauagacugaaccucugaaccuguacgccugccucaauuaaauguuaucuggucauagugucuguucacagcaguaaaacuaagagagacucugucucaaaaaaaaaaaggcugauaaaaaaugaauucuugucauaugggugaccucagaagcauccagcauagagacugcacaggggagcagggucaccuguaaacagcagggucuccaucaggacuaggacugcaggaauggauuucucucucuccuaucucucucucuucucuccucucucuucucucucuucuuucucucuucucuccccuccccuccccucuccccccucucuuugagacugggccuaaguauuucaggcuaauuuuaaugccuguaccaagugcugggcuuauagacacaaaguaucaagucuagguuaaguggugcuggacauugagccuagggcuuuguacaugguaggcaagcacucuaucaacugaaguacauaccuggcacagcacagaaacauacacggacugagcaguggugguguguuccuuuaaucucagcacuugggaagaaaagacaaggugaucuuugugaguucgaggccagccugaucuacagagcacagccaaggcuacacagagaaauacacaaacggcuccaacugccuuuagcacuaacaggaaaccccauuaauaggucucagagaucuaaagccuugaacaauuucagagacagaaaacaaagaucauuaaagcuaaauaaauaaauaagcagaaauggugguaugauaaagaaaaaaggagauaugguacaguggggcucugacucaugccauguggaucuuaaguggaacacugugaucuauaguuguaaaagaaucugacucaguaaggacaaugaggcuguggacaauggggauggugagcaaaguagcuaugggagcuaacaagaguguugcaugggcugggaaaggcugcagagcugguaccagggugucucucagaaccacagcaaagaaaagcacaaaaggggcugaagagaaggcucagccugaugaucugaguuccauccuggaauccacagugggggagaaccaacuucuuaaaguugucauggccucuacaugugugcaagaaggaucugauaaugaauguuguuagagagaggacacugaaggacaaacugacuacuuccaugcugaaggucugauaaguagagacaaggcucuuuaucaacaugggcugagggaguaggaguacugggaaggagagcagcacaguucagagucagaguaggugcuggagaugccaaugggaggggucucagacacugucaaggcggguggggccugaguucugaggagaagcaggagcccaaugggcaguauuaaauuaggguucucacugggagagauucucacaugaaaagugagaagaaacggaugaaggaaggcaggaaaggcuggccaaucacaucccuggaugcugaguggacaagcagccacaagccucauuccacugggcacuuuaaaagacacguucuuggaaauaguuaggaagaaauauucagagugggcaggagugaaaugggaacccagaugacaacaggaggacaggcuuugcagcagcagggggagucaagugccugcccauaagucucaccaggcuucaccuguccuuuguuuuaaaagggcguggggaagggaauacagggaagggaaauguaacgggagagauggcucagugaugaaagcucacuggcuguucuugcuaaggaccuggguuugguucccagcaccuacaugguggcucacagcuaccuguaacuccaguuucaggauaucugacccuuucuucugaacucuaucaggcacagacaugguacacagacauacaugcagcuaaaacaaccaugcauauaaauuaaaaugaaaaaaaagggggggggggagaaacccagucaguuccucacuuuguaucugccauacaauacaauccuagguuauuuuuuuuucuuuuuuuuguuuuuuuuuuuucaagacaggguuucucuguguagcuuuggcuauccuggagcucacucuguagaccaggcuggccucaaacucagaaauccgccugccucugcuuuccgaaugcugggauuaaaggccugcgccacuaugcccggcugguuauuauuauuuugggcaggggggaggaggcugugucucaguaauuacugcugugcuuuucuaguacaaugauaaaaauguugccaagaagggcagaagaugacaucugaaaccucaaccuuucuucacaugcacauaaaauacccagacaucagaugaggggaagguuaggaaacagaaaaggaaaaugcguaugccaggagagaauuaugcaguucacugcagccagguguggcaggcaccucuguaaucccagcacuugggaacugaaaaguucgaggacagcaaagaccccgugucaaaauaaucaaaacaaaacccuguagcaaagguaggcaggccagaguccacagaaugacagggcuaacuaaagggcuggcucaggaggagccccaggcagcccuucaccuccucuggagaagacaagagagagugggcaccgcaguaaaggagcuggcugcgcaggcccacgguccugaagagacuagguucagcaucccgcacaggcagauguuagagccccuggggauuaccggagcuggaggcuggccuccugcaagcacugcucccucuugugcccagcuggagcugcccuuuggugagccgggcagugaaggaaggcauggagccaaggguagaagucagggcaauuuccagacuuugcgccagcuucugcucaugggacacuggaccuguagagagauacacacaccauaauauccaggaagacucagcaagagaaauugccacaaguccuuagaggcagaaaaugacccuuucaaguucagacacguaaguauaauguccccaggaugguaaugacagaacgagggagucaaguccagggaguccugacaucuccuucccaucucuggaugcagaagcucugggcuucucucgcagcucccuagacaaaguguugugcaggacagagccaucuugaggcuucaagcugaacugcaucuaccuccuuuuuuucauuuauuuugugguacucuggauauagccuggaacuugugccuucuaccacuugcucagccacacuccaagccccuguguuacaguucacaaggccuuccugcuggccaaggaaaugaugagacaagcagauaccagcucuggauauccccuaucaugcucuauccucugccucagcugccuuccuuccuguuuuccucuugguuucuuugagauaagguuaucacuauguaguucaagauggucucaacucauguugauucuucagucucuggccucucagauuuaaaugcuggaauuacagacauuugcuaccauaccuuucugauagugaguaaaguaguugcagcaaaggcaggaggaccugaggucauuuccgggaaucugugccacaaccccaggcacaguggaacacaccuguaacccuggugcugagaggcagaugccuugagcuugcuggucacauaaaaaguuacauggcaucugccuccucacaccaggguuacagguguguuccaccauagagagcaaaacacacuccuccuuucaucuuccuccgguugccagguggauuccuuacaaguuguucuuaacuacuuuccacuuuuuaaaaggcuuuacacacuuuauuauuacuuuuguuguugucauugugugugugcucaugggucaugcucaugugcguggaggucagagcacagcccccaggguuaguuauugucuuccuuauggguucugaggauuugccagacauuuccaaagcaagccaagggcugcucuguucacguggugguggggauaccaauccagggaaucccugugacgucaccaggaagaggcaggaagccaggcagcugaaacucagcaacaguacaacuaacucacucucacauuuaccaaccauguuuucuuccugagaggcaggcaggccuccagccucauacuggauaagugaggcagggagacccacaaugcacuuccuuccaucuccucugggaagacaagacauaguacuucaaaggcauccagauacaagaaaacauggucugcuuuaaggaaccuauuguuucuccucucagcaagucugaauggaggcuucaggguaggaaaaagcauugcucuugccagaaaacacaaaaggaacucaaagcgggaaguucaccaauaagauggucgaucacaaaacauggugacagaacucaggaacagucagguguggggacuugacaggaggcucaacacaguccaacacuagucaagacuacauagugagcuuuauccugagcuacagagugaagccuucuuucuaaacagacaaacaagcaaacaauuaaaaaaaaaaaaaaggaaagaaaucucagaacaauaagagaacacacauaauccuuuggggcuuccagguuaucuaugggccaaagacaaaucugagaugccuuggggcucaagagauggcucaaagguuuagagcacuggcuguucuuccagagguccuggguucaauucccagcacccacauggcagcucacauauauaaugggaucugaugcccucuucugauguguagauguacaugcagacaaaucacucauauucauaaaauauauaaauaaaucuuaaaacaaaaaacugagauucccuacaaaaaugggaaggcagaggcauggucuccagccuccuacaucuaaucuacggaagcauacugccaagggcuguggcaucgugucagcaggaagggcagggaagacagccugaccacacaagagugacuuaccugcugaacaguccauguccgucaggccaagcucacugguggcuuucaucuucuuggcaguuggcucugagguaguaggugagaauaaagggcuuguggcagaggaagacgcacucaugccaaggcuguagugugagcuguguucagccugcucugucuuccuuuuccuugagggcaggguaaugacagaaggggucauugcugauggagucugugcucucccaagcaggcggcagccugaaauagagugcuggaguaggaaccggucgauccgggcuuucagggaaggaugagggaggggcugggacuguggaguaaaggc

SEQ ID NO: 1095 - RNA, 31897 nt, Mus musculus
acagaauugccauccaagaggcuuucuccauuuuauuucuuugggaaaggaaaaaugaaaacucuuuccaucacauaugguagauauauauauuuauauauuuauauauuuauauauaauuuauuuugcaguuggacauuccaaagcuguucauauuuuucucuccccccaucucuuuuguuuuguguuaaugccuuuucccagucacuguggaccaggcucagggucugaaucacguauugugagggauuagaagaaugggcagugguugccagaguagccgccaaucaaggucaaaacccugcugaggaccacccagaaggagcugugcagagagguggagacuacaaauagggcacuccuauuuuugugggggaugcacagcuuguuaaacagucaccagucaugggaggaggcuggucagggcuugggggacuugcucacaguaguuaccaacccucucccuccuguccccaagauuccaucuugggguggaagagagagugaaaaagagaaauacaaggacugagggccaagucuccucugauuguuauugcuggugaaguggaaauuuacuuucuuaagagagaaauuagaauuucccugccugucuuggggagauagaaucugagagauccuagagaaggaagugacauugacugucacgacccauacugaugaccauaccagccaacccugcccggacaaaugagccaacucaagagucuggcaagcaacccaagggucaguaguccucccucucucucuuucucucucucucucuuucucucucucucucucucucucucucucucucucucucucucucucucucucucucucucucucuaacauacacacacacauuagccuuguuccuugagggcagucccauccaacucggacuggccccucaaagcaagggccccaggcucagacuugggccaguggagcugggggugagcagugcaccaaaagccaagcagagcuuucugcugggaggaaaggugaaacuuggaagaaaaggcagccugggaagaugugagugcgaaaggaggccaaggggagagaucgagggaaaacacaggaagacaucagacauccauccaucugaccucagaaacgggcaaacagaagaccuaagaggcagguauagcuauaagcagagcugagcagugacccuggauuugggggggucaaccaagcagcaggggauguagccuuguaggauccuggccagagggugaggguggggcugagaagccucuaggugacccuucccgaggguaggaaggcagaucuccccuugggauugaguuuccagccucugcucucacuuccucacuauacacagagggacacaugcucagaacuaguccaggcucugaggcuggagcccaagauaccuuggugggggaggggucgggcagguagcccucucaaccacaggcaggccaucugcucccacuuccccugccaaucugccuggggaaggagaauagcacaugaaggagagagacugggagccuagggucugucgacacgggcagacccaugcaagcucccucaggcuguguggccuaggagggcacagacaguagcacuggacagaugguggugacggugguggcggcgguagcagcccaagaagggaaaggggcugggguacucccuggcaacgcaggccugcugccucuaucuccaacacgaggcuuccccagaaagggagccuugcuccaugcgccugggaccucaccccauuguacucugcccucucccaugcucuccuuggcaggagggucuggaguggucacccacaaaggcagugcuggagcugcaaggacgggggacaaguggggggaggggcuggucacagcugcuucgagaaccucuuuggucuggggaugugcagcacacguggggaagggagaugaauggaagggacauuggugacuccgaccuucagacagggcacgugucagaagguugugcacguagagaaucagauuucaguggacucgaugcgcuccaggcgggaggggguccaggcuuucuuuuccucuccaugcuggggaguaggcgugcuggaccccccugcugccccacgcucccgaagucgccgcuccagcugcugguugcgcugauacaucuccacauaacucagcuggagcuguuucugauacucaaugaccuucuccuucuccuccaaccacacccggcgcuccuccgcaaagcuggcacccuggcgcucacgggcacgccgcucagcagccagcucagccugcaaucuccccaccucccugcguagggcccgugucccacccucuccuccagccuccaccuccccaucaacagaaaccagagaagcggcagccgccacgccagccugccggcgcaucuuggccucgucacucucacaggaggccagcgccuccuguggcucgaccagguccacgggggucagcgcaggcuugaggcaggcagggggcagcucgccuucacucagcuccaggcuggccuguuugcugccgaaggagucccucaagcugagcagcugcuccuccuucucccggagcgaggcccuacccucccgaagcugugagcgcagccccacgaucucacucaacuucugcgacacaucggccugagaguccuucaguuguugcuucaggagggaaaucucaccggccuucuggcacaccuggacaggggcaggcggaagcagaagccgggguaaaggcacagccgagguaguaaagacuuaucacuacccagcucccagaucuaucuccaaaggcacuaagcacucauaggggggcucccugcuaggcucaucucuagagccccccagggcagccucuguucucaguuacucugaauugaauugguccuacuccuuucguaucccacccccauccccgcccuacacaggaguaagucugggaucuccaggggaaaaaaagaugaaagggagucagagaggggacaccuaagccccccagcccgcaccucccacuuaguuuccuccauccggggcaggaagucggccugcuccuucugacagacggccaccuuguccuccagcucuucccguugccuuaucagcugggccgccuccuccugcagcuguuucuuguccugcuguaaccgcagcaccugcagcuguaggcccugcugggcacgcugggcacggcgggccaccugcugcagcuucccacugcagcccugccggagcucggcuagcucccgcucccaugccuucugccgcuccuccaacaccugggccacggcugccucgcucugcuccaggcugcgccgcagagcugccaccuccugcuccuucucccacagccgcuccuccagcuccuggaucagcgcacugggcgaggguggugaacaggcugcaaauggcaggcccccauuuccgcccuccccggaucccagguggccugaccgccccauggaugaugacgacccacucuuacuggaagcccgcccacugucagagguccccagauccugguagccugaccccccaccgcugcugccacuacuauagccagcggugccaauacgguugauauggcugguggaagcacugaggggugccagaugcuggcuauagcuggagcuauaggugggcaagcuugugagugaguuccggccugagucugagaggccgcccccacucccaccagcuggggucaugguccgagacuuguccaguccgccuuugaggcccgcggggcccugucgucccucaggggucccauuggucuguggaggacacaaguucugcauggaaugaaaguucuuggguacaacaggcuugaaggcugauggccgaacuaguggcuccgagcacugcagaaaaggaaacagguuagaggcaucagauugagauuuuauccuuggccccuccucuucuuuacgcccaagacuuguucaagaaccaccuccugcccucuguuagaucuccccaucugggccuccaccucaagucucccacaaaccaucucuguccugaauccacaagugagacguagccccaggguuacacuccagggcucccugugauggugcccaucccacuaagagcucccaccuuaaccuacuuucuugguuaacaauucccacucuaaacaaggcuaugaggcucuccugguccuggggacuaaccuggucuagcuugccagagguggucaggagcuugggugggugauuggguucgcgauacugggguggagccuugucgcugcccccacugcugcugcugcccccacugcugcccaccacauuaccacagacaucuguguggucacugccccgcagcucgccauugagguagagagaguuggcgagaaccuuguccucugauggguagcgaccaggucucucccuguuggccccgcuaccaccgcuucuuggaccagggaaacugccuugguugcccccacccccuguucgagugcccacgcuuuucauaggaaacuccugagcaugggucaccccacuacccacacugcccauagucaggcggggaucuggggguccaagcucagaaggccggggggcaaaggccaggagaggaucccucccuggaucagcgcgcacagguaacgucuccagcuucgccaugauuaagccagaagggcacuguaggcacaagcgggaagguagagaggucagaauccaucccaccuccacccccaagcaagucaaccggggcccacuuugucucuuuguguuccuuacaauggacaccagagucaccaggccuccaagaugaaggugcacauacccucugagcugggcucauuccuuaacccacuccagacccagcaauccucuuaacugugcugcuacuccaagacuuuaguuuucauuaaauuuauccugggucaugcaugacucuuauauuucaguuucaugggccggggagauuggacugguugagaaaagcagugcuuggauccaauaggggaccucagagguuaaaggagagacaaaauaacccuuauauaaaaaaagcugacagcgcggguuuuucccagccccccugaaccaaauugguaaaugaucaaggugaaagcugacuacagcguagacuucucuucuuaccuuuccaaagagguggggggccggcggguccucaagcuugggacccuccgaggccaggucugcaggggccauauggcucuuucucgaaauccaggcucggcccuaagcagcugcgcgacuuuggacuagccaaccaagccaucccguacuacagcuuucuccucugugaaaugggaggaauuaaaaaaccgugcugccgcagagacggcaggcgaacgaaagaacccgggucuuggaguuguaugggcggagcugccgcugcggccugcgccaaggucgcgggugggagcagucaugguucugcagaccaacgcacacgggcuauagcugcagcagguagcaagagggcuuucccagagguuuuccuaacuuggccucaugggggccuggccccagaguggcccacucucugagaucaguacuuuacagcagucccgaaucgggcagaggcuggggcagggccgcagcagcacuagaacaccagcagccagcuacuuccuccuggcuuuucccacaggugggugaaggaggggcggggcuugugcaaccauuggugaccccugaggaugccaugccugcugaacccugcuaagaaugcaguaccaccaggaagaguucuuggauuagccauuucuccacauacacacaccccuuuggaccuugaccccguucaggugaccaugaaguucguugagccaauucuguugggugugcuuucaaagcugucccacagaagggggaacaaggccucagauuacuagagcucaaagccgccuaauuugcuuccugguucuuuuguuucaaguuagcuccuuggaacaccugcccuagggaucuguauaaugccaguagguagggacaucaggcaagucccugccacuggccugaagcucaaagaauaccaauuaugaaagaagagugcucuucaggccugauagccucagacaccaagcagggcaccuuucuucccuauuaaaguuggguccauguagcauccccuugaaugcucugcaaaccuccuucuccugugaugcucaauucuaauguuguguccuuccugucaggccccaaaccugggaggcugcccuaaaccugggaggcugccaacacacauacccuucaauuucuccuggccacacgauacaucuggcucuggguaaguucacuagcaagcuggucauugcuguuguagaaauccguuccaugcacauccccacagauauggagaacagcacagaugccaccccuccuccuuuaggacaguuugugcccacauguaggcuugcacuagucuugggcacaaauaccuaagaaagcuccuaagugcaggaugcacaggugacagguauaccgaccgccccaaggagaggccucuuggcauucugugcccucagauuuuuuuuuuuuuuuuuuuuuuuuugccuuccccuagcuccugcuaucuccacucuggggguacaaagacuggcagagugaagguuggcuggccuguggcuuggagccaacagggaagccugggcaugguuacaggaagaccuguaauccuuaugcagcuggagcucagguggagagaacgcgagaagaggcuagggcgcuggugugggugugacaucauuaacaugacaggcagagauugccugggagaagaccaaagauaccucauccaggguggaagacugauuguuagcauccgagaguggcgugggugggccuagcauggagcaagggcgguagagcccccauaagucugggaggaagucugggagagcagcaagaaguccaagagaagcugugcccugacagucaaaaugggagggggauucaaaacagaggcacuaaccagaauccuugcuacucuggauuuggaggcaaaaggauugcaaguucaaggccauccugaguaacuuugugagccugaggcucgugguugacuacgucccuaccaagaucccagauucaaucccuaguacaaauauauaucaggaagaagaggaggacaagaaggaagauaggcaggaagacagcaggagcagcagcgagcagccuaagccaccugagggggucgcuugaguccagaaguuugaugcaaugaugagaaccaaguaaaauuccaucucaaaaaacaaaggaagagggagggagggagggagggagggagggagggagggagggagggagggagggaggaaggaaggaaggaagggagggaaggaggaaggaaggaagggaagaaggaaggaaggacacaagggcaguuaccaguguugaaaagaaauauuccaaaagguaaaacuggaguugaggagcguggccugaauuuagcagcugagaacaucauugaugucuaugucaaaauggcuucagaaaagcuguguaaaacaaaagcagacggagcaaagggauggccaaguguugagaagagaggauagaggaggccugcacugaaggaaguguggaaucaaaggcuuuucuuucucuucuaaaaguaacccugaaagcuggacgugguggcauucaggcaaagacacaucaagaguucaaggcccaccuguagcguauacugagguagagucuagucuaggcugcaugagauugugccuccaaaaacaaacagcggaaaauagaauaauuaaucaacaggcuggggagauggcucaguaagacugccugcugcgcgagcaugguuaccugagucugaauccccagaagccaccuaaaaagccagugacacuggugccuguaaccacagugcuauggagggcugagacuggaggaucucagagaguugcuugcugccagccuagcucuggcuucagugagagacucucaagggaaugaagcaggcagagacagagcagaacacccaugaucuugcugugugugcauauacauacauuuccccaaaauccaaacaacauuuugauaggaauuaaaaauuagauagcaacacugaaggcaggcaccuccagggaaacaaggcagaacacuagcaagggaacugcaccagaggcugcagaggaaggagcaaacaccaggagugagcauguugacugagugacagggguaacauggugaguguuugggaagaucuuuauaaacugcgaagugcacacccuuucugagugccaaggaaccagaguuuggagggggucacaugucacugcaucacucugcuucagucgagccuucucagguucuugggguccuagacauuguccugaggcucccuucucagguucuaugugaggacagcuuugcagucaacccauaggcaauucccacagaguuccuugccacaguucuaaccugccaacgucaacaucuuauagccacucccugccccuugccucuuccaaccucaggcuccugcaaauucuuuccucaaaaccuugguagaguuggaaggacaaggaguggaaucucuuucccuggcaaguaggaacugaggggagaggaggggcugagagcccucuuuaggacuugaggcuugaggaggacugcccuaggugacagugugaucugcaagggcaguugaaccgcaucacucugggaugauagccuguugccugagccugccuccauuucuguucuaucaacccucagugccugugacauuacaauacuagcagucagaggggccaaauggacucuggcuaaacccuuccccgagcagggucaagggccuuagaauuccugcagcaucagcuccagguguaaaucacagcucagcuacgaaaccucaagcagacucaaauucucacaccuaccuuacagcgauuuuuuaaaaaggaaacggauuauguguaaaauccaugguauucuuuuuggcacccacaaccaaguagaguuuguagcagagucucuaaggccucucuugauauccacccuguauuucuccugaaagcagcucuucacuccacacaugaccucuucucagcucucugcccagccuacauucuucuggaaccaguccaaauacuccucagcauccuugguacccaagaggucuuggagcacuuagcucaggaugacccagggagauuucacugugagccuuccccauuggaagccuguguuaccccaggggucucuggaccccccccccccggcaucaugaaaaugcaaggccaauacuuguggggauguugguuaugagcaaugucaauaggaaaugaaugcagacauagaaacaaggaaaagcuuccaggaaggauuaagggaagggauucagggagcagaacuucuugguugggaugugugaggggagauucaucuucccuuggaaaugugggcaccugcaggggaagaggcccauccccuagauccugacucugaugaagccagugcuucagugcugaagguacugacagcacacccccacccacccgcucacacaggagccugccucagcugugcaugugugugucagaguguguggggggggagggggagggucgccauucacuagcacauagaccccagccacaaaaucucugcaaaggugccacagaggucuccgcgguuggagaaauuccacccauaccucccucgguucuccaccaacgcgcguggcccccgggggggggcggggugcagagagaagaggugacauaauccgggccgcacccccuccggccgccaccccccccuccccgcgcgccgguugaagcguccaugacaucaucggccucauccccccccagcuccccgguacccuagcagcgggacgcgcccccuccccagcuucccaccggccagaagcagcgagcgaugcagcgggcauggugaccugagggagaaccuggaggggcaccccggcaggccuguaucacuuacucacugccucagaguccggcgcagaggcucagacaccggcgcuagcugucccgcucucuggcgcagcccgaagcccgccccacagggcgcgcggcgcggccgggcucugcucuuggccccucccgccccgcgcccggcccgcccaccagcggcugcggcaaacgcgggcccgcccuccggccacgcccccgggacccgccaauccuggacgggggugggacucggugccuuaaccccuuuggucgcugagcgccggcccgccugcccaaaaggcuggguggcagauacucggccucaguccguuagccacuguaccaaauucuuggggucaauccccaauuucuguccuaccagaaauccagcaaauuccuacucucuuugaaccccguaucuggguguaugagcccuuugguuuauggacaaccuuguuuggacucuagauucaacuccugcaccagcuauucccugugcagcagauguccuaaauccuucaaauaugggacuggacagauggcuuaguggucaagggcacuggcugcucuuccauagaaccuggguuuaauucgcagcacccacaugauaacuaguuacaagggauuggacaccuucuggccucugcaggugcugcacaaacauauggucgaaacaaccauacacugaauuaaaaaauaauuaaggggggggaaaaaaaccaaaaaacccugaagagccuucaaaccuacaagaugcgggggugugaaggcaccugugacuaugaucuagguggaggcaagagccaauaaauugaccaauuuaaaacuugacgcuacaggaaauuuguauuuuauaccuugugccccgugccugcuguaaaacuaacaaaccccauccuaaaaagagauugaguaaagacuuuaucuuugacucagaucaacaccuuggcaagugcagguggcauacacuaaagggguugccagcugcccaggaaaacuuccuaaaggaagcacucagccuucaacuaugcccuuggucugaucaguaugaggaagcaagcuaggcccaggcuuccgccuuagcaaaaggcuguagguugugauugugauaacugaugaguuuagccauccuaugacauaggacuaugucauagauuuuaauuuuuuuugccuuuuuaaacaauuguuuuuauuuccuauagugaauuuaaugaauuccuguuuucaguucuaaugauugcuuuuaaauguauuaaguaaaugccuuuaaucccagaacuugagagacagaggcagggucucugagaccgauucuaaccuggucuacagaucgaguuccaagacagccagggcuacauagagaaaaacacugucucaaaaaaccaaaaccaaaacccaaaacccaaaccaaaccaaaccaaaaaaccaaaaagccaaccaaccaaaaaaaccaaucaaccaauccaaauaaggaaguauauuaaauaaacuaagaucuuauugucauuagccaaugacagaucauuuauauauucuacaacucugugaacugagugucauggaaaugugaugauccucaugguuuguggccaccauauuacaagauauucauuuaggucagagagguaacgugucauccuuguuuuaagcagaugaguccagcuuugcuaccccuuucagugagaagaggaugagaagagaacagaauaugggaagaauccccaggagacauuuucuuuuccuccuccuccuccuccuccuccuccuccuccuccuccuccuccuccuccuccucuuuuucccugaggcagggucucucuauagaggcauggcuguaugggaacucaccaucuagaccaggccucaaauucagagacaccugacggccucugccuaccaaguacugggguuagaggucugugcuaccaggcaagagaaaguuuugauuggcccacaacaacauguauuucgagacguuauugugagggauuuuguuuguuugguugguugguuuuuuucucuguauagcucuggcuauccuagaacucacucuguagaccaggcuggccucgaacucagaaauccaccugccucugccucccaagugcugggauuaaaggcgugcaccacuaccgcucggcuguuuguuuuuuaagacugggucucacuagguagcucuggcugucuggcuggccuggaauucccuauguauucaccauggcccuuaagucagagaucccuuguuucugccuggggaaugcuggguaagaauguuguaguucagggacugaguguaaaccuagcgaguaugagaccuuggauugcauccaacaccacacauacccauuuagguugguuugggcuucugccaacucuguuuacuuggucucauguuauugccaguauuuaagcucugauuuuucuauuccuacuuuggacccaccugucacaugacuguuuucugacaguucuaagaaccugaccuaggugaaaaugcuuucacucucuguucacaaaauucuucccaucuuccaucuuuauccccuugucgucucacuggaaauggcggcagagcugggcuuaucugucuaaagaagacacuuuaccucgaguuuuuaugagugugucucauccuuuugaaauuauuguugaguuuuugaggaagagcgagcaugccauggcagauguguggagaucacaggacaacuguuggagucagcugaaccaucucaucugcccagagcuuuuuuuauccucaggacucaaauguugcuacuauaugucucaguagcaccauuuguuaauuuucuaaaaacaaaagaucuuuucaacuuagaaaagccacaauacauuccugucauuuugugaacagauuuuuagggucccacuaaaaccaugcauucauugacuguugucaaaugugucucugcauccugagaaagcgggugaaacuuagccaucacagauucaaucuucuuuggugucuccacagagacauuuauucugcucauuucaucccuguuggccuauucuauuacuccccuauguucaauuuaaauuauucucuuuacaguucucuguccuuauuucauggagaaugugguuuuguuucuucagaguaauacuaucaaagaggauggggcuaucccagcacucagguagcugaugcaugaagacuacugagaguuugaggccagccugggcuaagcauaaaaaccugcuucaagagaaagaaagacagaaagacagaaagacagacagacagacagacaggaaggaaggaaggaaggaaggaagaaagaaagaaagaaagaaagaaagaaagaaagaaagaaagagugaaggagggaaggaaggaaagaaggaaggagagagagaaaggaagaaagaaagagagagaagagaagagaagagaagagaagagaagagaagagaagagaagagaagagaagagaagagaagagaagggaagagaagucauagcuauguguggcauguguguagcacaugcuugucccagaagcuugagguggaaagacuuuaaaccuacaaacuggaggucaguuuggacaauguaguaagacuccuucuaaaaacaguaaauuauuccugggcuagagagauagcuuagcagcuaggagaaccagccagcuacucuuccagagaacucauuccgcuagagguucaagucccugcaucuacauggcagcucacaaccaucuagaacuucagucucagauccaacauccucuucuggccuccaaaagccaucaguagugcaugcagugcacagacauacaugcaagcaaaacacccauccacauuagaaaaacaaacaaacaaacaaaaaacccacaaaagguaucacauaccuuuaaucccagcacugggcacugggguaggagaggcaggaagacugccacaaugccagccuggggcacauaaugaucuccauaucaacuaggucuacauggagaaaugguagcuaaagaaaauuaauaaaacaaaagaaaauaccuauaccaauaccuaacacuuguguauugaugcucuucaaauuuauacauuuggagcugagacaggcagaccaaaguucaaggauauccuagguuauauagaaugaguucuaggccagccuagacaaacaaacaaacaaacaaacaaacaaauuaacuuuaaaaauuacccaagccaggcaugguaguucagaccuguaaucgcagcucuugugaggcugaaguaggauuacuguguguucaaggccaagcugucuuaguuagggucguacugcugugaacagacaccaugaccaaggcaacucuuauaaggacaacauauaauuggggccagcuuacagguucagagguucaguccauuaucaucaaagcaagagcauggcagcauccagacagguauggugcaggaggagcugagagucccaccucuugcuccuaaggcaauuagaagacuggcuuccaggcaacaaagaugagggucuuaaagcccaugcccaugccugugcccuuaguaucacagcugauacuaagauuccagauuauguacuaccuuggcuuugguaaaaacacagccuauauggucuaaagcacagguugcccuccuauuuucaaugugugaguaaaucccccacgcuuuguaccaaguggauggagcaggcacaacuccagugcagccuugccuggcuuguaguaucuucuucuauugaacugcggucaauggaagcauuuaagaaacacaugcuaucaaucucacuugucuagugucagguggucuguuuggcagcuccuguaacuuggguuuaggagucccugucuuaucaaugggauaaagaagaggcauucaaaacaaacaucaaaaaagacuggaaaaaaagaaagaauaaagaaaggaagggagggagggaggaaggaaggagaaaagagugaugacugggucuguauaguggcacaggccuuuaucccagcacucucuggaggcagaggcagauggacuuuucugaguucuauauauaaguuucaggcaggccagccagggcuaugcagugagaccuuuuuuaaaauaagaacacuggccaggcgugguggcgcaugccuuuaaucccagcacucgagaggcagaggcaaguggauuucugaguucgaggccagccuggucuacaaagugaguuccaggacagccagggcuacacagagaaaccuugucucaaaaaaacaaaacaauaaaaaaaaaaaaauaagaacacugauguggcugagcagggucagaguaaggcagaucucugagcugaaggucagccuggucuacagauguaguucuaggacagccagagcuacacacagaaaacccuguccaaacaaacaaaaaaaguuaacaaguaaagagaaaaacauaaggaaaacuaacuugaccacagaaaacuggauagagagaaugacauaauugguucugcagauguaccuggacaaccagcagacuauuucuugaaaggaaucccguccuacccugcauaaccuauauuagaguucuaagccuccaaauguaauaaaucuacauugggcuguggcuauaacucagugcuuacaugaaguccuggguuugagcucuaucacaauauaaaacugagcagaccuguacuugggaguuaagcaagaggauuagaaguucaaggucauccuuucuuauagauggaauucauggucagccugagaaacaagagaaccuguaucaaaauaacuguacacauaauaaaucuggagcugagauggcucagugguuaagagcacugacugcacuuccagagguccugaguucaaaucccagcaaccacaugguggcucacaaccaucuguaauaggaucugaugcccucuucuggugugucugaagacagugacagugugcucacauacauaaaauuaaauaaauaaaucuuggaaggaaggaaggaaggaaugaaggaaggaaggaaggaaggaaggaagggaggggaaggaaaggaagaaggaaagaaggaagaaggaagacuguguuguucccaacucuuggcccugguaagauguuacggcagcauugaaaagcagguauaggauggucacuguuggugaaugaaaucacaacccaaaugucuacugugaaguagacaacuuccggcuucaaagaggaauguggggcugcuucugugggagaacugugccucugcacaccaaacucugguggaugaugaacuuuuagcuuagauguauauauauaaagcuggugcaugguuuauguggaggucuggaggacaucaggcacugcccugauggugacagccucccaccuugcucacucuccacuuuggauuuuuuguuuuguuuuuuguuuuuuugagacaggguuucucuauauagcucuggcuguccuggaacucacucuguagaguagaccaggcucagaaauccaccugccucugccucccaagugcugggaucaaaagcgugugccaccacacccggcuucguaucacuuuuuuuuuuuuuaagauuuauuuauuuauuaaguacacgguauugccugcauuuaugccugcaagccaggagagggcacuaguccucauuacagaugguugugagccaccaugugguugcugggaauugaacucaugaccucgggaagagcagacagugcucuuaacuucugagccaucucuccagcccuucguaucacuuuuuaacuaauguacgccuccauauaugucugugugagaguguuacaucuguuaaacuagaauuacagacaguugugaacuggcauauggaugcugagauuugaaccugggucacuuggaaaaccagccagugcucuuaaccacuaagucaucucuccagcccccaaaguagacaguuuguuuguauuuuuauguuccccaaggucucaacauucaauuuuguuuugggagugacggcucacacuuuugaucucaaguaccgggagaagcgaguaguucucugugagcucaaagccagccuugguuuacauagagagcucugggccugccaaggcuacacaguaagacuuuguuucuaaauaauaaaacaucgaaauaaaauaauaguagaguuauauucuaauacuaaggagccaccuguacuugaccacuguaaacuucuuuguaagauacaaaauaaaaagaaguaucuaucacuacccuaaguaaacucucuuuacuauuugcgaagcagaagagguguuuuggucuuguguugaagggaaagucucuaguucccuggagccugcuauguagccaaggagggccgugagcgucucaccauguagcuagcaccuauguaugugcugggguuacacagacacucaaccgauuucauggacgcaugcagaauuuucaaacccuuguucuacauauuuacuccagacagacuuggugaugaccuaaugagacuuuuauuaucuaccuuugucucucauuuugccaugucagugucuuuucuccugaguugucaccuaguagggacaguaacugaguuguggaaacaacuuccugaugauuaugggcaauauacucaauaauaucucacuuaugacuuuguauuuguuacuccagucuauuuugauacgagacaauaugcacaagauaggacaguaaggcagccgggcaagaccaaaguccauggcuucuguggguguuuugaauggcaucagcucccacaggcucauguuuguaugcuucgucuccugcugauaucagucauuaggggugaccuuguuggaggaggugugucaccccaggcccagugugucugucugucugucagucucugccuacugccugccauuaaggauguagaguucucaacuacugcuccaguaccuuccugccuguugccacgcuccccaccauaaugcuaagaaacuaacccucugaaacugugagcaagcccccauuuaaaugcuuuccucuauacagguugucucagucauggugucucuucacaaagcaauacaaaagugacaaaggcagccaguccagucuacauagugagucccagggauguguagaccugacacuuauaacucuagcuccugcaaucugacacacuucuuggauaccugcaaccagaugauacacacacacacacacacacacacacaaaagcuuuaaacaaacaaauaauagggcuggagaaauggcucagugguuagcaaaacugcuauucuugaagaagcccugaguucaguucccagcacccauaucuggcaacucagaacugccucacacuccaggggauaccacuggccuccuuaaguacaacagacaaacagacagacacacccccacauaccacgacauugccaauguaguggcucaagccuucaauccuaacacccaggaggcugauugcauuuggucauauuggcugaguaccuguuuagcauaucaaaggcaucaaguuuaauauccaucaucaaaaugaacaaccaaucaagcacacacauacucacaccauuaauguacaacauauaaugcuuaccuagguacucauucuuacccuguacucgauaugaaaugaacaaggcucuuuaggacaccuuuuaucucuucuuucuuauuuuuaggcguuggggauaaaaugcagggccucacauugaaguacucuaauacugaaguacauucucacaucuccagguaaaagaucugcucauggagccaaguguagugguguacaaugauuccaguguuuggaaggcagagacaagaacuuugagaguucaaagccagcucaggcuggagcuuaguaagaucuuguuuaaaauagacaaaaauuagauuuguugaaugacuguaagaucaagccaccaucgaagugcugaaaaucuagaccagcauugaaguacaguagacaaaaagcaccacacacuagacuguggcaagcaauguacucugaaauguuugccucaguugcuucuaagauuugcuugaguuacaugagagccuaucuagaaacagaaacaaguguuuaaaauauuuauauguuaacuuuuuguguguagugcuaaaaaucaaacaugagacuuuauauaugcuauauccacagcccugagaauuuuuuguuuuguuuuguuuuuucgagacaggguuucucuguauagcccuggcuguccuggaacucacuuuguagaccaggcugcccuugaauucagaaauccaccugccucugccuccugagugcugggauuaaaggugugcaccaccaugcccagcuugagaauuuuuaauauuuagaaaucuuaacauuuaauguuuaaaaauuaguaaucuuagccuggcuguucuggaacucacuauguagaccaggcuggccucaaacauagagauccacuugccccugccuccugagugugggacuaaaaguguaugccaccagccuacuuuauucuucaaguuuuaucugacuaguugugaaagaaauuuguacauguuuagugaacuguuagcuacuuacuauuuaaugaacuguucguuuaauauguuuauuacauuaacagauuaaguacuagauaaugaauacauaaugcacaaaagauuauaugcuuguaguggggcuggagagauggcuggguggguaaaagcacuggcugcucuuccagagccuggguuugauuccuagaauccaaaugauagcucaaacuguuuggaacucuaguuccaggggauucaaugcuauuuucugguuuccaugggcauuacauguaugcgguacauacacacacacacacaauaugcagaaaacacacacagguuauaggccuuuucuuucauaucaagccuuuggaacaucaccgaucauuaaaagcuggaagcaggagcauggcauauauaccuauaaucccagccccugggaggcuaaguccagagcacccugaauuugagggcucugcuaccaucucaccacaggaguccugggauuacaggugcaugguaacauuccuagcuuauaugugguaucagggauugaaccugggucaacagguccuuauggauggugcuuuuaccugcugaaccaucuccccagucuucacaguguagucuauggguuuucagccuugcugccauuggcaaucugcuguugauguauucugauggcaucaagauucuuaacuugcuuuguguguagucuaugaggaaaauacuaagaaccccacagguggauguaauaacuaaguaaccacugauaggcugacuacugucaacuaugucucuccuaccuucucuuacuguggucaucugcauuuuuucccucucuuacaaagacuaggcuauaaauggccuuaccaacaaugcauacagcccuuuccuuuucucuauuuacugacuacaaaugccuacugucucaaaaaacaaaggagacugcacauguuggugcaugccuuuaauucuagcacuugggaaucagauagaucucuaaguucaaggccagcuuggucuauaaagugaguuucaagccagcuagugaaauauugccuacacacacacacacacacacacacacacacacacacacacacacacacacgguggcuuacaacccucuguaauuccaguaccaggggaucucaugcccucuucuggacucuguagacacgcacauggugcacacaaauccacacaggcaaaaaccccauacacauaaaauaauucaaaaaugugucucguccacaugcacagcccacaggaaccagagcaaaugacccugcaagagucccacaucuuccaucccacacccacuucugagcauauguuccucauauccugcagugggcagaaucacccacaccagcuacaucuuuuucuugucuaggauucagggcugaauucaugugauguguugucagaacuguuacauccagccccacugguccuuccuccucucccugucucauacacagccagccagucuuucuuccagagaccuucuuuucagagggaccuaugucuccuggacucuaucuuuggcauuucucauuaacucuucucccuaagguuuucagcuuacucagaacaccugggucuguaaauaagauggugagauuucccucaccaauuggaggagauauggccugagagacuuccaaucuucacuuuucucugcccaugagaagguacuuaucuagggauuggggcuugcagggcauaaauauaauaaauguguuaagagguuucuugugaaacaugagugggacuucuggcaccucuaagauaaacccugagguuuauuuuaccugcuuaucugagaccccagugaggucuucuacaaacaacaagcucagcaguauucacaggccuuuaauccacaacuuucuggucauauuccaucccugccccaagacggcauuagggaaggaugaagacacauguaggccacaggauacacucaaggaaggacuggagucaggcugaagccugggcagggagguccuggccccaggagaugagggaguugcuggccugggcaagcucugugauggacacccggccccgcugucggaugaaauuggccacggcagccaguuccucugggguuauguagauaaacuugccccggucgucaaucacaccuguggggacaugcacguaguaggacugaguccuccugggcuuucucuaccuaaccugagaauuuccaucuauuccuuuauaacugaucuccugucagccuuccuggguacaucaaagcccaugugggugaguugcacaaauccuuucuucccaugccucacuccaaagcuaggcggaggcuucuaggucuuccuugugaccaaguccaauuccuaagugucccucacugcguaucccuccugccccggagaggccaggcugccuuuggaacaagucugaggccucugugcucacucaagccccacaggucagggccuguuuguaggcuuggcucucaccuguuagaguccccuccgucagcagguccuggaugcgguuuauggcguccugugaggaaaccaagucucagagcucguuucgugguucccauacccacagacccaucauuucuccucucucucccuagggugcuacuccugcuguggcugugguucuccuaggagggaguccugacugaaggggcucugaucauuggaaaugccaagccccgacggaagcucucuuccagccggaaaaggaauaguggagaugucccauggcaagacaaccucuggcaagaaguaacuagauuugggcugcgcuggucacaggacaguauagcacuugacuuuccuuuuucuuuccuguucuuuucaucucuguagaaaugcagaauuccuggaguguaaagaaaucccuacacucuguucacucuugguuggggacagucugaaagggcaucacaacuuaccaucuucaggccagccuccuacucucuacuggccacagacccuguagcuauauuccauauucucaggcuuaccugaguccuuaggcccaucuggaaagccagaucuuccaaaagcacaaccuuggacuucuacagauaaaagggagaggagagagagaggcugagaccacuuggccagcucuaugacagugugaugcccuaucuuuaaaaaaagguggagggcaccuaagaaacaauaugcagagcugucuucuggauucuacauucacacacacacacacacacacacacacacacacacacacacacacaccauuucuuuaaaccaacauuuucuaauuaauuaauuaauuaauuaauuaauguguguguguguguaugugcaacaacacacauguagagggcucagaggacaacuuccagaaguugguucucucuaaucaccaugugaauccaaggacuaaacucagaucuuaagguuugacaucaaguaucuguaccugcugagccaucuugccagcccaaaaguuggucuuuuguuuucaaguuuuuaaaaauagaaaaugguuaccuaagccagguguuguggugcauaucuguaaccucaguauuugacagaaagaggcaggaaggucaggaguucaagacuguacauucauacacauuuaaaggaaaaaagaagaacugcaggaaugguaaacaagagucaguaccuaccgcugagcuaaaagccuaucuggugaaacagacauacacagaccagaugauaacaggccugaggucuuucacaaggcccagagacuuguuucucucuuguguuugccucacauucuucugcuucgaucuccacuguccugagagguguacacuucuuuucacucagccucuucacacugucugaggcauaacccucucucaccuggaauggccaaauaacuaucacuaaggcuggcaagaugguugccaggcaagugcuuuugugcuucugaggacgugaguccaauaccuagaacucacauaaagaagcuggguguggcuggaaguggcagugcucgaacucaggaggcagaggccgauggauugcugagagcucaagacuagccuggucaauggagugagacccugucucaaaagcaagcaagcaagcaagcaagcagcuggguguggcagcacugcgcacuuggaaccucacugcuggaaagguagacagguagucuauuuggcucacuggccagcuaggauagccugcauggugagucccagaacagcaaaacaaaguacaucacuccuccuugcaagaaaaaaaagguggacaguacccaaggaauaaacaauaccugaaggcccccagauauguaucucugugcucaccaguacaugggagcacccacacuauacaaacacacacaaagcagcccugugaacagugacaguguucucccucugugguccugggccgugucucaugacugcucuugcacucuuaguagaaacuuuagcuccaaacagcucacacaaggagucacagcuggguccacgcaugcaucugcccccaccuuugccacauauagcauacgauuugagagaaggcgguccuucgcauuucugugaaucuuccacagcaaaugagcugggggaguaaugacauggugacaccuccucagcuacauauggcaugugacuuguuggaaugccaacccguaugugcaagcaggggugcgggguugggguggaggguugggaaggauacaaucaagaggcagccgggccagggagugggcaagcgcaaaaugaucuggccagcagcuucuaccugugacauaaaccaggcacuaggcucuccggaguccccuucuaugcugccugguuccugaggaucuggcccgaggcaauguuagagucaaaguguaccugcacaaacauuccuagccaugguaggaaggagaacagacauccuuacuguugacaugaaguggguugugugcagaaacccuccuccaguucugaaaaucugucucaagggucagaucccuuggcgugaggaagguggauagagugaauuucagaaguccucuuucuuccuccaagcguuuggagaagaccaagaguagacucuccagggaaccaccaaaggcaagagccagaacuaccuaggaacuuucuucuggccccugcagaaaugaggguaaaauugaaguugcccccuaaaucuaccugggaggccuugugaaggaaguauuuuagaccuaugcugcuucccacucuacagguagaggcagauaguucucaacaacaggacauugugaagucacgcucagagcagugugccaggguggagugugggcuucaucaaaggagaaggcuuacaaccuaauggaaaaggacccucuggaagaugcuauggcuucucccucucagggauucugggccccagacaugagcccagucccucacugcugcugggagauaucuaagcccugcucucuuuuaggagaggugggggaggauuaugcaagccccagcuucuuggcagccccugguaccacccccaguaucgcccccgcucccucugcacuccuucccucagcugccucugcaccucugagcugcacuugaaaaccucuccccuucucgcauccuuugugggagacaaguugcuuagcagcaaacggaucaggaugugcuuaugcaacccagagcagcauccggacagccuguggaguggcuguggauggagggacacugccgacugcucaggauugcaauggaaacacuauccuacuucuucuugaaggcccaaacucccagucaggaccacagagcauuuguuccgauucaguggaaccucagcgugacagagcugacagaaaacacaugugaauugacuucaaaacaugaugacucauugagcguggggucugaagagcagagggacugucagucaaguauuaggaagcuauuggaggcucccacgcaaaccucuguccuucucuaccuuccaggucugaagaaaaggaacuuuccuggccaagaaccagcagccaacccuucuggaccccaugcccaugacccaacauugaaugagauagacacaccugcuugguccugagaacauauacaaaauauacauagacgcacgcauacucaccugcaggaaaagauaucagaauucucugagccucuuaccuugauguaauugaugaauucugucaggaagcugugagacugaagggcagagaaagcagugagugccaccccugguuggaggccugcucacccccgcaugcugcccgccugcagccugucuucuguucccaccccaucaccugcuuucauaagagguaaggaccuacacuuacuggcacucgacucgcuucucaguacacagucccaagugucuaaggugguguggacggccucggacuuaacacacacuacccucauggcacagaucucccaggagugaugggcccaccugcuccucagucaugguuucgcuaacaccuucuucuucuaccacgaaggccuccuucaguuucagguacuccucgugcucccgccgggccugcuccuccugagccuuccucucuuccuccuccuguggacacagaggaagaggcagguauuuggggcagcugcccacucacaucuguuccugucugcaggauacaagcuuaugcacuccagagacggugcuucuucaagacuuucacccuuuggucucaagcuaaccaacaggcagaggcucuccucauccgcccuaucauugcccaggccacgcugcccggacccuuccccuguccucuugcucaggagauuuacuuaggaaaaaaaaucuugaaaaccuugccgcaacuucuuccuggucaugucuaggucugaacaagcagcagauucuauacccuaccggcuggcacauagucagcccacuguuuccuaccagccacgcacacagccagcucacuguagucuggcuucugaaucaccugagaagagagucucacuaaagaacuguucugacugccuugcuugaugcgggaaggucccccuucccguggcagcccagaccaaaacggcagaucagaagauugccucgcccccgcucaggcagucucucugcucaccucccucucccauggaggccaaaagucgguaccagaucucaagcugggguugccaguguuugugugcuacuugguaagggcgcugggauccaaacucugguccucccauagagcagugagcccuuacccacugaccaucucucugcuuccuaacuguggcagaacagugacuuauuuccacacaaguaugaggagauggagaaaaauaguaaaagcauacagcaauaguucaaaaguggagcacuucccuggaauacacaggcuguguucaauacucaguccuggggauaaagaaaaccaaacaaagaaaacgacgacaacaacaagaacaagcaaaccccagcauaacuccagauuacgucaucccaggacuccaaaugcaggguaagcaaaguacaaguucaaggccagccugggcuacagagaguuuuagaucuauuuuuacauaguaagacccucucucaaaacaaaacaccccacaaaaaacaaaacaacaaaaaaaaaacaaauuaauucaaaauaaaauuuagaacaggguguggugguccuuuagucccugcacuugggaggcagaggcagaggcaggaggaucucuugagcuugaccucuugaguuugagacuagccucaucuauaaagcaaguuccaggacagccaaggcuauauacuguacaaagaaacccuaucuaaaacaaaacaaaaacaaacgauaauaaacaaacaaauaaacaaacaaaucucagggcuggaaagauggcucagcaguuaagagcacuggcugcucuugcagagaacccaguuugguugucagcacccauaugauggccccuauuuuuuuuuuuuaaucuaaaagacaaaggaaaauaaaaauaaaaacuagccaauccaaaucaagauacauuuuacagauuaguuuuccaauauccuucaaagcuaguaagaugauaaacaaggaaacccugacaaucaacccccacggaggccuaagaagacaaaacaagugaccaaacauaguguguuaaauauggcccugcaaaacaaaaauaccggggcuggagagauggaugguuagaagcacugacugcucuuccagaggaccuggguucaacucccaguguccacaugggagcucacaacagucucuaacuacaguugagggggaucugauguccucuucaggccucugagcuuauuugcagauaaagcacccauauacauaaaauaaaauuaaauaaaauauuagggccaguggggaugcaugaagcucaguuaguaggauuuuugccuaccaaguucuggguucaauuccuaucuaagccaggcaugugaauaaagugugccacuuaauuuaaggaugugcuauuauucuugugagaaauauaccaauacaugaaaaacuaaaacagggagaaagccagaacaaaggagguauauuaggcaugaccguuacucaaaggugaagaacuuucucugucaugcccuucacugacauuccuacagugugcauggccaggcuuccuccagacauacagaguucuggaacaagccaaccagacgcccuugugcuuuaugcauacuacagguuugcacuuuccccuuucuuagaaaccagguucuagaauaaucuggcaaauaagaauucauuaaucaucuuucaaugguggcuccaguucuccuaugcuaggcccgaacgcauucacugucuccuaagacugcggacaaucucaggguccucaggguccgggacugcuggacuucucuaucgacuuuguuccucguugcuuucucaguuccagacacucugacccuguucaaaugucuggguacccguagcucaugcucacaagaauccccagcucugggcuggaaggagcucagcacuuaagagcauuggucgcucuucuagaggaccuggguuccaaucuggaacccaaugguggcucacagcuauuuguaauuccagucuucuggccucuauaggcaccagggauauucacaguguacagacauacaugcaagcaaaauacccauacacguaaaaggcuuuguuuugguuuuuuggagacaggaucucucuacauagcccuggccauccuggaacuuaagagauuggccugucucugacucccaaaguauaaaaacccuguaccaucauacccagcuccuuuuuucaaccccccaccccauacacauaaaauugagggggugugugugugaaagagacucucaggucaaagccaugcucuuucggcaggugauguucugaggcaggcccuugugcuggguccauggucaauccuuaguuuugaagacaggaguuagcuaguuaguccagguuguccuccugccucagcuucucaagugauuauagguaggagugggauuauagguaggagucaccaccauacccaguaccauggccuauccuguaggauggagacauuugggagcaagguuagauacuaaugggccaggcaacaggguccagggucaaucuuaccuucuguucuuccuucaggcgaagccguuccucuuccuucuuccauucggccucacguugggacucuaggcguuuccguucuucacguucagccuccucugccuagagagagauuucuauagcacauuuccucuuccucuagcuaguuuucucaccccccacagaggccaaagaaagccacugccugggccaggacaagggcuaagacugcaggccacaaagccagggagacagcaaacaccagcagagcguaaaaggaaccccaagggcagucugucaugggaacuagagauugguucuuuuccuaccccuuggagcuauuccccaaccucuugcuugccucucgcugagccuuucgagccuguuuuuccucuagcuuccguaguuucuuggcuccaauuuucccuguugggugaacuucugcuggcuucucaaugccuucuuccuccugggcugaguaugaucagacaaagacaaucugaguccuagacagagaagacucacccccgccccuugugacuuucuuuaagggauaggguaggggugguuucuaccuaccucugcuuuccagaagcaucuaccauauaugugcauacacauaccaguguaagaacaaacacauuauguacuugggggguggugguggugguggaaggccacacacagggacaaaggagacuuagauacugcacagcuguaagaugucaauaccugaauguuugagacucauauguaccugcagaagucccuaauuucugucucugugccaaaccuccaaggaaguuuauuccugcauaaauccaacguccuguauguucuagucaggaacugaugagugucucagacuccuucaaccuuaccuacaaccucccaaaggagcuuuaucuuuaaaauaaaggaugcuuuaucguaacagagccagacagaaaaaaauaacccuaaccucaggacuacuccagggccagcugaaaauaacugauacgcugaugccugggccucagaguauaggacccaaaucugagacaggacggacggugaagagagggucucuuuguugcggcugggugcugcuuuugaaacggcuauauaagcauggcuggccugaaacuucccaugcuccugccucuguuuucugagugcaggaguuauaagcaugcacacauacccacugaaggucucuuuuuaagacaaaggggcuaauaaucccaaggagucaaagccaaagcccaauuuccccuaaauucucuucuuccuaccaagccagacuucaaguacuagagaagacacauucuuucccacaaccaugcggauuuuguaagacuccaagugucugcuguguggauguaaauaucagcugaaaugucucuauuucuaagcacuuauucuaggguuacagcuaauugcacugaaccaagaugaaggaagugacgcccaauagaacagggauugaguuaagaaaugcugacuucaaggaccaaagcccaggcccaagacuccaguccuaccacuaaauguccuuccuccacuggcuucaugcuccuugugugucucuagcuugggagacuuccgaacgccuuuaauccagcccucccccaggcugggcccucuuaccuggaauaacaguuugacccacauucucauccccgucuucccaggccacucgcugggcucgacgcugggccuguagacggcugcccaagucccuccgacgccggggucugcuuccaguucucuguucuucagacuccuggggcaaagagcggccuaccuggccugcuccugcccucucuuccucauugugcagugguucuccgucagcuuuugggagggaggaaucauaacacugucaagcagcccaucuucaagagagugaagcacaggaucuugggagucucaucccccugcugaaccaccucagacuauugcugcccacagcaccaagucccaacuuagguuugucaaggccuuuuuuguacgcacacuuuggccugaugcucacuucucauuuccuaccuccuuugauaucuucaucuugaacaggcgaccugugaggauacucucacccugagguuuacagaucucgcuccaugcccgcugcaagauuacauuuacuucuugcuauguuaugauuuuauaggguacgccaaccagagacuacaugucacagucgaggcugaaucgucccucccuggaagacuuguuggcaaucagcuuuaccucagcuucugucucuucugcccgugggacacagaggugcucugagguggcuuauggggucaggcaucagagagauauauagaaacuccuacacuuacgugaaauguuaguaagggggacugucagguugucagugccaggccacuucuaacccugguggaggcgaggcaaagcagcaugggugcccucuuuggcgggagaugcauucaguuuccuaaggcugcuuagcccuccuacuccuaguaagcggaacacacugggcaggauuagaaaaccggcagccucuccuauuggugcagaguagaaaggcaggcuugguuccuagguugcauccccagcucugggcuccgcgcuaauuccgaguguguccuaaggcgcgugcgcaaagcucgggccagcgcacaagcuccucguaagcacaggaaagcucgucagugcaugcgcacgagucgagggccuaccaaagcccaggaacucugaaaaacggauuccuccagcccugggacggcggcaccuccuaccugcugccgcccgaccccggcugcgagucaggaagaggaucaggccgaugagcaaaacugccgccaccagauacacccagggccccaccaugacgacagacagccgggcagcgcagccagcgcgccugcgggauccggaucgccaggccccgcccacuaccguccgcccugcccagccgcucgcug

SEQ ID NO: 1096 - RNA, 31897 nt, Mus musculus
cagcgagcggcugggcagggcggacgguagugggcggggccuggcgauccggaucccgcaggcgcgcuggcugcgcugcccggcugucugucgucaugguggggcccuggguguaucugguggcggcaguuuugcucaucggccugauccucuuccugacucgcagccggggucgggcggcagcagguaggaggugccgccgucccagggcuggaggaauccguuuuucagaguuccugggcuuugguaggcccucgacucgugcgcaugcacugacgagcuuuccugugcuuacgaggagcuugugcgcuggcccgagcuuugcgcacgcgccuuaggacacacucggaauuagcgcggagcccagagcuggggaugcaaccuaggaaccaagccugccuuucuacucugcaccaauaggagaggcugccgguuuucuaauccugcccaguguguuccgcuuacuaggaguaggagggcuaagcagccuuaggaaacugaaugcaucucccgccaaagagggcacccaugcugcuuugccucgccuccaccaggguuagaaguggccuggcacugacaaccugacagucccccuuacuaacauuucacguaaguguaggaguuucuauauaucucucugaugccugaccccauaagccaccucagagcaccucugugucccacgggcagaagagacagaagcugagguaaagcugauugccaacaagucuuccagggagggacgauucagccucgacugugacauguagucucugguuggcguacccuauaaaaucauaacauagcaagaaguaaauguaaucuugcagcgggcauggagcgagaucuguaaaccucagggugagaguauccucacaggucgccuguucaagaugaagauaucaaaggagguaggaaaugagaagugagcaucaggccaaagugugcguacaaaaaaggccuugacaaaccuaaguugggacuuggugcugugggcagcaauagucugaggugguucagcagggggaugagacucccaagauccugugcuucacucucuugaagaugggcugcuugacaguguuaugauuccucccucccaaaagcugacggagaaccacugcacaaugaggaagagagggcaggagcaggccagguaggccgcucuuugccccaggagucugaagaacagagaacuggaagcagaccccggcgucggagggacuugggcagccgucuacaggcccagcgucgagcccagcgaguggccugggaagacggggaugagaaugugggucaaacuguuauuccagguaagagggcccagccugggggagggcuggauuaaaggcguucggaagucucccaagcuagagacacacaaggagcaugaagccaguggaggaaggacauuuagugguaggacuggagucuugggccugggcuuugguccuugaagucagcauuucuuaacucaaucccuguucuauugggcgucacuuccuucaucuugguucagugcaauuagcuguaacccuagaauaagugcuuagaaauagagacauuucagcugauauuuacauccacacagcagacacuuggagucuuacaaaauccgcaugguugugggaaagaaugugucuucucuaguacuugaagucuggcuugguaggaagaagagaauuuaggggaaauugggcuuuggcuuugacuccuugggauuauuagccccuuugucuuaaaaagagaccuucaguggguaugugugcaugcuuauaacuccugcacucagaaaacagaggcaggagcaugggaaguuucaggccagccaugcuuauauagccguuucaaaagcagcacccagccgcaacaaagagacccucucuucaccguccguccugucucagauuuggguccuauacucugaggcccaggcaucagcguaucaguuauuuucagcuggcccuggaguaguccugagguuaggguuauuuuuuucugucuggcucuguuacgauaaagcauccuuuauuuuaaagauaaagcuccuuugggagguuguagguaagguugaaggagucugagacacucaucaguuccugacuagaacauacaggacguuggauuuaugcaggaauaaacuuccuuggagguuuggcacagagacagaaauuagggacuucugcagguacauaugagucucaaacauucagguauugacaucuuacagcugugcaguaucuaagucuccuuugucccuguguguggccuuccaccaccaccaccaccccccaaguacauaauguguuuguucuuacacugguauguguaugcacauauaugguagaugcuucuggaaagcagagguagguagaaaccaccccuacccuaucccuuaaagaaagucacaaggggcgggggugagucuucucugucuaggacucagauugucuuugucugaucauacucagcccaggaggaagaaggcauugagaagccagcagaaguucacccaacagggaaaauuggagccaagaaacuacggaagcuagaggaaaaacaggcucgaaaggcucagcgagaggcaagcaagagguuggggaauagcuccaagggguaggaaaagaaccaaucucuaguucccaugacagacugcccuugggguuccuuuuacgcucugcugguguuugcugucucccuggcuuuguggccugcagucuuagcccuuguccuggcccaggcaguggcuuucuuuggccucuguggggggugagaaaacuagcuagaggaagaggaaaugugcuauagaaaucucucucuaggcagaggaggcugaacgugaagaacggaaacgccuagagucccaacgugaggccgaauggaagaaggaagaggaacggcuucgccugaaggaagaacagaagguaagauugacccuggacccuguugccuggcccauuaguaucuaaccuugcucccaaaugucuccauccuacaggauaggccaugguacuggguaugguggugacuccuaccuauaaucccacuccuaccuauaaucacuugagaagcugaggcaggaggacaaccuggacuaacuagcuaacuccugucuucaaaacuaaggauugaccauggacccagcacaagggccugccucagaacaucaccugccgaaagagcauggcuuugaccugagagucucuuucacacacacacccccucaauuuuauguguauggggugggggguugaaaaaaggagcuggguaugaugguacaggguuuuuauacuuugggagucagagacaggccaaucucuuaaguuccaggauggccagggcuauguagagagauccugucuccaaaaaaccaaaacaaagccuuuuacguguauggguauuuugcuugcauguaugucuguacacugugaauaucccuggugccuauagaggccagaagacuggaauuacaaauagcugugagccaccauuggguuccagauuggaacccagguccucuagaagagcgaccaaugcucuuaagugcugagcuccuuccagcccagagcuggggauucuugugagcaugagcuacggguacccagacauuugaacagggucagagugucuggaacugagaaagcaacgaggaacaaagucgauagagaaguccagcagucccggacccugaggacccugagauuguccgcagucuuaggagacagugaaugcguucgggccuagcauaggagaacuggagccaccauugaaagaugauuaaugaauucuuauuugccagauuauucuagaaccugguuucuaagaaaggggaaagugcaaaccuguaguaugcauaaagcacaagggcgucugguuggcuuguuccagaacucuguaugucuggaggaagccuggccaugcacacuguaggaaugucagugaagggcaugacagagaaaguucuucaccuuugaguaacggucaugccuaauauaccuccuuuguucuggcuuucucccuguuuuaguuuuucauguauugguauauuucucacaagaauaauagcacauccuuaaauuaaguggcacacuuuauucacaugccuggcuuagauaggaauugaacccagaacuugguaggcaaaaauccuacuaacugagcuucaugcauccccacuggcccuaauauuuuauuuaauuuuauuuuauguauaugggugcuuuaucugcaaauaagcucagaggccugaagaggacaucagaucccccucaacuguaguuagagacuguugugagcucccauguggacacugggaguugaacccagguccucuggaagagcagucagugcuucuaaccauccaucucuccagccccgguauuuuuguuuugcagggccauauuuaacacacuauguuuggucacuuguuuugucuucuuaggccuccguggggguugauugucaggguuuccuuguuuaucaucuuacuagcuuugaaggauauuggaaaacuaaucuguaaaauguaucuugauuuggauuggcuaguuuuuauuuuuauuuuccuuugucuuuuagauuaaaaaaaaaaaauaggggccaucauaugggugcugacaaccaaacuggguucucugcaagagcagccagugcucuuaacugcugagccaucuuuccagcccugagauuuguuuguuuauuuguuuguuuauuaucguuuguuuuuguuuuguuuuagauaggguuucuuuguacaguauauagccuuggcuguccuggaacuugcuuuauagaugaggcuagucucaaacucaagaggucaagcucaagagauccuccugccucugccucugccucccaagugcagggacuaaaggaccaccacacccuguucuaaauuuuauuuugaauuaauuuguuuuuuuuuuguuguuuuguuuuuugugggguguuuuguuuugagagagggucuuacuauguaaaaauagaucuaaaacucucuguagcccaggcuggccuugaacuuguacuuugcuuacccugcauuuggaguccugggaugacguaaucuggaguuaugcugggguuugcuuguucuuguuguugucgucguuuucuuuguuugguuuucuuuauccccaggacugaguauugaacacagccuguguauuccagggaagugcuccacuuuugaacuauugcuguaugcuuuuacuauuuuucuccaucuccucauacuuguguggaaauaagucacuguucugccacaguuaggaagcagagagauggucaguggguaagggcucacugcucuaugggaggaccagaguuuggaucccagcgcccuuaccaaguagcacacaaacacuggcaaccccagcuugagaucugguaccgacuuuuggccuccaugggagagggaggugagcagagagacugccugagcgggggcgaggcaaucuucugaucugccguuuuggucugggcugccacgggaagggggaccuucccgcaucaagcaaggcagucagaacaguucuuuagugagacucucuucucaggugauucagaagccagacuacagugagcuggcugugugcguggcugguaggaaacagugggcugacuaugugccagccgguaggguauagaaucugcugcuuguucagaccuagacaugaccaggaagaaguugcggcaagguuuucaagauuuuuuuuccuaaguaaaucuccugagcaagaggacaggggaaggguccgggcagcguggccugggcaaugauagggcggaugaggagagccucugccuguugguuagcuugagaccaaagggugaaagucuugaagaagcaccgucucuggagugcauaagcuuguauccugcagacaggaacagaugugagugggcagcugccccaaauaccugccucuuccucuguguccacaggaggaggaagagaggaaggcucaggaggagcaggcccggcgggagcacgaggaguaccugaaacugaaggaggccuucgugguagaagaagaagguguuagcgaaaccaugacugaggagcaggugggcccaucacuccugggagaucugugccaugaggguaguguguguuaaguccgaggccguccacaccaccuuagacacuugggacuguguacugagaagcgagucgagugccaguaaguguagguccuuaccucuuaugaaagcaggugauggggugggaacagaagacaggcugcaggcgggcagcaugcgggggugagcaggccuccaaccagggguggcacucacugcuuucucugcccuucagucucacagcuuccugacagaauucaucaauuacaucaagguaagaggcucagagaauucugauaucuuuuccugcaggugaguaugcgugcgucuauguauauuuuguauauguucucaggaccaagcaggugugucuaucucauucaauguugggucaugggcaugggguccagaaggguuggcugcugguucuuggccaggaaaguuccuuuucuucagaccuggaagguagagaaggacagagguuugcgugggagccuccaauagcuuccuaauacuugacugacagucccucugcucuucagaccccacgcucaaugagucaucauguuuugaagucaauucacauguguuuucugucagcucugucacgcugagguuccacugaaucggaacaaaugcucugugguccugacugggaguuugggccuucaagaagaaguaggauaguguuuccauugcaauccugagcagucggcagugucccuccauccacagccacuccacaggcuguccggaugcugcucuggguugcauaagcacauccugauccguuugcugcuaagcaacuugucucccacaaaggaugcgagaaggggagagguuuucaagugcagcucagaggugcagaggcagcugagggaaggagugcagagggagcgggggcgauacugggggugguaccaggggcugccaagaagcuggggcuugcauaauccucccccaccucuccuaaaagagagcagggcuuagauaucucccagcagcagugagggacugggcucaugucuggggcccagaaucccugagagggagaagccauagcaucuuccagaggguccuuuuccauuagguuguaagccuucuccuuugaugaagcccacacuccacccuggcacacugcucugagcgugacuucacaauguccuguuguugagaacuaucugccucuaccuguagagugggaagcagcauaggucuaaaauacuuccuucacaaggccucccagguagauuuagggggcaacuucaauuuuacccucauuucugcaggggccagaagaaaguuccuagguaguucuggcucuugccuuuggugguucccuggagagucuacucuuggucuucuccaaacgcuuggaggaagaaagaggacuucugaaauucacucuauccaccuuccucacgccaagggaucugacccuugagacagauuuucagaacuggaggaggguuucugcacacaacccacuucaugucaacaguaaggaugucuguucuccuuccuaccauggcuaggaauguuugugcagguacacuuugacucuaacauugccucgggccagauccucaggaaccaggcagcauagaaggggacuccggagagccuagugccugguuuaugucacagguagaagcugcuggccagaucauuuugcgcuugcccacucccuggcccggcugccucuugauuguauccuucccaacccuccaccccaaccccgcaccccugcuugcacauacggguuggcauuccaacaagucacaugccauauguagcugaggaggugucaccaugucauuacucccccagcucauuugcuguggaagauucacagaaaugcgaaggaccgccuucucucaaaucguaugcuauauguggcaaaggugggggcagaugcaugcguggacccagcugugacuccuugugugagcuguuuggagcuaaaguuucuacuaagagugcaagagcagucaugagacacggcccaggaccacagagggagaacacugucacuguucacagggcugcuuuguguguguuuguauagugugggugcucccauguacuggugagcacagagauacauaucugggggccuucagguauuguuuauuccuuggguacuguccaccuuuuuuuucuugcaaggaggagugauguacuuuguuuugcuguucugggacucaccaugcaggcuauccuagcuggccagugagccaaauagacuaccugucuaccuuuccagcagugagguuccaagugcgcagugcugccacacccagcugcuugcuugcuugcuugcuugcuuuugagacagggucucacuccauugaccaggcuagucuugagcucucagcaauccaucggccucugccuccugaguucgagcacugccacuuccagccacacccagcuucuuuaugugaguucuagguauuggacucacguccucagaagcacaaaagcacuugccuggcaaccaucuugccagccuuagugauaguuauuuggccauuccaggugagagaggguuaugccucagacagugugaagaggcugagugaaaagaaguguacaccucucaggacaguggagaucgaagcagaagaaugugaggcaaacacaagagagaaacaagucucugggccuugugaaagaccucaggccuguuaucaucuggucuguguaugucuguuucaccagauaggcuuuuagcucagcgguagguacugacucuuguuuaccauuccugcaguucuucuuuuuuccuuuaaauguguaugaauguacagucuugaacuccugaccuuccugccucuuucugucaaauacugagguuacagauaugcaccacaacaccuggcuuagguaaccauuuucuauuuuuaaaaacuugaaaacaaaagaccaacuuuugggcuggcaagauggcucagcagguacagauacuugaugucaaaccuuaagaucugaguuuaguccuuggauucacauggugauuagagagaaccaacuucuggaaguuguccucugagcccucuacauguguguuguugcacauacacacacacacacauuaauuaauuaauuaauuaauuaauuagaaaauguugguuuaaagaaauggugugugugugugugugugugugugugugugugugugugugugugugaauguagaauccagaagacagcucugcauauuguuucuuaggugcccuccaccuuuuuuuaaagauagggcaucacacugucauagagcuggccaaguggucucagccucucucucuccucucccuuuuaucuguagaaguccaagguugugcuuuuggaagaucuggcuuuccagaugggccuaaggacucagguaagccugagaauauggaauauagcuacagggucuguggccaguagagaguaggaggcuggccugaagaugguaaguugugaugcccuuucagacuguccccaaccaagagugaacagaguguagggauuucuuuacacuccaggaauucugcauuucuacagagaugaaaagaacaggaaagaaaaaggaaagucaagugcuauacuguccugugaccagcgcagcccaaaucuaguuacuucuugccagagguugucuugccaugggacaucuccacuauuccuuuuccggcuggaagagagcuuccgucggggcuuggcauuuccaaugaucagagccccuucagucaggacucccuccuaggagaaccacagccacagcaggaguagcacccuagggagagagaggagaaaugaugggucuguggguaugggaaccacgaaacgagcucugagacuugguuuccucacaggacgccauaaaccgcauccaggaccugcugacggaggggacucuaacaggugagagccaagccuacaaacaggcccugaccuguggggcuugagugagcacagaggccucagacuuguuccaaaggcagccuggccucuccggggcaggagggauacgcagugagggacacuuaggaauuggacuuggucacaaggaagaccuagaagccuccgccuagcuuuggagugaggcaugggaagaaaggauuugugcaacucacccacaugggcuuugauguacccaggaaggcugacaggagaucaguuauaaaggaauagauggaaauucucagguuagguagagaaagcccaggaggacucaguccuacuacgugcauguccccacaggugugauugacgaccggggcaaguuuaucuacauaaccccagaggaacuggcugccguggccaauuucauccgacagcggggccggguguccaucacagagcuugcccaggccagcaacucccucaucuccuggggccaggaccucccugcccaggcuucagccugacuccaguccuuccuugaguguauccuguggccuacaugugucuucauccuucccuaaugccgucuuggggcagggauggaauaugaccagaaaguuguggauuaaaggccugugaauacugcugagcuuguuguuuguagaagaccucacuggggucucagauaagcagguaaaauaaaccucaggguuuaucuuagaggugccagaagucccacucauguuucacaagaaaccucuuaacacauuuauuauauuuaugcccugcaagccccaaucccuagauaaguaccuucucaugggcagagaaaagugaagauuggaagucucucaggccauaucuccuccaauuggugagggaaaucucaccaucuuauuuacagacccagguguucugaguaagcugaaaaccuuagggagaagaguuaaugagaaaugccaaagauagaguccaggagacauaggucccucugaaaagaaggucucuggaagaaagacuggcuggcuguguaugagacagggagaggaggaaggaccaguggggcuggauguaacaguucugacaacacaucacaugaauucagcccugaauccuagacaagaaaaagauguagcuggugugggugauucugcccacugcaggauaugaggaacauaugcucagaagugggugugggauggaagaugugggacucuugcagggucauuugcucugguuccugugggcugugcauguggacgagacacauuuuugaauuauuuuauguguaugggguuuuugccuguguggauuugugugcaccaugugcgugucuacagaguccagaagagggcaugagauccccugguacuggaauuacagaggguuguaagccaccguguguguguguguguguguguguguguguguguguguguguguguguguaggcaauauuucacuagcuggcuugaaacucacuuuauagaccaagcuggccuugaacuuagagaucuaucugauucccaagugcuagaauuaaaggcaugcaccaacaugugcagucuccuuuguuuuuugagacaguaggcauuuguagucaguaaauagagaaaaggaaagggcuguaugcauuguugguaaggccauuuauagccuagucuuuguaagagagggaaaaaaugcagaugaccacaguaagagaagguaggagagacauaguugacaguagucagccuaucagugguuacuuaguuauuacauccaccugugggguucuuaguauuuuccucauagacuacacacaaagcaaguuaagaaucuugaugccaucagaauacaucaacagcagauugccaauggcagcaaggcugaaaacccauagacuacacugugaagacuggggagaugguucagcagguaaaagcaccauccauaaggaccuguugacccagguucaaucccugauaccacauauaagcuaggaauguuaccaugcaccuguaaucccaggacuccuguggugagaugguagcagagcccucaaauucagggugcucuggacuuagccucccaggggcugggauuauagguauauaugccaugcuccugcuuccagcuuuuaaugaucggugauguuccaaaggcuugauaugaaagaaaaggccuauaaccuguguguguuuucugcauauuguguguguguguguauguaccgcauacauguaaugcccauggaaaccagaaaauagcauugaauccccuggaacuagaguuccaaacaguuugagcuaucauuuggauucuaggaaucaaacccaggcucuggaagagcagccagugcuuuuacccacccagccaucucuccagccccacuacaagcauauaaucuuuugugcauuauguauucauuaucuaguacuuaaucuguuaauguaauaaacauauuaaacgaacaguucauuaaauaguaaguagcuaacaguucacuaaacauguacaaauuucuuucacaacuagucagauaaaacuugaagaauaaaguaggcugguggcauacacuuuuagucccacacucaggaggcaggggcaaguggaucucuauguuugaggccagccuggucuacauagugaguuccagaacagccaggcuaagauuacuaauuuuuaaacauuaaauguuaagauuucuaaauauuaaaaauucucaagcugggcaugguggugcacaccuuuaaucccagcacucaggaggcagaggcagguggauuucugaauucaagggcagccuggucuacaaagugaguuccaggacagccagggcuauacagagaaacccugucucgaaaaaacaaaacaaaacaaaaaauucucagggcuguggauauagcauauauaaagucucauguuugauuuuuagcacuacacacaaaaaguuaacauauaaauauuuuaaacacuuguuucuguuucuagauaggcucucauguaacucaagcaaaucuuagaagcaacugaggcaaacauuucagaguacauugcuugccacagucuaguguguggugcuuuuugucuacuguacuucaaugcuggucuagauuuucagcacuucgaugguggcuugaucuuacagucauucaacaaaucuaauuuuugucuauuuuaaacaagaucuuacuaagcuccagccugagcuggcuuugaacucucaaaguucuugucucugccuuccaaacacuggaaucauuguacaccacuacacuuggcuccaugagcagaucuuuuaccuggagaugugagaauguacuucaguauuagaguacuucaaugugaggcccugcauuuuauccccaacgccuaaaaauaagaaagaagagauaaaagguguccuaaagagccuuguucauuucauaucgaguacaggguaagaaugaguaccuagguaagcauuauauguuguacauuaauggugugaguaugugugugcuugauugguuguucauuuugaugauggauauuaaacuugaugccuuugauaugcuaaacagguacucagccaauaugaccaaaugcaaucagccuccuggguguuaggauugaaggcuugagccacuacauuggcaaugucgugguaugugggggugugucugucuguuugucuguuguacuuaaggaggccagugguauccccuggagugugaggcaguucugaguugccagauaugggugcugggaacugaacucagggcuucuucaagaauagcaguuuugcuaaccacugagccauuucuccagcccuauuauuuguuuguuuaaagcuuuuguguguguguguguguguguguguguaucaucugguugcagguauccaagaagugugucagauugcaggagcuagaguuauaagugucaggucuacacaucccugggacucacuauguagacuggacuggcugccuuugucacuuuuguauugcuuugugaagagacaccaugacugagacaaccuguauagaggaaagcauuuaaaugggggcuugcucacaguuucagaggguuaguuucuuagcauuaugguggggagcguggcaacaggcaggaagguacuggagcaguaguugagaacucuacauccuuaauggcaggcaguaggcagagacugacagacagacagacacacugggccuggggugacacaccuccuccaacaaggucaccccuaaugacugauaucagcaggagacgaagcauacaaacaugagccugugggagcugaugccauucaaaacacccacagaagccauggacuuuggucuugcccggcugccuuacuguccuaucuugugcauauugucucguaucaaaauagacuggaguaacaaauacaaagucauaagugagauauuauugaguauauugcccauaaucaucaggaaguuguuuccacaacucaguuacugucccuacuaggugacaacucaggagaaaagacacugacauggcaaaaugagagacaaagguagauaauaaaagucucauuaggucaucaccaagucugucuggaguaaauauguagaacaaggguuugaaaauucugcaugcguccaugaaaucgguugagugucuguguaaccccagcacauacauaggugcuagcuacauggugagacgcucacggcccuccuuggcuacauagcaggcuccagggaacuagagacuuucccuucaacacaagaccaaaacaccucuucugcuucgcaaauaguaaagagaguuuacuuaggguagugauagauacuucuuuuuauuuuguaucuuacaaagaaguuuacaguggucaaguacagguggcuccuuaguauuagaauauaacucuacuauuauuuuauuucgauguuuuauuauuuagaaacaaagucuuacuguguagccuuggcaggcccagagcucucuauguaaaccaaggcuggcuuugagcucacagagaacuacucgcuucucccgguacuugagaucaaaagugugagccgucacucccaaaacaaaauugaauguugagaccuuggggaacauaaaaauacaaacaaacugucuacuuugggggcuggagagaugacuuagugguuaagagcacuggcugguuuuccaagugacccagguucaaaucucagcauccauaugccaguucacaacugucuguaauucuaguuuaacagauguaacacucucacacagacauauauggaggcguacauuaguuaaaaagugauacgaagggcuggagagauggcucagaaguuaagagcacugucugcucuucccgaggucaugaguucaauucccagcaaccacaugguggcucacaaccaucuguaaugaggacuagugcccucuccuggcuugcaggcauaaaugcaggcaauaccguguacuuaauaaauaaauaaaucuuaaaaaaaaaaaaagugauacgaagccgggugugguggcacacgcuuuugaucccagcacuugggaggcagaggcagguggauuucugagccuggucuacucuacagagugaguuccaggacagccagagcuauauagagaaacccugucucaaaaaaacaaaaaacaaaacaaaaaauccaaaguggagagugagcaaggugggaggcugucaccaucagggcagugccugauguccuccagaccuccacauaaaccaugcaccagcuuuauauauauacaucuaagcuaaaaguucaucauccaccagaguuuggugugcagaggcacaguucucccacagaagcagccccacauuccucuuugaagccggaaguugucuacuucacaguagacauuuggguugugauuucauucaccaacagugaccauccuauaccugcuuuucaaugcugccguaacaucuuaccagggccaagaguugggaacaacacagucuuccuucuuccuucuuuccuucuuccuuuccuuccccucccuuccuuccuuccuuccuuccuuccuucauuccuuccuuccuuccuuccaagauuuauuuauuuaauuuuauguaugugagcacacugucacugucuucagacacaccagaagagggcaucagauccuauuacagaugguugugagccaccaugugguugcugggauuugaacucaggaccucuggaagugcagucagugcucuuaaccacugagccaucucagcuccagauuuauuauguguacaguuauuuugauacagguucucuuguuucucaggcugaccaugaauuccaucuauaagaaaggaugaccuugaacuucuaauccucuugcuuaacucccaaguacaggucugcucaguuuuauauugugauagagcucaaacccaggacuucauguaagcacugaguuauagccacagcccaauguagauuuauuacauuuggaggcuuagaacucuaauauagguuaugcaggguaggacgggauuccuuucaagaaauagucugcugguuguccagguacaucugcagaaccaauuaugucauucucucuauccaguuuucuguggucaaguuaguuuuccuuauguuuuucucuuuacuuguuaacuuuuuuuguuuguuuggacaggguuuucuguguguagcucuggcuguccuagaacuacaucuguagaccaggcugaccuucagcucagagaucugccuuacucugacccugcucagccacaucaguguucuuauuuuuuuuuuuuuauuguuuuguuuuuuugagacaagguuucucuguguagcccuggcuguccuggaacucacuuuguagaccaggcuggccucgaacucagaaauccacuugccucugccucucgagugcugggauuaaaggcaugcgccaccacgccuggccaguguucuuauuuuaaaaaaggucucacugcauagcccuggcuggccugccugaaacuuauauauagaacucagaaaaguccaucugccucugccuccagagagugcugggauaaaggccugugccacuauacagacccagucaucacucuuuucuccuuccuuccucccucccucccuuccuuucuuuauucuuucuuuuuuuccagucuuuuuugauguuuguuuugaaugccucuucuuuaucccauugauaagacagggacuccuaaacccaaguuacaggagcugccaaacagaccaccugacacuagacaagugagauugauagcauguguuucuuaaaugcuuccauugaccgcaguucaauagaagaagauacuacaagccaggcaaggcugcacuggaguugugccugcuccauccacuugguacaaagcgugggggauuuacucacacauugaaaauaggagggcaaccugugcuuuagaccauauaggcuguguuuuuaccaaagccaagguaguacauaaucuggaaucuuaguaucagcugugauacuaagggcacaggcaugggcaugggcuuuaagacccucaucuuuguugccuggaagccagucuucuaauugccuuaggagcaagaggugggacucucagcuccuccugcaccauaccugucuggaugcugccaugcucuugcuuugaugauaauggacugaaccucugaaccuguaagcuggccccaauuauauguuguccuuauaagaguugccuuggucauggugucuguucacagcaguacgacccuaacuaagacagcuuggccuugaacacacaguaauccuacuucagccucacaagagcugcgauuacaggucugaacuaccaugccuggcuuggguaauuuuuaaaguuaauuuguuuguuuguuuguuuguuuguuugucuaggcuggccuagaacucauucuauauaaccuaggauauccuugaacuuuggucugccugucucagcuccaaauguauaaauuugaagagcaucaauacacaaguguuagguauugguauagguauuuucuuuuguuuuauuaauuuucuuuagcuaccauuucuccauguagaccuaguugauauggagaucauuaugugccccaggcuggcauuguggcagucuuccugccucuccuaccccagugcccagugcugggauuaaagguaugugauaccuuuuguggguuuuuuguuuguuuguuuguuuuucuaauguggauggguguuuugcuugcauguaugucugugcacugcaugcacuacugauggcuuuuggaggccagaagaggauguuggaucugagacugaaguucuagaugguugugagcugccauguagaugcagggacuugaaccucuagcggaaugaguucucuggaagaguagcuggcugguucuccuagcugcuaagcuaucucucuagcccaggaauaauuuacuguuuuuagaaggagucuuacuacauuguccaaacugaccuccaguuuguagguuuaaagucuuuccaccucaagcuucugggacaagcaugugcuacacacaugccacacauagcuaugacuucucuucccuucucuucucuucucuucucuucucuucucuucucuucucuucucuucucuucucuucucuucucuucucucucuuucuuucuuccuuucucucucuccuuccuucuuuccuuccuucccuccuucacucuuucuuucuuucuuucuuucuuucuuucuuucuuucuuucuuccuuccuuccuuccuuccuuccugucugucugucugucugucuuucugucuuucugucuuucuuucucuugaagcagguuuuuaugcuuagcccaggcuggccucaaacucucaguagucuucaugcaucagcuaccugagugcugggauagccccauccucuuugauaguauuacucugaagaaacaaaaccacauucuccaugaaauaaggacagagaacuguaaagagaauaauuuaaauugaacauaggggaguaauagaauaggccaacagggaugaaaugagcagaauaaaugucucuguggagacaccaaagaagauugaaucugugauggcuaaguuucacccgcuuucucaggaugcagagacacauuugacaacagucaaugaaugcaugguuuuagugggacccuaaaaaucuguucacaaaaugacaggaauguauuguggcuuuucuaaguugaaaagaucuuuuguuuuuagaaaauuaacaaauggugcuacugagacauauaguagcaacauuugaguccugaggauaaaaaaagcucugggcagaugagaugguucagcugacuccaacaguuguccugugaucuccacacaucugccauggcaugcucgcucuuccucaaaaacucaacaauaauuucaaaaggaugagacacacucauaaaaacucgagguaaagugucuucuuuagacagauaagcccagcucugccgccauuuccagugagacgacaaggggauaaagauggaagaugggaagaauuuugugaacagagagugaaagcauuuucaccuaggucagguucuuagaacugucagaaaacagucaugugacagguggguccaaaguaggaauagaaaaaucagagcuuaaauacuggcaauaacaugagaccaaguaaacagaguuggcagaagcccaaaccaaccuaaauggguaugugugguguuggaugcaauccaaggucucauacucgcuagguuuacacucagucccugaacuacaacauucuuacccagcauuccccaggcagaaacaagggaucucugacuuaagggccauggugaauacauagggaauuccaggccagccagacagccagagcuaccuagugagacccagucuuaaaaaacaaacagccgagcgguaguggugcacgccuuuaaucccagcacuugggaggcagaggcagguggauuucugaguucgaggccagccuggucuacagagugaguucuaggauagccagagcuauacagagaaaaaaaccaaccaaccaaacaaacaaaaucccucacaauaacgucucgaaauacauguuguugugggccaaucaaaacuuucucuugccugguagcacagaccucuaaccccaguacuugguaggcagaggccgucaggugucucugaauuugaggccuggucuagauggugaguucccauacagccaugccucuauagagagacccugccucagggaaaaagaggaggaggaggaggaggaggaggaggaggaggaggaggaggaggaggaggaggaaaagaaaaugucuccuggggauucuucccauauucuguucucuucucauccucuucucacugaaagggguagcaaagcuggacucaucugcuuaaaacaaggaugacacguuaccucucugaccuaaaugaauaucuuguaauaugguggccacaaaccaugaggaucaucacauuuccaugacacucaguucacagaguuguagaauauauaaaugaucugucauuggcuaaugacaauaagaucuuaguuuauuuaauauacuuccuuauuuggauugguugauugguuuuuuugguugguuggcuuuuugguuuuuugguuugguuugguuuggguuuuggguuuugguuuugguuuuuugagacaguguuuuucucuauguagcccuggcugucuuggaacucgaucuguagaccagguuagaaucggucucagagacccugccucugucucucaaguucugggauuaaaggcauuuacuuaauacauuuaaaagcaaucauuagaacugaaaacaggaauucauuaaauucacuauaggaaauaaaaacaauuguuuaaaaaggcaaaaaaaauuaaaaucuaugacauaguccuaugucauaggauggcuaaacucaucaguuaucacaaucacaaccuacagccuuuugcuaaggcggaagccugggccuagcuugcuuccucauacugaucagaccaagggcauaguugaaggcugagugcuuccuuuaggaaguuuuccugggcagcuggcaaccccuuuaguguaugccaccugcacuugccaagguguugaucugagucaaagauaaagucuuuacucaaucucuuuuuaggaugggguuuguuaguuuuacagcaggcacggggcacaagguauaaaauacaaauuuccuguagcgucaaguuuuaaauuggucaauuuauuggcucuugccuccaccuagaucauagucacaggugccuucacacccccgcaucuuguagguuugaaggcucuucaggguuuuuugguuuuuuuccccccccuuaauuauuuuuuaauucaguguaugguuguuucgaccauauguuugugcagcaccugcagaggccagaagguguccaaucccuuguaacuaguuaucaugugggugcugcgaauuaaacccagguucuauggaagagcagccagugcccuugaccacuaagccaucuguccagucccauauuugaaggauuuaggacaucugcugcacagggaauagcuggugcaggaguugaaucuagaguccaaacaagguuguccauaaaccaaagggcucauacacccagauacgggguucaaagagaguaggaauuugcuggauuucugguaggacagaaauuggggauugaccccaagaauuugguacaguggcuaacggacugaggccgaguaucugccacccagccuuuugggcaggcgggccggcgcucagcgaccaaagggguuaaggcaccgagucccacccccguccaggauuggcgggucccgggggcguggccggagggcgggcccgcguuugccgcagccgcuggugggcgggccgggcgcggggcgggaggggccaagagcagagcccggccgcgccgcgcgcccuguggggcgggcuucgggcugcgccagagagcgggacagcuagcgccggugucugagccucugcgccggacucugaggcagugaguaagugauacaggccugccggggugccccuccagguucucccucaggucaccaugcccgcugcaucgcucgcugcuucuggccggugggaagcuggggagggggcgcgucccgcugcuaggguaccggggagcuggggggggaugaggccgaugaugucauggacgcuucaaccggcgcgcggggagggggggguggcggccggagggggugcggcccggauuaugucaccucuucucucugcaccccgcccccccccgggggccacgcgcguugguggagaaccgagggagguauggguggaauuucuccaaccgcggagaccucuguggcaccuuugcagagauuuuguggcuggggucuaugugcuagugaauggcgacccucccccuccccccccacacacucugacacacacaugcacagcugaggcaggcuccugugugagcgggugggugggggugugcugucaguaccuucagcacugaagcacuggcuucaucagagucaggaucuaggggaugggccucuuccccugcaggugcccacauuuccaagggaagaugaaucuccccucacacaucccaaccaagaaguucugcucccugaaucccuucccuuaauccuuccuggaagcuuuuccuuguuucuaugucugcauucauuuccuauugacauugcucauaaccaacauccccacaaguauuggccuugcauuuucaugaugccgggggggggggguccagagaccccugggguaacacaggcuuccaauggggaaggcucacagugaaaucucccugggucauccugagcuaagugcuccaagaccucuuggguaccaaggaugcugaggaguauuuggacugguuccagaagaauguaggcugggcagagagcugagaagaggucauguguggagugaagagcugcuuucaggagaaauacaggguggauaucaagagaggccuuagagacucugcuacaaacucuacuugguugugggugccaaaaagaauaccauggauuuuacacauaauccguuuccuuuuuaaaaaaucgcuguaagguaggugugagaauuugagucugcuugagguuucguagcugagcugugauuuacaccuggagcugaugcugcaggaauucuaaggcccuugacccugcucggggaaggguuuagccagaguccauuuggccccucugacugcuaguauuguaaugucacaggcacugaggguugauagaacagaaauggaggcaggcucaggcaacaggcuaucaucccagagugaugcgguucaacugcccuugcagaucacacugucaccuagggcaguccuccucaagccucaaguccuaaagagggcucucagccccuccucuccccucaguuccuacuugccagggaaagagauuccacuccuuguccuuccaacucuaccaagguuuugaggaaagaauuugcaggagccugagguuggaagaggcaaggggcagggaguggcuauaagauguugacguuggcagguuagaacuguggcaaggaacucugugggaauugccuauggguugacugcaaagcuguccucacauagaaccugagaagggagccucaggacaaugucuaggaccccaagaaccugagaaggcucgacugaagcagagugaugcagugacaugugacccccuccaaacucugguuccuuggcacucagaaagggugugcacuucgcaguuuauaaagaucuucccaaacacucaccauguuaccccugucacucagucaacaugcucacuccugguguuugcuccuuccucugcagccucuggugcaguucccuugcuaguguucugccuuguuucccuggaggugccugccuucaguguugcuaucuaauuuuuaauuccuaucaaaauguuguuuggauuuuggggaaauguauguauaugcacacacagcaagaucauggguguucugcucugucucugccugcuucauucccuugagagucucucacugaagccagagcuaggcuggcagcaagcaacucucugagauccuccagucucagcccuccauagcacugugguuacaggcaccagugucacuggcuuuuuagguggcuucuggggauucagacucagguaaccaugcucgcgcagcaggcagucuuacugagccaucuccccagccuguugauuaauuauucuauuuuccgcuguuuguuuuuggaggcacaaucucaugcagccuagacuagacucuaccucaguauacgcuacaggugggccuugaacucuugaugugucuuugccugaaugccaccacguccagcuuucaggguuacuuuuagaagagaaagaaaagccuuugauuccacacuuccuucagugcaggccuccucuauccucucuucucaacacuuggccaucccuuugcuccgucugcuuuuguuuuacacagcuuuucugaagccauuuugacauagacaucaaugauguucucagcugcuaaauucaggccacgcuccucaacuccaguuuuaccuuuuggaauauuucuuuucaacacugguaacugcccuuguguccuuccuuccuucuucccuuccuuccuuccuccuucccucccuuccuuccuuccuuccucccucccucccucccucccucccucccucccucccucccucccucccucccucuuccuuuguuuuuugagauggaauuuuacuugguucucaucauugcaucaaacuucuggacucaagcgacccccucagguggcuuaggcugcucgcugcugcuccugcugucuuccugccuaucuuccuucuuguccuccucuucuuccugauauauauuuguacuagggauugaaucugggaucuugguagggacguagucaaccacgagccucaggcucacaaaguuacucaggauggccuugaacuugcaauccuuuugccuccaaauccagaguagcaaggauucugguuagugccucuguuuugaaucccccucccauuuugacugucagggcacagcuucucuuggacuucuugcugcucucccagacuuccucccagacuuaugggggcucuaccgcccuugcuccaugcuaggcccacccacgccacucucggaugcuaacaaucagucuuccacccuggaugagguaucuuuggucuucucccaggcaaucucugccugucauguuaaugaugucacacccacaccagcgcccuagccucuucucgcguucucuccaccugagcuccagcugcauaaggauuacaggucuuccuguaaccaugcccaggcuucccuguuggcuccaagccacaggccagccaaccuucacucugccagucuuuguacccccagaguggagauagcaggagcuaggggaaggcaaaaaaaaaaaaaaaaaaaaaaaaaucugagggcacagaaugccaagaggccucuccuuggggcggucgguauaccugucaccugugcauccugcacuuaggagcuuucuuagguauuugugcccaagacuagugcaagccuacaugugggcacaaacuguccuaaaggaggagggguggcaucugugcuguucuccauaucuguggggaugugcauggaacggauuucuacaacagcaaugaccagcuugcuagugaacuuacccagagccagauguaucguguggccaggagaaauugaaggguauguguguuggcagccucccagguuuagggcagccucccagguuuggggccugacaggaaggacacaacauuagaauugagcaucacaggagaaggagguuugcagagcauucaaggggaugcuacauggacccaacuuuaauagggaagaaaggugcccugcuuggugucugaggcuaucaggccugaagagcacucuucuuucauaauugguauucuuugagcuucaggccaguggcagggacuugccugaugucccuaccuacuggcauuauacagaucccuagggcagguguuccaaggagcuaacuugaaacaaaagaaccaggaagcaaauuaggcggcuuugagcucuaguaaucugaggccuuguucccccuucugugggacagcuuugaaagcacacccaacagaauuggcucaacgaacuucauggucaccugaacggggucaagguccaaagggguguguguauguggagaaauggcuaauccaagaacucuuccuggugguacugcauucuuagcaggguucagcaggcauggcauccucaggggucaccaaugguugcacaagccccgccccuccuucacccaccugugggaaaagccaggaggaaguagcuggcugcugguguucuagugcugcugcggcccugccccagccucugcccgauucgggacugcuguaaaguacugaucucagagagugggccacucuggggccaggcccccaugaggccaaguuaggaaaaccucugggaaagcccucuugcuaccugcugcagcuauagcccgugugcguuggucugcagaaccaugacugcucccacccgcgaccuuggcgcaggccgcagcggcagcuccgcccauacaacuccaagacccggguucuuucguucgccugccgucucugcggcagcacgguuuuuuaauuccucccauuucacagaggagaaagcuguaguacgggauggcuugguuggcuaguccaaagucgcgcagcugcuuagggccgagccuggauuucgagaaagagccauauggccccugcagaccuggccucggagggucccaagcuugaggacccgccggccccccaccucuuuggaaagguaagaagagaagucuacgcuguagucagcuuucaccuugaucauuuaccaauuugguucaggggggcugggaaaaacccgcgcugucagcuuuuuuuauauaaggguuauuuugucucuccuuuaaccucugagguccccuauuggauccaagcacugcuuuucucaaccaguccaaucuccccggcccaugaaacugaaauauaagagucaugcaugacccaggauaaauuuaaugaaaacuaaagucuuggaguagcagcacaguuaagaggauugcugggucuggaguggguuaaggaaugagcccagcucagaggguaugugcaccuucaucuuggaggccuggugacucugguguccauuguaaggaacacaaagagacaaagugggccccgguugacuugcuuggggguggaggugggauggauucugaccucucuaccuucccgcuugugccuacagugcccuucuggcuuaaucauggcgaagcuggagacguuaccugugcgcgcugauccagggagggauccucuccuggccuuugccccccggccuucugagcuuggacccccagauccccgccugacuaugggcaguguggguaguggggugacccaugcucaggaguuuccuaugaaaagcgugggcacucgaacagggggugggggcaaccaaggcaguuucccugguccaagaagcggugguagcggggccaacagggagagaccuggucgcuacccaucagaggacaagguucucgccaacucucucuaccucaauggcgagcugcggggcagugaccacacagaugucugugguaauguggugggcagcagugggggcagcagcagcagugggggcagcgacaaggcuccaccccaguaucgcgaacccaaucacccacccaagcuccugaccaccucuggcaagcuagaccagguuaguccccaggaccaggagagccucauagccuuguuuagagugggaauuguuaaccaagaaaguagguuaaggugggagcucuuagugggaugggcaccaucacagggagcccuggaguguaacccuggggcuacgucucacuuguggauucaggacagagaugguuugugggagacuugagguggaggcccagauggggagaucuaacagagggcaggaggugguucuugaacaagucuugggcguaaagaagaggaggggccaaggauaaaaucucaaucugaugccucuaaccuguuuccuuuucugcagugcucggagccacuaguucggccaucagccuucaagccuguuguacccaagaacuuucauuccaugcagaacuuguguccuccacagaccaaugggaccccugagggacgacagggccccgcgggccucaaaggcggacuggacaagucucggaccaugaccccagcuggugggagugggggcggccucucagacucaggccggaacucacucacaagcuugcccaccuauagcuccagcuauagccagcaucuggcaccccucagugcuuccaccagccauaucaaccguauuggcaccgcuggcuauaguaguggcagcagcgguggggggucaggcuaccaggaucuggggaccucugacagugggcgggcuuccaguaagagugggucgucaucauccauggggcggucaggccaccugggauccggggagggcggaaaugggggccugccauuugcagccuguucaccacccucgcccagugcgcugauccaggagcuggaggagcggcugugggagaaggagcaggagguggcagcucugcggcgcagccuggagcagagcgaggcagccguggcccagguguuggaggagcggcagaaggcaugggagcgggagcuagccgagcuccggcagggcugcagugggaagcugcagcagguggcccgccgugcccagcgugcccagcagggccuacagcugcaggugcugcgguuacagcaggacaagaaacagcugcaggaggaggcggcccagcugauaaggcaacgggaagagcuggaggacaagguggccgucugucagaaggagcaggccgacuuccugccccggauggaggaaacuaagugggaggugcgggcuggggggcuuagguguccccucucugacucccuuucaucuuuuuuuccccuggagaucccagacuuacuccuguguagggcggggaugggggugggauacgaaaggaguaggaccaauucaauucagaguaacugagaacagaggcugcccuggggggcucuagagaugagccuagcagggagccccccuaugagugcuuagugccuuuggagauagaucugggagcuggguagugauaagucuuuacuaccucggcugugccuuuaccccggcuucugcuuccgccugccccuguccaggugugccagaaggccggugagauuucccuccugaagcaacaacugaaggacucucaggccgaugugucgcagaaguugagugagaucguggggcugcgcucacagcuucgggaggguagggccucgcuccgggagaaggaggagcagcugcucagcuugagggacuccuucggcagcaaacaggccagccuggagcugagugaaggcgagcugcccccugccugccucaagccugcgcugacccccguggaccuggucgagccacaggaggcgcuggccuccugugagagugacgaggccaagaugcgccggcaggcuggcguggcggcugccgcuucucugguuucuguugauggggagguggaggcuggaggagagggugggacacgggcccuacgcagggagguggggagauugcaggcugagcuggcugcugagcggcgugcccgugagcgccagggugccagcuuugcggaggagcgccgggugugguuggaggagaaggagaaggucauugaguaucagaaacagcuccagcugaguuauguggagauguaucagcgcaaccagcagcuggagcggcgacuucgggagcguggggcagcagggggguccagcacgccuacuccccagcauggagaggaaaagaaagccuggacccccucccgccuggagcgcaucgaguccacugaaaucugauucucuacgugcacaaccuucugacacgugcccugucugaaggucggagucaccaaugucccuuccauucaucucccuuccccacgugugcugcacauccccagaccaaagagguucucgaagcagcugugaccagccccuccccccacuugucccccguccuugcagcuccagcacugccuuugugggugaccacuccagacccuccugccaaggagagcaugggagagggcagaguacaauggggugaggucccaggcgcauggagcaaggcucccuuucuggggaagccucguguuggagauagaggcagcaggccugcguugccagggaguaccccagccccuuucccuucuugggcugcuaccgccgccaccaccgucaccaccaucuguccagugcuacugucugugcccuccuaggccacacagccugagggagcuugcaugggucugcccgugucgacagacccuaggcucccagucucucuccuucaugugcuauucuccuuccccaggcagauuggcaggggaagugggagcagauggccugccugugguugagagggcuaccugcccgaccccucccccaccaagguaucuugggcuccagccucagagccuggacuaguucugagcaugugucccucuguguauagugaggaagugagagcagaggcuggaaacucaaucccaaggggagaucugccuuccuacccucgggaagggucaccuagaggcuucucagccccacccucacccucuggccaggauccuacaaggcuacauccccugcugcuugguugacccccccaaauccagggucacugcucagcucugcuuauagcuauaccugccucuuaggucuucuguuugcccguuucugaggucagauggauggaugucugaugucuuccuguguuuucccucgaucucuccccuuggccuccuuucgcacucacaucuucccaggcugccuuuucuuccaaguuucaccuuuccucccagcagaaagcucugcuuggcuuuuggugcacugcucacccccagcuccacuggcccaagucugagccuggggcccuugcuuugaggggccaguccgaguuggaugggacugcccucaaggaacaaggcuaauguguguguguauguuagagagagagagagagagagagagagagagagagagagagagagagagagagagagagagagagaaagagagagagagagaaagagagagagggaggacuacugacccuuggguugcuugccagacucuugaguuggcucauuuguccgggcaggguuggcugguauggucaucaguaugggucgugacagucaaugucacuuccuucucuaggaucucucagauucuaucuccccaagacaggcagggaaauucuaauuucucucuuaagaaaguaaauuuccacuucaccagcaauaacaaucagaggagacuuggcccucaguccuuguauuucucuuuuucacucucucuuccaccccaagauggaaucuuggggacaggagggagaggguugguaacuacugugagcaagucccccaagcccugaccagccuccucccaugacuggugacuguuuaacaagcugugcaucccccacaaaaauaggagugcccuauuuguagucuccaccucucugcacagcuccuucugggugguccucagcaggguuuugaccuugauuggcggcuacucuggcaaccacugcccauucuucuaaucccucacaauacgugauucagacccugagccugguccacagugacugggaaaaggcauuaacacaaaacaaaagagauggggggagagaaaaauaugaacagcuuuggaauguccaacugcaaaauaaauuauauauaaauauauaaauauauaaauauauauaucuaccauaugugauggaaagaguuuucauuuuuccuuucccaaagaaauaaaauggagaaagccucuuggauggcaauucugu

SEQ ID NO: 1097 - RNA, 2763 nt, Mus musculus
ccagcgcacaagcuccucguaagcacaggaaagcucgucagugcaugcgcacgagucgagggccuaccaaagcccaggaacucugaaaaacggauuccuccagcccugggacggcggcaccuccuaccugcugccgcccgaccccggcugcgagucaggaagaggaucaggccgaugagcaaaacugccgccaccagauacacccagggccccaccaugacgacagacagccgggcagcgcagccagcgcgccugcgggauccggaucgccaggccccgcccacuaccguccgcccugcccagccgcucgcugagcuccgcccccacccugggcuugaccugggccucaguuaacugaagagucccugaugccacauuugcuugccaucccagugcucgggaaguggagacucggagaccaacauuucaaggucgucucuggcuauauggcaacauggaggucgucugcauuuaaugacgcugacugcucuuccagugggccaggguucaguucgcagcacccacauaguggcuuacaaccuucuauuacuucaauuccaggggacccaaaacccucuucagacccucucgagugucaggcacgcagguuauacacagauaugcauaccugcgaaacacucauacacgucaaauaaguguuuaagaaaaaaagaaagaaaaaggaagaaaauaguggggcgaguaaguaggggacuaagcugggguuguagauuaguaguagagcacucauggccaaggcccuuaguuuaauuuggagcacugaaaaaugcaacguguguacgaauaucuuauuaauacugcaaguuaggcauccauuguauuacuuucuguaaauguggaauguuuuguaauuuguuucucaauguugauaaaccuaaggccuuccaggcgucaggcaagcgcuguuacgguaagcuuuaucucuagcaccuacguucuuuccguauauuuggagauuuagauccauguucggcugaagguugaggcuuugcuggaauuuuaucgcagcugccccccaccuuuaguuguuugguuuuguucugagacaggguaucugguagccuaggcuggccuuggacuugguguauaguagauggugacuuuaaacugauccuuugcuucugccucauaagugccuggauuauaugggaguacaggugugcacccugauguccagacgcuccuccaucuuuugaggauggguuguuuuguuuuaguucuuugagcucucauuauauggcccugccuggccuagaacucaauauguacacaaggcuggccacaaacuuagagggaucugcuugccucuuccuugguuauaauuaaaggcauguggcaccacagaccugccuggcuccugaauuauuauuauuuuuuuuccgagacaggguuucucuguguagcccuggcuguccuggaacucacucuguagaccaggcugaccucgaacucagaaauccaccugccucugccucccaagugcugggauuaaaggcgugugccaccacaccuggcuggcuucuuaacaaauguuauuuuauaugugauauauauauauauauauauauguauauuaauuaccuggccuauauauguaauauauaugcuuauaugugauuauauauauauauaaaaucuaguaccuguucucucucucucucucucucucuauauauauauauauacauauauauauauauauauauauauauauauauauauuuguguguguuugugacuucuuggauguuaaaugccucagcuucucucucucucucucucucucucucucuaaccuuugcuuuaaaaaccucuacuucuccacuuuucugaggauucccuuuaacuucaugaaagagagagacaagugacaugcaggaagggccauguuacucagcccagccuuucccagccaacucuaaugaaccacagguccucaaaaaauaacaccaucgaggggcagugaagaggacacuaugaucugucuccaaagacacuguauacagcaaagcuucugaauuguguaacacgcaauauuaaggucacgagcaaagauuugaggagaacauagcuuuggcuacucugugaggacagcucuagaguuuaagaaaaacucauuagugggcuggguauguggcucagugguacagugcuugccuaagucccauaagccccuuaaguaaguugcaucuauauaacaauacccaaggcuguacaagguuaauaacauuaagcuaaacagccaggcuugauuaggauucuauuguuugugugugugauucugggggccaaacccaggaccuuggucaugcuaugcaaauguucuaccaucaagcuacaucccugacaccauauauagcccaggcuagccuuuaauucaugaucuuccugcuuuaaucucagugcugggauuauaaauggccacacuuccagcuagcacccuguacuuuuguuuuguuuuuuguuuuucgagacaggguuucucuguauagcccuggcuguccuggaacucacuuuguagaccaggcugaccucgaacucagaaauccaccugccucugccucccgagugcugggauuaaaggcgugcgccaccaugcucggcuuuuuuuuuuuuuuaagauguuuuuuauauguaugaguguuuagcugcucguaugugcgcugcauuauauaugccuagugccuucagaaaccagaagagggcaaugcauucccaggaacuggaguuacagacaacuga

SEQ ID NO: 1098 - RNA, 2763 nt, Mus musculus
ucaguugucuguaacuccaguuccugggaaugcauugcccucuucugguuucugaaggcacuaggcauauauaaugcagcgcacauacgagcagcuaaacacucauacauauaaaaaacaucuuaaaaaaaaaaaaaagccgagcaugguggcgcacgccuuuaaucccagcacucgggaggcagaggcagguggauuucugaguucgaggucagccuggucuacaaagugaguuccaggacagccagggcuauacagagaaacccugucucgaaaaacaaaaaacaaaacaaaaguacagggugcuagcuggaaguguggccauuuauaaucccagcacugagauuaaagcaggaagaucaugaauuaaaggcuagccugggcuauauauggugucagggauguagcuugaugguagaacauuugcauagcaugaccaagguccuggguuuggcccccagaaucacacacacaaacaauagaauccuaaucaagccuggcuguuuagcuuaauguuauuaaccuuguacagccuuggguauuguuauauagaugcaacuuacuuaaggggcuuaugggacuuaggcaagcacuguaccacugagccacauacccagcccacuaaugaguuuuucuuaaacucuagagcuguccucacagaguagccaaagcuauguucuccucaaaucuuugcucgugaccuuaauauugcguguuacacaauucagaagcuuugcuguauacagugucuuuggagacagaucauaguguccucuucacugccccucgaugguguuauuuuuugaggaccugugguucauuagaguuggcugggaaaggcugggcugaguaacauggcccuuccugcaugucacuugucucucucuuucaugaaguuaaagggaauccucagaaaaguggagaaguagagguuuuuaaagcaaagguuagagagagagagagagagagagagagagaagcugaggcauuuaacauccaagaagucacaaacacacacaaauauauauauauauauauauauauauauauauauauguauauauauauauauagagagagagagagagagagagaacagguacuagauuuuauauauauauauaaucacauauaagcauauauauuacauauauaggccagguaauuaauauacauauauauauauauauauauaucacauauaaaauaacauuuguuaagaagccagccaggugugguggcacacgccuuuaaucccagcacuugggaggcagaggcagguggauuucugaguucgaggucagccuggucuacagagugaguuccaggacagccagggcuacacagagaaacccugucucggaaaaaaaauaauaauaauucaggagccaggcaggucuguggugccacaugccuuuaauuauaaccaaggaagaggcaagcagaucccucuaaguuuguggccagccuuguguacauauugaguucuaggccaggcagggccauauaaugagagcucaaagaacuaaaacaaaacaacccauccucaaaagauggaggagcgucuggacaucagggugcacaccuguacucccauauaauccaggcacuuaugaggcagaagcaaaggaucaguuuaaagucaccaucuacuauacaccaaguccaaggccagccuaggcuaccagauacccugucucagaacaaaaccaaacaacuaaagguggggggcagcugcgauaaaauuccagcaaagccucaaccuucagccgaacauggaucuaaaucuccaaauauacggaaagaacguaggugcuagagauaaagcuuaccguaacagcgcuugccugacgccuggaaggccuuagguuuaucaacauugagaaacaaauuacaaaacauuccacauuuacagaaaguaauacaauggaugccuaacuugcaguauuaauaagauauucguacacacguugcauuuuucagugcuccaaauuaaacuaagggccuuggccaugagugcucuacuacuaaucuacaaccccagcuuaguccccuacuuacucgccccacuauuuucuuccuuuuucuuucuuuuuuucuuaaacacuuauuugacguguaugaguguuucgcagguaugcauaucuguguauaaccugcgugccugacacucgagagggucugaagaggguuuuggguccccuggaauugaaguaauagaagguuguaagccacuaugugggugcugcgaacugaacccuggcccacuggaagagcagucagcgucauuaaaugcagacgaccuccauguugccauauagccagagacgaccuugaaauguuggucuccgagucuccacuucccgagcacugggauggcaagcaaauguggcaucagggacucuucaguuaacugaggcccaggucaagcccagggugggggcggagcucagcgagcggcugggcagggcggacgguagugggcggggccuggcgauccggaucccgcaggcgcgcuggcugcgcugcccggcugucugucgucaugguggggcccuggguguaucugguggcggcaguuuugcucaucggccugauccucuuccugacucgcagccggggucgggcggcagcagguaggaggugccgccgucccagggcuggaggaauccguuuuucagaguuccugggcuuugguaggcccucgacucgugcgcaugcacugacgagcuuuccugugcuuacgaggagcuugugcgcugg

SEQ ID NO: 1099 - RNA, 13414 nt, Mus musculus
cggaguuccuccaagcuuuuaaaacaggcgcgccccuucccuccgggcuccagugagugucccugcacugcucugaaacuucguagucccucccaggccggcaccccacgacucucaggccugcgcacgcgagccgccgaggauccagaacagaccucgcgggugagggcgcgacuuuggcuggaagcagccucacgccgcacgguuaggagcgcggcgcggcucgcaggagugucgccggcuccagcugcgagccggcccagaaccacggaguccugauugagaagcccgggccauggccacgccaggcguguaugccagcgccggccucucaggccugggugggcgagaggcugugccggcuuugcgccuccggagggguucgaccaaaagaguuccgaaugucagugcgcgcgcgcggggcaaggggcggccugggacaccgugggcauccuguccguguuuguucugcguucgcggucuugacacacacacccucagcaacugaaggaaagauguaacguagccggcggaggggaggguugggagcuccgaaaugggcaggguggcgcuuugguguccucagcaccggauugcguuccgccgccuagaguuacgauucaucagagcuggguguauccggccacucaccugcacguggguguggucuguuccccuuagcuaccgccccaagugccuccaaauccugcccaucuacucacucucaguggcugcaaacauggacuacaucuuuuucucguacaggcccauccucccgugcguccuucuuugcacaaacaucucggauaguaccuccaaucucuguguacugcacacccacucuaccccuucuuuccggcaucgcaggacacgguacaacccugggauagaggcaguugcugggucgguccccugggugaccccuaggccauugaagagaugggaagaacugcgucugagaugggcauguguggcccuuggcaaccagggcagaucugaggagaggcucacccccaccucaaagugcugggcgaggcugggcuggauccagggaggaggcgauuuccaguugucuuccuccagaacuggauggggcucagucagagacgcuuggauuaaugagccgaguacugaugauaauuuagugaugacaugaccugaggaaguacucuucacuucccuggcacgcauaggaaguccauacuaggcagacuaagggauuuaauaccuuacaguaaggauggucaucccagacacugcaggcuccccuacauaguacuuugacccccaccucucucaugcaagugggcuugcauguguuccuaggaaggaugaggaaucaucaggcauggggugaacuaaggcuguccagggcugguccacaggauuggugacuauucuuuggcuucuuuuguagaaaacuguccuugggccaugucacagaaugaacacugucaggacuccggugaauacuucucagguguguaucuagaaaaucuggggaacucagccuguguacccaucaaugaaccccaggcagagccacuuguccauagcccauugcuggggugguuagcucccaccuguccgaaggccguguggcuugcugaguaggcagcugaugagacuggccaaaggcaagcaaccaggggugcggaggucuugggagggcagauuaggcuaccagugccgcuuacaguuuucuccuguggcucaguauucccgggcccuucauaucuggccagcuuaggccacaugcuauacuaugccuuguccuguugggccucaugugguccuggagagagaggcugcaauugucccugcuucaacuggcuagcuccuucucugcauuuggcucuaugcugcuuaucugucuacccuuuguuucuuuguuuugucucauuugauuuuguuugagaaaaagaaaaaagaaauccucauguagccugggcuggccuaaaacuccccauguagccaaauaagaacuugaauuuccaauuauauccaaauauuaagauuacaagcuuguaccaccaaaccagguuuacaggguacuggggcgugaacucuggguuucaugcagguuaggcacauauucuacacaucgagcugcaucccuagccuucccauguuguuuaguagcaugcauuuaggcaucacggugauguguuuuuacccagaucuccugggugggagugcucuuugagucaggcuggaagcuggcagguuagauuuaugucugugcuacuuggaauggcauggcaggagaccuaagaggucugagagucaaggcuaagaaaaggaagagaaugaugcaucaggcuaggagcaguagcagaagcgagacugagccuggcugcuggaggagccauguggauuuacuuaauaauuucagcagggugucgggggugguggcacacgccuuuaaucccagcacuugggaggcagaggcaaguggauuucugaguuugaggacagccuggucuacagaguaaguuccaggacagccagggcuauacagagaaacccugucucaaaaaaccaaaaaaacaaacaaacaaacaaacaaacaaacaaacaaaaaaauaauuugggcaggaucucacguagccuaggcuagcuucucgaucacuagguagcuaaggauaacguugagcaucugaaccucuugccuacucaacaagccaaugcuaccuggcuccccucccagcccaagucauuuuaaauaagguaggcccacguuaaggaggguggcugccauggccuccacaagaggcaggggggaauucuuuuggcucaaugauucuccagggcugcggguggggugaucaccaggucaccucaggauaucuagguauaaggccugggauguucagaggaagcuaaagggcagggguggaaaugagucagggugagucacugucuggcaggugugggcaugccacugaccugucccugucccugugcaggugugugccagccauuaguggggucuggauuacaucggccucuuuccuaaaagugcccacagauguggagcuauacggcagucugagagagguucugacugugcugggaaagagaacucuaaacgagcccgacgauaacccuggagggagagaugcucuccuggcuuacaggacaagagugggcaugucuauggcccuagcugucuagccuaaggagagauggagacagucuaacugaccagaggcaccaaggccuaaggaaagaauaagaggcuggcccgggcugugauuuuuuuuccagggcuacagggaaaagggggauuuucauguucuauagaacccuuccugcugcaucuuggaaaggaagggcacaauggaagucgacuaaggaggccuuccaucuuccagcuguuucacaggcuuucuugccuccugggucuuacagccuugaugcucugcccucagucuucccugcccuccccgggaggagggcucuaagcccugcaccaaugaggcaagggaggugggggugguuggaaucggcugcagcuucaccucccugggguucccagccagagaaagcugggagaaagcagccuuuuauuuuaaauuuuauguuuguuuucauauauauauauacacacacacacacacacaaacacucagagccaauacagacucuuuuuuggagcauguauguguuuguuuguaagugcauguguauagaaggccagaaggcucccuuggagcuacaguuagcauuugugagcugcccagccuugggcugccaugugaucugaauuccuauccucgugauuaagcagcccgugcuuaucuuaaccacugagccaucucaccagcccaacuuuuuuauauuuugaaauagggucacacuaaagcccagguuggccuggaacucauguaguccuccugccucagccucccgagugagacuguggaaugaggcucuugcacacaguguuuguuugcuuuuugcuuuuguuuuuucuuagacugggccuaauuguguagcccgugcuagccuuaaacucuugauguuccugccucagccuucugagcuuuauauaauaggcaugugcuagccuguaacucuguauguagaccaggcugaccuugaacucauacagaucugucugccucugcuugaaugcuaggauuaaaugugccacuugaccuaacauuacuguuuuuaagcugaagggucagacuaguacagaucccuguuuugguuugguuugguuugguuugguuuuaucgagacaggguuucucuguguagcccuggcuguccuggaacucacuuuguagacaaggcuggccuugaacucagaaaucugccugccuuugccuccaccuccggagugcugggauuaaaggugugcaccaccaccgcccggcccuuguuuuuguuuuuuaagauuuauuuauuuuauauauaugaguacacuguagcuguacagaugguugugagccuucaugugguuguuggaaauugaauuuaggaccucugcucacucugguugacccugcucuuucagucccuucucccucuggcccagauuuauuuauuauuauaaauaacuacacuguagcugucuucaaacgcaccagaagagggcaucagaccucaugagagauaguugugaaccaccauguggcugcugggauuugaacucaggaccuuuggaagagcagucagugcucuuagccauggagccaucucaccaacccugguuuuguuuuguuuuguuuuuuuaagauuuauuuuguguaugugaguacacugucacucucugucacugucuccagacacaccagaaaagggcaucagaccucaugagagaugguugugagccaccaugugguugcugggaauugaacucaggaccucuggaagagcagacgaugcucuuaaccacugagccaucucuccaacccccagaguccugguucuuaaaguugaaaaggggguacaaacgaucaccucgcaggggcuuaagcucugugagccagcugcuacacucagaguagggccaggcaggaccagccauucugccucccuaaaccaaagcucucuucuugacuggugggaggccucauaccaucagggggugcacucaggagauggagcagggguaccugccuugggcugagagccccuucuuauggaagcacugauagagggucuuuccuggugacagccggcacucagggauacuucaagaacaacauggaggauaaccuugaaguccgggaagacagccuaggggaugaggucuuugacaccgucaacuccuccauugugucuggcgagagcauccgguuuuuugucaaugucaaccuugaagugcagcccuccaaaucugguauggggaugguagauggcccccugcucugcugaggagcccugagagggugggacagccugcugagcucucuucccacuccuuuagacuuagaagcugcaacggguggcugcgugcucuuacacaccucucgcaaggugaggcccauccuccaggaaugugcugggucuccaguugggguucaagagaucuggcucccuuacaucugcuaugcuguccccauguucccaggcguuccuaaacagggaucucagacuugcccauucucuccuggauaugauuccuggugggcagggauagucauagaccacuguggagggcagguaggggccaucaaaacaagggucuaacagccugugugguucuguaccuggggucccuacaguaucugaaauugaagaacuuugaggaagagguccgugcacaccgggaccuggauggcuuccuggcccaggccagcaucauccugaaugagacagcuaccucacuggaugauguccuccgaacuaugcuaaaccgcuuugcccuggacccuaaccacgcagaaccugacugugaccuggaccugcucauggcuaagcucuuuacagaugcuggagccccuauggagagcaaggguaaggcugucucccuggccugccacggaauggcuuggcugcagcagcugacucucucucccguauucuccucuuaguccaccugcugucagauaccauccagggagucacugccacuguccgaggggugcaguacgagcagucuuggcucugcaucaugugaguugccauccuacaacuaccaugccugguccccuacuguuaucuggagcuagcccagguauuucaugucccuggagaaacugaccuugacccaaaggacacaacugugauggcaucuccaauguggaagacaagauaugagcccccugccccaucugaucuccuauuuuaauguguuuggguguuguguguacaccauaugcaugccacagauguuagggcuccuggugcauuguaagcugccaugugguuaacagggaauugaacucugcuccuuugcaagagcagccagcauucuuuacugcuaagcaguuucuccagaccuccuguugucuguuuccccugguccuccgucaugggcuugucaggguggcaggagccucugcuccugaggguggcaacuguccuuuggcucuuuucuccugagcagcuguaccaugaagacccuacagaaacggcaugugugcaucagccgccugguucgaccacagaacuggggggagaacuccugugagguucgcuuugucauccuggugcuggccccacccaagauggugaguuucaaucucuggugccuugugagacagggccccagguugcucugcccuuuacuugggaacauugcuacaggccgccucauaccugcucuuccugucuguuggaugugucuuagagauguucuugcaaagucccuguugcaucagaauuucccuggaaaugccccaaagauuggcuuuccuucugaaaagaaaugcuuuguuaugauuacugauucagguggcuggcaguguugcuugguggcaaggcucagcauguacaagguccuagauucaaguccaguauaaugacuauaugcauuggggccauucuuuggcuggcuucucaccagccuuccuccuuuaggguaugcuggacaaggaccuucauuccuugggcccuaccuuuguuggggcugaaacugguccagucugcgaguucucccaauaaggaaaaggcuuaaaauccugagugggaacuguaaucccccugcccaaagcccuauggacaggccuuaauaguuaaacuuugauuagcuucugcuccuuguguucucuauuguuccccgcuggggaugggccucagggcccucacauauacacauagcugggcaggugcuccgucauggaccuacaccucuacccuuuguuaguuauucugaaacaggcuggaggcuggccuugaacuccauccucuugccuucccagugcugaacuucucccaggacacccacuuuucuuucuuuuuuuaaauuuguuuaaaaaauuuauuuauuuuauaugcauugauguuucaucugcacuccugucuaugugagggugucagaucuccuggaacuguagucacagacagcugugaaucaccacgugggugcugggaauugaaccccagguccccucaaagagcagucaguacccuuaaccgcuaagccaucucuccauccccaacagcaccacccacuuuucauuagcuuuuugaugacucugccugauucuggugcaggcugccuucucuggauuuucuggguaccaggaauaggggggcugcuccaguaguccuauagauaugcugccuguaauauuccugugcuagaaggaaagagagcaccuccugaguuacagggaguggcgcuggcaguguggccagaacagucaccuugaggaagucaggcugcacccagcauggacacacaggcacaauccagacuguugcucagagucugacagaggggccuccugagacuugagcaagggauugaacaggccauguguuagcugucacugugaugaguaacucagagaaucaacuugaauaaggggagaucuacuuuggcuugagguuucuuucaccccuuggcuggcuggagcggaauaucauaauggcgaguacuguucugggggaacugaguaggugcccucauggcagcccagaagcuggcucuggcucuggggcagcaggcugcgguagcaugugugaugcucugaguuugauccccagcaccuaacagaaaguggggggaugguccugggacaggauauacccuucuaaggaguacuuuccaauaaccuacuuccucagcccaggcccucauugucauuuccacuacuucucagucaaugucgugaaauuguaacugugucagguugugacucauaaugaggucagaguccucagaagccaguuaaugucccccccccccagugacuacacccaucagcugggguucaagccuuucaauacaugagucuuuaggggacauuucauacccagaccuuaauacuugaccaugucagguaugagaauaagguccaaugggccuggaccccuuucagagucagacaaaccgaagacacugggccugcugagacauggcuagggauguguugagcuccauugugacuucuugccggugcucaacccuuguugcuguuguugcugcuccuccuccuccuccuccuccuccuccuccuccuccuccuccuccuccuccuccuucuucuucuucuucuucuucuucuucuucuucuucuucuucuuccuccuccuccuccuccuccuccuccuccuccuccuccuccuucuccuccuccuccuccuccuccuccuccuccuccuccuccuucuucuccuccuccuccuccuucuccucuuccuccucuuccuccuccuccuucuuauuuauuuguuuuauguauaugaguacucuguaguugucuucagacacaccagaagagggcgucaggucacauugcagaugguugugagccaucacguggggauugaacucaggaccuuuggaagagcagucagugcucuaaaccacugagccaucaucuccccagcccucaauccuucuucuuguuaggacaaugcuagugucugaauuaugagaaaauacuaagcagggcauucgcaacacuuggguagccaagguauggagaacaccauaguucuagaccagccuggucuacagagugugagccuaucucaaagaaaaaggaaagaaacccaccagauccacagugguucuggggacuugcuggccuagggggaauagugacauagugacaaggugcauuaaugccugagcuuauggacccagcugccugugugugaccucacuuggcaaagacaggguguccucugcuguggugcugggggugugccuguacuauccauccucuguccccagaaaagcaccaagacugcaauggagguggcacgcaccuuugccaccauguucucagacaucaccuuccgccagaagcuccugaagacucgcacagaggaagaauucaaggaggcucuggugcaucagagacagcugcucaccaugaugaugccaagagccgcagggcacagcaugagcucccuccauacucacagacacccucagguacaggagagaggcaguguggugggagcggcaugggccaaccagggcuaacucggucuaucuuuucucccagcccccgaaaugcaaggacuuuuucccuuuuggaaagggcaucuggauggauaucaugcgcagguuuccuguguacccaauggacuucacugauggugugugcccagccagagcuuagccuuucaggccaccaggccauguguaugugccugccgugcaucccuggcaaaugcugucugucuugcauuccuaggcaucauugggaaaagcaagagcgugggcaaauaugucaccaccacacucuuccucuacuucgccugccuccuaccgaccauugcuuuuggaucccucaacgaugagaacacaaacggggccaucgguaaggggcugggggugguagggaugugccagguaggacucugggcagugaugaccucugaccuuaccaccucugcagaugugcagaagaccauagcuggacagagcaucggaggccucuuguaugcacuguucucugggcagccccuggugauacuguugacaaccgcaccccuggccaucuacacccaggguacagugggguugaaaugggaaauggucccagaccccaccucagcccugacuguccauccugcccugcuuguauacagugauucgagucaucugugaugacuacaaucuggacuucaacgccuucuaugcauggacgggccuguggaacaguuucuuccuugcacuuuaugccuuccucaaccucagccugcuuaugaaucucuuuaagaggugauugguccugggcuacagaguccagagaugugggucugucucaugucaaagcccuauaaccccaggguaguguguucuccaagaggcggaggugggcuuuuuaggaguggucccauugagcauucuuucauggggaugggcuauauaggaguucagggaacccacuaauuacccauacacacauuaaccucuuugcaggucuacagaggaaaucauugcucuguucauuuccaucacguuugugcuggaugcugucaagggcauggucaaaagugaguccaaggcaggugugcugugcaugccuuuaacacuauuugggaggcagaggcagaggcaggaggaucucagacaguuuucaaacagcuaaggcugucucaaaaaaaaaaaaaaagugaguaagugcugagaaggggcccugcuugggagaugggagcucucaacuguggucugcuggggcagcagagaagguaucaagcuaagauuguucuucccauggcaaagaugcuguaggagccguggcuggcacaaagcagcagcccuauauguugcugaaggggaauagccucuccagguaccaccagagauggggcagaggugccgggccaggcaugauggggugcagguacagccaagacuugggagacaaaagauagacaaguggugacuccuaguugacugggaagggcagagcucucuccuauuccuucugucuccccuuagaagcccucucucccuuuauggccccuccccucccccuucaguauccugaccucccucgggacaccccuccauccuauaucuguaaagaagcuaagcuacagccucccagauaccagauggcuuaggccuguugaccugucccacagucuucgggaaguacuacuauggucaccacuaccacacaaaaaggacuuccuccuuggugagccuguugggcauuggcagaagccccaacagcagucuccacacugcacucaacgccagccucuuggccagccccguagagauggccacaaccagcagccccggcagcacacacucgggccaggcuacagcggugcucagccuccucaucauguugggcacacucuggcuaggcuacacccucuaccaguucaagaaaagguaaggggacaccuuuuaguccaguacuuagggaguggaggcaggagaaucuuaacuuuaaagccagccuaagcuacauagacucuaguucaaguaaugaggggggcucaggcacagggugggguaagaggcagccgcccugggccaugcugacaugcccguccaugcucuccagccccuaccugcacccaugugugcgugagacccugucugacugugcccugcccaucgccgugcucuccuucucccucaucggcuccuauggcuuccaggaaauugagagugaguugggaugggagggaugagcuggggguggguguggcuuugcucccuaggaacugugggccaagccuguccccuguugcagugagcaaguuccgguauaaccccagcgagagccuuuuugagguggcacagauccacucucuguccuucaaggccaucggcagugccaugggucuugguuuccugcucuccuugcuuuucuucauugagcagaaccugguggcggcccuggucaaugcaccagagaacagguacugagggccgugggagggugggaccagguuccagacuucugacagucaacgggccucucuccaugugugccuaccuaccuaccucaggcuggugaagggcacugccuaucacugggaucuccugcuacuugccaucaucaauacggggcugucucuguuugggcuacccuggauccacgccgccuauccccacuccccucugcaugugcgggcacuggccuuaguggaggaacgcguggagaaugggcacauuuaugaaacgugaguaugaaugggcccuagagucccagggcaagagccagguggaucugaaggucagagggggacaaccuuagucugaaugugaccuagggaaggauguggcuuagagacagaggcucagaggcaguguagcccucgcuagacccacacguagcucugugcucugggaucucacaggauuguggauguuaaggagacucggcugacggcgcugggugccaguguccuggugggccuguccuugcugcugcugccauucccucugcaguggauccccaagccugugcuguaugggcucuuucuguacauugcacugaccucccuggacggcaaccagcucuucucgcguguggcccugcugcucaaggagcaggugggugccuggaccagggaaggggugugggaacacaaccaccaucccugacggccugguugccucuugcccacagacaucauacccacccacacacuacauccggagagugccccaaaggaagauccacuacuucacaggccugcagauccugcagcugcuacugcucugugccuucggcaugagcucccugcccuacaugaagauggucuuuccccucaucaugauugccaugauuccaauccgguaugacaaggcugggcagcugucaggagggcucagccuggggcugggcucagcaggugccugcuauaaccacccaccacucaguuuaccucucucucuacuccgcagcuacaaucugcuaccccgaaucauugaggccaaguacuuggaugucauggaugcugagcauaggcccugaccugcgccacccccccccccauucuucaggccugcucuguggcaacauauggggagguaugagcuggcuguggcucuggcccauccucauugcugucuuauagccuaaaggcccuuggcacugugguuuucaaaggugugugcucacuccucacccuguuaacauucaguuuggggucagaaacacugucggguggggcuaagaagaguggauauucuuuugauaaaagaguugaugcccaggagagagcccauuuccuugauuguauaaggaacucaguugugcacauuagugaauaaaagucuuguuucuaugcuuucacaugca

SEQ ID NO: 1100 - RNA, 789 nt, Mus musculus
ugggucugaaggcaaaauuuuauuuuccuuuaaguauaaaaauaagcauuuuaguuccuucucuuuuucaaaccugcaagagauaccuuggggauuguuaaaaucuuuaugaguggaagaaggauuuuuuucagccaguacuauuuauaaauaauucaaaggcugaucauuguagcagggaaacuagucuugugguguuauaauuuaccaugaaaagaugaauuuaggacacguaggacaucuugacaaggucgauaugugaugcuaaaguagaccuuguauauaguaagcaacucuccacuuuaugcaggaaggaacuugggcucugagauuuuuucuggcccaccgacccacagcuggaaacaauucuauccagacucugaacugcaaaggcaggcgucuccugggauacugugagcacacugaugccagugcucucaacaggccgcaucgcuaaggggccgaacguuccaaggauggauaggcaacugaugugaaacagauaacuguagccaggcagcgguccaggacaccuagagauaaagccaaauacagaccagaagaagccuagcccggcccucgcgggagcgagaccccgccccgggcgcguccgcgagcguggcuguagcucccgcagaacccucaccgcacugagagaccuuagggcccggagguguggugucccggagccugcgccuggcggcccgcaccccaaguccgucuggcuccuccgcagcacggugcggcgcugggccggacucacacugacgcccccgcugcgcgcgcucc

SEQ ID NO: 1101 - RNA, 1812 nt, Mus musculus
gccuuuccauuuucccaguuaaaaauccacugauuucuaggaaucccaucagaaaucccaaauacaguaaaagcuaguccuagaccccuuguggaaacuuagcagcucuugguuuuacuuucucaggagcagacacaaaauuaacacacacacaaaucaguagucuuucuuucuuucuuucuuucuuucuuucuuucuuucuuucuuucuuucuuucuuucuuuguuucuuucuuucuuucuuuuaguguaagccuuuuuccuuuuauuuagaaucuuuuuuuuucuuuuucuuuuuuuuaagcaauuuccccacucccguguuggccaguacggauuacaugagaacuggccgccuaucgcuggauacagaugcaccaaugaggguuaaaaacuuuccgagcgaaaaguggaacagaaagaaaagaaucuccuagcauuuccccaaggguucacucucccgccacacacacucuccaaaggaucgcuacagauccaacucuaugucagcuucuuggcuuugcuguagagggaguccacuacuuuacuccuguucugaauaguuuccagagcagcuucauaaguuuuaucuacuagggguucaucgaaaaugaucaggacacccucccccugguccaaaaucccaugaaacuuuuugucaagaaucaucugugauaauuuucucuccacgucggccuuggagaguuugaugaggcuagauauguguucaaucuggacucgggaaaaagacucaauaacccggaucagauucuguuccuguaaguuauuguacaacuuggccaaaugugugcugaugauugggucgucccggagcucugcccuguagucugucagggccuuuucaaaaucugccagugaucuguucuugcuagcuugagccacacauuucaaugcuucugucugccucccugcacaccgaagugcaagcuuucugcucaccaaagccuggacaucuucugggguguugagcaugauucugcacagcaacaucuacuucagagaugugauggccuuggggcuaucaauggagucguagccuucgaaugccucauagaaguaugaguaugcaguuuuccaguccuucuccucugcugcaugaauaauaccugacugcauguccaggguggccugcaauuuagggggacaguagauggcauuugcugugguucgagcagagguuaaggcagcucgggcuuucagcagauuacucagagcaugguaaguuuugcuuucuaaaagcuguacuuccaccaaaagggcuuuaucauccaucuuuuucaacucccgaagcagcugagaacccaaaugcaaugcuuccugguaccucuugguaucaaaauacaaagacaccagccuugccuccaaugcuuggcguaagaaaguucuuuucucugauuuggcccauucgaugcacucuaaacauagcucgaccuccugcccuguagcugcuuccauaucuagaaacagaucaagaagagaccggaccagacgagcugcuuuaguuuacugauggaauucaagaaaggucguacauacuucaggaguccuccaagcucaucagcuuguccagucuucgccaggagagaacccaguucaaggaugcucugcucuuugaccuggacugccuccucaucauuuucuugauugucauguuucacgauggaguggaggaugucgauggaggccucccggucggugcuaaguagagacuggacucucuggaacuccaccaccgcugcggccgccaucuuaccacucucacaccguccccggcugccucacacugucccca

SEQ ID NO: 1102 - RNA, 123841 nt, Mus musculus
caggcgaaggggagccggcgugcgggguguguauguguucgcugggcgccggcucagccccaggaagaugguggcgguggcggcggcggcggcgacugaggcgcggcugagggggagcacgacggcgacagcagcgccugcgggcaggaagggcaggcagcaccgacccugcaccgcgacaggggccuggaggccgggaccgcgcgcccggcugugucuaccgcgggugcugucgcgggcgcugcccccgccgccgcugcugccgcugcucuuuucgcugcugcugcugccgcugccccgggaggccgaggccgcugcgguggcggcggcggugucgggcucggccgcagccgaggccaaggaaugugaccggccgugugucaacggcggccgcugcaacccuggcaccggccagugcgucugccccacgggcugggugggcgagcaaugccagcacugcgggggccgcuucaggugagugcggguggggagugcaggcccagccugauguuccaggcccaaggcaggugcagggcuugaaaucgcgaggguagaauuugccccacuguguuugaugauggcuugccuccuggagggauguucauuugguggccuucgggucugccugugguggaagauugagaaggaacgggaacacucgggaggcauuuguugcuguggguuagauguggguccugaagaguauaaaagcccaccucgaaaacgggcuuauuuaggauaaaugagguaucaaggaaacggugagugagugaguucuucagcacuugccuuugaccagcccaagagauuggagauaugugugucuggaagaaguacagccgaggaagugacauguugggugaaaauagaagguaaggcuggguuguaagauuucagggauaaaaguaccauugguuguuguuccaaggaaagugaagaaacuaguuuuuggauccucacuguuggccuauuggaacgggguugucuagagaggagaauccuauuagcccuagauucuccacaacaugcaguuggcuugguuuggggcagaaccucuuggagagaucacuuuuuaauuagcuuuuaucuauuauuugcuucuguugugagagaauuuuuggauaaugcacacagguagauccaucauccagaguuugaugugguccacaagaaguuaggaacacagcaaggggaaguuauaagaccuacagugucauccauaucucaggcagauauuuguugacuggguuccccauuugacgugggaaagugagggaaugugaacguggcguaggauugauucuugcuccaauugaucuuauguucuagugagggcugacaggcagucaacacguaacuaggcaaaaggaaugagcaggauaauuucagauagugguaaaugcuaaaagcaaaauacaaacagguggucggucuuccaggauuccgauaaguggugacauuagaagccacccauuugagugucauuugaucugagugaggccugaaccuggcauaagagaaccuguggaaaugaaggggcagagagugugugacuggcuagcaguaagcagagaagucucggaggaggaggaggaggaggugacauugaauuugagcaugugagguuaaguaggauuugcaagcgugaaguuggggagaagaauuccaaauggaaaaaaaaagcugcagacauagugguagaguccagaagguggaguuuugccagugccccuguaguagaagagaguuguaagggagaagcuuggaauguuaaaguaauagaucucuguuagaucuucuaggggacucagagaucaguggcaagaugaacucuuaaguuuuacaauggagaaaccaaggaaccucagcaccaguguuucggggguuggucuaauaguuuagcguguugugauuuuaggcuucgagauacagugguaaacaaguuguauguaauuuuauucuuguagaacuuaacuuuucguuugggaguaaaaaauaccauaauggagcuggagagcuggcucagugguuaagaguacuuguugcucuugcagaggacugggguuagguucccagcaccuacaugguggcucaugaucauuuaugacucuaguuccaggggaugucaugccuucuucugacuucaggcaccaggcacacaugcaggcaaaacacuuacacaggaaauaaaaauaaauauuuuuaauuuggaacuuacuguguaggccaggcuggccucaaacucacagagaucagccugccucugccucccaagaccugggauuaaaggcaugugacauccugcccccuuaguccccccaauaaauaauucuuuaaaauuauuuaauuuuaaauccaguaaucaauauauuguaauuuugcaugauuguggaggugagggcagcgguagaagccagcuccuuucagagugagacuaagauucaucuuucuguugagauacuccugaggggcaggaugggggaugagugacaucaagacagguuagaggggagauccaguguccauagcagagagagcaaaagggaccaagacugcagagagaggucggugcagugcuaugccacauagagguaggaaguggauuuaggauuugaccuuucaccaaagagcaaugggaugcaacaggucacucuguuuucaugaaauuguagacuuagagacgggaaccagaaagggaauagccuuaaaggucaguugacuuuagaugcuuccaagaucagggggauugauggagggaccuucaaauucugaaaaccugggcuacaggcaugagauguuaugggcaguugauagagacuguugguguaggucagagccagacaccacugcugcuaguagagacgagguagauauugugugggaguauagagauaaaaugguuaggucucucuuucagaucgguuuguucuuggacaugugaacacgauagugaggagaaaaggcuagcucuuacuuugggugauugagaggcaauauuuacaaggcacagggacauagguaggacuaggcugagauaagcuuagauuuauacacagaguuuggggaguuuucaagguaugugccuggcacauguuccuuguugguugagguuauuuaccuguaagagggcuugccagggagagaaagagaucugaguguccacaugaauaguucagagaagagccuuuuaaaacaggacaggcacuccugauagugccucagcuacucucauauguaagugacugucacagacauucccuuugagcuugugcucauuaaggcucaauuaagacugccucugacaauacuauuauaguaaguggcuucuagaauuguuaaaauaauaaaaggccaggaguuguagcacacaccuauaaucucagaacuuuggaggucaggaauucaaagucaaccuugggugacauagcaaguuugugaccauucugaucuuuaugagucuaucuuaaaaaauaaaaaaauuaaaaaugaauaaaaaaauaaaaauaaaaaauagggcuugagaguugguucaaugguucugaguccugguugguggccucuucugcuccauggaugcuaugcaauguguagugcacaguacaaauaagucuaaaggaacuguaaaaacagauuauauauuuucugacaggacaucugucucacgccuauaaucacagcuguucggaagcugaggcuggaggaacaguucgaggcaagcuucggcuacagaauaaguucaagaguaaccuggggcuacuugggcuugucuccgaaaccaaaaugagcaaaaaggagcaagcuaggucuuuugggaaaauuuuagcugacuaauuuuucaccgagagugaguaacgaguuaaugcugcgucugcuuaccagauugauauguauccugguuuucccuucuucaccaccagucucuccuccuccucuucuuccuccucuucccucuucaaguuaaacuaagaggcauugaaugaauacauuuuuuuggcuuaauucuuauucucagugauaugcuuagucuugacucgagcgccucgugcaugcuaggcgaacacuucaccauugagcuacauucccaagccugccauuuugguuucgauggcaucaagucauggcaccuguuucuuucugugcacgcucgugcgugcacgcagaggucaggacaacuugguuuuggagcuugaucucaagcugucaagcuuguaugucacgugccuuuacccacuaaacuaucuugcuggcccaggguuuaugacuuauuuauuauguaaguccuguguuagagacuauaggguuuuuuggguuuuuuuuuuuuuuuuuuuuuuuuuuuuuuguuacuugaaaggaauguaggauaaugaagcauuagauuuuacucacacuaucacuggguucauuguaugccuaauuuaggcagggguauagcacuuuauccucaggaaacucaggaugugguauaaaauuucaauuauuuuauguguauaguaaaucacuuuuuuuuccuaaaugaaugauuauagagaauaaguuaauaguaucaguucaauaaaaauaacuauagcugaauguuauuaagauaauacacuuuaauuuuuaugugaaucuucauaauucagugaucaccauuuucuauuugugauacuacuguuaaaaauuuucuuacgugaauaaauauaccucuauuaacuuaaagguuaaauaagauuaaguauguuugugaaauuaccauacauuuaauucuuuaaguuacuucuguacaaaacuuggaagauggaagggaauaaccuagauugggccuguauaauugccuacauuauuaagacaaacuuucuggagaagaaagcacuuacuggcauugguuuuguggcaguguaugcuuucagagcagugaugguggucacagcgucgucucucucccuccauuucaaguauuuuuccacuuuuuuuuuaagguauuaugccaaaugccuuuuagaaauuaccccuuaauucuuaguguucccauuucauagguaggaaaacugaguuugaaguggggaggggguuuaaagguugcugcuuguguaugagugcaggauguuuauauauaggcagacaugccuguauauaggucagaagacaauuuuauggaguugguucuuuuuccagguggguucugaaaguuaaauucaaguugccaggcuaaguggcaaguaccuucaccuaccuugaaguauucuuguuuuguuuuuuguuuguuuguuguuuuguuuuuuccuaucuccaugcuggggaugggacucagggcuuuuuauaugcuagguguguauuaccacggagaaaccuaaguacagaguuugcagauguauuggauaacuuguucaaggccacagaacuugggugaaguuggaauuugaacuuaggccuuaagugauucugaaauccugcugucugugauacuguuuggcuuuucauuuuugucugaguccaguuacuuuugcaaaugaucuuuugguaggacugucuugauuccagcaaaugccuugaaaaauauaggaagcaaaauggauuuuuauaauagaaaagauagcauaaaagcaucuuaguugcuagaauugcuggcuucugguccgaggacacaaaugcccuuguaacagagagggaacucugaaaguaacaguugaagagaauggcaagucagguuucuuuguaguacuuaggaggugauucuugguauuaacuuggagcccuaaacuuaaguucaggagcccagcuuguguucuuaucuuuugugugugugugcuauuucagaguuuggaagagagcuuagggcacagcccauaguaacuggugcugagcuuuuccuguauguuacuacuuguggauuggucugauacagcuugcuauguagacuaggcuagucucaaacuugcaguaaugccucggcucagccuuucaggugcugagauugcagguaugacuuaccaugcuuagcuaagucuuuguaauauaauucuugggacucuaaugaaagucaucuuuacccauaugacugauacauauuucuugucuucuguuucuccggcaccucucuaucauuucugucauuuccuggcaucuuuauugggauguuuuguugucagcuccuccugagcugagcccaacaccaaacagacuucauguccccauugaaaagaaaauagucagcuuuggcuacaggugacuuuacuuccaagaggguaaagauccuguaaaaggggccgggcgugguggcacacgccuuuaaucccagcacucaggaggcagaggcaggcggauuucugaguuugaggccagccuggucuacagagugaguuccaggacagccagggcuacacagagaaacccugucucgaaaacccaaaaaaaaaaaaaaaaaaaaaaaaaaaaaagaaagaaaaaagaaaauagucuuuucuuuguaucugucuaaaguuuuauuagucuccuacucugucuuaccugcaccuggaccuucaccuuauuucuagccugucugugcuguagccuacauaauuggucucucagaccugcaauguccucccacauguugucauacaaucucuuaaaaaugugccauuauuauacucaaaagguuuuucuuuuugcagggucccacucuguaguccaggauagucccgaauuccuugugauccuccugccucagcuucucaacuauuaggauucuagacagagccacuguuacuggcagaaaaagccuuuuacaggauuuauuuauuuauuuauuuauuuagagacaggguuucucuguuuagcccuggcuguccuggaacucacucuguagaacaggcuggucucuaacucagagaucagccugccucugccucccgagugcugggauuaaaggcgugcgccaccacugccuggccccuuuacaggauuuuuaccuucuuuuggaaguaaagucgccuguagccaagccugacaaucugaguuuuauccauaggacccacccaguggaaggagaaaagaaaugcuggcaaguuuuucucugaucuccacacauaggcaguguggcaaacguuugggccccucuccccaauaaaugaauaaaaacucagaaaagaaacaagacaccucuuagcuacagaauggccuugaacaguaggcucucaucucuuuaugauauccuuuuuauagacaaacccuuccgcuuuguagguuuuuuuguuuuguuucaguuuuuuguuuguuuuguuuuuggucucugcugaaucccacguuuacucccucucuguauauccccccacucccaaaaaagcuggagacugaacuuggggucuugcccuuccuaggcaagcuuuuuccagugaguuaaaccuccaguccauuuuaaaauggcuuuuccgggcuguuuuugaacuuccuguguagccuaggauggccuuaaacugcugguccuccugcccacuccucccaaguacugggcuuauaggaggaugccagaucauauuuucaguuaaguaaaaaaauuuccuuuauuuuugacacuggguaccacugacuagcccuggcuagucuggaacucuggccucagguuugccuugaggccguagagguccugugcugggauuaaaggugugugccaccuugcccagcguaucuuuaguuucuuauagcaguagcuggcuuuccugacauuaccuucuuuuaaauugagccaucaaccuguucaauucauaaauuaucuuaugaaugauuauugugcagguaguagauggugcuggacuagaauguguuagaaagauucagucuuuugagggcucugauagacagcaucagagaggaaaggacuuugagaaaaucuccgaguuugagugugauuacgcucucugaggaagaaagcuauugcagcaggaaucaagaguuuuugcacaggcaaagcauggguuaucauacuuagugccuucauuuccuaguguguuauuacacuacacgaugcuggcuugucaacggauucucucauaguucucgagggugcaugucugaaaugagguaaaaauagugcaugccuacuucugaagacuggagagaauaugcuccaugccuugccuuagcuuucggaggaucacaaucguugucacucuguggcaagcuuagucucugcucccaucagucauucuuacaugguacucugacacagaaucacaucacauuuacauggaugaccuuuuccuaaucugauuguaucugcaaagagccaaaaaucacacugacagguaaccaggguuagggcuucaacauacacuuuuauaggacagaguucaacguacaguaguuaauggagauuguugaagaaaccaguguuuaugugcacccgggguggcgaauggagguggauuggaaggaaaggagacuagaaggugacagugacuucuauuuucccuuccuaagagccugcagcuucaggguguguccuugacugaggguacccaccauugaggcugccaguuuuugguugugauuguuuggagccuggcaugugaccuaagcugucuaaucaaagggaaucucaggacuugcuggagacuuggccucugugguguuuaugaaggagaugcuuugucuuuucuguagugacuggcuuuagaacagaugcagcuaacagugcuguguggagaggaauucaccccaaaucagggcacauuccagaggagggaggauggcagaggaaacagugcuuuagaccccacuuagugacccucugggccaggccgcucccaaagccauaccuucugagguuguaagguacuacaguuuuuauucaucuuaagcuuuagacuugauaucuugucaauuaaaguuccugcuaugucaaguuucauagggagggagggcuagccaaguaggauuguucagugcccgauacuauauaacgcauuaccauagguuacuucucuuaaagguucccaagauagucaaauaguuuaguuuacuacaguauagaggcaugaauauaaaauacagaagagcaggguauauuuaccacuaaaacagguuuuuacuaacuaugacuauggauuuaauacaguuguagcuuaucuugaauuaaauacagaacugacuggauggacagacauuguauguuaauuuuugguuuaaauaugaaauuguuuccagaaguaaaaugaagcugcaguuauacuuugugaaaugcuuguaucugaaacugguuucacuuaaauagaacucuacugcccugcuuuuucaagcugcaacuuucuuuccuuuuuccuucuuuacacuuucaaaugcagggcuauggacuugacauuuucuagcuuuguuuuuuucuucuuaggauugcuuucuuguacuuuuuuucuuguucuguuaugccacaucuuucaguugcuuuucuuucuucuuuuuucccccuccauucucccuccauuucuugagaauuggaguugugugucucuggcuauccacaaccucuuuccuugucuguggcaugcgagccagccuucugagugcuggggucucagguaugcaccaccauaaccaucugggacauuaacugcuucucuuuuaucauuugagaucauaauuugauuuuaaccuuucaauuuuuaauucuucaagccuucagauuuuuuucucuccuccaaguuacuuuuuaagugaacauagaucuauguaucugcauauuuacuuguuuagaauucuuuauuuuucauuuauaaaaauuauagucgggcuggugagauggcucagcggguaagagcacugacugcucuuccaaagguccugaguucaaaucccagcaaccacaugguggcucacaaccaucuguaaugagaucugaugcccucuucuggaaugucugaagacagcuacaguguacuugcauauaauaaauaaauaaaucuuuaaaaaaaaaaauuauagucauggaugaauugcauauuuuacuuuagaauuugaauugacuaacauaugguaguuauuaagugaaugaaauuuucauuaauuccucuuggucuuuuuuguauucuuuuuaaaagaagguuuucuuuuuggcaguaguuuacccagcugcagcuuuucuaaauuaucuuuucuaagcaugcucucccugaugcguugguauuccucacauuucgacguccuuacucuuccuuuaaagccucccucccugccauguguccccugacauccauuauggcauaaacugcagggcuuuucuccuccuccccuccauuguccugcucagggcagcugcuaagauuuauagcuugcuggcucugggcagauuucuuuuaaacucaaauaaaauuguccuugagcuaaaaauuaaguguguguguguguguguguguguguguguguguguguguguguguguguauguguguguaugugugugugugagacugugagucuguguaagaguauguacacauaugcaugggugcccaaggaagucagaagagguuggaucccuuagagcuggaguugcaggcaguugugaacucugaugugggugggugcugggauuccaacuguccucaagaaccauccaucuugcagugccauuuccucccugucucuguuguguagucauguuauguguuuuguuguuuugaguuaggaucuuacuguuuaguucugcugaccuauaacucauauguagacugggcuggccuagaacucacagaaauauccugccuuuuuguccugaguguuggaauuaaaggugugcaccaccacaccaccacaugcuagauccacaccccaucugcccccaauugaaauagucucacucuguguauuucaggcugcccuugaacucuguauguagccuagaccagccugcaguacugugauaacaggcaugcaccauaaaucuuguaaaauaauuuguuaauaagaaucauaauuguguugguuaguuuuaugucuucuuggcacaaacuagaaucaucugggaagaggaaaccucaauugaaaaaaugcuccugucuuaguuacuuuucuuuuccucugaagagacaucaugguuaagguaaacuaaagcuuauacaaaauacauuuaauuggagccuugcuuacaguuuuagggggugaguccaugaccauugugucaagaaguguguuggcuggcaaguaggcauggcacuggagcaguagcugagagagagauacuagaccuggccugggcuuuugaaaccucacugcccaccuucagugacauaacuccuccaccaaggccacaacuucuaauccuuuauaaacaguuccacugacugggaacuaaauuuacaaauguaugaaucuauggggccauucuuuuuuaaaccaccauagcccccagccaaauuggcccauggggaagccugugauggauuuucuugauugaugauuaauauuuacuguggacagugccaucgaugguccuggauacucaaagaucacaagcugagcaagccaugaggagcaagccagcaagcagcacucccuccucccuggccucuguaucacuccugccucuagguuccuacccugacuuuucucagugaugaagugugaugaggaacuguaggcuuaaauaaaucaauccuuuucucccaaguugcuuuuagucaugauguuuuaucacagugaucgaaagccuaagacaacacuguagguuuggggguuuguuuuuuugguggggaaggguacugaaaauuuaaucuagggauuugcacauguuuaaacaaguacucugccacuaauguauauguucagucuacaguguacauuuuaaagcuuauaaugaugcaauauaaaagaaaauugaguuuuagcuuuuaaaauauguuuuucauuuuaaugugcuuucaguuauguaaagaaaaacaagauuuauggauaauuuaaagugacauuuaauuuaagaucagacuggacuugguggcacaguccuguaagccuauguacuuggggccuaaggcagaaacaacacauguucaagggcuuccugucuacagagugaguucaagguagguuuaagcgacuucaaggagaaccccucucucucucucugucugucugugucugucugucucugccucaaguuugaaguggaaaggggcuguaguuggggcuguacccgacuguagcucagugguccuguugcuugcauagcaggugcuuacccuggguuugauucccagggccacaacuuuuuuuuuuuuuuuugagauuaaauauuuauugaaguauugaauuugacuguuucuccuguuaaaauuaaguaauuuucuuguucugauaggcuuuaaaaauuaucucauauuuuuuuccuuuaaccuaaauaauaguuuccaaguacuuguaagcacuucucugcagaauagcacauuuccuauuuguuuuuuucccccuuuucccuguaaaugaaaagaccaagccugcuauaauugucacuuuacuuuuccuugccuaaaaaguauuuuauuucauuuauuauuguauauggauaugcacaugccaugacaguugagcagaggucagaggauaaugcuguggaguuggcucuugcuuuuuaccuuucuucuuucauuuaaaauacuagaagugucuuacaaagcucuaaaagacuguggucagaaagcguggcaaaggugauugugaggcaaacuuuugaaaugagauugauuuauggucuucuguaacuuguacuugaaugucaucauguuucucuuuaacaaaugucauuagcgcacuuuaguuggaacgacauuugaaccacugcuugacaaacagugaucagcaucgaugaaaguauuugcuugcuuaaaagugaucagauguuuggugcuaggucaguuccuggaguugauuuguuuuguuuugagccagggucucauguaaccaagggccuugaguucugaccuucugagugcuggaauuacaaggaagugccucugugguaugccauuguaguguuuuaaacaagauguccccguaagucuugguaacugggauuauuaggauuauuaggagguguggucuugcuggagggaguuaagucacugggagccagccuugagguuccaaaggacugaugacauuucaaguuagcucucagcuuccuguuuguggauagagaugugagcucucugcugcuucaauuaccuguugccugccaccucauggacuguuguuacccuucugucaccguaagccccaagucaacccauucuucuguaaguugccuucaucaugguauuuuaucacaguaauagaaauguaucuaagagagccaacaugcgugguuuuucuuguuguuguuguuguuguuuuggugcuaggcauguuaggcaagcacucuaccaaaagcuacauccucaagucugcagaugaacaucugugaauuuaucaccuaguacuccugaauuuuuuuauauauaacuauuauaaguaguaaauauuacagauguuauaauauguauaguaaagccuuuaugucuggcuuuaaaugaaauguaucuguguguguguguauauauauauauauauauauauauauaugugugugugugugugugugugugugugugugugugcauguauauauauguguguguguguguguguguguauacacauacacacacauauauacauaggcauguauguauguguguauauaaguauauauauacauacacacacacauacacacacaucugaaaauuguuuuccugagucuaucaggcuuuuuguugaagauuuucuuggguuaaccaauuacuguuguuacuuuguauacaucuacguaaacuaugcaaauguaguuuuuugagucaaggucucacuuuguaacucuggcuguucuggaauucacuauuuaggucaggcuggccucaaacuaaaagagaaucaccugcuucugccucccaauguuagaauuauaggcauaugacaucauguccagcuauuagcauuuaaaaaauuguuuauguguuaauuauguauuuaugggaacguguaggugcucuuugaagccauaaaaggauguuggagccucugaaacuggaguugcaggcucauugugaaccaccuguuagugcugggaaccaaauuuagguccucuggaagggcaauggugcucuuaacugcugagcagucucuccagcccugugauauauauuuucauaaacaacacauauauucauauauauguguauauacacacauauguuaauaucuuauggaagacaguuacagauguuaugggcucucuguccagaguuuguacauaaguggcauaaucagcucacuggcguguaccuugcuuccucucucugucauuacugaguaaaggcuccugcaaaugcuuauauauuuaaacauuuuuauauuuauuuauuuauuuggugggaggcugggugugccaugcugcuuguguggagaucagagaaaaacuuuugggaguugggccucccuuccacuguguggguuguggggauccagcucagguugucagucuuggugacaguaccuagugacccaucuugcuggccccaguagguagauucuauuguauggaugcgccuuaacuauuuaaaaguguuuuguggaaguagugaugugcgucuguaaucuccacacugggagguggaggcaggaaaauauaaagccagccuaggucacaugagacucccucccuuuuucccuuccuuccuuuuuuguguauggauauguguauguguauguauauguguguguguauguguguguguguauguguauauguaugaguguuuguguguguguguguguguaugagugugcgugggcaugauuuuauguauacuuugggugcguacuuugaagccagaaggcguggggaaucuuuuucacuuuuuaccuguuccuuugucucucuaacaccuggcucuuguuuacuugguuagguuagauuuuauagcaagucuuggccauauuacugucuuugccccuuggagcugaggucacagggacaugcaggaugccuggcuuguuacacaggcugagauucaaacuccaguccuuaggauuacauagcaagaccucuaaccauugaaccaucucucuaaccccaaagagccaucucuucauucccuucccugccuccuuccuuacucugccuugcuuucucuuuuccuuugaaaugggaucucaguauauagccuugucuggccuggaacuugcuaugcagaccagugugguucuagagauccccugccucucugccuauggaguguugggauuaacgguuuguacucaagcacacuagguuugagacccuuucuuaaaacaaagcaaaacaaaucuuguuuaaaagugcaaacaucauuuuauguauuugugggucuaccuuuaggaauaaggucucagacgugaaauugcuguaccagaggauugauggauguaaaauuuugccucauauugcuaauagcuuccugcacagagauugucccagguuuguuacuagcaucaaugaaguuuugucuuaaauuuuaugacaucuuuugcuuuucugugaugcugggaauuaaaucuagagcaucauacauaccaagaauguauucuauaacagcuaaauauacagacagaaaguucaacucuuaauugcgaauuuuccugugguguuuaugcuuuuugucuuauguuuuugaguucucuuguuguaccaaccuuguagagaucuuuccuuuuucacauuccaauuguccacuuguaaugcaauucuaugaauucuuuguuuugaugcccauaguuagucaggauaaaguaucuuauaaaagauaagcaguugucucaguuccauuuauauauuagugugguuuuucucuucaguguucuguaguagacccuagacaucaaauuugucuuacuuguucuuagccauuuugacuuaaaaaaauuuuuuuuuaauuagguauuuucuucauuuacauuucaaaugcuaucccaaaagucccccauacccuccccccacccaacuccccuacccacccacucccacuucuuggcccugguguuccccuguacuguggcauauaaaguuugugagaccaaggggccucucuucccagugauggccgacuaggccaucuucugcuacauaugcagcuagagacacgagcucugggaguacagguuaguucauauuguuguuccaccuauaggguugcagaccccuuuagcuccuuggguauuuucucuagcuccuccauugggggcccuguguuccauccaauagcugacuguaagcauccacuucuguguuugccaggcacuggcauagccucacaagagacagcuauaucaggguccuuucagcaaaaucuugcuggcauaugcaauggugucugcauuuggaggcugauuaugggauggauucccggguguggcagucucuagaugguccauccuuucaucucagcuccaaauuuuggccauuuugacuuuuaauuucaauaacugaugcugagauuaggcugggaaaauuuguuaucuuuguuuaagauuuauuauuauuauuauuauugacagaguuucucuucucuguauagcccuggcuguccuggaacuugguccuuagaccagagugaccucaaacucagagauccgcuugccucugcuuuucaagugcugggauuaaaggugugugccaccauuaccgggcagguuuuauuauuuuuaauuaagugugugugaguauuugcauauacaugcaggugaccauggaggccagaggcaaguaaggggucuggaguuacagcagucaguugugaaucaccguguguaguugcucuggcuuugaugaucucuuagccauugagccaucuuucuagacacacacacacacacacucucucucucucucucuuuaaauaaaagauagauuaaaaacucuuuuacaaggauauuuuguguguucauuuauuuaggccucauguauuucaauaaauagauaaaaauaaauaaauauccccccccaaaucguauuacauuuguuaaguguaccucuggguauguaguuuugcugucuuuacuauaauuggugaguguagaauguagggcuugaacuuuauuuuuuuauuuaauuuuuauuauuuuuagaugaauuuuuguuguguugucuagaaugauuuuccaguucuugaauuacagucuuccuaccucagucuuuccauuaucugggacugcaagcugugggguguuuauguguguguguguaugagaagauguauacaggagggcauacacguacugugguguauguuuggaggucagaggacagcuuuccggaguugccuuuucuccuuccaccaugugggucuugggauugauugucaggcuuggagggaaggguuuuuaccaagucaucuagccagcccucaauuacuuauuuuugagacaggcuugcauuauguagcccauauauguaugcuuguaaguguguuuggauguaugaguguguguaugcuuguaugugaguaugagucccuguguacaugcagggaggccagaagaggagagggcucccaguauccucugucccucugccucuuccuuugaagcaggaucugcuuucugccuccuuuggagcugaggcugcagacgcuugugggccuaccuggcuuguuauguggggcugggaucagaacuuugguccucaugauuaugaaucaaguacucuuaacugcugagccgucccucuagcuacuucuuuauuauuguuugucaaguaugcuuuggccuuuauugucucaugguguuuucauguagauuugagaaacaucuuggccacuugugguuaggacaguauaccuagccugucguucagcuugaagagaauugggagcuuuuagaaugucuuccaaaccgugaccacaccuccuccccucaguguugaacguggaacccagggccuguacgugcuuggcagccuuucugggauugaacuacauuuucagccccaacuuuuuuauuuagaaccuaauuugucucaauaagauuuuacaguuuucugugcugagauguuauauaucuccaagcuuuugucuuuuuuuuuuuuuuuuggugugauugucaaucaugucauuuaauuuuuaauuuucuuuuuaaauuuuaaaauccugugugugugugugugugucugugugucugugugucugugugucugugugucgugaguggguagaaaucagagaccaauuuucuguuuuuuacuaaguggggccugaggauugcacucagguuuuuuaauuugguagcaaguaccuguugagccuaaauuucauuuucaguuuugaauuguugcccguaguaguaaauuccauuggucuuuucuuucucuuuauuccucccuuuuguagucacccaggaccacaguauuuacccuguggggugaggauggauuuauuuauuuauuuuuaaauaaaaaccuggucucauauaggcuguguuauccuaagugcugggauuacaaauucaaaccagcacacuggccugggaaaguuguucuagacugaugucagaaugugauaaggcauggggauuuauggucaguauuguugcagugugggccucucagucuggggaucuagggcagagauggaaaggugaaacaaguuggagcugagcuuugaugaacuuugugugcagugcuaacucacacggaaguucccaggcaguuuuggcaggguuaggcuggucuucgaggaagaugacuugugccccugaacuggcuggguuaggaaguuggacugagccauuaguuaagaggcuuuugcuggggacuaggugaggauggggagaauuuaaguuagcagcugguacacagagggcaggggagagauaaagaugaaguaguuuguaggugagaugaugggacugugugagguacaggaugaaucuguagguuucagaacucaggguggaugaugacacaauggcucuaaacccuagaugaggagccuaagcaaggccccgaggaaggcaucuccagggaaagaaaagggaaagaaaagggaaagaaaagggaaagaaaagggaaaaggaggcguucggggacuuaaguuuuggauuuggauuuggauuuuggaguaggaaauaugaaucugaaacauggaaccuagcauggaguugaggcuugaacacuaaauauaagaagugaaugaagccauagagggaauggggcuuaccuauaggggcuucaaggaauccccaucuugggcugcuguaaggagagaguaaauaauuucagggaaggaacuuuccauuuucgcuuucuacucucuugagguagaugauuuuuuuuuuaauugagagagcuauauaaccuugugguauuauaauuuuggaugaguauagcagaaugucuuagacacuaaagcacagauuacauauuugcaacguuaugucacuuguagaacuugaagaguacuauaacuuggguuuuuacuacuaguuucuauugauuaucacaugcuuuaucuguugcauuuuagacccauuagccugaguaacauauucaugacgaaccuuguugcauuuuuauuguaaagaauuauaucaagggccagugaaauggcuugguggguaauaaacugcuugccauguaagccugaugaccugagcuccauaucugggauccaugguggauggagagaacuguuuguuccccaaaguuuucuagaccccugagcacaugcucgagugcacgcaugcacauacaugugauaauacauauguugagguucagucuguugcuguggauuguaaugcuaaauacuggcccccaagaucugguugccucaggguuacaccaggucauguuauguaaucuugauuacaagauuaucaaguuauuucugauuggucaguaaauauacauauucaugcuuacagccuguagcuuggcagaagagagguaggcagggcuucaguucccaggcuuggggucugaggcagagaccacaaggaagaaagagaagguggagagaggagaaaauuccauuaggguaacugaaucaugaaggccaugagggcuggccaguuggaguaagagugacgcagguagaacauggcuuuauaacucagagcuacugacagggaaguagguaggcaaagcaggcauagauuguugauaucugcccagcucuagugcuuuaaaggcuuauuauaaauauaaaaguuuuaugucuuuuaugugggaacuaaaugauccaagguggggaagaaauccuccuauuaaucuuaauauuugccauaauacacauauacuuacuaaugauaaauaagguaaauuuuauaaagaauuauuuuuaaaaacuaaauuaaaggcaagaauguauauaucaaugguaggacauggaguuagcauucauaagauuuuggguucagucaccaucaccacuuccaaaggugaaacguggggauguggaaguaauuuuaguauuagugccaaauucagccacauaggugucacucccuaggggccauccacuuuguguuuugagucagggucugucacuaggacccguggcuugcugguuagguuaggcuggcugguugucuggccccagaacccuucugucucugcuccccagcaguggggcuacagugagcacugcugugcugcuugcuuuuaugucagugugacacaagcugcagucguuuuacaaguggcacucucagcugagaaaaugcuccaccugguuggccugucuauaaguuuuggagcauuuucuuagcuagugauugauaugggagggcucaguccauuguggguggugucaucccugggcaggugguccugggguacauaaaaaagcaggcugagcaagucuaaaagcugcaccccuccauggccucugcaccagcuccugcuuucaaguuccggccuuuacguucauauccugauuucccugggugaugggcuauaaaccaaacuaaaguaaacccuuuccuccccaaguugauuuucgucaugauguucaucacaguugucuuccuuuggaagauuugacagugcuguuuuggggaggauugugcaaggaacuauggacuagaaaagcuguuuaaugcuuagagcuuagugagcuguuaugugggaagauggaguagaagaauauugagaacaacacagauguuggagacuggcccauaaaguuucagaaagaaguuugugugucacuuuaagaugcuaucagggccauuugauauuuugaagcuagcaaccauagaaguggacaguugauacugguuagccggggcgaaucagcuuuaauuaagaagaccugcagcgcugaggcagaacguucggaaaggguuucuacagcacacagaugcuguaguccagauagaaggccauaccucucucuggcagccaaccuugguaaucucuuaagagucucccagcugguacugguuuugaagucaugaaggggucauggaaagcagcugagguuuuacacagugaaugugcaacaccaguugauguugaagccccaagauugaaagagucauggaaagaaguuaagguuuguuaccaugugguaagccaguuccaaaagagagcccaggagaggucauggugaaggugcagccuagaugccaguaccgugagaugaccaccaaggacagcaacagguaugaaauggagccugccugagacuaguagacacgugugccguggcaaggccuuuggagccaagacaauugugauuggcagaggcuggcacugagcuuuacacuguggacuuuaguucugcuuugaucugguugugacugugccuggcucuuuccucuuggaauaauaaaguauuuugcuuauuuuuuaauuugcaggaguccacagcuaaaaaaauuaaagacuucgaacuucuagagagacuuuagagugucaagacggauuuuggacauuuuagagacuugggauauuuuauaucuuuaauuauaggcacuaaacucugauacacccuauuuuauagaaauuauaccacuagauuuaacaucaaucuguuaauaguagaugauuucaguacccuguuuucuguaauagaucaagcugaauaaaauaaacaugagaauuaauugacaucacacaucaaauggacuuaacagaggucuacauaauauuccaccagaacaccaaagaacacaguucugagaacacacagagcuuuucuaaagcaggccacaccuugagacacaaaaccagucuuuacaaguucaaaaagauugcaaucacuccaguuauucugaccacaaugcaguaaaacuuaaaauacacagcagucaaaucucugguaaauacagaaacucuuuguauuugagaauaaguaacucauuacugaaugaugaaugggucaaagaagaaaucaagaaagaaauauauaguucuaagugccaacauuuuuuuaaaaaaucagaaaaagcacuaauugaugacuuaauguggcaacucagaaauuaggaaaaaugaaaacaaacuaaaucuagacccaguugguagcaagaaauaaaugaaauauaaacaaaaaaauacgacaaaaaaaaaucaaugauucugagaauuggugcuuugagaagauauggccaacagaccuuuggcucaacuagccaaaauaaagagagaggacccaaaugaacagaaucagaacugaacaggaaaacauuacaacagauaccagaaacguuaagaauuuuagagguagccgggaagugguggugcacaccuuuaaucccaguacuugggaggcagagguggguggauuucugaguucgaggccagccuggucuacagagugaguuccaggacagccagguauacacagagaaacccugucucgaaaaaccagaaaaacaaaccaaaaacaaaaacaaaaaugaauuuuagugguaauacuuuaaaaaccucuaacacauuaaaauuagagagccuuaaagaagugaauggauuucuagauucagccaaaauuaaaccaaaaauuagccaacaaccugaacagacccgcuauacaaaugaggagauuggcauaguaauaaagaaccuaccagauaaaagaaaguucagggcuagauggagucccagaggaauuuuuccagacauucagagaaguucuacagucaaucuucugaaacuauuaaaaaaagaaagaaagaaaaaacaaaacaaaacagaaggaacaucccccaaacucuuucuguaaagccauuuaaaaaggagagagaagagacaggccccaguggcauccccaaaagagaccuggacauggguagcugguuaauuccugaacaugcuggugagguguugaggaaaucagaaauaguggugagaaugaagaagcuuucccuucacccaugaaaggugaauuuaauuuuacuucuacaauuaagggugccaucugcugacuuagacaucagaacugcagauucucugcccuucagguucugggaucggcucuaguguuccaacuugggauguuucugacaggcaguccuugcucaagagcuuccccucugccaaagcucaacugucuccuuuacccaguuccgcuuguuucuuaucacuccuuccucuugugguguuacaaccaaccuggaccccagacucuugacuuagcaaaugcuucccaaaagcuagcgcuggggcuggggcucaggagauggcucaaucagugacgugcuuguuguguaaccguggcuugcugaguuuagacccagaaccaacagaaagcugggugugaaggugcacacccauaagcagugcuggagagaggcuguaaagauaggugggcacagggcacacuggccacgggagcucuuaagcaaagauugccugggaagggguccauguuggauugaaaugcuuggaccuuuaaaucuucaaaaauuugggcuguccugggaaaggcauggugugguaguacgguccugaaggacaaaauaaugaccacguguacugcugucacugacagcauccuuccuugagcagggaauuagcaugucuuccugucuuccuuaagaaugagaaaauauuuccuagaugccauucacagacuugucucacaucuaaggauuagauuacaugcuaugacaaagauuagcaauuauucuuuauagcgauuaccaacuuuucuaggauagagaauucugagcuuugagguaucuguuacacauuuugaauacuugcuaaaugucucugcccuccucuauauguagauauacacuuguuacuucugacaaaugaauaucuguagaguuuucauguuugacuuaggagaaggugugcuuaguuuccuuucccuccuugugcucguugggaugggucugcuuaaccacaggagccugaggagucggggugacuuuuuagguagaagccaaguguuggggaugacagaagaaggcuacagagcauugggcuacugauaauuaugugauugccuuacaugauuuuguuaggcguauuagaacuuaaccuuacgugaguguguauuucugguuauugggacacaagggacacaaggaaacaggguuguuuaaacuaacaacccuggggugcaguagauguggacaggguccauagagaucuauauuaugcaacugcaguagaagagaaaggaaagaagauugaggaaauuggaagaucagauuuuuaucauggucuguacaagaaaucuuaaguaaaugggcuagaaauguguggcuguugauuagugaaaagaugucaugguucaggagauugguagucucugugggaagacaacucacugaaagggaggaaauagccuggaagagauaaagagacagugaucagcuaggaagcuuaaaauuuaaauuuuguuggaaguacuguuaggaauacuagcagaggccagaugaauguaugguuaaguuauagcaaaggaaaagauuguuaauggugagguuaggaaugcagggugacaccaaccuguaaugucagcauuagcgagauagaagcagguguuuaaggccauucucugcuacuuagcaaguugaggccaaucuggaccacaugagaccuuuuuucaaaaauaaaucuccuuaaacaaaagaggcuggguuuuuugauagauucuucaagauguuaauguaaauaaauggaagaccaaggauggcaugcuaauauccucagugucugaagaaggacuauguaguguuggcugcugacucugaaguaagugcucauuacugacagauaguguaucuuagagccuggcagaugggauggaagugaggaagcaaguagcaccuuuguauauuauguucuaaguagccagagauacuugacacaaaacaaaguugagaaaauguaucuucuagaaaauacagacauggaaagguguccuuucuauaaaagagguauuaaacauuaaccugaaaaaaaaguuagcaaauugggcuuuggcaaaugaauauagucaaguuucauuuuuauuuuguuuuuuguauaugacuguuuggcuuguuguaccauguguguuccuggugccuaggaagucagcuggaguuacagauggugugaguugccaugugggugcugagagaugaaccuagguccucuggaagagcaguuagugcucuuaaccacugagccaucucucuaguuccuucuguagaauuuucauuaauuuacaaaggagaaaguauaaaugauaaaaccaugagaagauagaccggcacuagaauuaguggagucaaaauguuaaugauaugucagauacgccuuauaugaggaaguugcaaaauuaugaaaauccaggcacuccacugaguuagaaaucuaggcucugaugcauacugcuaugguaagguagcaaguggccauugagugcagaagugagucuggaugggucuucugguguuguggagcacacagacugcugucuucugcauugcaguuucaccuguauuuccuuggaacuacuuagcuuugcaacuaggcguuaaaaaaaacuuuauauuuaugguuuuaaguuauuuauuuguuuuauuuuauuuuaugagacauagucucacucucuaaccuaggcuggccuggaacugccuagguaacuugagcuggugauucucuugccauagccuucuaaaauuuuagauugcaggcauaagccagaccacuccugacuuuuguagccauuuuucugacaugaaguguaacuuugcuuucauaacuaaaaugauuuaguuguuuuguuauuguuuaaucccuuuugcuuugaauguauccuuuuguguggguggcagauauauaaccacagacuuuuccacaggcauccuacccuagguccagaaaugacucugagacgucuuauauaugaaugaaugccuaggccaauagcuuuggcugauuuccacggguucauagcucaguuaucccauuuaaacuagucuaagucaugccaugaggcuacauaccccuccuucaguuucaggcgacugucuucucaguuguguaauguccuauccucuguugcugcuccccaacccccauccuugcgucauaguccgucuguccucgucuccccccauuuacuugcacaacggacucuacucuagaaguccucucugugcuggagcuugcaccuccgcucuccccgucuaagcuaauaggcaacagcauuguacagacaggugaugcuuccauacaucgcacaggagauucucccuacacagauacuuauucauccagcgugaaugcaaccguccaggcguguucuccuaguuguaguacaugcuguuguaucagucugaugaauuucuuugucuuuacaaccaagaaagauaauacuguaagaaauuuugacuaacauuuuuucuuuauuuaaauuacagacuaacuggcucuucuggauuuguaacagauggaccugggaauuauaaauauaagacgaagugcacauggcucauugaaggacaguaaguuauaauggcugacuuuauuuuaauuuauuauaagagcacaguauagcacaaaauacuuccauguguguuauugcuauuucuugagacaggaccuuucugacugaguaacucaggcugaccuugaauuuugcuaugcuaccucugcuucccaagugcuagggugguagguguggaccaccaugcccugcugcuaaaauaccguucauugaugcuuuucauuuggauaguguucuugcuuuuuaaaauuuacuuuuugggggaccagagagauggcucaguggguaaagugcuugcugaacaagucugguuaugugaguuaaucccuggcucccacaguggaagagugacuccugaaaguugucuucugacucccacgcuugugcaugcacgcacacacacaaauaauaaaauaaaaaauuaaaaggaaauuuucuuuuuugggugauagggauugaaccuaugacuucacuaagcaagugcucuauuguuaaauaauuccuuuaauuuguggguuuuuuuuuuuuagguuccaaguugacuuaauguuauaaaugaaagauacauaccagaaauuugcauauuucuaauaguuuaaaaaacuuaguuaaaaucuuuuuaauaguuugcuuaaaucuuuauauaauaaugcuauuauaucauuuuucuaaauauugauuuuauuaucagcaaaacaguaaaugagccaucagaauaaccacuguagccuguuucccuggcccucuguccuuccaucugucuaucuucucuuuuuuuuccuuuuuugugccugucauuuagggcaaagcauuuuagucucugaacaaaacuuugaaauuuccaaguaacucuuguuuauuuguugugucucauauucaacccaagaaauauuauuuacuaacucauuuaaaagcaacaauuauaacccacuacauguuagcagaaaaaccuauuuguuuuuauugagacgggaucacacuaguaagcacuacauggcauggcguucacuguguagaccaggcaggcuggcuucgugcucuugacaguccuccuguguuugucucucacuucugagugcugggauuauagacauuaccaacacaccgauuugggggguugggguacugggaucaguccagaguugcauggaugcuaggcaagcacuccaccaacuuagcuauaucccuggucauaaaugucauaaggaaaaaaauuccuuauauuuaaagaaauuuuaagaauugcauuguuuaagauuucacagaucucuuugcuaucuggcaaucuuuuuugauauuuuguuuuguuuuuaaaaauaugugguauguaaacaaacuuaaauaugaaugggacaguuccagaugagagugaaaaguuaaauauuugggagaaaaauugauagguuuaucuauuauggaaaauuucagagauuuuaguaaaauuugaaaauggagcugggaggucugagguagucaucuaaagcugccaguuguagagcguguuggaguguggagucagagggaguuacugauacacuuguugaaauugcccaggcuucaugggaagugaugaggggcuguuacugugacucugggcagggcuuguuaguuuccuuuggauuuagucucagucagaguugauacauaguuuccugaggacguggcuuuuugguacagugcugugaaaaggcagagaagcagguaaacuuagaaaauguguguuuuuaaagugauguguuaugaaaucuuacguaagaugaauaaagaaagaaguggggacacugagggcuccuguuucuaaauguuaaaagcaaggcuggaaacauucuuugaaggccccugaagucagagcccgugucucuuuugguucccaggacauuuuugauauucccuuacacauagcaaauacuaacuagaucucugacaaaugcaggaaagcuguuuauauuuauauauauuuauauuguauauuuuucuccuuauaaauucuuuaaaagucuguuuuaguaguuaauguuaugauuauuauaaauuacuuaauuauuuuucuaggccaaauagaauaaugagacuucgcuucaaccauuuugcuacagaauguagcugggaccauuuauauguuuaugauggggacucaaucuacgcaccucugauugcugccuuuagguaagcccugcugcauuucaucucaggaaguaagugugucuccaggauggaguccgugcugcauuuacuuuauucugcagucacacucaucucauggaauuaguucuguucuggugagcuacaguucacuugguuuuuauguacugggucguuuuccauguauacuaguauguagccacgguuagucuugaacuucugguucuccugccuccaccuuccaagugcuaggaguauaggcuugugccacugugccugacucauuucacauucuugaacugugaaguuuugauaacacuauuaaauuuaccugcuauuugugauuuuguuaaaguuugcauuaaaaaguuuuugacuauauugauaauauuuuugugacaaauuuaaaucagaaaccauaccuuucuuguucuuguauguauuucauuccauaggcccuuaggaauaacuuuuuucaauaguauauaguucucucaguuuguauauauguauuauuagggauaggaggagcuuucuggaagacuauuuauaaauuggacaauggcuagcuguugagagugaggaauuugcuaguuuuguuuuguaaaucccuccccaaugcaucuguauuagugauuuaauaaaauaaugcaauuuugucaguuauauggguugcacugaauuuuugcuauuuuauuuuaagaaagauuuuugugugucuacaguguauaugaguguaugauaugugugcgugugcauguguguguguacuucuaugcagguacucacaugcuauggugugcacguaagguuggagugcagccucacauguugaucauuauauuccaccuuguuagagauagguugucuuuguuguuugcugcggccuggagcuggagcuggagcuaaggagucucagccaccugacauggguacugggaaccaagagcagcaagaccucuucuucuucuucuucuuuuuuuuuuuuugguuuuucaggacagaguuucucuguauagcccuggcuguccuggaacucacucuguagaccaggcuggccucgaacucagaaauccgccugccucugccucccgagugcuaggauuaaaggcaugcaccaccacguccggugcaagaccuuuucuuaauugcugaggucucucuccauccccauuuccagacuucuuuccuucaaacauucuacuuccuucacguaauuuuguguguguguguguaguccuggaugccuggaacacacuauauagaccagguuggucuugaacugacagagauccacccacuucugcuucccaagagcuagaauuaaagacauucaucaaucaccaugcguagcaacuuaaauuuucugaaaguuuauuguuacuuuguaugugggggagggagaauggagggguuggcacaugugugcccgaguggagguuagaggacaguuuuguggagucuguuuucuaauuccaccuuuacagggcuuccaaggauugaacuugguuucuaggcaaauggcuuugaccugcugagguaucucacuggccccuuauuucuuuacuuuagaaagaaaucaacacuuuucuguucuucucuuggugguagucugcuggaaugccacauagugagggagggacuacuuaguacgcaaggaggcaaaggacaaauuagaagacuaguucuccacccauugcuccuauagcucuccaacaauuauuuuaacugagaacuuaagaguuucacuuaauggagccaaagagcaggcugugcuaagcauuuaaaauggcauuugccauguguuaaccauguauauaucuauuauuugaaauauaccuugcauuaugggaggaggcaccucaaacuauaauggaagcacaaaaacuaaauaugauauuauuaugauacuacuuuuuaggaauucaucuauuuaacugcauuuguuaaucagaauucauagagacccuuuuaugugacuggccuuugaauuagcuagccauagccauuguaagaauaugagccaagcaguuguacuuagaguuuacuuagacuguguauuugauuaaauaggcauaaaaauuucuguauguagagaauguugguuaauugagagcaugaacuaauacacugguuagguauuaaagcuaccuacuguugggcaugguuagucccagcucuuuggaggcagggccguucaggucucucugaguuugaggccagucaaguucccaugaguuucaggccaggcagagcuacauagacaaaauacagaaaugaaaaacaaaaauaaaaaccuuaacuuauaacauauuugaguauuaauuuuauaaaauuauagugagauaauauaaaagauccaccccaaaaccuuuuuaguacuuacaaugccaagcacauucucuaucuagaacuaaggugauaaugucuaucaauuuaaaauuuugugguguggguuuguaguaauauuuuagcuguuaagagccuuuguuguucuugcagaggagugcccugauucaauuccuaguacccacaugguaguuuacaacucuccauagcuccauuuccacaugguaguuuacaacucuccauagcuccauugccuucuaaccuucacaggcaccagguaaacacagugcagacauucauguaagcaaaacacucaugcacauaaaauaaaauaaacacaucuuuuaaaaaguguuguggugcucaggguccagucuggagccuugugcaugcugggcaggcauuuuacuacugaguuacauugcuagcugaaaauuguuguauuuaaaaaucagagcaccagagcccggcgugguggcacacgccuuuaaucccagcacuugggaggcagaggcaggcggauuucugaguuugaggccagcccggucuacagagugaguucuaggacagccagggcuacacagagaaacccugucucgaaaaaccaaaacaacaacaacaacaacaccaacaaucagagcaccaccucccuacugucuuagguugugugguuuucucagcauugccauuguaccaguagaagaaucggcauguuggugaugugcugagcauccaguauagagacagccuagcaauagauaguucauguaaggugcaugaaugaaaugaauaaaaggaaaaccaaaaaggauucauaagauaauuuacuuucaguguaaauccugccugaguugcugaauagaucauuuaagugcucuaaacuucaaaacuguguguggucgcacauacuuuuaacccuagcagcaugagaggcugaagcaagaggacugcuaagaguucaagggcagcugggguuguagacuagacuuuagcaucuaaaacauaagacaaagguacuguguuaguuuaaucugcauucuaucuggcuuugcugcaagcuguagcuuaauuugcuuccggacuauuucauauuugucuuuuauauauugaaauucuaaauaaaaacaguuuaacaacguucuauuacuagacaaaugugaggaccacuggggcaaugguuuauaucuuuaauauccuucuagcucacuaccuuuucuagcuccauaauuuuauggaacauucaacauauaccaaguauuuuaugaaggaccuguuggcagguguggucauggugauugaccagggcacauucuucagaagaauauuauucuuaagcugguauucagaccuauaacacccgcauuaaagagccuaaugugggaaguuuguaaguuuagguucagccuggguuaauuaauauuuuuaaaaagauuuauuuauuuuauuuauaugauuucuuuauuuuauuuacacuauagcugucuucagacacaccagaaugggauauuggauccccauuacaaauggcugugagccaccaugugguugcuggauauugaacuaaggaccucuggaagaacagucagugcucuuaaccccugagccaucucuccagcccuaaaaugacuauuuuuuuuuuuuuuuuuuuuuuuugguuuuucgagacaggguuucucugugcagcccuggcuguccuggaacucacucuguagaccacgcuggccucgaacucagaaauccaccugccucugucucccgagugcugggauuaaaggcgugcgccaccacgccggcucgaauauuuuuuuaaaaauugguuuguauggguguuugguauacauguguuauaccauuacaugcuuggugcuuggugucugaaggcuagaagaagauguuggauaucaucaaacuggaguuacaauugguaugagccucuguauaagugcuggguaauugaaaccaggucuucaggaagaaagcagcuagugcucuuaagugcuugcuugcuugcuugcuuauuuauuuauuuauuuauuuauuuauuuauaagaaacucaauacguaugagacauuuguuagcaccuaauugaaaacuguucaggucaguucucuuuuacauuguggacccuucuuuaccaggcaaaguguagacagugcucaauccucaccaaggucugauccuugaccuuugagaaucuuucuuccuuucuacauauuuugacccuugaggagcuuauagucuugggaggagagagauacacugauuuggggaugacuagguaugaugguuaaucuuauguagcuugauuggauugagagacaccuagaguucaagaugguauaccuugguauauugcuagcuaggcuggggggcuagaucuggcaucaaaucaaguuguagaagaaaggacuuuuuuggacuaacaguuccaccagaauaggaguccaugaugauggagcagagauagcagggguaggugguggaaguaguaacuaagagcucauagcuugaacugcaagcaggaggcagagaggacauauuggggaugauggcaggaggauuuugaaaccuugacccuagugaugcuccuuuuccaccaaggccacaccuccuaauuccucccaaaucgccaccaagugagugccaaguauucaaauacacaagacuuagggggcacaucucacucaaaacacaggaacacaccuuuaguacaggcuguguuuucauaggcuuggagccaggauugucuauaugcuacugacugcugugagcugaggaacuucgcuguuauacaauaucucccuuggaugauaggauggaauuucugaaaccaaaauacauccuucuuucccccauaaauuuaauuguuuauuuuuugaagcagaaucucauguagccuaggcuggacuuaaauucaagaauccagugacugccuugaauccaccuccccaagugucuccuugccuauuggccuguaaguuguuuuuaucagauguuuuuccauuaaguguugacuaauauacuagcaaauuuacauaguacaguugguaaagucagguugugccucauauauauuuagggauuccauguuagccugagacaguuaugcugaguuucagauuuaugaagaaaauacauaguucuguaauuuuucaaaaugaacccaguaggaccugccuguauccccagcacuuggauggggaaggagagaauagcugaacagauagauucccagaguccauuggcuagccagccuaacugaggaagguaucucaauccucugaaugaaggaaugaaggaaugaaggaaugaaugaacgaaugaacgaaggaagcuaaagagauggcucagugauuaaaaguacuggcugcccuuccagagaacccaggauugagucccaguacccauaauggugccucacaaccaccuguaacucuagucccagggaauucaauacccucuucuggcaacaaacauacacauauaugcaggcaaaacaccuauacauaucaaaugaaacaauaaagaaaauauaaaguagacagugauagaagaaagacgcccaacuucuacacacaugagcauggguaccugcacuagcaaguauauacaguacaccaaaaaaacccaaaauuccaaauguugguguccuugaaugucuacccugugaccuauggaucuuauauaacugggacacaacauagaaucaucauagacuuacuuaaaauguuaugaaauuugugugugagauugaugguaacauuauagcacaguguucagagguugaucauacuuucuagucugugcuuagaaugugaaguggugagcagccugggguaggcaguugaagaacugccugcagcuuagacuacauuuacauauauugguuuccuuagggacagggauagggacucacaguagcuccucuuccucacaugucuugcaugcugagcuagauagacuauguuuguguuuacuccauauuauugacauaagugaguuaauguguuuucauucugggagaaaucuauauaugccacagcugucacaguuugauuuuaagguaaauagaagcaacugcccaaacgucuuugacagugaagaagcuguccuaccuuguccagccucuguaguuguaguuggcaaacuuauccauccugcauauuuaaaugcccucuguaagaagacuguugcaccuucuagcagcacacugcuguaagcacuucuccugcucugcugguugguccuugcugugcugcugugagauagucuggguuucucucauugucccuaugaagaaaucaaaacuuggacaugucagugacuuuccaggauauguggaaggacagacucucuggucuacuuuuuccucaaaucugugcuagacuaggagaguacagcauuucccacaagugguuaaaaauccccaauccuuuccugugaucauuugcauggaacguaccuguuucuagguggccuugcucuuucuucccccacacccgucuaagugcgugugugugugugugugugugugugcgugugugugugugugugugugugugugugucugucugucucugccuuuauauguuucucauguuuuuuuguuuguauuuauucuuuuauuaacugaauacauaguagaaaaugugucgguguucuguaagcccuagaguacugucagaaucuuacaguuccuauguucucucuugauacugagacagcuggcucaguuuaauuccuucugcacaggcauggagagcugaguuuagaucuccaggacucaaguaaaaguccaggugugguugugagccugugaucacagugcugaagaggcggagacaagagagguccuggaacuuacuggccaguccggucuaaccaaucagugagcucagguucagugaaagauccuaccccccaaaaugaggugggcuguguugcggcacaugcauauaauuccagcacucaagaggcucucugagaauucaaggccagccugguuugcauagugaguucuaguccagccaguacuacuucaugaaacucuuaucuccagaagaaaaaggaggggagugauugaagacaccugacagugacgucugcaggcacacucacauaauguacccuacacacuuuggugcggauaacaugcacauauaggugcucucauacacgcaaauuaaaugaaaaaucccauccucuucucaucggcgcucucuguuuauguucucuuguagucacuuuuaugugcauguaccuacgcuuacauagauguacagguaccccgggccuguuguuuuuucucugugccucccuuuuuuuuuuuuuuuuucgagacagggugacaggguuucucuguguagcccuaccuauuguccucacgaagcucuugguuagucuugcagaccuacagauuuguaaugacuaauuuaaucaacucccauaaauaagcaauuaggugacuuuuagucaguugucaucugaauagugcuguaguaguguucuuuguuuuucuguguauauacggggaaguauuucuuauacaaagagaauugcuaggucguaguuuuuaagauggucauaacccugaaguaggaauuuaccugguguaaucguccaaaaacuuaggggacuagggauugagugagugaaagagagaguaguacugauaagauguuuauuuauugagugaaguuguauguguggagcaaaucacauggcuuuucuaguggcuaaaugugauuggugguaguaguuguagugaauugauaauggaaaaaauaauaggagcgacuaaacaugaaaaugauuuaccuugggaguacaccauguauuaaaugagcgggaccaacauaauauuccuuacuguugguaaguggggugggguagacacuuccauucuauaaugagguuucaaguuacacacacggacaaacuuacauggaauucacuauguagaccaugcuggucuugaacucagagauccaucugggucugucuucccaauacugggacuaaagacaugugccaccauuuccagccuucaaguuaauauauaucuuuuguaaaacaaggugguaugauuuuguggaucaaaugccuuaaaaaugguauauucuuuuuuuuuuuuuuuuuuuuuuuugagacagggugacaggguuucucuguguagcccugguuauccugggaacucacucuguagaccaggcuggccucgaacucagaaauucgccugccucugccucccaagugcugggacuaaaggcgugcaccaccacugucccgcugguagucacuuacucaauaaaucuuuacacaugaauuuacuggcauccaaaacuucaaauauuacccacuagguucuuacugagauucuagggagccuuuggcaccuucaguggcagugcuuauugugaauuauaaacauaaaauguguuaccaguuuaacaacaaaaauacgucugaaagcuaauaguauaaggauuauaaaucaguaaacuuuucuauuuuuacuuauauaagacaucuauaaaauacauuaaaaagauuauaugauacauauuacaaaaauauguaaaguauuuucuuucaacaguauauauuugacaguugucaauucauaaaguuuguuaauaauguuauuguagagacuugagaguauuauaauaaaaaguuuauagcaaaaacaaaaaaccaaaaauucaaucaaagucauagauuucaaauccuuuuagauguugggcauaguagcgcaugccuauaacccaggagguggaagcaggugggucugugaauuugaggccagcuagagucacauuuacaguguguguuggaacaggagcagcaggaucaaauaguaacauauagacaguuucuguugaaguugcuguaaucuggucuguguuuacauuucaguggccucauuguuccugaaagagauggcaaugagacggcuccugaggucacugucacuucagguuaugcacugcugcauuuuuucagugaugcugcuuauaaucugacuggauuuaauaucacuuacaaguaagauauuuagauuuaauauuugugauacuacucaaaugacuuaauaacacuaauauauuggagggaggcuucuagcuagucaggcuccuugcuaaauuuuaacauggauuuucuucuucuucuuuuuuuuuuuuuucauaauugaagaaacaggagcuaaaagguuaaacaaauaucagccccacugguugggaccacaguucuuggucuuucuagaucuugucacugaggaucuccuagaagagagagacauucuuccgcugcuggaagaaaaugucaggaguuuugcuaagugaauuuaauaaagacuaguagugucucaguaauaaucaucaguaggagaaaucuauauuuuuaagcuauuguaauaguccacuaaugcaccccuuuaaaaagucugaaguauggcauuucaaauuguagcaaaacuguuaucuuaagucaugagacacuuaaacucauacaugaaguuaacugcucuucuccuucuaagcugauaaaaguuacuaaagaccuuuaacuacaucacuggaaaauaaucuuaaauucuguuaauucucagaaucuuuacagagaaauguauaccgugaauguuggcagcucauuggcuuccucuccuuccuccacuuccuagcaugaccuugcugcuuuuguagaacucuuuacuaaugagcuaccagaaagaguaggauccugguugccagucuugagcuaagucuaagugauuuugcacaaaugucuauuguuuuguaauuucucuaacuuugugaguuauuuauucuuccuucuucauaugugaaugcagcaagguugauuugauuucauuacuugagccuggggcucuagcuacacagagcucugugagcacacuugggcuaacugguaaguccugcagucacacuugcaaaugaacugaacuuaaacugaaggaggaaggucugcauuaguugcaauguugcuuaguugaaauuguugacuucguuuucuccugucuuuguaguuuugacauguguccgaauaauugcucaggccgaggagaguguaagagcaguaacagcagcagcgcuguugagugugaauguucugaaaacuggaaaggggagucgugugacauuccucacuguacagacaacuguggcuuuccucaccgaggcaucuguaaugcaagcgauaccagagggugcuccugcuuuccucacuggcaggguaggagcugcccuucaaaguccuuucccucacagaaaguucugaguuagugaacuguagggaguuuauuuuagcagccauacgccuuauguuaaucauguaucagguggcauuuaagcauucaucuccauuuauucagauucuuugaauuuacauauaugugguuguuaucuaugugcuuagaauuguggaaagguuugacaaauccuuugcaacucauucgugggaauuagggaacauggucuggugauagagaagcagagacucaagcugagaggaggacaagcguuccuuagagucucagugcugucaucuagugccauuacccaacacaaccggguacuaagguacuguagggaauucccugggguauugaggaagcagucaucguugguuuagugauuuuccuucuaugcuuagguccucagaaaguaaguguucauguaaauguuuuuaguuuguccaauucucccuuugucucuuucaucuauucagcgccuggacuugccagaagaucgauuuugaucugucauuauauuucaacccuaaugccuuuuccacaugaguuaauauaauaaccccuuggucuacccuuucuacuaaauguugcuucagcaagauuuuuaccucuaaaaaaguuuaaccugauuaucagaaauugccaaauuaucagaaaguguguaguauuaaauuuuauaagggagugauugguuuuggucuguaucuugaguaaguuaaaaacucauguuaggugcuaagcagauggcuucuugguuaagaguacugguugcucuuccagaggacucagguuugauccuagcauccacaaaguagcucauaagaucuguaacucuaguuccaggggauucaaugccuuuuccugacaucauuggguaccaagcaagcaagugguauauaggcauacauguaaacaaaauaccuguacauguaaaaaccuuuaaaaccccacaaguuaaagauguuugcgcuuaagugcuaaaggaaacacaagucuuuuuuuuuuuuuuuuuuuggucuguuuuuuaaaaaauuaauuuauuuauuucaugugaguacauuguugcugucuucagacacaccagaagagggcaucagauccccauuacauaugguugugagccaccauguaguugcugggauuugaacucaggaccuccaagaagagcagucaguuuucuuaaccacugagccaucucucuagccccacaagucuuuaaauauucuuugcacuuagauuggaacuuggaauacuauaaacuuucaggcugcauuuugugaagcuauuuguuguuguuguuguuuuuuuuuuuuuuauuagguccuggaugcucaauuccugugccagcuaaccagucuuuuuggacucgagaagaauauucugauuuaaagcuucccagagccucucauaaagcuguggucaauggaaauauaauguggguuguuggcggauauauguucaaccauucagauuacagcaugguuuuagcguaagugucuuuauaaugaaacauuuuauuuaugguaacugaguguauauaaggggguguauacaguggugugcaagaggagcucgaaggacaacuuccuggaguuaguuuucuccuuucaccuuugcaaguguuuuggguauuugguucagguugccaggcuuguaaugcuuugcccuuugagccauuuccagcucugagaguggugguaagugcuucuguacaaagcuuaaguuuccacccugaaaaacugcaguguaaaaaaaaaaagccaagaaaucaccaguaauuaccgaggaaagucuguuuaaacuuugguaguuuucuucuaaacuuucuugauauguguugauauucuacaauuuaacgccccaaagaauucauugucaaaauaagaauaauuuaucuuuuuaagguacuuucuuugauauuuugcuuuagguauauaguaaguuauauaaauagggguuauuuuaucuugauuuuauuaauaguuuucauauaucagaugguuucaguuuauagcuuauuaguauuaaauggccuuugucuaacaauucccaggguuugaagucuuauuugugcuuuuuugaagguagaauauacauuaucauauuagaguuaguuauagaaaacagauuucaagacaagauuuauacauacuuaaaaccauguuaauuuuauggccuggaaauuuuuucuucuagugauuauaaagcacuagcacucaucauaaaauuaguaggacuauuaggcaguuugguauaguguuuuuguuaauguucuauuucuuugaagagacaccaugaucaaggcaguuuuaaaagaaagcauuuuauuagggggcuuauuuacaguuucagagaguaagucuaugaacaucauggcaagaagcaugguagcagcaaggcacagcacgggagcaguagcuaagagcucgaaucugaucugcaagcaagugggagggaagaaagagcaaagggaggagacagacagacaggcagacagacacugggccuagcaugggcuuuugaaaccucaaaggucacucacucccagugacacacucccccacaaggucacaccuccuaauccuucccaaaacaguuccaccaaucaggaccaaguguugaaccuauuggagccauccucaaccaacccaucacagacaguuuuugaaucaccccaggcauaguaauuaaaagacacaaaguaguguagaacagugaaguaaccuuauaaaauggaugacagcucuaaaacaggugacaggagagcgauguguaauaugaaaggacaguuuacuagagaaaguaguagaaaugagaggaccaggcuaacaauucuaaaaauuuagaauugaagacaaaauguggaaggacacacauauacaaacacaaugauacugcuuugcaaaaggaauguugaaagaggaaucuuuuaaauuauauggagaaaaauauaaaagucuuuuuuuuuuuuuaacauuuauguauccuguguguuugugugccauagugccuguguggucagaaaaagacuuggaaugcugugcugugcucccacccuguaggugagaucacuuggguuacccaggucaucaggcuggcagcaaagcacucuuccucugugagcuuucuugcugaccuaagaaaaaauugaaauacuaacuaugauuaacacaccuugaacacuguguguaaacaaccaagagaaaaaaagcagcagcaagaaaacaguauggcucaguacuccugagcacaguaaacagugugaggcaggguguccugagacuuuucuuuuugccuauguauguuaaauuuacugcugagcacauuugcaacuuaguaauacugauagguacaagaaagaaaaaaaaauacccuaaggaaaagacguaggauguagcccagaggugggguucucgccuccaugugcagggccucuaauuauauguagcaucucaaaagaauaaaaaaaaaauuuaaagcaagaucuuccagaaaaucuugugcucucuuuaguccaaggauuuagaaagacaaaacuuucaauaguaaugucucuaugccagccagaugccacagaaaucuagcccuggccugaucugugccaguaaagcuaaguggggagccuggauguccuuccuuaccaggauacaguaagaugccccaacgacuaggguuagcaccagagacaccaaguagucauagggcuuucagguucaccaguuggaaauacagcuucugcccagacagugccaguagaggccaugugaggacauugaccucugcugucagcaacaguaauggcaguaauaaguugaccuucuccauccuaugggaggggucuaagaaggcauaaaaucaaagaggaucuagagucucacagcaugauauacaaaaucugcccagccaagagcuaauaugaucucguuuugaaugagaaaucaaagagacauugacauuagggugacacacauuagaauuaucugacaaggaauguagugcuaaggaugaagucuggugcuucccauacgcugagcaugccuucuaccaacugaacgacagccucagcagugggcuggugcugcagucuggaguaugucgaggugugugagauacaaugucugugauuaacugugucagcauuaaaaauggaauuuuaagguggccuaccuaaaacacuacaaugagcagcuacacacauauaaaacaaaugaaagaauagaaagucucaccaaaacaaauacaagacauaacaggauaccagaggccagguuaaggcacuuguccagcugggccuggugacccacuuggguggaagaaggaaccaguuccuggcaguugccuucugauuaucuuugugccuuggcaaauacauggccuugcccaaauaaauaaauguaauaauaauuauuagaaagaaucuuaaguggagggccuggaagauggcugagaggcuaagagcauuuucuccugcucacagccagcugggacuucuguucuagaggauguagaugcccucuuguggccucugcuggcacugcaugcgcaugguacacagauaggaaggcaagcaaaacacucagacacauaagauaaaaauaaauaaaucuaaaaagagaauaucagauggaguuguaaaauugaaaaaugcagcaauggaaacagaaaucccaguggguggauuagcauuggcaggacagaggcaagaaagagccagcgagccuccagacagaccauuagaaauuccacagucagaacaauagggagaacaguaaaucuuacauuaaaagaaggccagggccugguagcaaaagguuuuaauuuaagcacuugagagggagaggaggcaaaucucucugauuggggguugggguuaauggugaaugccaugacacccugcucagaguuagccuucuccccuaaaaaaauuuuaaauucauuuucaaugcugacacaguuaaucauagacauuguaucucagacaccucaacauacuccagacugcagcaccagcccacugcugaggcugucguucaguugguagaaggcaugcucagcauucgcgaagcaccagacuucauccuuagcacuacauaaaacuggguguggucaugcacacuuauaacuucagcaccauggaggcagaggcaggaugaugagaacuugaggaucauucucaguuacauagggaguuugagguuaagcagggguacaggaggccugucucaaacaaacagacaaacagacaaacaaacaaacuucaaaaaacucuugaaguacuaggccuaguacgugcugagauuguagguauaugucaucaugccuguuguagaaugagugagagcggacuccauaggcuuauagauuugaaucuuggugucugucuaugucaugucaucccugcacaaaagcccacacuaggcccacacauucucucugucugcugcauguggguuagaugugagcucucagcugcugcuccagugccaugccugccugcugccaggcuccagccaugacggucagggacuaacucucugaaacuguaaccaaguucccaaugaaaugcuuucuuucauaaguugccuuggucauggugucucuucacagcaauagcacaguaacuaagauaccuggcuccuccccuccccaccccaccauuauuuaccauaaaguaaacaauacacaguuggauaacaugauacugaaguuauuuuccuguuuccugauguaacccaauuuuggacaagauuaagccuuaaauagcaagcugugaggcaggauaaagaaaaagcucgcaggccaaugucugcuuuaccaaauucuguucagcagucuaaagcugccgucacuucgacuccugugauggcauuuccaucacuaucuuagauauucccugggucacaaccuuuuaguacacagauugcaacucugauggaauggcugacugcuuggcuaauuaaagcaagcuagaguuugucuggcuuccuugucugaauggggaggugguauuuacaaaauuuuguaaauaaacuacuauauuugcaugauguauauaaauuugauguggcugcuuuuaaaucauuuaaccuaaacugucccacagaaucaucuguuugauuggaaagauuguagcuucaagagaauuucugcugaaccugaaaugauucauaaugaugugucugaagaaugugugcuaucaccuacgguuuuuguuuuaguugauauuuguacuuuaagauuuccuuuauguauguguguguguguguauuuaugugaauguauaccucauguauguggugcucaaggacaccugaagaagggcucuggagcuggaguuacagggaguugugagugcuaggaaagaaagcuggguacacugggaaaucaaaaggugcuucuaaccacugagaaauccugccagccccuugguuuauuaaaaauaucaaacaaaaccaacacuaguuacauaaguaucucucucucuuucuuucucucuuucuuucucucucucuuucucucucucucucucugucacacacacacacacacacacacacacacacacacacacaaaggauccauaauaguucuucuguaucccgguuaaauauaaguucuuaggggcuagagagauggcucagcaguuaagagugcuuguuguucuuccagaggacccaaguucagauccuaguacacacaucaggcagcucacagcuacccauaucuccagcuccaggaagaaccaaucaaugccuauggcccaugcaagcaccagcacacauaugcuccacaaacauccauauauauagcuaaaaguaauaaaaauaaaucuucaaaaaauuaauucugguugaacugaaaaagaucaccuaacauuuagaaaaagcaguuuacuagugaauaggacauaaaucaugguaucaaauauucuguuguuaaaggaagcaacuagaaaaagcauguguuugaaauaaccaauggauacaaaacaaaugaggcaaccccaacaucugucaguaccuugcaaaccaacacaauaaauuugauuuuauuuaaaucguaguuauuuuucaugcuaguaguuuugaaacacaauaaauuugauuuuauuuaaaucguaguuauuuuucaugcuaguaguuuugaaaccaagaucuagauuuuguauagccacauaaauacacauuagaauugcaaacugauacgagcuucaucuucaucagucucucuucaugaaaagcaguuacagggacugagacaugacucagcaguuacggcaugggcuguucuuccauacgacauggauucaauucucagugcccaaauguuggcucacaaccauuuguaacucuggucccaggggaucugacacucuucuuggcuucuauggccacuguauucauacgguacacagacacauaugcaggcaaaacucaacaaaaaaaauaagguuuaaaaaaaagaauuagaacuuaaaggcacuucauuccgucagcacuaaaucagccucucuggagucuucccacuucaugagaaaaucgucagcucuccacugcugucuguggcugaggagcaggaccuggacaacguucagagauugucagugcaucucuuuucuucuuugguuugcugucaucagguucacugucacauucccuuuguaccauccuuccuuuaacagccuuuugaaaaugcagaaauguuggaugcugccuucaguucacacaggcugucuuuuuagcuccucaucuaucuaugcuuaauuuguuaguggugcucacccauguauguguuuaugucaugaagccacaagaugagccuugauugagucuugcugucaguguggaucacagaaaugacacccuaucaucuuugcuuccugcuuguuagaagucauugauucugcuuauacucaaggcccacaguauuauacuugggugugaaccccaggaagcagggagguggggggugucauggauacuacucagauaucugacuguugugauauuucaucaguucucauugguccuaucuuuaaaaucugcccuacaucuagagcuggcugugguggugugugugguggcaucaguaucagaacuuggauuacagaggcaggaagauugugauuuuugaggccagaauaggugcauacaaagauccugucugcaaaagaaacaaaugugcaaauaauuauaacuacuuuacuaauagccuaacuaauaaccacugcuagugcuguguccacgaaaaggugaaguaaacugugaaaaugacuuccccuucugugugacacacgccgucaugugauuuuacuugugucucaucauuguuuuuccuucuguuugcaugugugaauguucacauguggaagccagaagucaguguugagugucuucauaauugaucucuauucucuuuguuuugagacaggguuuugagacuaagcccagugcucagugauucauccaguaaacuguagggagcuuccugucucugccuccacaguguugggauuacaagcaugauccaaauuaugugacaagcgcuuuacuaacuuagccauguccucagcuccccacuccccuuuucuuuucuucuucuuuuuuuuagacuuacuuguuuauuuuuaugaaugucuugccugcaugcauacacacacacacacacacacacacacacacacacacaccccacaugcaagcaauuccagaagagggcauugaaucccugaaacuggaguuccaguuaacugugagccugucaugugcguacugggagcuaaauccggguucucuggaaggucagcaaggucuuaccugggagccgucucuuuagcucauguguuucucucuugaagcaagaaaccuaggaaucauuuugaaacuuccuucacagccuuuaucauaacuucacgucaauuuuuaccuacucuuucaacaaauacauguuauauuuacuuauuuuuauguuuagccugcuauugguuucuacuuagccucuugcaguagaguucugucagauuuauguuucuauugcuuuuaauuuauuuguaaaggugaaugggaaaauauuuaaaaauuacagaucccaucauuuacuauauucuuaaaagccauggcuagccaggcuugguugugcaugcuuguacucccaggacucugacaacucaguaaggaggagagugaaucagaaaauagcgccagccugugcugcuuagcaagaaacagaaacaaguacaaucacacacauagaaaaucccccauuaauaccaucccauuagauauaaugguccuguaugaccauucaaccacuguuuguccucuguacugcaguaacagucuucugcccuugcccgugaagcacgugcgcaccccgccuccaagugcuuuugcacugguguccuccgucuagauguccuguuacuauauguaaggacugguuucuccuccucuuuacaguucaaucuaauugucucaugaaaagaucuuuccugaccaucugguucagacagguucucccuguuguuguuuuguuuuuuguuuuauaguucuaaauuccuuucaggaacuuuugcuuauuuuaaauucccugagugcauacgugugcuuguuguugcucaugcucguuguuugggcuuacuuuacuaucagcucuggaugugguucacagaaggugcucaggggagcacucucagccacucaucucacacggguuauagauauauguauugaugcuacguuugcuugugagccauguuuuaaagauuagaauaucuuuucuauguguacucuaucaaaacacauguuagggcuuuaucuauuuuauacagauauugguguucuugcuuuacuaauuuucauggaauuucggugaauauuaguauuuuagauaggaagacuugucucaaaauguagcucagcugguugagugccugccugcauguagaaagcccuguauucacucuccagcaccucagaagugggccauggugcauaugcugucaucucagcacuccggagggagagaaaagagaaucuggaguucaagguuauccuuggcuauauaacaaguccaagaucagccugggcuacauggcauccugccucaaaaucaaacaccaaaucaaaaagcucacaucuugauccaaaagaagaagguagagagaauacacugggaaagucuuugaaaccucaaagcuaacuccaagugacagugacaccuccuuagcagggccauaaauucuaauccuuccccaaagcccaccaacuggagaccaaguauucaaagauaagaaucuaugcaguccauucuccuucaaacuaccacaguagguuuucuuaaaaaaagaaaaaagaauauuuuaauugauugugauuauucaguauuauucaugaauaaucaugaacuacauggcaggacuauaaacuauuauuuuuuuuaaagauuuauuuauuuauuuuauguaugugaguacacuguagcugucuucagacacaccagaagagagcaucaaaucccauuacagaugguugugagccaccaagugguugcugggaauugaacucaggaccucuggaagaacagucaguucucuuaaccacuaagccaucucuccagccccuauaaacuauuauuauauuuauaaaauauaaauccgugagucugugcaccccugugugcacauggaugggacaucuuugaacuggauuauaucauacuuagaagaauacaagauacucuguuuugucauuugggugaaaauauggucuguuuauuuugcagguaugaccugacuucuagggaauggcuuccacuaaaccauucugugaacagugugguuguaagauauggucauucuuuggcauuacauaagguaaacuaucucaacucuucaccaagcaagaaguucaacucuuccuguugcuuuaugucauugaauacuaucgagcuuugguuuuaguugguauaagcuuuguuuugaugucauggagguauauaauucaccaaguugucaccaaguuguaauuggaaauugaaguuagaacgauuuuaauccauggugucuugcauuuggauacucugaucacaguuaacaaugaagauuaaauagugucagcaagccuaugcccauuaucaagucuagcauacugcaugcgugugacugaguagccauuguuaucuccuuguuuugagcguauauuguagaaugaggcaacuguauuuuccacaccauuuucguucuguaacacguuucauguagagaaggugauuuagagaggggaagaaugugauuguauugguugguucuuucucuaugcuauuccuagcaagucaccgaagagcucauguuacucacacuucuuaagcugggaucacaaugagauugugaaccacucauuguuguuuuccaauauaauuuuuaaaaagauguauuuauuuuuauuuuauguguguggguguuuugccugcauguaugccuguguauacuguuccuccagaggucagaagaggauggcaucagaacugguggcuguuagcugccauguggguacuaggaacuaaacccggguccucugcaagagcagcaaguguucauaaacucucucuccagcccuagaguugauuucuuaaugguuuuaaaaauccuguuuacaucuuucuuauaggauaaaaucuacauguauggaggaaaaauugauucaacagggaacgugaccaaugagcugagaguauuucauauucauaaugaaucauggguauuguuaacuccgaaagcuaaggaucaguaugcagugguuggacacucagcacacauuguuacacuggcaucuggccguguggucauguuggucaucuucggucauugcccacucuauggauauauaagcguugugcaggaauaugacuuggguauguauuuuuuccaguggaggcaucuugaauaucauacugagaaccccugcccuuauuauuaggacaccguaacaaaauucagcaugaucuugauccaguaccuugucuugaaauaguaucaguagauaacuggugagauugagguuguugaagucccugugcaacagcuguuucuuacuugucaaggucuagucuuggcuugggagggguucugaggaaaggggugucaaaaaacccaaaaaguccaauuguagguccaagcuggcagcuguauauugcauuaaggaaagcugagggaaauuugggauauuuauuucaucuauuagucuacaucaagcaagucaagcgcucacagucaacguuugcacccucaaauuaguaacaaaagagggggaacugaggaguccagcaugguccugguugggacagaaugacaugguuccagcccugagacaggggcagcagguccgggccuccauggaugucacacuauggacauaaaccuguuuguauaauaauguacauauuucaugcuccucuucugaguaauguccuucuguuaaugugaaugacuucaugauaaucagagccagugugagucugggaaguaaauggugggaccuucaggacagcucuuaaggcuguggaaaagaacaugaguucaaaaccauauacuuccucaacuauacaaaaauagaaggaugcaauaugaauuguaugaggggcuucacagaucuaaaggaacaaaagcagcuucgcugugagccaacuugucagaaagauauugaguaagcaguuaaagagauuuagggagugcugauugcuagaggaggccacccagcuaaguuugugcuuacaaaggcagacaaaguccugaguucagggugggccuggaacagagcaagguuaguuagaccuuggugugguagaaaugguaauuuccagacaggauacccaacuaguuuuugugcuuaacagaggcagguagaucucugaauucuuuuguaauguuaaaaggaaaugugugcuuguugucucccaaggggccugagucccaggaugcugauuuauaggaaaccuggaguaacuggguuuaugaccugcaggagacgagcuauccagaauguuuuuugcaauagcaagagagaacugccuggagaacugccuucagcaaagaauagcaagagaaagcugucuagagagagagcugucuguagagaaagccggucagagagaaaguagacuggaaaacugucuccagcuuggacccacaauuugacuuuuuguuuuuguugacaaguugcccucccccagaaacaccuuccucaggaccccucccaagccaaggcagggccuuggcccuucuugucagcuugcaaggagccaaagauagcauuaaaugcuuuggauaucaaaauaagcaaaaugcaaaacaguaaacacucuaaaauaauucuggcuaguccuuuaaauauuaggccagugcacuguuauuuuaccuuaauguauaaucuuguguuacauuuuauuguuuuuauuguauaauaggaaugucagaauuauaauuuuguaacauuuguuugacauuccugugaaaaugcaucuaaagaucauuaaagugcaucugaagaucauaaggacucacugaggagcacagggaauuaagugucugcuuaagagaacuuugaaucuuuaaucuuuagaauuuguuuuaaaaauuugaaucuugccagugugguggcgcaucccuuuggucccagcacucaaggggcagaggcagguguaucuccauuagugugaggccagccuggucuacagagcaaguuccaggccaggcaggguacacagagaaacccuagcuuaacaaaacaaaacaaaauaugaaucuuuaaaaacuuguucugugaaaauuucauacauguauacaauauagcuuguucauauccaccgccauuccuuccagcuccucuaggcuuucccagugcaucuccuuccuagccuuauggccucccuuucagggugaagguuagcacacugaguccaguuagugcugauccgaugcagucuugucuagauggucuucuuuauaauaaggugaaaguauauccuaaacuuccgucuuuugcucuaagguguuuagacuuuaaacuaauguuuaaaucguuuaaauaauuuauuauuucauaagaagaggagccugcaacauugacuuuaacuauugucucuuauccagaaaagaacacauggaguauauuacauacucagggugcucuugugcaaggggguuauggccacaguaguguuuaugaugacaggaccaaggcucuguacguucaugguggcuacaaggcuuucagcgccaacaaauaccggcuugcagaugaccucuacagauacgauguggauacucagaugugguggguguuuuccuagagcuuucccuugguagucuagaaucugcagaggcaauugauuaaaaauacugugcuaugguuugacuuuuguucagcauuguauguaacaaaguuaggagaucaauacaguaauagaguuaagguacuaauggugcuguugcugucuguuagugcuuagugcuuuagaccugauucacugaacucuagcaagguuuccucucuucagaauucucagcaauaaaagcugugcugauuuuauccauacuuaaaaagcauauccuuccuuuucucuuuuugguguuggggaucaaaccuuguacaugaauaggcuauaccaucuuuauccauuuacaucaccaaacaggaugcucucgugccuauuugauaggguuuucacucacuucgaacugaaacuuggguuguaagaguaugguacuuuuagcaaauggaaauaaauuugaguuaugaugcaauuauaaagcacuggucucucuguauuucccuccuccuucuacucccucccucuuccuuucugacccccucucucaacauacauuagagaccaugcuuugacugucaauuuaugcugugcugaagaucaggucuuuaguggcugugaaccacggagccuaugcaguggaaguucuggucucuggcuuuugccuuacuaauaaaacacugagcauaaauuuugauuuguauuucacaauucuuaccuggaauucuuaaguggaauuauggagccauagagaaugaacauuuuagggcuuuuaauauaguuucccgaaauuuuaacagauuuucaugauuguuaaaggaaguggcuuacguauagggggaaaucaaguauugcacauuugaaucuaaaguuauaaaguaauuacauuuaaauuggcaaauaaguauucuuuuaaaacuaaccuuauauuuauuauuucuaaauaaacucaaaaggaccauucuuaaggacagccgauuuuuccguuacuugcauacagcugugauagugaguggaaccaugcugguguuuggagggaacacacacaaugacacuuccaugagccacggugccaaaugcuucuccucagacuucauggcuuaugacauugguaagcuuuccaaagauguuuuagcuucaggaauauuuucuuugcugauggaaagaucacuauguuaaaauaauugcaccauuuaaaagaaguccaggugguagaauuugcauuuaauuugaguaggguuacacaucuauugaaaagcauuauuuuggauuaaacuacauuaaauucuuugugaaaucacucuucuuaauugcuuuaauucuuuuuuuagguugaguuaauugguaucuucuuucuuauaagugccuuacauaguaguggugguaguuguaaccaccaguguuauguuaaguuugaugggauaugcuguuuccuagaaaccugguuuuacacaugcuguugaugucaauauacauguggccagaagagggcagugucuguuuauuccuggaaaauaaacaucagcugcucuguuguguaaauaucacccaugugauguucuuucuguuuauuugucuuugcauuuugagacagccucacuauguagucuaauuggcugaagcucaguauauagaucaaggugaccuugaacuuagagaaauccuccugccucuucugagugcuaagauuaaagauguguacuacgaaugaaaaaaaaaaauguguacuaccacaccugacuagagauucauuuuaaaaauuauucuuauugugauaaaaugcucagaauaacacucaccaucuuaauguuuuaaguaguuuagauuuaaauauauuccuaguguuauucauguuauaauaccaucugcuugccgacuucuuguaaaacugaaacucugcccuuaaacaauaguuccucucuucaucccucacuccagccucuugaaaucauuuucuauaucucuaugauuuugacuagucuaaauuaggcauuuuuuaaaaaaaauauuuuguuuacuuguauguguaugaguguuuugcaugcauguauguuaagcacaccauguauauucagugcccauagaagccaaaaguaggcauagauuccccagagcuggaauuacagacuuuugugagccaccaugugggugcuggauacugugcccaaauccuuuggaggaauagugagucuucuuagcuguugagccaucuugucagcccuagauguuuguuuuuaacaaacguguuuuugccagccauugaguuuuuaaauugagaaugggggguacacuauaguuaguccuuagcuucaagcuuguggaagcagaaaugagaagacaauauaaucuuaacucaggaggauucuugcuggcugaaacaaagaugugaaauuaccuccgagcacuccuaagccacuggggugagcaggguggucuggagaggccuugaagagaagcugucugagcuuguuccuggggacacugggagucaaauagaccuccugggcagggggauuuagugcagacaagaggcaggaaaguacaugucaaauauuuaggacuuuugaaccgcuaccuuucuuuugucaugguaacacagaagguagcaggugacuguuagacuagaauguucagaucugauucagagugccagggaucguugguuggucuuguguaaagucucacaagugauagaaucauaugugugucuuagacuuuuuuuguuguagguauuuuagauuuuucuuguuuuuccuuuuuguaagucuggcccucacacuaugguccaggcaggcuuaagacuuaugguaaccauccuacucugccuuuaugggccaccaugaccaauuuaagaagcucucuuggguggcauugugauaagugaucuggaaggggcauauugacaguuagcaggcugcuacugcagaaguccuaauuagguuuguaucaaggccauggaaggagcagugacuucuaguaccuggcuguugugugucuugacaaaaauauaacugcccuuucuucccaagugucuacuauggaccaccuuugccaaaacuaaaagcagauucagagaaaaacauaucaugauugcacauggcuauaaucccugaacuuaggaggaugagaaauauggcaagauugagaccagucugaacuaucuaguaagaccgugucuuuaauaaaaauaguaaaaauuauaaaaucagggaguaggaucugggaagaagagaaugaaguaaguguggggcauauccaauuggagaugucuuuaggacagagcugauugcugagaggugguuguaggagaggugaguuauuguggggcauaaaagaugagcaagagucagagacaguuggagaacagagucugaacaagaguagagacuaaagagagugucagagaagcagggagaaaauaggugagauugaugaccugugagauauguuaauggccagaagaguggcuaaaaaugacuggagaauccuucagacuugucaacaaagaaauccuuuagccuaauuuagggugcaggcggcugaggaaggacauaggugaaauaugugcucuguguguucauuuuuauuaaagcuuaucugcaaaggccucagauuugcuguguacuuguagcugaggcucuuuugaacuccugguucuccuggcuccaccuucccaagugcuaggauuacagaugugugcccuaguuaaaauagcuguauaccuagcauuaaaaauuuuaaguuagaaaauacuguggugcuccggggaugcaucucagcaguagagugcuugccugcuauacacaaggcccugggacugaucccuagcaccacaaauacuaaagcagacauucugguagggaaaacugguagacagcagaguggugaccaucaggagggggguugugggugaugaaugacuacauuaauuagaaguucugugcaguauauuuauuucaugcccugaaacauugcugcugcuguugcugcuuuccuuuacacauaauaacauaacuaaaagacagacaagcaugugguaugaggcuguggaugaggcauucuuuguuuuccuuuuuuuuuuuuuuuugagacaggguuucucugaccuggcugucugaaacucaguagguagaacaggcuggccuugaaugcacagagacccuccugcuucugccuucugagugcuggguucaaaauuuauguuuuuuucuauaaagacugagaguucacauggacuauauaugacaaccuacucugaaauguguuuuucucccccuuagcuugugaccgauggucagugcuucccagaccugagcuccaucaugaugucaacagauuuggccauucagcagucuuguacaacagguaauuggaaagcaaaggcucuauuacugucuuacaucuuauauucauuuuuaauaucaacuuccuaacaguuguaucugaaugguaagagguuuggggagaaaaaaggagagaaggcaguucuaagugcacgauaagguaaggggaauaggacugggagguuauggggucaaagagcaagucugaagucugcacuauauccaggugugugcucaggaauacuuuucugaccagcagagcucuuuuuccauuugcuccaggaaccuuaguccuguaaaggacaugcaaaggacuaggguugugggccagcaauagaguguuuaucuagcuugcacaagauccugaguucugaccucagcauuuugccuucugcaaacacagcauuugccauaagggacaugcagaauggccauuuuaccuagucacuugaaagugugcuuuaagauugagaaacuuaacagccugcugaugcugacuuuucuuauuuugcuucuguuacugcuuucugcuucuuucuuuaauacucuaaugcuuacauuauauaguccuacagguauucaaauuuucuguuggaguuuccuaauacaaguaauuuaacuugcauuaggaaaaggauaaaagugccauucuggaguugugaagaaugaccguuuagaagcuagauaguggggaaagaugauaucuuuaaucaugugauuauuuaguguuuuacaaguauauaggggauuguggcaagaccauuguaugauuagagacuaaaguggaaagauuuuuuaaauaucuuguuaacuugaguguuaucuuaaauuacaaucugaugcuuuccucagaaaaagcccuaaaugccucuugagguuuucaucuggcaaguaucaugucaccuggccuugcugguggaaucugccccagcucauguguguucuuaguguucuccuagcacagaguuaggcacgugugggcauuugcauacuaauguauaguaauaguaacaauugaaugaauugucuauuaaaacauucuuaaguuuuacccaaacacagagaggucgacaauuugucauaaaauguaguuuauccaugaaucaaaaucaggaaugacugucugaacaguguuuuuauuuuuuauuuuauuuuauuuuguguaauuucugugauguguuugaauaucucaguuuuaggcaggauuggaaauguuagagguugguaagaggucaugguugcaguuugaucaugagagaaaucgauggcucucccuucauugcaguguugucagucagcagugugggaucaccuaugucuaacaguuguucuaauugagagaggauuacaggagggaaagcagugagauugugaggugcuagaugaggagauggcauuuaccuagcagccuucucucccgcccucccaucaugugaccugagagauucacaauuucugaagauaucagcugugcuuaguuuaagcaauaguuuuauuaacuaaauccaacuugauucauguuauucccagggaaccagugguaggauuaaaaaugaauccuaguguucuuuuugguuauuggaaugucaaguuuucagacacuguaacgaauacagagccauacaaucacuauauuuauuugguccuuuguugacuuagaaaaauugaagcccaguuuaggugagcuaccaaauuucucauuguggauuaguauuaaacuugcguggaguugugggaucuuggaagugggggcuaagcauccguguuugucacagcccagaaggaacagaugagguuccuuuugaggagucuuaugucuuuaugaacuuggacuuagaaauauuugauguguuuaauucugcuguaguuuuuuaaacucuagcuagugagcaucuuuucacaggagcgcuugagucugaccuacagccauugucugucucuggugugcauauuacaaaugcacugggagcguuucuugacccaaacauauaauuagauuuuucuucuaaaaaggucuaguuugggaaggaaugaaagggauuagagaaauguuguggguuugguauuuauuuauuuauuuauuuauuuauuuaauguauaugaaugaucuaucuucauguauaccugcaugccaaaagaggacaucagacucaugauggugaugaaccaucaugugguugcugggaauugaacucaagaccucuggaaaaacagcuggugaucuuaacugcugaggcaucucuccagcccaauuguucuguuuuaguuugaggaugaacaucuaauuuagagaugcccugcuuuuccaaaagugaguuuuaaacacuaauuuccauugucaguggauuggucuuuuaagaauauagguagugguggcacacgccuuuaaucccagcacuugggaggcagaggcagguggauuucugaguucgagaccagccugguuuacagagugaguuccaggacagccagggauacacagagaaacccugucucgaaaagcaaacaaacaaaaacaaaacaaacaaacaaaaacaaacaaaaagaauauagguuggaauagguuggaagcagccaaugauagugcauaccuuuaaucccagcacuugagaagcagaggcagguggaacucugaguuugaggccagccuaguuagucuacagaguauuuuccuggagagccaaggcuauauauagaaacccuaucuugaaaggccaaaaaaggaggaaaaaaaaaaaaaagaaaagaaaaaagaaaaaaagaaugcagguugggcagucaggguaagugucuaagguaagaggaauucuucaagguggaaagucaugaguucugcgccagccuaggcuacagaguacugaaaggggaagagacuguccaugugucagacccucauuucuccaaaagucacaugacuauauuuuuucuguauugcccacucuuccauacaugcaccuaacaauaaauauugaaguucacucuguggcacuauaucuaugugauagacuucuagaaaagugauuuaaaguucaaaagguaaauacguaguuuuguuucaaguugccaaaaucccuuuaguagacuccuacaaucuuacaugcccaguagcaguauagaagcuugcuuguugccuugaagccucaccaauucaaauauuagguaacauuuguuacauuuuucuuugucagcuggauagguaaugaaugacacaacaauguguucccauuuucucugcauuacuaauugaaguccuaucacccacagcagacugaagaguuccuuuaauauuuuauggacuuugacaaaccuaggauucauagcuuccauacagagaggaauuucacaaauagcaaaguugggcuguuagaagaauaaaaagagaauucugaguacagcuucucaaagaagagucccacguagguguccucugggaugugccuagaugcaggguuauuguacaggagcucuucugucugcucucugauacuugagauuauaggguugcagggaaaugcauuagauggcauuacaaacugauaagauaaaguuaggagcuaucagagauuuaggacaugguuuuucucuguaaauggggcuucuggugagauuccuagaaaaugcuguuuauagcuaggaaugggguuauagcuaggaauggggaaagaccuuaagcaguugugagcugugguggaaugcauguguuuucaguuugcuaaggcuuccgggaauacuuuuccugucgauaauuuucuuucacucucuuuguagccuucuuuguauuaaaauccucucugcuugcuuuugugugugaauguguguauguguguguuuguguauguguguguaugcaugugcauguaggucccuacauaggacagaacauauuuccuggaguuauaggugcuugugagcagccuuuuagggaaccaaacucuguccucuggaagaguagccccuuuaacugcugagucauuucagccucaagaaucuucucuuuucccuauuaguagaagaugucaucuuagcucuaggaacuacaccaccucuggccucaguggacacccauuuacauaugcacauacagcagacagacauauaacuaaagauaaaauaaaucuuuuuaaaaugucauuucccuguguacuaauuuuccauguacacacucacagguagauuuuuaaacuauucugagugaucacaaagcagagcagaaggugaaauuugagagaauagaugauauuaguggauuuugagaccuugaaaauaaugucucagagcauuaaauuaaucacucauguauguauguauguauauaaguauguaugcauguauuauguggaugggggugcuguagcacauguguggaagucagaggacaacuuugugaagucauguuucuccuuccaucuuuauaugguuccagugauugagcucagauugucuaccuguguagcaagugccuuaccugcugaccugucgcacuagcccucucagaggacuuuuaauauuuggaauauuucuaacgauugacagucaaaaguuuauugugagccaggcacuuaaaauccuagcacuugugagacacaagauggaggucaguccagucuacugaguucuagaccagcaagggcuacacagugaaaccugucucaaaaauuucaaaagcggagcuagagaaauuacccaaggagcuaaagggaacugcaacccuauagguggaacaacaauaugaacuaaccaguaccugggagcucuugucuuuagcugcauauguaucaaaagauggccuagucggccaucacugcaaagagaggcccauuggacuugcaaacuuuauaugccccaguacaggggaacgccagggccaaaaagggggaguggguggguaggggauuggggggguggguauggggaaccuuugggauagcauugaaaauguaaacgaggaaaauaccuaauaauaaaaaaaagaaaugauaucagaaaaaaauaaaaaaauaaaaaauaaaauaaaauaaaauuucaaaagcaacaacucaaaccagcccuacgucgugccucugaguucucaguaaauuccuucucucucuccucucagcaccauguauguguucggcggcuucaacagccuccuccucagugacgucuuggucuuuaccucggagcagugcgaugcacaccgcagugaagcugcuuguguggcagcaggaccugguauccggugucugugggacacacagucgucucgauguaccuccugggaguuggcaacugaagaacaagcagaaaaguuaaaaucagaguguuuuucuaaaagaaguauguuuuuucucuacuuagaauuuaaaaaucuaauuuuaucugaauugugaaggaaccuagucucuguacuuuccuguucaccuuacucucuaguuauuucuuaauaaaaaaauacacaagaucuuuggaugggaggaagcauguggcuccuggaagcuguuagcagguaauaaguugucuuugaauuacacaggcuuuguguaccaacuccuggucuggcugcaggugaucugaagccauagcacaaugaaauuuguuuucauuuugguuuuaugagacagggucuugcucuauagcucauacuggucaagcuccuugucagccuccuccuucagccucuugaaugcugggguuauaggcaugcaucacuggcccuacuugggaaauauuuugaugacagacaugcuauauauuucuuuguucaguuuaguagccacuagcaaucuguuauuauuagauauuugaaauguggcuauguaacuaaggggcuaacuguuuucuuuucuuuaguguauguagugaggcagauguaguagcacacgccugcaauccagacacucacgaggcugaggcaagaggcaguucuaggccagccugggcuguguaaugagaccuugucucaagagccaaaacaucaacaauaaaagaacaguauguggcuauuggcuguuauguugaugaugaaggucuaguguuaaggauaagagccucuaaugguaugaucacauauagcaaauugcucugguagacagcagagagcugcuguucuugaaaaguauuuccagcccccuuuagcuguauauagcaagcaguacagcauaacagacaaacuauggucccuucuucuagagccccuggcgugcucuuguuauuuuucucuccuuugcuacuugcuuagugguugcucugagcaccacuucaccaacucagcgaaguaacgugcaaaaauguuuggaaaauaagaaugccuccaagauauuuguccauaucaaucuuuaaaguaugaaacuacuuccuuaucuaguuguugcaguuacaugagaguuauauuaggcagagacuacuucuguuuuucugguauguguuaaauaaaguugugcagggacauaaagcuccugaggcugugcuguugauuagaauuuugguucauuuauggaaaacagcuuaccagaaccugguaggauucauaauucucccgaaacaguuagaauugguagaauaaccaaaauuuaaaguuaagcuuaaauauacagugcauuggaaauaauauuaucuucugagguucaguaugagcccauuaguuuaccucacuuucuggguagaccuaauccugucagaguaaacuuggcaagaaaagcagccuacaugaaaacugaucaggcagggaaguuucuguggccucucuuccugcuuguguaugucauauucaugaaaugauuuauagauggcaacauggcuuuuagcuucuuguuuggggauuuaaugagaauuauguuaggucuacaaagaguggaaguugugaaauccacagguuuggagucacaugaguauauagaguucgaguuagcaagugccuccugugggguugugggucacuggguauaccugcacccagguaggccuugcauuuguaacaaggacaaauguauuggucucucauauugcuuucuuaggcuucugcacagcuucugguguuaauucuguugcuaguugauguuugucgugggaagaaaagcauccauuacuucuuagaagcuauaaaauuaacagaccuuugcuuuucacuuucuggacacuaugggaggacaguuauaaaacaguguuucucggauugucugcuuauaucuguuuuauuuuaaccuaaacauggcacugcuuuuuuccuuucaguuugacuauacacuuugcuuccugacuauuguuaggagcuuuccuaccucagauuauacauaagagaggcugccgcauaguugauggguuugucuucucucuguagcccuugaccaugacagaugugaccagcacacagauuguuacagcugcacagccaauaccaaugacugccacuggugcaaugaucacugugucccugugaaccacagcugcacagaaggccaggucagaugcuguuuuucacggauuuuagggaauagaaaaaugcuagaugagugugaguguagggcaaauaaugaguagaguucuuuuuaaaaugggauaucgauuugaauucuacuguugcucagguuuucucuuaggaagggaugcuauauacauccugauuccaaggaucgcuccugcugcugaggucuuugugcaguguuuccgaaagcauguuuuacagaaugcccuuggcccauaucugacucagcaugacaucugggcuaaucauguaugauuuguuauaggugauaauaggcuaugaguaaggugauccagcuuuugcugucuuugauggcuuaugacauuuuuuucucaaaguuuaaugcauuucauaagaaauaagacuugagauugcuauggugggcacgggcugggaggagcucuggaaaagcagcagguucagcuuucacguuuuacagauaagcauuggcugaggcuugguggugccagugguuccguugggcugcuagcuugccagcuaaaagcauguuagugagaauacacacugugguauucacauugcagugcugcuuccuguucauucuaauucuaucauucauccaucuaccuaucucuaucuaucuaucuaucuaucuaucuaucuaccuaccuaccuaccuaccuaccuaccuaccuaccuaccuaccacuuaucuaauucuaucugucugucugucugucuuucugucuaucuauccuccaucuaauucuaucuaucuguccaccuaucuaucaucuaauuuuauacauccauccaucuauccaucuaucugucugucuaucauauauguaauucuaaccauucaucuaucuauccacuuaucugucugucaucuaauuccauccauuuauguaucuaucuauauaucuaauucuaucuauucaauucuuuucuuuuuuucuaucuuucuuucugcaguuaccauucucaguuaauucucacugaguuauuugugugaauaacaaaacacuucuccccuguguuccagaucuccauugccaaguaugagaguugccccaaggauaaccccauguacuacugcaauaagaaaaccagcugcaggagcugugcccuagaccagaacugccagugggagccccggaaucaagagugcaucgcccugccggguaggccuugcacagggauguccucuauaagguccaagcuugguccucccuccucagaucaagguggaccuaggaacaagauugcuuauucugucuauuuagcccucucacuauugggggggggggcgauauuuuguauguuuuuaacuuaaaugugguuuuuauguauguauuuacuagccuuugaaagaaagugaagugucagcucauguucuggagaauugggggguagcuaagauccauguuacaaacugugucccacuguccuuccuucugcugugaaggagaaccuggcacuagagcucuguggucucagcagcagucaggaaccugcaggaagcacuuacugacaguugugugagaagagauuucuguaccagcaucaucucccaugugaccuuccuucccgacuauuucagcagagguuguucaggguauuaacuuagguccugaggccagcuagcccugacuaaaucucuaugauguauuugcuugaucaggauauccaggaaggggagcuucugugcucuccaacaucgagguuugaggggaaguuggucugacucuuuugaaagcauuuuauuuaguuugcugaaugggcuuuaguuuagccaguguucuauugcugugaagagauaccauuuccaacguguaacuuuuaugaaaggaaacauuuaagugggggcuugcagucucagaagcuauuaucaucaugacagggagcauagaggcacaaaggcaggcauuagagugguagcugagagcuacauccucaucugugagcagaggcagacaaggugugaaaaagacagaaccuggccugggcuuuugagaccucaaagucuaccacccccagugagacacuuccuccaacagcuccugcaacaaagcuccaucccccgauccuucuccaguccugccacucccuggugaaugagcacucacauauaugagccuaugggggucauucuuacucaagccacuacaggcuuuguuuugugucucagacuuuaugucaauagaauaccuagacaccuuguuacaagacaggccuggaaagccugcagugcugacucccugccaguagcacauucugaggagcaagucccuuaagucgcuuaccugcucuuacauuacgccuuucccugaccauuuagugagcacuguugguguccccaaccugaaccugguucuggggaaacacuugcuuauucacuuccgugcuaauggccagggagcaagcaugcuuucaugcaacacugugaguucaguacaaccacaggaggagauugcagacuuccuucguguacuguaucacuaugagguuuuccaaaccagucucccuuucaccucauuuuuuggcaugccuuauguacuugcuuauacuuucuaucuuaugacaugaaaacagaguggcauuuggaggcuuaaauuuaucacauucccaauucaauuccauuuucaguuuacucuuucuguauauacaucagugugcagauaaauaucucuuugugugagcauuggaggccagagguuaaccucugguauauucuuccucuaucacucuucacaggguccuuugaugaauguggagcucacugauuacauagacuagcugacucaacccucaggccucauaacccugccucuagcccucagaugagauuacaagcaagcaaaacuacgccuggccuuuuaugugggugcuuggaauuugaacuggguacuuaugcuugacacaaguauuuuauccacugaaccaucucccaagccuccauuugcaguuuuuuaccucacccuuccaauauauauauuuauuuguaugcccuuuguucaagauuuuagucaccuuuuacauuuuucuucaaaaauaauugcaccaauuucuuaauaauggcacccaaaaguaggaacauuagccuagaguauacccugugagccaggaaaugugacuggugagacuuguaaaagggucuuuuuauucuggcccucagcggaggcucagcaguggagcaugcaugcuguuccucuggaggacccgagguccccaggggccaggucacaaccacuuguaacuuuaacucugaucuaaugcccucuauggcuuuugugcuauagucucuugcacuaacccacacucaaggcacacauacacacauucuuuaaaagauaaauuauuuuauuuucaaagguuuuuuucugcauauagaaguuaauaauuugucuguuaugcucaccagauccuaacaaagcaccugaaauucaaaucaggaugaguucagauguucaguauuuugaacuaguaaaccgaacugcauaauuccuaaaacuuuguuuucuuuccucuuccccuuuaaaaaagaaaauaucuguggcaauggcuggcauuugguuggaaacucgugucugaaaaucacuacugcuaaggagaauuaugacaaugcuaaauuguccuguaggaaccacaaugccuuuuuggcuucccucacaucccagaagaagguggaguuuguccuuaagcagcuucgauuaaugcaaucaucucaaaguauggugaguuaauguguucagaacuuugguuucuagggcacaacagcagcucuuauguagaaggccacaguuguauguuauuugccugguaagagaaagaauuacaauaaaugauuaauaauauacugugggccucuauuucagaggcucuucuuuugauaccuuucuucuugucuuaaaaaguucaguacuuugcauauuuuauuaguuguuauuauuaaguaaauuauaagguaugaacauauggaaugaaugguaauauguguacauauucuggugacaucagauuauuuuguacuugauuuauaucuagauucugcuugggaaaagggagaguaaaauguuaguuaccuaggugucauuaaagccaucuacagccccuggagguauuauuauagcacauaguguaaucgucaguaagaaauguaaaaucugcccagguuuuauagccuucuuccuaaggcuucugaacucagaaaguucucuuacucuagagccaaacucucaaauggcuuguaguuacuauauagucucauuugguauuuuucuugguaagucuaauucuaagacuugugauuugacugugaugcuucagucaauuagauauucacagagcagcuuuucugucuaugcuggcugugguacagagagaugugagggacauguuuuugucuagccaggagaagacagaaugcagcucagcaucucucauuuggcaccaccuucaugugaugggaugccgguaugguguggguccugguuguuaaaucucaggaaguccauauauccagaaaugaccucaacuauagguggauuucuggcaauuagguaaaagucagcauuccuugggcacuugggaaacugguuaccaucugcauaaaggagucauuucccuucuaucuggcagaagggacauauggcuaucuauugugccugucagcauggaagcacaugcuagucuccagguccccccaauaucacaaguaccuauagcagugaauuaguuaaacugauuuggcucccaaugggucaaguacagcugcaccugcccaagagcucuuuggguuugcaaaugagagacacauaguuaauuuuuauaugcuuugacuaguucaguugcuggacauuucuaauccucccugcaguagcauacauuaaccccuccaacuuuccugagucaacuuacuaacucaacauuucaucucugacaccccagaccuaauggcagaguggcccuuagagccacuuucccaauuuuuuuuuuaucagauauuuucuuuauuuucauuuccaauguccccuuuccuaguuucccuguccucucccccugcuccccaacccacccacucccucuuccuggccuuggcauuccccuauacuggggcauagagccuucacaggaccaaggaccucuccucccauugaugaccgacuaggccauccucugcugaauauacagcuagcaccacgagucccaccauguguuuucuuugauuggugguuuagucucagggagcucugggguacugguuaguucauauugguguucacuuucccaaauucuuacauggcugguuuaguucuuuccugcagcucuuaggucuaaucccuuuccuuccucugucauggugauugccuuccucuccuaucucaguuccuugccugcucaaucuaaaagucccaccuccaucuuucugcccagccacuggcuguaugcaguucuuuauuaucaguugaagccagcuaggggcagagaccuucaggucuguaagugcuuuggggagcagaauuaagacaaagcauuagaaccaauucccaacaaguaccugcuauacauuucaaaguccauauuagucuccugggucuucccuuccccagcuacuuguccuccuuguaauccaaaugacaagcuuuuucacacaucucuuuaucucacauuucccuagcccuggccauguccacuuguucuuuuacucucugcucugcucucuuuccaaugccucuggauauuuucucucucuuauucacaauaaaaaccaaaccaaaccaaacaaaaaaccuuacccuaauaauggaguggucacgccugagguuuccuuacugcucccccuugcacacgucuugugucugacacacuggcaggcuuuuauuagcagcaggcucuaggagcugagagaagcagcaggcaccucugaggugguaguuacuagagugauuagaacagacaguggagacguggcuggaaauauggacucugguguuuggagccaaguaugguaggcggcagaagccagcagaagcaugauccacaccuucaccagguugcuuccauugggaaaggcuggaccccuugggaaggggucccuuugugccuuccuagguguucggagccaggugugugagggauacaguaaagggacugacugcaugacugcuccauuagggugaaggguuuuguugugaauaggagaaacaaaaugugcagaggcaucugggagagagcagagcagagugaaaaggaagcaguguaggcauggucagggcuagggacagcggagacagcaagauagcgagugggugauaaggugagagagagugugugugugcggugcacacaucacgugcauuauaaggaggcugaguagcuagcuggggggagggaagggccagaaaacuagcaugcacucugaaacggguacuugugaugcugagggagcuugggggagaagggcaugccucaagaccagaagagggaguuggaguuacaguuuguaagaugccuaauuugaaugcugagauccaaacucugauccuuuggcugaacaucauaucugcugagccaucucuccagccccuagaaagguggugauggugguuguucuuguuuuguuuuauuuuguuuaaauggggagccagguacaguacaucaugccuuuaaucccagcaggagauucaggagauagagacagguagaucucuuugaguucaagggcaccuugguguguauaggaaauuccauccacccagggcuacagaaggguaccuugucuuuaaaaaaaaaaaaaagaaagaaagaaagaaaaagaaaaaaaaaagagaaugaaauuucagaguuaugcaagauaggagcucagugguagagugugugcccaggaagugcuggguuugacuccucagaacaacagcaggggcagaaacuagucuacagguucaugagugguguuuuguuuuguuuuacauaaaauguguugaauuagauaaguagauaaaaugugacucauacacagauaaauagauaaaaugugauacauguaccuguacauagaagauuaugaucucaccuuuaaaaaggaggaaauagagaguuuugguaguuacaccacaggaaaacuggaaaagaaaauguauauaugaggcugugccccauggcuaaaggaacauguuuuuaagucauuugaauucaccaaacaguuuuagguaaugauauaugguuuugcauacaaccaguauuuuauaaauauuagcaaggucacaucauuuaugaaccaacauuuaaacuaaauuuguaaaucaucauuucuuuauagcacuugucauagaacauaaguaguuuaaaaugugauuauugcuuugcucuugaugucugaaaaucuucauguauucucuucuuugagccauuuuuaugcuuugcaguacuggaugcauauugaagugaucacuuauuuuaaucuaccuugccugaguuuggggaauagaugguuuccacaugucuguggguuaugccuaagcuagugguuuuuauguuagagcuuguuuuggggaaggcacugguugcauucauagcuguguuucuuuugccuguaguccaagcucacucugacuccauggguuggucuucggaagaucaaugugucuuacuggugcugggaggauaugucuccauucacaaauaguuugcugcaguggaugccaucugagcccagugaugcuggcuucugugggaucuugucagagccuaguacucggggauuaaaggcugcaaccugcaucaacccucucaauggcagcgucugugaaaggccugguaaggacaugggugcauauagugcuccaggaggagccaagacagcaaaggaggcacagcugaaugagcgcugaggugaugaaguacuuauggcagcagggagaggagcaccaauuuaggcauauguauuucaaacagaacccgauuccagauagucuuucuuggccucugacugcuuuaagccauacugaaaaccaaaaauaaaauugcugaaagaacccaguuuauauugagcugcacuguuucguuggucucaaaguguugagaauuguucuagaagauuauuuccuugguguuggcagagaagugcuauggaggaaacaacaaccugaaaccaaagaaacauuuagaaaagcagcaagucaggacacuauucagacacugcugggguggggggagaggggcauggccaaagaagccgacagagccaacaccaggcuguggcaauguccugcgcugagguuaagguuagacuccaugaggccaggcccagaacagccauacacaaaugaggacuccaaaacaagaggugcaaguguaguggagacuccaucccugcagguccuguuucaggaaaugauuguacuuugccugaguaauacagccuaggagcuacuuucugauaggguuuuuuaaauacuuacaaagaauuauuuaucuuuaaucaugugguuuuguaugugugugcuugcacaugcagugcuugugagagagaguaugugugagagcaugcauguaugagagugugagaauauaugugagagagugugagugcaugugugcgugugugcaucuguguguacagguguguguacaugcauguguguauaagaguaugugagagugugggugugugugugagaguaugugagaauauauguaugagugugugugaguaugaguguaugugcgugccugcauguguguguguguguguguguguguguguguguguguguguguguagaaguggccuuggaaaacagaguugucagaucucuuagagauauaguugcaguugguugugagccaucucauaugagcgcuggaaguugaaauuggguucucuggaauccucuggguuccuuguugaagccugaauauuuugauaaauauuuaugucauuaucccucaaaauuguaaauguagaauuuaacaaacucaggucuugagucaucuuugucccaagguuuguuuguuugguuuuuuguucccccaccuuuucuucagugcuuuuaaaaaagagaguccauuuuuuccuaaauguuuaaauacaguugaggaauagaacaucugacuccaauuuccuggguuucccuccauguaguguagugcugaccugauuucagugugcauugaaaacuuugaucacuuggaaggcagcuaugcucaccacuauacuaccaaugucugcaauccuauaggagaaacaacaauaugaacuaacuaguaccccccagagcugugucucuaguugcauauguagcagaggauggccuagucagccaucauugggaggagaggcccuugguauugcgaagaucauaugccccaguacaggggaaugccaggaccaggaagcaagaguggguggguuggggagcagugcgggggggggggguauaggggguuuuggggauagcauuugaaauguaaaugaagaaaauaacuaauaaaaauugccuuaaaaaaaaacaaaaaagaaaaguuuuugaucuuagcugaccagugucucuuugggucuuaauuuccagcaaaccacagugccaagcagugccggacaccaugugcccugcggacagcguguggcgagugcacuagcagcagcucggagugcauguggugcaguaacaugaagcaguguguggacuccaaugccuacguggccuccuucccuuuuggccaguguauggaaugguauacgaugagcagcugcccacguaaguggaaggagcuuuugaacauuugcaggcaaguugggcuugacuuucugcucaaguccaugcagaagcuggucgggccggcccuuccagauuaacauguauguauagaaugcagcacaguguuccaugcaguaaaucaguuacaucaaggagaaggcacaggguacagaaauaccuuuucuucuucaggguaauauuauaauucaaucuguauaauguuucuacaucuuaaucuaccaguauguaaagugcuuucuaguagaggccuccccagcucccuuuuucauccaacauccugauauuaaaagguuggaaaagucccuguuauauauuauguaaaauguggggcccuuuaaauuauuucaguucaauaaucacuauaggguacuauuuuuaauucauggaaguuaaaucaucuguuaaaagaaaagguaauaacaguaaauucaaaucuugugauagugaauuacaaguuggauuguuuugccuuguuuuuuaauagcugaaaauugcucuggcuacuguaccugcagccauugcuuggagcagccaggcugugguugguguacugauccuagcaauacugggaaaggaaaauguauugagggcagcuauaaaggaccugugaagaugccgucacaggccucugcaggaaauguguauccacagccccuucugaacuccagcaugugucuagaggacagcagauacaacuggucuuucauucacuguccagguaagaugccuguguauccuaguucaaaucucguacauaaacuagacgcccagaucccuuggcucacuuguuuucuugacuguguuugaguucuuucuguguucugcaucaccuuguuggaucauagcuggcaaaggugcucuccuuucugugggcuuuuucuuuacuugauugauuguuucuuugguugcacagaagcuuuuuagcuuucugaagucccauuugccaguuguccuuaauuccugggcgaguagaagccucauaaaaaaaaguuccuuccuacacauguaucauguagggcacugccuauguuuuauuccagaaguuucagagguucggguuaugucuuugauccauuuaggguuacuuuuugugaaagguaauggacacaguucuguuucauucauuauucuacauguggacaucuacuuuucccagcaccaguuuugaagauguuaucuuuucugcagguuguuuguuugcuuguuuugucucuucagaaaaucccagauggcgguagcugugagugcuuaggcuuggccuaccuguuucauuauguuggcuugcaugucuguuuugugcagugccaccauauugucuuaauugcuauagcucugcaaucuaucuugacaucuguguuggcaauccugcaguuucgacccuucugcucagcagugcuuuggccaucuggggucuuuucuggguucauaaugaauuuuaggauuuuuuuuucuauuucugagaaaguauuguugauauuuugauugcgauugaauugaaucuguaaauugcuuuugguagaauggucauuuucacaauauuaauuuuacugauccaugaacauaggaugacuccagucucucaugucucccuauagcccugucuuaagagauuuggagucuucauuguagaaguccuucaccuccuugguuaaguuuauuucuagauauuguauugucuuugguauuauaaaugguaguauguccaugaucuuguucucaguguuuuuuuaguuuaguuuuuuuuaauuuauguguaugaguguuuguuuuauauauguguauaugugcauucauguccucugggcaucagauccccugggacuggauuuacagacagcuuugagcugccuguaggugcugagaauugaacccagguccucugcaagaacagccagugcuccuacuccccagccccagaaguacuaauuuuuaagagcugauuuucuaccuuugcugacauuguugauuguuucuagaaguuuagugauagaguuuuugagauuucuuauauaucuuauguuaucuguaaaaagggauaauuugacuccuuuuccuauuuauauccuuuuauuucuuucauuugccauauuguucuagcuagugcuucccgcucaguauugaaaagaguggugauugugaacagcuuuucuuauuucuuauuuuaaugggauuauucacccauuuaagauaauguugguuauggguuugucauacacagcccuucuuauauugagguauguuccuuccaguccuguucucucuaggacuuuuuuuuuuuuaaucaagaaagcauauuggguuuuuuguuguuguuauuuuguuuuguuuuucuagacaagguuucucugugcagcccuggcuguccuggaauucacucuguagaccaggcuggccuugaacucagaaauccaccugccucugccucccgagugcugggauuaaaggcgugcaccaccacugccuggcacauguugguuauuuugcaagcccuuucuacaucuacuaagaugagcaugugguuucaucuuugucuguuuauauugucuguuguauuuauugacuuauguguguugagccaaccugaaguucugggauaaaacccacaugcuuuggaugauuuuugugcuaugugcuuauauuguguuuguuagugcuuuauugaggacgucugcauccguguucaucugggguacugucuguaguuugcuuauuuuguugucuuuaccugcucugcauuuuagaguaauccuggauuuauagaaagcauuugggaguaguccuucuguuuauuaaaaaaaaaaauuaagaaugauugguuguugugugguggaauucugcugugaacccaucugguucuggacucuauucggaaggcuuuuuauuacuguuucagucuccuuguuugcagugaucuauuuagguugcuaaucuccuuaugauucauuuggaugaaucaagaaauuaauccaucucuuuagauuuccagcuuaauggaauaugaguuuuaaaguauuucuuuauagcauucuguauuuuuuggcaucuguuguaauauuucccuguucuuucuguuaaucucuuucuuucuugugguuaguugggcuaagaggcucuugguuuuuuuuuuuuuuuuuuuaucuuuuuaaaggaccagcucuuagauucauuaauucuuuguauuauuuuccuuguuucuuuuucacugauuucauuuuagauuuuauuauuucuugccaucuacugcguuuggguugguuuuaguuauuuuuccaagauuuucaguuucaucacuaagucauucauuugggcucuuuuggguuucuucacgagaacccacuugggacuguuaccuucccuuuuagaccugcuuuuaaugugccccagagauuuguuacauugucuuuucgauuuaacuuaguuucaggaauauuuugauuucuucuuugacccauucaucauucgguaaugaguuguuuaaucucuagugaguuuauacauuuauuagaauuuuguuuacugaugauuuuaagguguuuggcuuuguuuguuuguuuguuuguuuguuuuucgagacaggguuucucuguuguagcucuggcuuucucuauguagaacagucugaccucaaauucacagagauccaccugccucugccacugaaguucugggauuaaaggugugugccaccacuaccuggcugauuuuaaguuuuauuacauaauagacagguaggguacauagauuuucuacauuugugaagguuugcguuguuugucagcauguaauucugugugcugcugagggaauguauguuguuuugacaguuagguggaaaagucuguagacaucuguuagauccauuuuacauuucaagaagccauuuaauucugaaguuucucugcuuauuuuuucccaggugacuuaccuauuggagaaaauagggugcuaaaaucauuuacuauuauuguuuuuuuuuaagaagaaaauaauuaauuuaaaaaacccuggaaagaaagauaccaaaugugaaucauguuuccuggauagugggguuauauuugaucauuuauuuuuccucucaaauacugugaguuuuuacaaugaauaacaacauaaauauuuuuauguugcuguggacuuuaacuuugcuuugauaauauauuugguuuuuugagacuaauuucuuuuugauauuuuauuuucucauacuaguuuuuaguaaacuuugguuuuguuuuguuuguauuuuuuagacuggccaccaacuugcuauguugucaaggguggccuuaaaauccacacccaauacuuuguccucucuuucuuucuuucuuuuuuuuuuuuauuggaacaaaauuucuaggugggaaucucacuauguuacccaggcugaccugaaacuucugggcuuaagcaagaugggugcacaugaucagagacgcugcgcugcccgccucagccccugcuaguuggaacuauaggcacagacagcuguacuucacucauuucaaugauuuaacauuuagacuauaugcaaauaaauaugaaauguauucaccaaguucuccuaugggagaaacagagcccuuaagauuuuuuccuuucagcuugccagugcaacggacacagcaaaugcaucaaccagaguaucugugagaagugugaggaccugaccacgggcaagcacugcgagaccugcauaucuggcuucuauggugacccgacuaauggaggcaaaugucagcguaagucacacaggucaaguuagucacaagucagguacaauaguacaguaccugcaguugacuuaaauaucuuaaagggaaaaggccucuugguuugggauauugccuuucuuaauuauguuaaauuguuaaaaguuuaacugaggggcuagaaauguggcucaguuggcuaagaacacugacuguucuucuagaggaccgagguucaauucccagcacccacauggcagcucacaagugcuuguaacaccugggauccaacaaccucauacagacauacaugcaugcaaaacacuaauauacauaaaauaaauccauuaaaaaguguuugaugaugcuggaagaggaaaaaaggcucaacuuguggguuugggagcaguuaguuaaagcaacaaaccgacaguaaaggagcuaagcuuuuauuucuucagcagaggcauaaacaaggggccgaagucacugaggcaccagcugccuuuauuccauuucccucccauggaagcacaucagcucaagucaagcagagcagccugggaugggaggucaucucauuggagaaggaggcaggaggcauugugaggggagggaggacaaggcugggaaugggaaguccugagcucagaaucagaaugaggacaagaucuucaguuuccuucuuaauauaaagagguaucacagaggucucuauagaagucuacuggaagccucacacaggcacaaggguacauuugaaaaacugugacagccagggagaguccccuucugaaguguccuuccucagagacugcagcaccugacugugccccagucugcaagagguuuggggagagcaacugaccuccugaggaccccagaugaaucuuuaagauggccugcuuuugguuuugguugguugguuuuuagacagaucuaggagaguuggugaugagcuugaauucucuguccuccugccugaccuccaaaugcccagcuucacaugggcucccauuaaguugugaguuucggugucuggcuccugcucucacagccagugcaguacauugagcuccauagagauagcgccggggcaaaugagagcuggacgggcacugggugacucugugccuugugccggaaaaucaacuaaacaugggcaaaggagauccuaagaagccgagaggcaaaauguccucauaugcacucuuugugaaaaccugcugggaggagcacaagaagaagcacccggaugcuucugucaacuucucagaguucuccaagaagugcucagagagguggaagaccaugucugcuaaagaaaaggggaaauuugaagauauggcaaaggcugacaaggcucguuaugaaagagaaaugaaaaccuacauccccugcccccaaacaggagaccaaaacgaaguacuaggaccccaaugcacccaaugccuucuucggccuucuuguucuguucugaguaccuccccaaaaucaaaggugagcacccagcuuauccauuggugauguugcaaagaaacuaggagagaugugaacaacgcugcagcagaugacaagcaacccuaggagaagaaggcugccaagcugaaggaaaaguacgagaaggauauugcugccuacagagcuaaaggaaaaccugaugcagcaaaaaaaaaaaaaagggggguggccaaggcugaaaagagcaagaaaaagaaggaagaggaagaugggaggaguaugaggaagaggaggaagaagaaagaugaagaagaauaugaugaugaugaauaagcugguucuaguuuuuuucucaucuauaaagcauuuaaccccccuguauacaauucacuccuuuuaaagaaaaaaauugaaauguaagccuguguuagauuuguuuuuaaacuuuacagugucuuuuuuuuguauaauuaacauacugccgaauaugucuuuagauagcccuguucuggugguauuuucaauagccaguaaccuugccugguacagucuggggguuguaaauuggcauggaaauuuaaagcagguucuuguuggugcacagcauaaauuaguuauauauggggacaguaguuugguuuugguuuuauuuuuggguuuuuuuuuuucaucuucagucgccucugaugcagcuuauaugaauaugauuguuguucuguuaacugaauaccacucuguaauugaaaaaaaaaaaucguggcugucuugacauccugaauguuucuaaguaaauacaguuuuguuuuuauuaauauuguccuuucgacaggucugaaaguuuucuucuugagggaaagcagucuuuugcuuuugucccuuuugggucacauggguuacugcaguguguaucuuuucauauaguuagcuggaagaaagcuuuuguccacacacccugcauauugugguagggguaacacuuucauccauauucaaagaaucuccaaaaucgugaucaguuggauaagaaauauuauauaaccuacuuggcaaagcaaggugugaucaauucugucacaccaugggaucauuagaaucaagcaaucugaaaaucuguccuuaaaggacugauagaaaaguauuuucuaauccuuauacaaaggcucuccuuuaacugccacugcuauguaaugacaguuauguuuugcaguuucccuacuaaagaagaccugagaauguauccccaaaagcgugagccuaaacuacacaacugcaguacuauuuguugaccuuagucccagcgaaggcuaucacgagaaugcuagcuauaauauaaugccucugccccucuaucuaaauauggauugcucaggaaacuugacugcuuaaagguauuuuuuucauauuguuguuccuccuauaggguugcagaccccuuuagcuccuuggguacucucucuaucuaucuaucuaucuaucuaucuaucuaucuaucuaucuaucucuugucagauuucuuuuuucuuuucucuuucuuucuuucuuuuuuuaagauuuauuuauuauuauuucuaaguacacuguagcugucuucagaugcaccagaagagggugucagaucucauuacggaugguugugagccaccaugugguugcugggcuuugaacucaggaccuuaggaagagcagucggugcucuuaaccacugagccaucucuacaacccuuaaagguauuuuuaaguaguugagucagcuuuuaaaauuaugccagaagugucaaaaguucaaaaguuuaggaccauccucuauugaaguacagggucauccugggcuacaugagacccugccuuaaaaccaaaaucaaacaaacaacaggaaaaacaagaguuaagaaagagaaaaagaagcacuuggaaacaaagaucuguggaguauguauaggcuucucuacaacagguguauguaggaucuugauggcuuuugagucuauuacccucaaagagguacugagaaaccuaaaugugaucaccguggucucugaggggcaccuggcaggauuaugggagauaacuaaagcuugcuaaucacagaguuuagggagggaggacgucucuaaggcaaguuaacugucugguuugagaugcuuaggugaugucugaggaaguaauaaggccuguccauuuucauacacacucaggccuuaagucuggguaauggcuacuugaacauaaaauaguccucuaugaaaggaauaauaucucugugucagcagccuucacggcuaauguuaauugugcaggaacccugcuucucagucagacagaagcucaaucaggcaggggcaggacuucuuugccuuucccauguccuuguaauuucccuggcuuuucaucuugguucaaacauacuuaccuguuagguaauuauaagaacaccaaauauuacugaauaaaauguguuuaugacuuuguggugacugccauucaagaauuagaugccuuagccagcaaugauggcacacgccuuuaaucccagcacuugggaggcagagauaggcagauuucugaguuccaggacagccagggcuacacagagaaacccugucucgaaaaaacaaaacaaacaaacaaaaagauuucgaugucuuuaucacccaaaucaaguaacuuuccaaagucucacagugagauguagccuaguugggagccacaucuaauauaugcugaugaucuuaacaaguagccugcuugugucuucaggugaccaccccgguguccucagcuaccucuagaaagaucacacuuuccucuguggucucugcagggucccuguaugauucuggaaccuugcuguacuucucagaguccugauucauaaagcacugaguuuuugcuuguuuguuuguuuugauacuauugguaagaauauauauugaaccuugacaugccuuuuuaaaauaacauuauuuuuacaauaguacuuuagccuugauuauguuaacugcuuacuguuucagaugacauucguacaucuuuuaauccucaaaccaguccuaugagauggcuagcaucauugucacaucauuuaggcaaggaaacaggucuuggguuaagcuucaugcucagagcuccuuggaacacaguggacucaagugcaagcagacugacgcgacuggguuuuacuaauucaguaagccuguacucuauggaggaagaguuucugaccacuggaugcagucugaugaccucugacuguucuguuugaaagguuucuuucagugauuuuauuuuucuccauguggacuuuuuuuccagcuuuuaaaauauauauauauaucuuauucgcuucacauccugcucacuguccucccuccccugucauccccuccuacaauccuucauauccccccuuaccuucugagcagcugggagccccucuggguauccccacacucgggcacaucaagucugugaggcuggacgcaucuucccccacuguggccagacaaggcagcccaacuagaacauaucccacagacaggcaacagcuuuuaggauagccccugcuccaguuguucagcacccacaugaagaccaagcugcacaucugcuacauaugugcagggaggccuaaguucagcccauguauguucuuugguuugugguucagucucugagaaccccaaggauacaaguuaucugacucucuuaaucuuccuauagaguuccuaucuccucuggggcccacgauuggugucccuauugcuucacugggauuccugccuggcuacacccacuaugaccaaggcaagucuuagaaaagacaacauuuaacuggggcuggcuuacagguucagagguucaguucaguaucaucaaggcaggaacauggcaucauccaagcaggcauaguauagaaagagcugagaguucuacaacuuaucugaaggcugcuagcagaauaccgacuuccaggcagcuaggaugggggucuucagacccacacccacaguuggugucccuauugcuucacugggguuccugccuggcuacaggagguagccucuucagguuccauauccccaaugcugugagccacaguuaaggucacccacuauugauucuagggugucucccucaucccaggucucuuucauuguggagaugccccccacuuccccaccacugucaguugcagauuuccauucucgggaccaucuggccaugccuucuguuucuccucacaccugaucccgacacccccgcccauuccuucuccuaccuaguucccucccuccauaugcuuccuaugacuauuuuauucccccuucuaagugagauucaagcauccucacuugggccggccuucuuguuuuguuucuuugggacuguggaguguagcuuggguaucccauuuuuuuauggcuaauaucugcuuauaagugaguacauaccauucguguccuuuugggauugaguuaccucacucaggaugguauucuuaaguucuauucauuugccugcaaaauucaugauguuuuuguuuuuaguaacugaauaguaguccacuguauagauguaccacaguuucuuuauccauucuucaguugagugaaaucuagguuguuuccaguuucuggcuauuacaaauaaagcugcuaugaacauaguggagcauguguccuugugggaugguagagcaucuuuugggcauaugcccaggagugaugauauagcugagucuugaaguagaacuauucuuaguuuucuaaaaaaccacgaaauugauuuccaaaguaguuguacaaauuugcacucccucuaaccaagcaagugaaagaucuguaugacaagaacuacaagucccugaagaaauaaacugaagaagauaucaaaagauggaaagaucucccaugaucgugaauagguaggauuaacaaggugaaacuggacaucuuaccaaaagcaaucuagagauucagugcaauccccaucaaaauuccaacacaauuuuucuguagaccuugaaagagcaauucucaguuucauauaggaaaacauaaagcccaggagagccaaaacaguucugagccauaaacgaacuuguggaggaaucaccaucccugaccuuaaagccgcacuacagagcagucgugauuaaaacaacaacaaaggcugcgcacuuuugguacagaaacagacgugcugaccaauggcauccaauccaagauccagaaagaaacccacacacuauaguuuuuuuuuaaauauaaaguucuucagcuuaaugcuucucauuauucaugagagaagaagacucaacagcaaagaaggugaaacaagggugacaaguaccacagggcucucgagugucucuugugauggacuagggagcccgucaguucugaaugcucaggaaugugguucacaguguggccacaguacagaagauccccgagauaaggcagaagacagucaccacaggucaucuccacagggcaaggacucaguauauggcauauuacuaaugcucuuaaauauuuacugaacaaaggaacaaaaugcugagucugucacagagaugaaaauagccguugcuucaggggacagcagaagauagccuuuuuuucuccuugaaugguaguuaauuuaauguugccucuauauuauuagaaauaaauuacaagcugaaaaauaaugagucauacgcagugauuucucuugcuuuaggcugucuuuacuacaaacccauuucaggcuaaaugauuuugucuuaaucacagucuaugguaaucugucaagccaguugugaccugucuuccuuuccuucuucccagcaugcaagugcaaugggcacgcaucacugugcaacaccaacaccggcaagugcuucuguaccaccaaaggugucaagggggacgagugccagcugugaguaccacacacacucugugucuccagugggggacugggccuugcagcugccugggcccugucggccaccugcuugccugggcauuguugcccuucacucccagggucuuugaguggacuaguguggagguuuaccuuuuuuccuucagacagguuaucucaguuacuuuaauauugcucugauaaaacauaugaccaaggcaacuuacaaaauaaagccuuuaauugggcuuaugacuuaagagcauuggagucuacauugaguuccagggcaauagagcuacauaguaagacuguaucaaucaaucaauaaauaggacuacauaguaagacuguaucaaucaaucaguagaugaagagaaagaaagaaagaaagaaagaaagaaagaaagaaagaaagaaaggaaggaaggaaggaaggaaggaaggaaggaaggaaggggaagaacaaaacaagcuuagauaggaagaacaggauagaaugaaugacaaaugcuugaaaaauguuuuagcuguacuuuuagaagcauacucaauccacacagaaguaaaaauguuguuccuuaugaguaguaccuagcauuauuacauauguacuugccuguguccuugggcaaguauuuguuuauuuguuguuuuuauacuguugcugguguaaauuacugagcaguuagcagaaacauuccugcaaaugggauagucucucugaucugaauaaugauauaguuuauguaaaaggauuuacuugguuuaaaaauaaauauagagucugugcuuuaaaugucaauagaagauaauuucuuuuuucccuagaugugagguagaaaaucgauaccagggaaacccucucaaaggaacaugcuacuguaaguuuuuguaauuguuucuagagaguaauugaacaaaacgacauugcuuuuuuuuuuuaccauugucugagaaugauaaaugcuugggggaugaagcaaauacucauagccaugccccugacuuggugaacacuguucuaacugaggcauggucucugcuggucauccagagcaguuagcaggggugcuguccugccuguccuuguucagcucccgcggaggcgugcucauucaccauugcccaguguagcuuaucauguccaaucuucagacagccaggaaggaguuucuaagauagaggugcguuccaccauucucucugcagcugauuugugcucacaaacaaguaaauaaaacaccaaauuaauaccuuggugugaaagugaaucugguaagcuuacagcuuuaucauaaauauauuuuuugucuaugagaaucuacauaguagguucuagacuauagaacaauaaaaaaaggaauuaacauuuggcauaugcagcauaaugguauauauaaauuguagaagaaaauggaugguucuagaccugaaaagacaagaaaauugcuuguguguaaucugggcaggucuuaaguugugaccuucaacaucugcuucccaagcagcuggaaccaccaggccuacagaauucuuagcuaugauucuaaaggucauucaucaaauauaauguuaauguguauuuuauuaaaguuucaaacuucuaucuuuaauaaucugcaaauguagcucaguagaggagagcucucgcuguaagguccuguguucuauccccagcacaacaaaacaagacauuuaagaaaaaauuaaaacaaguuggcuguauugucucaguaucucauccuugagauagugaggcaggaggacuuuuaguuugaggccuauguggguuauguagugugaaaccuuucucaaauaauauuuacacuuuuuucuuuaaaaaacaacuuuuuucuuaauuuauguguuuugcaacauguaagucugugcaaugugaacauaucuguugccuuugaaugccagagaggguuucaguuuuccuggaucuggaguuaccaaggguugugagcugccauagugggugcugguaaugaacugaguccucuggaagagcagccagugcucuuaacugcugagccaucucugcugcuagguacucccccuuccccccuuaaauuuaagacaaaggucucacuguguagccucagauggucuagaacucaauuuguagaaugguugaccuuugaacucacaaaacucugccugcuucugccuccugaguguugagauuaaaguuguaugucaccacaccugccccuaugauuucuauauuuaauaaagaucaugacuaggauauagagaacacuuuuagaacugaagaagaagacaguuacaguuaaaagcaaaacaaaaacaaaaacaaaacaaaacccagaaaaaaaaagaaugaaaacuagcacugaagaaaaaauaaauuuuaaaaauaggcaaagagucacuauuauauugugauggauguguuauauguuuaaaaccacaagugagauacaggccugaaaugacuuuaaucgaagcuacaccagccuggggugguaguucaguugguaaaguucuugcuaugcaagcacaagaagcuggguuugaugcccaggacccaugcugaaacccaggagugcugcugagugcuucagcucugggguggcagggcucacuggcaggaagccuaggcuaagagagacucugucucgaaaaacaaggccgauggcaccugaugaacggcaucucagcaugaccuuugcucggcauauaauguguacacacaaauucauaguuuaguagaagacaaguaugaucugcuuuucaugaagucuguuguaauacgccuucuuuaguuaaccauaguugcuuaaaaaaagaaaaaaaucgaccucacuggacagaaaauggauagaguguucuaauagccaauucaauucaucaucauuaucaaaaccuauaacuuagggggcuggagagauggcucagcggguaagagcacugacuccucuucugaagguccugaguucaaaucccagcaaccagaugguggcucacaaccauccauaaagagaucugaugcccucuucuggagugucugaagacagcuacaguguacuuacauaaaauaaauaaauaaaucuuuaaaaaaaaacaccuauaacuuaaacuuaucaauaacuuuaacuuuccuaccccaugcuuccuaguuacccauucugcuuucuguuuguaugauccuggguauggcaucuuaauggaaccacaguguuugacuuuguaucuacuuaauauuaggcaugaugccucugacucucaucccugauauagcacaguucaaaauugccuuucuuuggugcuguacauauagcugagcguuugagugcuucccugcaugcacagguuucugaauucaauccccagcacaaaaaaugauaaaaagaaagcaaaaaggcuuauuuuuacagcuggacagaucauccugcauugugccugucauguuuugcuuguuucuucugucaguggacacuguguuacuucuaccuuuugguuguugucaggaauauuguaaacaugagugaauauacacccagaaguacaacuggaugugguaauucuaugaguguuuuguuuuuugagggaugguuauuauuguuuccauacaauaaauuacauuuccuuacaguucauuacauuuccaaaagccaugcauagcauuucuguuguucuacauucuuauugacaccaguuuucaauuuacauuuauuuugugaguuuuuuaauugguaaccaucauaauggacauaaaaaauagcucauuguaguuuugguauuuguauuucaguaaugcuuggugugauuaucuuuuuauauucuuauuaaccauuaguguguaucuuuuuuuggaaaaacaccucuucaaggguuuuacuauguagcucuggcuggccuggaacuugugcagaccaggcuugccuccgguucccacugucuuagguagguuuccauugcugugaagaggcaccaugaccagagcaacucuuacgaaggacauuuaauuggggcuggcuuacaguuucagagguuuaauccauuaucaucauggcaggaagcauggcagcauccaggcagauguggugcuggaggagccgagagaguucuauaucuugauucaaaaauagccaggaaaagacugucuacagcaggcaaccaggaggagacugucuuccauauugggcagaacuugagcacuaggaguguuccaaagccaccuacacagugacacaguacauccaaaaaggccacaccuauuccaacaaggccacaccuccuaauaguucuacuucucaugggccaagcauacucaaaccacuacauccaccuacuucugucucccgaaugcugggauuaaaggcauauguugccauuacccaauuuuaaaccagauuauuauuguuuuuuuguacaacagacuuuuaagguuaaaguuugcagcaauaggcauucuuugaagcuguaucacacugauauaugucuguuguuuucuuccuuccuagauuaaaauaguacaguauauucaaguuucaauugucccuuuccauaagaaguccugguuucuguuccauuauuaguuuauaucuuaguguucuuaaguaaaaauacucaguauuuauagaugaguuagauuagagccaaaccccaaucaggguauugguaaugaagguuugcuggauaauucaaaggauacugcaaagaucugguuucuaauggaaagaacauguaaguuggccauuaguggaccacacaucuguauuucuuauucuuuggaaccuugggcaggauagacagaugagcuaagauuccuucauagcuauugaauuugugagaaaaacaaauuguguuuccagaaaccugcuuuaguuuguaucaacacuuacuuucuuucuguguguggugugugugaugugccuguaccauuuucaaguuuuucuuccuucuuuccauagauacccuucucauugacuaucaguucaccuuuagccugucccaggaagacgaccgcuacuacacagccaucaacuuuguggcuacuccugaugaaguaagcuuuucuuuuaagcugucuuauuuuguguuaaauuuuguauagguuuuuuucuuggucauccuggacaaaaguacuacauagaagcagacaguaucagggugggaauauaaaaggcaaccaguuuuuaaguauuuuuuuauuuacuuguugacaguuuuauaugauuauauaaugugcuugaugauauucaaccugugaccuuuugucucccucauacuuaguuccuucucuccccaccaagucaccuucacucccucucgugugugugugugugugugugugugugugugugugugugugagagagagagagagagagagagagagagagagagagagagagaaagacagacagacagauagacagagagacagagauugauugauugauugauugauugauugauugauuuaccuaccuaguuuaccagcugacugcaggagcaugcugggugggaaguucuuacuggagcauagacacauuacagugacuacaccacugaagaaagugacucccucucagguagucuucacugccacuagguccucagggaucaagagaauguuuggagucuacauuuuaucuuuuuuccacucagaaggcaaacauuacugaauguuuuuaaguaguagaauaauguucaugauagucuguuuaauauuaaauuaagaauuuguuccuaauuauaaaauuuuuagaagauagacaagaagacaaaauuuuugaguuaacaguuugaaagguuuauuuuuauuuuauuuuauauguaugaauauuuuagcuucuuguaucccugugcaucaugugugugcagugccuguggaggccagaaauagauauuggaucccuggaacuagagugauagaucauugugagccaucauaugggugcuagaaccaacccaggguccucugcaagagcagugagugcucuuaacugcuaggccauuucuuuagccccuaaaugugaacaacucuuuaaauaaauguaagugaucuuaaauacucuggagaaaaaucuguagcuauaccuuacuuuuuaaaaauuauuuuguuuuauauuaugaguguuuugccuacauauaugugugucugaugccugcagaggucagaagaggguguuggauccccuagaacugggguuacagauggcugugagcagcuauguggugccugggaguugaacccugguucucuguuagggcaacaacugcuuuuaaccaucaacccaucucuuuggcacaugggugcauuguugguuuggcugcuugaguugugugugaggggugugugugcauacauauguggguccaugcuuauccaguggaggccagaggucagagucauguaucucucuguuacuuucuaccuuauguuuuggaagcaagauuagauagaccccugggaccuuccugucuucuccucagcacuaggacuacaaguccacaccugacuuuuuacauggggcuucagaucuaacucagucccaacacuuguuucauuuccuuagcaccuuggcuagauucuuaggauuuuagaaggagcuuauagcaaaauaccacaagugaaauuuacuacugccuuagucauaagcaaauauugaaggcucagucuuuaaggguauaauugauaguguucuuuuuuuuuuuaaguaaacaaauagccugucaugguaacuaucgcuguagucccauuacuugugagagaugucagcucaaggccagccuccgcuacauaaguaagggaagaccagccugagcuauaugggacucuaucaaaacaaauaaacauuguagaauuuuuguaauacuuauuagaagguagcugaugaucaugagagucuuuagacauuucuucauuccacuguuuuguguguguguguuucaugacagauuucuuacuagauuuaucucuuuguguguguguguguguguguguguuuuacaaaaugacaaagauuuuaguccuucucguggaaaguaguugcuaguggucagcagauacuugcuaguauaaauaaaugagcauagaucugcgcuugcaaaggaagacaaagggaaaaaagguuuucuugaacauaauuccuacuuugugaaagaaacuucucauuuggaaauuacauuuugaaaauagguauugugaauguuuccauugugguuugugguauaacuaucaaauaacacuuuuuuaaaaagaaaaaucuuaauuuucuaagauuuuuaaauacccuuuuaaaaugagcauuuccagcaugguuugauuaauuuguaaaauguaagaauauaguaucuaaggcuacagaaaugacucagugguuaagagcacuggcugcuuuacagaggacccagguuccauccccagcacccucaugacaguucacagccaucuguauuucuaguuccagggcaucugaugcccuucucugauuuucuccaguacuagugacacacagcauacauuugaacaaaaccacugauacacauaaaauaaauuguuuucaagaaacaauauagcaucuaauuagcuuacaaaacuaauuauuuguuucuguacuaauuacguuucuauuggcaugacuaaggcaacuuauaagagaaagcauuuaauuugggguucacacuucuagugccuuagauucuaugagcaucaugguagggaguguggcaguaggcaggcaggcauggugcuggagcagaggcugagagcucacauuugauuuucuacuagaagacacagagagagcuaacuggaaaaggcaugggcuuuucaaaccucaaagccccccucuaggaacacacaccuccaccaaggccauaccuccuaaucaaacaguccuaccaacugaggacuaaccauucagagauagaugagucuauggaggccauugucauccaaaccaccacaggccccaagaaagauuuguuagugaaauuucagugaaaacuaaaacagcauuagaauuuaccuggcauagccagcaaugaucucuucuguucagugccacagauuucuuugaguuaaaacucaguuguuaaaaccaaaaaucaaaauguaauuggcacuuuaaauugcuauaaggggaaacaagguuuucaaagccaugaaaccauauucagaauaauuuuagcgagagaaauauuuuuucuuuuuuuugucuuuucuuuuuuuucuuugagagaaauauuuuuauuauuuuauauuauuuuaauuacauauuuaauuauuaaccauuucugacagagggcaaaaggugaggaucuucauggaacuaauaucugauaaagcaccaaauucuucccaacucugggaugcaaaugacaguucaacuucaguuuauugcuuguauugaagaaaauugacaagaaaugucaugucuuaacauaagcauggauuucuuuuaagauguagaauagucuauaauuaauguuuuugagacuaguaagaccugauuauuguuguaucuuaaaaucuagaagguacuaacaauuuucuaauguguauuuuuuuuuucaucagcaaaacagggauuuggacauguucaucaaugccuccaaaaacuucaaccucaacaucaccugggccaccagcuucccagguacagacacaccuagagagauggauuggcaaguuuaguguaggaguuggggaaggaggcucugaaggcuggugagugaguucagagcccaccucugccucuuaguagccauggcaccuugaacaagccaugcuugaacaagcauguacaauucccucucuaccuuaggcuacucagagugaggagucacagcucuugccuccagcguugcugguucagguugguuggauggcugcucccugcuuugccaccaccuuccagcacuaugacuaucucuauguuugugcuucacaggggaaaaacuaaagugacucauaguuuuaagaaaugaaaacucuuuaagggaagggggauaacucuaauauguagagguauucauacuuugggauaacuccuaaaaguacagcuuuuccauucuuguuuaucuuauagugacuauaaaauucugauggcccuaauguagcaguuacuauaaauaaccacuccauaacuugauagcccugaagauagaccuagguuugaauuuaccugcacgguguugaacaaguuacugaagcuuucuuuucuuuguuuuuuaaguuuguuuuauuuuauguguguguuugccuuugccuguauguguauaaguguaccauguaugugcagugcuugagaaggucagaagaggacaucagcuccccacccucaacgaguuacagacaauuaugaacuacuauaucugugcuggcaacagaacccaggucuucugaaagagcaaccagugcucuuaacugcugagccaucucucucuagcccccaaguuaccuaaacuuucugauccaguuuccuucuuuauaaaaugauacagugaaaauagcuuugcuauguacagagauauuccaacuuuuuaauauuacaacaugacaucuacaaauauguuagcccucauucauaaucuugccugaauuguagaguguugcaaggaauaaaugaaauaaaggagguacuuauuauagaguuugagguuugccuucaugcauaaagagaagcuuuuuugagucuguacuacucauguucuuagccaauggaguauauaaaauaugguagaaccauuuagaaauggagucucacuggguacaggccugaaugcagugguagcagguagcagaaagaaggccugaguggcugcuugagcaccuucuccaucaagacuugaggaccuuucugcuuaggaagugaugagcgaguaagugucccugaacaggagccuugagcauauucuacagugugaagcagaaauacaaaggaguugagguaucaugugcaaaaugaaugcagugucuguuuuauauguaugauuguuuuacauacauguaugucugugcaucgcuuauauaucuggagccucugagacagauuacuuaaucuauugggacuugaguuuuuccaaucuguagauggagauaggaagguguuguguggguuagagacugaagcucauaaggcuauauucuuuugacacuguaagugcucaauaaacuuuuacccucauuacuagugcgcaaagauucuuucugauuggcauacccgccucccaagucuuuauuuuuauucuugcuucuuucuagccggaacccagacuggagaagaggugccuguuguuucaaaaaccaacaucaaggaauacaaagauagcuucucuaaugagaaauuugauuuucgcaaccauccaaacaucacuuucuuuguuuaugucaguaauuucacuuggcccaucaaaauucagguaagaacugcuuuuuaacuucauucccguaaagauggugacaucucuuuaguggagacuaacuucacucauuuggaaucuguggugacugaaagauaguguugcuuugccuuugagggaucuuugccauagacugaguagcaggugagugcuguucuuagguuggagagauguucagugaguggagugcuugcuacacaagccugaggacaugcaguucaucugcagccucucauacaaagcgggacacgcagggugugccugucaccucagcacuggacaugcagugugugccugucaccccagcacaggacacgcagggugugccugucaccucagcacuggacaugcagugugugccugucaccccagcacaggacacgcagugugugccugucaccccagcacuggacacgcagugugugccugucaccccagcacugggaagcaggggacagaaagaucuugcuugcuggccagccacucaaagcuggaucugugaguucuagauucaguuagagacccugucucaaguaaaauaagguagagaggaauugaggaagacaccugauuaccucuggcuucuguaugcaugugcacauauauauaccuucacacauauacacacucagagaaaaaauucugagagugucauaucacuugugaagaaaguuuuaaagcacuuuuaaaagcaagaugaaagcuaugcaagguaugcaagguaguauacuuuuguaaucccaggauguggaagaccaaugcaggaggaucacccugaguuugaggccauaggaagacccugccucaaaaggagggaaggagggagggagggagagagagaaagagaaagagaaagagagagagaaagagaaagagaaaaagaaagaaagaaagaaagaaggaaggaaggagaaagaaaaucaaauugauuggcauauaguuauguguuuauuuuuugaguaauugcuauguaaaagccuuuagaaauacacaguuuuaauuauggaauugaguauaaauaaaacaaguacauguuuguaaccaauaaaguauaaaaaugacacauaagaugucaaagugguaugauggcuauaauguggaguccauagaggaagcaguaggcaguaugagguacuguguaaaaacacauagcuuuacuauugcacagacaaguguggauucuuguucugugugugguucauggaggcucuccaguuugcagauucucugugcauguguccugaaggauuggucuuccugcuaugaccucugguguuauuagccugaacugaguccuaaggagacagguaguggaaauguuuguauugcaaagacaguauggguaguuguuuuuagaaacaggaguucaacagaauugauagaacuugugaucaagaagcuaacagcuggacugggauguagcucaguugaaagaacgcuugucuaacauuaagaagcccuggguaccaucacuaccacagcauaaacugagaguagugacagacucaugugucccagcacugggaagguagagguaggaggaucagaggcugcccagggagguugagagugacuuacgcuaggagauagaucuaaaaaugaaaaggaaaaagaacuugguagcugcuagagcuaccaugaagagaguggagcuuaaggauucagcugaagaauguaaacugccuucugaugacaacugagagucgcugaguuauuuaaagucaggaagugaacaaagaucaguguuucagaaagaccucuguggcaacaguauugacuagaaguagccccuccuaugucagguacugguuuagacuguauuuggaaguguccucuuucuugauggcccucagacaccuuucauggccacuccucugcauuuguaccccauagccacacacuugaugguucuuuauuacauaaauagcuccuuauaggcaaugauagauuuuauauuuuugauaauuuuaagauaaacucuaugucauugcauagaauuuaguaguuguagguacucaguaaauguauauaggaugaauacaaaagcuuuaggguaacaguauuuuguucuucuucccccgcauuuuuaacuaucucauaguagcacagacuaacccauaacugaccaugaagccaaggaugaccuugaacuccuguaccuucuaccucuuccccgaaagugcugaaguuacuggcaugugcugcucacccaacuaauagcaaguuuuucuuauaaaggugcugaugcccuuucccuguuuguguuaauugcugacacuuaaaagcucuuuaucccaacccacaguguuaaagaguuuaguuaaauuuuguggaaauuuugucccaaaugaagugguugauggcaggccugguggcuccuuccuauaauuccaacacucaggagacagagucaggacgauggccaagaauucaaggccuugggccuacagaguagaagagagaagaaugaggauucgaacaccugauuaaauagauaccauuuccugcuaccaaccugugccuuagcuacucuucuauugccgugacaaaacaucauacccaaggcagcuuauaaaagaaagcauuuauuaggacucacaguuucaaggguuauacuccaaaaccaucauggccgggagcaggcagcaggcaggaacaucugcugugaggaagagcugagagcucacuucuuuauccacaaauaggaggcagagagaaagcuaacuaggaauagaaugagcuuugcagaccucaaagcccaccuccuucccaaacauuuccaccaauugggaacuaaguauucuaaucugugagccucuggaggcccauucuuauuuaaacuaccacacuuuauaaguuaauacuacaugugaugaggaaacugguaugggaauucugaaaaguaguucacaggagugggaggggcugaacgugaguagaugcuagcaugugugucaggagugaaguguucagagcauugccugguuugacuucucuccagagcugaggugaacaugcuuugugccaauacaaacccguauuaaagcggugguaguuacugaaaaucagugcagggcuguggucucaacacaauguuugaaaaagaaaacagggcauccacaucaggcaguguacagcugcuuauaauuccaguccucuggccucugcucacaugcacauacccccccauacauacacacaugauuaaacauaaugaaaaauuaaaaauuaaugcuauaaaaauggaaagagccgggcgugguggugcaugccuuuaaucccagcacuugggaggcagaggcaggcggauuucugaguucgaggccagccugaucuacagagugaguuccaguacagcuagggcuacacagagaaacccugucucgaaaaacaaaaacaaaaacaaaaacaaaaaaaaaaguggaaagaaagguucacuguuucacaggaaaacucugagaggugauaauccaaucccaguuuaaaauauacuccauagugcacacagccucucccauccuuggcaacugaggccugugagaagacucaguccucuccuggcuuccaaccuuacaguguucaaaacucuucugcaagauccacaugguccuaccaagacccugaaggucaggcaugcugauuaggcugucucugggccugaagugaaagguaaacacuuccgagaucuccaaagccuugggaagauucugaaauguauggguguugguucagguagacucucagccuuggugaagcugcccccggagcuguaggguuaucugcagaaagucagccaggugcacuuacccuggaauccucucccauucacagacaccucccugaggcuuuguggcuucaccucacugugcagcuagcuccuguuuuacaugcuuauauaaugaauggucuugguaaagaagaugauaaaggcaagcuagaggccuuuuuuuuccccucuucaaauuuugauuggccuuucccuacuguuacacugucuacucaagguuuugagcauuuacuuuguguacauaguaaaagcaaaguacauauuuuuaaguagaaaagaaagcaucuguggucuuugauauaggugcuuuucuuuauuuuaauaguaauacuuauuccaugcuuguuaagaaauucauucacagcguguuuucauagagacuuucucuauagagauauauagaaaucuagacaugaggacagcccacuaacccacucuucagacacuagcugcuucucuuagagcccugggcucucacccuuuggaggacagccauccucacucauaugugacaagcuuagacacagaauaaucacagagacuccagccucccccacaaacccacaaugccaauaucccauauucccaggaacuuuuaauaagccauccacucuaauacuccaucucuuaucucaggcauaggcccugguuuugguuugcuucagaguacugccuuuucucuaccacgcccuucccacucuuugcugacccuccagagaugucauuuccaaaugaaggggguuuuugguucuguggguguuuuguuuuucagugcaguuccuuaacugcuauucaggggacggagcaggcaaaccagaucucuaacuucugaggccugugaagagaagcaucagaaccucccaggggagcuguaggagcaggagucaggccuagauaugacugugagagaguggggaccauuaccagugucuuacaaaugaggggaaggacuaccgugcugggcccugaaagauaaggaggaccaggcuucaggaagguaggacacauucugcugacugucugggauugaggacaguaacacaacuacuuagacauacuuugaaugaaggacagacuuagugcuucagaacuguaaauccauuauaucuuucccaagucuuaggcuagccaaguuucucaacauuuaucuaccucaucccaaaggguucccaggacaaauauuucuuacucaaacauuugaugggaguuggaaucagguugaggaaaugcagggguguagauuuuagauuucugggaauauguauagauagcuaccuucuguuggauagaaaaugagauuguaaguuuuucaguguuuuuuuacacgaguuugugugcccauguaugcacauguggaggccacgggucuaccuuaggugucuucuucaggaaccagccaucuuauuuuuaagaugaucucucuccagaccucagggcuaucaacacaccucagggauccauccuccugacuguaugucccuagcauuuggguuacuguaccaccaugcucaggucuuuguguagguccuggggaucacaguuagguucucauacugcagggcaagcacuuuguaaacaacuaucuccccugcauauggaaguauuaccacuaaauuacaacaagauuuucuucuauuaaaauuauauuuuagaagcuggauauaguaaugcguuggggcaaaaggagggagggaaaugaagaggauaggaagagggggagggagaagggaaagaguggaggcgggaucagaaguccaauguuauucaagggcagccugaccuagauaaaucccuauuaaaaaguuuucaguauagaaacuucucaucaccuucauuaucagaaaagccccuaaauucagaacacuuuuuaaucuuaauuaguugacaauuucauaaauguauuauuuauauauaugaauaacauuuuccuccuaccuuuuuuucccuuccccucugaugauucccauccucccaaccaagccccccuucugcauuuguuuguugcuuuaaugacccacugaguuccauugggcucacuuccaugagugugacuagaagagcuauuuaucagaaugugggcaacuuaccaguagugacacugaugaagaaaguguuucccucuuacccaguaaccauuaauggccaggagcuccugggaggggugggcgccuuaugagccccuucuccaaaaugcuuucaaacugugaccagcuauauuuaauguuuuuauuaugccuguguauccaugugggacaagaaagcuugagaguaucauagcaugcauguggaggucaaagaacaacuguguaaagucagaucucacuucccaccuucacaugggcucuggcacugaacucaugucagugaccugagaggcacuuuauccucuaacacgcacccugugcccagccuaaaauuugaccuuugcaagguuuaguguguguuaucugacugucugaguaaggaugacaaaaugaaaccaaacuuaugggauaaagcuuggugguuguaucaguacauuuuuauuguugugauaaaacauuaugaccaagacagcuuauagaagaguuuauuuggguguauaguuccagagagguaagagucuguccugacaaggaagcuguggcagcaaguggcagguauggcuacaggagcaggaagcagaaagagcaaacuagaaacaguugagguuuuuuaauaggaaagcccacuccccuaaugauguccuuccccuagcagaccacaaguccuaacccucccuacacagcaccaccagcuggggaguucaaaugucugggacugcaggggacaucucauucagaccaccucagugggagaaugcuugccuucauaguaugugcaaggcccuagguucaauucuagccaagaaaagagaacaugaggaaagaaaagaaggugggagagaguagagaaagaagagaagaagaggaaaaaggaagggaagggggagacagaggaaagcagggaagcagaggagaggagaagagaaagaaaagauuaaccagccugguuuuuaauagcaccccucccacucucaguaguucccaauuugagcauuaaguucaagacugauagauauuucugggugggugaccaguguggucauaaacauggugacuuuugcucuccguacaacuugugauuaugaacuuguuagaugaucagcuucaacaggagagggccuccuuuagucucaggugcccccuccagccacccugggacucgcagccucucugugaugagacacaggacauuaacugguaugguucugcuuugccaaaacgucaguccaugguugaacucuccacaaugagaaagaagcuuugagaaucauuacauggcaucaggcaagccaggacugauggagccugagaaagggccaggagcauccgcagguuuuggcacccaguacuaacuaguaaaagcaccucauagguuucuuuaaaaugcaaacacuaaggaaaaucuaacuuuuuuuuauuuauuaaggccauucauuuuauuuuauaaguauuuugccuguauacauauguaccacaugcauacaaggucaaaagauaguauugggucuucgaacuggagguacagaugauugugagcugccauguggauccucgaaauugaaccuaggucgucuacaagagcaggaagugcucuuaacuucugagccaucucuccagcuccagaaaagcuacucauaaaagucaaaucuaagccaugugucuggugauguacaccuuuaauuguagcacauggaaggcggaaguaggcggauuguuauucauccaaggccagucuucucuuaacagugacaaaaacaaaaccaaacccgaaaccuguuacuuugcacuuuagaguauaagugauagagaaaagacacagaaauuuuagaaucuauaccuuaaaauaccuuauggcuuauaugauacuguugggaccauauuuacuuauggaaugcaaaaaaaaaaaaaaaaaaaaaagauggggggggagcugaaggucuccuuucuauucuguuguaaaucuagcuauaaaaagaguaagaggcaugagugugucucagugguagagcaccugcuuagcuugugugggauugaaugauccucagcaccacagaagaaggguggggcaauaaauuuaggaaaauaagaugcuaaucauugacuuucuugauuuuuuuaaaaaaaguuauuauuuuauguuuauuguauauguuuauauuuucuauguguguuuuugaugugugcuggagggaugggggccacuugcugaacuucccaauuguuaucauaacuaccaucuuuagugaaacaguuaccaucuacuuaguaauuguuucauucgaauagauacugaacacucuuaaucugaaacuaaugcucagaaaguuccacuuugccaagcaagcaggauaauguaagccuauaauuuuagcacugggagggugaggcagaauugugagcucaagggcacccugagcuuuugagauccugucucaaauaaaauuaaauuauauagauaucagauuuucagaauagguguguucagcugcugaauaaaucuaagcaaauauccccaaagaacccugaaaucugaaacguauuaguucuaagcccuauguuguguguguguguguguguguguguguguguguguguguguguguguguguguaagauagauucucacuauguaacccuagcuugccuggaucuugcuauauagagagaccaggcauaugcuaucgugccugggagucccaaacguuuuagaugaaagauuucaguuguaccauuaucuuccuaaugagggcucuggucuagugaggcaggugacauuaggccaguaguaaguauuaggaauuggugaugacggucaauucugagacacacaguagauacaucuaaucuaccaauacaaccaaugauuuagaaagaauuaggccauaguuaaauuugcaguguuuuucuucuccacaaaauaauguuacuucuuucaguucuuaguucaaauacaguaggaauuuuuuauauucuuggugcuaaacacuauuauuuuauaguaaaguuaguaagauagaaaugacgcccuguggguugucuggucguagucuguagcugaggccauuuugcugagaagcagcguaggcugucacuggcuuugucacccauauuuucuguauuuuugcugcagauugccuucucccagcacagcaacuucauggaccugguacaguucuucgugacuuucuucagguaauuucucuaugcuaauuguacacauuccaucgagacagucccuuaacugcagcuugcuuuguauaucccuacaaagcugcuuuucacucacagugauguaaauuuagucugaugugauaaaacucuccguuuguaugauucggcucuuugcauggggagagguuugggcucaagcaguuauuaauaauauagcuacugcugugagcuacaugucuuaaucugucuuaaucaagauaugacugugauuuuccauagggaaagguaagguuuacuugcaaacuccugggguucuccuuuuuuuauaguuuucuuauuaguaggguuuuuuuuuuuuuugagaauacuaugcagaaaugauugaaaagaacaaauuagucauugcauauugguaagagaagcagcaagagccaccucaccucccucugcucuccccaaauagaaacugcucugcugugcugcuucucuaccuucacaccaaugcucggccugccaacucaguuaucuuuccuuuccuuuuaagauagggucucuccuuauaguaguuaugacuguccuggaauucuaaauagaagagguuggcuuucaaaucacagauccuccugccucugccuucugaguacuggaaguaugguguaugccaccgugccacagcuaacucaguuauuuuuugguguucuauaacugccuuacauacauacagaccagguacacacaaaauuccuuuccauuaauuuaauaguuauaucacaaugcauugaccaacuaaaaaauccuaaauugacuuaugauucuacuugcucauguuuuaaaggaaagguuacucuuugcuuaucuuaaauguaauauuuuuccuuugcaguugcuguuuaaauuuucccuauaagucgaccccaaauuuacaucuauaaucuggcaaaacaaaaagaccucuagugaugguugucucuuagcuuuagucucucuuggacuccauucccuccacccauaauguuccauccucuguccuuaaguguacuagucuccaaggccugcuaugugguugucauuguuguaguuacuuuucuauguugugacaaagcacccugacaguggcaauuuagaaagcauauaauuugaggaucacaguuccugguuagaauccaugaccaucuuagcaaaggcagacaggcaggccuggcacugaacaaguagcugagaucguccaucugguccacaagcauaaggcagagaagcuaauugggaauggcaugggcuuuggaaaccucagaguccacucuuagugauaccuccuuauccuuccaaacaguauuacacauucaaacuucaaaugugugagccucuggggaccacucucauuuaaaccaccacagugaucuuggcaacuucuuuuguguucgucccaugccacagucuuuccauguauuucuccuuuugcuggaacuuuuucccucgaagguuccugaggaaagaaacauagauaacuuuuguauguacuucuacaacugaaaguaucuuaauuuuugcccuaacaaauuuuuguuugcuuacuugcuugcuuacuugauucugcgugcaugcauuuauuuguuuguuuguuuguuuguuuguuugagacaagaucucucuuuguaguucuggcugccucaaacucagagagauucaucugccucugccuccagaaugcugggauaaaggcaugcuccaccauaccuaauccaaccucacaauuuuuuaaguguguauuuauaugugugugugguauauguaaagguguguguguucaugcacacaugugcagagaucagaggagucagguuuucucaucuaucacucucugccuuauuauuuugagacagggucucuuguucgauauuacauauacuaggugagauagcccaggagcuuguaggaauucucucccauuucuaccuuccaaaugugugcuacugcaucuggcuuuaagcaaguucugggaaucugaggucagguccuuacaccuauguagcaacucugccuacugagucaucuuacuaguauucacaaggucaaagguugggaccaacagccaagguuguccucagaucuccacacagauguacccacaauuauacaaacacucaacauaaaccuauuuacacacccacaucacacgcacacacauacaugcacauacaaaaaaaugcuuuuugaaagaaguagagaaugcuagauaugguauuacacguauauaauccaagccacucuggaagcugaggcaggaggauuucaaguuugaaaccagcuugaccacauaauuauaccaugccucaaaaauuguauagagaauaagaaugaauaugaaugagacuaaagucauaucucaguuacuuuucuauugcuguggcaaaacaccaugacaaagguaauuuacagaagagauuauuggggcauauaguuucagagggugaguccaugacaauuaugauauggcacugaaguaauagcugagagcuuaaaucugguccacaacauuaggcagacagagagcuaacuggaaauagccaugagauuuugaaaccucaagccccacuccuagugaugucccacaccuccuaauccuucccaaacaguuccaucagcugggaacaagauauucaacauauaagccuaugggggucauucucauucaaaccaccaguaguaauuauuagagcccagcaaagaaggaagggauagaaagaaaugauugaugggaacuggggugaagucugauacagagagaucuuuauguacugcagcguagcucaggaagauaacuaugguuaaggacaauuagcuaagugauuaguagagaggauuuuaauauuuccaauacaaagaaaugcugcaggccugaaauaggguacguuucagugacccagaucugauuauuacaacucauacacuuguaccaaccacauaaauauguacaauaauugugucaguuuuauauuaaauaaaaauguggagcaaguuaaaaaaugccuguuuuaaacugaucacaguuauaugccagcuuuucuuugcugugacaaaauaccauagggaguaguuuauaaggaaagagauuuccuccagcucauaauuccagaauuuucagucuagagucaguuaguucuaucauauugggcccacagcuagaccaaauacaaugauggggagaaugugguaaagaaaaguauuuaccucagaguggucaggaggaacacaagacaaaauauacauuucagucccauaccuccagugacuugcuucauccaaacagacgccaccauccaauagccauuaaaauacaagucaaccaguugauugacauccauugaucuuagucauaucccuaaauucaaccucuaagcucugaugcucugggggccaagccucuauugcauaaaucucuggagcauauuucauaauaugaaauauuaaacaggucucucaggagcuguuugguagacuuaguuguuuuuuuuuuuuuuuuguuuaagguuuuuuugguuggguuuuguuuuguuuuguuuuguuuuguuuguuuguuuguuuguuuuuuuucgagaccggguuucucuguauagcccuggcgguccuggaacucacuuguagaccaggcuggccucggacucagaaauuuaccugccuccuccucccaagugcugggauuaaaggugugcgacaccacugccuggccuagacuuauuuuuuuaaucagauuugagucuuugccucuggaaucacaguagcuuuucccauucaacaccuaguuuacagaagaaagaaaacccaauuuuuuuuuuuauaaucauuagacaacuagaaguuuucccuccuauuaagaaaacauauuaacgggcuggcgagauggcucaguggguaagagcacccgacugcucuucccaagguccagaguucaaaucccagcaaccacaugguggcucacaaccauccguaacgagaucugacucccucuucuggagugucugaagacagcuacaguguacuuacauauaaucaauaaauaaaucuuuuuaaaaaaaaaaaaaaagaaaaagaaaaagaaaacauauuaacaguauugagaaaacuguuggcuuaaauuugaugauuugaauuuuauuuuacuaauaaaugcauguauugcugggcauggcagcacaucccagcacucaggauuccgagauaagagaucauaaguccacgcuagcuggaauagcaaaauaaaaucuuuuuuuaaaaaauauacauacauacauacauacauacauacauacauacacacacacacacacuuuucucaguaguacggccaauuaguugacuugucuaacggagggaggaagaggaggcagagagcaugcuguucagaucacguucucuuuugcauucagucugggaccccagcccauaguguggugcugcccacauugauuauugguauucaguuaacccaguguagaaacucucucagagacaugcccagaugcuugccucauaaccacuguguauguauauaugcuuacagaaaauauacucaucauuacacauaaauuucauccacuuaccucuuaugaaaaguugauuauuuacugagauuuuucucauucugaaaauccauaaagucuaccacauugauuaaauuacuuguuuuuuaccuguuauugcucauguuagaauugcuuuccuuauuugggguaagcugucguuggccacugugaggggcuuaucaagaagucagaaaugggaacaccuucuaggaagucaggacuggaagcuuagcugagccagcaaguguuucucacacugcacuuccugugagccuaccugugcggcaucaggaacuggaguugggaccuugaggauuguucccuggaggcagggguggagucaggcaggggugaagcugacucacaagauggucuugccuuucaguuguuuccucucgcugcuucugguggcugcaguggucuggaagaucaagcagagcuguugggcauccaggcggagagagguaagcccaaguagacaaacuccacauaaaacucauuuuuuuccuucuuucuaggcagaucacuuuuaccuguugagugaugacuaauauucauaugagaagcaugcuguuuaaccugcauucugugguuccacuaugugccaucaguagauuuuaauuauucuugcauaaagugucauuaguuuugccacugcuugauucaagucuuccuaagagucuuuccuaagaauaugaguguagagacaaguucagcucagugacagagcacuugccuggcauaaacugagucccuggauucuagucucagcacccucuaauagcacaacacuagagacaaagcuucuaaccugugggucuugggcagcagguaggggagggggauuuaaaaaacaaaaacaaaccucuagcuguagccugugucauuuguuaugacuaagcacuagaguggguacuaguagacaugccauguggacauugagcaccucuccaucccaggcacugauccaggugguucugcuuuaucuucaucuccacccuaggauauaagggaggcuacguaacuacccaucaccacacagaugcugagguacagaacugagggguaacuagugccucugccuucacagcacagguuccuaaacacguuuucuacaaacacuucauuuguucuagucuguucauuuaagaaucucauguucugacugaaugagcuagacaacucacccuagacuauacauucuaaagaagggcaacaaggcaguuuuguuacuguugagaagaaaacaaaguuauuuccguaugaguuauugagauagaauaguagagauuugucugaauacaaaauagaaaguauauaaaaguauauaaguggaucauaaagaaagcaacaaucaacuggaaaauauuugcaguaucaugagagagagaaaacuagaagaugaacccccucaaaaaaggauuuuuaaaauaugcuuagacuguauucagucagcuaauaaacuuuuuuuaccuuuauuuggaauuuacgaauagcacugaaccugaccauuguaaaugcacgaggucaggcaugacuuguucccaguaggaaguuguuuuuaguucuugcuguggccuggguccugauggaaguucuuuacccaccuuaucuccuguccucuuggcagagguucuagaauagugcugugaugggguagcaacugucuuccugugacccugcaccuagauuauuacagaacccagacuggguuugcugaguuaauggaaauucuuucuagguucaguagagagaugugcugacacauacuaggccaucuaguuuuucaguaaugcucagagaccgcaauaggauauguaacagcaacaaaauuuuuaacauaaaauuucccuucuaaaacagagugaugauuuauguagcuucaggauccugccuccuagaagaugguuugaagcaaggccaguuugucuucccuagcauaaccucagaagaccucucauauuauugaugguauaggaaugaaugcccacauucuguauuugagaugugugcuauaguaucucaucugacccaacaugaaaacauuucaagccaugugugcuuggguaagguaggaguucaaagucauccagugaguucaaggccagccugggcugcaugagacacugucucauaaacagacacuugaaucucauuuaaagaagacauugaagacuugauacuuugaacaccuauccuaacguauccacccccaaauccagaguccuucauguucuuguccucugcaguuccacuuucauuguguucucagcagcagcucucuccgaggagaguugucucccauccuaucagccaucuuuuuuauuguuguugcucugacaaugucugguucagguuuuaacacaaagcaagcuagagugauuuuaaucuagcaacaaaaauauaaaaagguaaguuuuugcccuuuuauauauucaaucaacagauaucauagcauuauauccuccacuuuaacuuuuauuucuuacugguaagggcuuuuuauaaaaauauaauaguguuaccacauguaacaaaauuugauaccuugugcuaccuagcaccuugucauguccaguuuuccucagcugucacagaagcgacacugcaucugaucaguuugaaucagagagaguguagcaugucuaauaucuaguauucacuaauaaaaucucaguacuaagcauauuaauaauacuauauuauucauuagcaacuucuucgggagaugcaacagauggccagccgccccuuugcuucuguaaacguugccuuggaaacagaugaagaaccuccugaucucauugggggaaguauaaaggugagaaguggcucaaagguccauauagcuuuucagaacucaggccucaguuugcuaggcuacagacagcaagcgcucugugugucacuccugucuccucucuaacaguuagucagcagaagcaaccccgagcgaccguaaggggcucuguguguggcuuuacuuuucgaguuguugcaugucagauuuuaacaugcaaauuaagcuuguuauucuuacuuuguggcauaauacuuuauaguuuuuauuuggaaauaucuaaucugggcuaggugugauggugcacaucuuuaaucucaguucagaggaggcagagacagaggcaggcaggaucuccuugaguucuagaacagcuggucuacauaaugagacccuauauguuagaaaaaaagaaagagggggugggggaaggcagcuaacuuuaaccauuaauugaaccaacacacacacauuuuguucagagccccaguacucaauuaaaagccaggcaggcaugguaacaguacuuagggagucagaaacaggauucccagaguaagcagucugacuaggcuagcaggaaauggugaguuucagguucagcaagaggcccugccucaguaaguaaauugaagaacaacugagggagacuugcaugugcacuugugcaugcacccacacaugcacuugcacacauaccauaugucaccaugcuuagacuauaaaauguagucacuacuggcagcacaugccuacaauacagaugcaggagaaucacugcaaauuugagaucagccugggcuacuggacaagauuuugucucaagaaaacuaaaacaauacaaaaguguacuggggggguuauucuaaugccaguguuuaugacagcacauucagaacugacaguaaaggcaaucaaggacugucagugguggguauauacauaggcagaggagcaacugcuacuagaaacuguuuauccuuuaaaagacuaauguaugcugcagcauagacaaacguuaaguuguguuaaguaaaagaugcuguaucauuccacuuacccaucgagaauaaucaaauacaagacagaguaaaauagugacugcuagaggcuuaaaagaaaagaccaggggguggggaaagggagggaaggaagugggagagggaggaagggagagagggagggagggagccagacuuuguggcuuacagcaucaagaggcugaggcagaaggguuacaaauucaaggcccuacugggcuacauagugagaaguaggauuuccuugagcugucuuucuaggucauaaucucucauugggggaagucagggcagggacuugaggcagaaaccauggggaaugcuauuugcuggcuccuucccaggcuccucucuagcuuuguuuucucauuuuguuuuuacugucuauggguguuuuaccugcuuguuuuucuguguaccauauacaugccugcuacccacagaggcacugaugccuggaacuggaguuacagaugguugcaggcugcccugugagugcugggaacuaaacucggguccucuacaugagcaaguguucuuaaccauugagccaucucuccagccuauaaaauucuuuuuuaaaaauaaagucugcaacagaaaaugaauauuuucuagagcugaagcauucaaugaguggauaaagaauccauuugaugagcuaucuaccuuucacaagcucuuaaccccuacagacucaggacuuaguggcuggaagaugaauguaaaacagguagcucucuccauaauaucuggucuguuugugccaggugugcagaacugugcaacaggucaccauacaaaccggcgugggccuuuccugacacucacacagcucucgggacagugcccguggggaccucuuauugaccuuauaagcaccugacugugcaguguagcagggaguuaaggugcuucuguuuucuuccuccagaccguuccuaagcccauugcccuggagcccugcuuugguaacaaagccgcaguccucucuguauucgugaggcucccucgaggacugggaggaaucccuccuccuggucagucaggugaguagacaggagacaaugacagauauuggucugugaaggacugagucuuagacacuucuucugguauagaaccugggucugggcacagugcuuagugguacagagcuuugguggaacaauucuauaguccccaaacuguguucugagcacugacauuccuguccugggguggaaguucaggaccuuccucacggugcacagcguccucagacauucaugcucugguccccuugacucuauugaucccugcuuucuuuuuuuuuuuaaccccuuguucuuaucucaaauuuaggcuuuuucuuccuugauacaagcuccuauucaucuccaugccucuggcuuccagccauguccucaaagcuuguguugccaaguacagaguucuagucaugcuccacaucuucuuaaggucuugcuaugcagccuuagcuggacgagugcucguuauaggccaggcaguggugguacacgccuuauguccuagcacugaggaggcagaggcaggcagaucucugaguucaagaccacccuggucuacagaguaaauuccaggacaaccagagcuacauagggaaacccugucucaaaaaaauaaaaacaacaacaggaacaaccccaaaaacucauuauauugcccaggcuggcuucaaacucauaguuauccuccuacuucagccuccaaagugcugggauuaugggugugacccuucaugcccagauugucuuaaauaugaggcaugaagaaguauuaugaaaacauaaaggauauuuugaaaauuauaauucuacuggguuaaugcagauccauuuucauuucauugaaauaaugauacagccuuuggagguagggggagccucuccuguuuucaaacugacuuugaacuucugaucaucccgccaccaccgccaccuccuccuccuccuccuccuccccagugcugagauacaucacuacuccugguuuauguggcacagaggcucaaacccagggccucaugcaugcuaggcagacacucuaccagccaaccuacccacagcuccuagaugugcaccguauuacaaacauuuauucuucagcauguuuuuuuuuuuuuuuccuaaaaaucaucucuacaggaaacaaguaccagugguguuuuagggcaggaauaggaagaaaauauuuuuacuauauacucuuuuuuuuuaaucauuuuuuagauuuuauuuauuuuaaaauuuauuuacuauuauuaauaaguacacuguagcugucuucagacaacccagcagagggcaucagaucucauuacggaugguugugagccaccacguaguugcugggauuugaacucaggaccuuuggaagagcagucagugcucuuaacuggugagccaucucuccagccccuacuauauacucuuuuaaaugacuuauuugcuuuuauuuuuaugugcauugguaaucugccugcauguaugucucugagagaggaucagauuccuuggaauuugaguuaccuugugggugcugggaauugaacccagguccucuggaagaacagccagugcucauaacugcugagccgucucugcagccccuacuauauacuuuuuuuauaguuuugaauuuuuuuuucuuuuuggguauugcuaaggaucaaauauagaucuacuauuuauuuuuuauaacauccauuaguauuuuuauaacuuacuacauaguuugccaauucuuuuauacauguccaucaaacauguaagucauaauuuauauaaaccuuguguuaaagcuggaggcacagaaggaagauugcuacagagugaagucuagacuagccagggcuauauagugggacccuguugcaaagaaaaaguucucucuuuaaacacaaaggcaguaugaaaagacauaccuugauucugaagcugugcauaggaaugccucacacaguguucugcucaggacuauacucagaugcaguggucugagggacuugguggugucucagccaaaauaaccuggaguuuaguaggaaagucuccuuuauccguguccaguccugaagggaagccuuauuuauguaugaugagucaggacccauugucuucaucuuacuuggcauccccccagcacugagucucugaguuagccuuacuuggacagagugacucucugggcacucuggacagcaucuccugcuucaaaagggcaagaucuuuagaagacacagagauggagcaggucuuacauggagauauagcagcuuuuccuuccugacccuugacccaaugcuucuuuggaaauccucaugaaacccugcuccuuucuggagacccaccccacagcaggguuauccaugccaagcuuccuguacuuucucuuuuugaggaagcacauacacacaaaguuuuaguagcucgcacaucucacugugaaguagugauacuuucauugcuaucuucuggaaacaggcaggaguaggcacacgcucagagcauagcugcacucucauucacuugccacccugaggcagagcacacgacuuugugaucugcuauggaggagagagaaaugaguaguuagguguguauaaauaagcuaacaccaucaccccuuuaucuuucacuagggaaauguaaaaagaaaucugaaauuauuuuguaaaaaaguaagcugcuucaugacacauguccccucuuguggguucuuccaaggucucgcuguggccagugcccugguggacauuucucagcagaugccaauaguguacaaggagaagucaggagcuguaagaaaccggaagcagcagccgccugcacagccuggaaccugcauuugauacuggggcaggaauucgcccucacagagggcgugugguccacgaagcugucuacaggggaggcugcaggcaggaagcaggcguggggcagaagacuggggacccuugaagcguccaacucaugugcaugaucaugcaagcuguuuucauggcucaccccucuguguccagcaucuaaccuuuuacuucuguguaggaaauaauuuaauuacaaguccaggaauggucugcucuacucauggguggaggagaccagugccgaccccgugagagcugaaggugaugcugaggucccuuguggaagccucucuugggaaucucaacugcagaggagcugcccucugucagcagcucuccagcaugguccucugacacuccucagaugaacuguucucaucggaagcuugcugucuuuuuacaagaugagcuuuuacucucuuccaggaaguagcuuuuuuucuagcugagaauuaauaauggucuuucucuuuggaagucauaucaaaguauaauugaugggggccuuguuuuguuuuguuuugguuuuuggagacagggucucacuguguaguccuagcuggccuggaacucacuauguagaucaggcuggacugaacucacaaagauccaccugccucugccucacaaaugcugggauaaaaagcaugaaccaccaggcccagcaaagagggcuauucuaaaugucaaggucaauggaguuagaauauauauaaaaaaaugcaauugauaauucucuauagaaacuugauuaauuuuaauccauucuuuccuucucuuucucucacucugucuuacacacaugcacacauacacacacacuaagugccuagacuuugaauagaucuagcaauuggacauuaguaagccuaaguuuuuacaugauugcauuccuacauucuuguaaacuuuaaguaacuaccauugcaguuuguucuuuuuuuaaagucuaauuugcagccaagaacgaguaauucucaccccaagcaacaucuaauagggacugagugaccccagcccagccuagugucacuuuaggccugacguuugagcaacccucggcucuugccaaggcaccacagaaugcacuugcucaugcccugugccucuugagcagaaaagagcacugacaacugggacaccuggcucugucuuccuacagcugcucgcacugaccugugggaaccugugggucauccccaggcugaauggaguacacacuagaagagggaugaugccuagcauuggggcagcaucugcucagcacauggaaagggaccugguuccaucuccccugggcaggaguugguccagccuccucccagacccagcugguggcugugaggagguggggaaugcuaaugagaaugaaaagcacauggguugaugggaagggacaagauuaccacguuaggagggugagcagcccucugcuaugugcccaggacccugccuggacauugcauuuccccauuuauggugcuccguauucuggcauuaugcagcagccucacacaccuguccucuccuucuucauguccuacaguucugcuaucaccugacuagaauagcccucuaggcaacagugcucaaauguaugaguuuggagaaguuaacaaucagaagaacaaaaacuguaguguuucaccuuuaaaugcaguguugaagagggagccuuucucuaagcccugcacuaacccacuccucccaagacucuuguggagugacaguuccaagcugaaccauaaaucacugaugcacaaaacacugcuagaaggcucaccucucaaaacacgacucuuugcaucacuauuaaagagcagaaaguucuagaaaugaucccagccucauccccuauacaguuaggagcuccccacaucucuaccaaaacccagcacauaaguaucugcguggucuagccuuucaucuccguaacaagccaggggacucuuggccaaaagaaagaaagggaaguugcacuagggcuuguccguccauaaggaauuccccucugcuuugcucaaaggaccaaauuucuuuggccaaagaaguugcuucuauguuagucccauacccugaaguaauauguaccauggcucccaccuaccuguuuaugcucucccugcccccagggaaacuguuuauucuuucaaaagaagcaaacagcguucauuucugcuccuguaauggagaaacagccagcuccccugcaucccuuacagccaacagcucccuucaggcuuagagcagggggaauggcagggauuaagagcucagcucagagccaguuaccaagauggaauggaguugugacccaguaacugugucacgagagaccauguauauaaaauagucaugacgacacugaccucuugcacuuguacauaacuauacuguaguguccagaauguucagacauucaggguguacauaaacagaagaguaucauaauguauuuuuauuaaacacuaacaucugaguuucaccuaaucuguuucugugccauauacuggguauccaagcucugggaaguuauccuaccaggcccugaucuguugauaaggcacuauacaccaugcugguguguucuguagccuugugcccauuagguaacugaacaaugauucagcucuuagaauaccuaggaagacagcaagcagggugacacacggcugugaucuaagcauucagaagacagaggcaggaagaaaauucaaaaauggggcuggagagauggcucagugguuaaaagcacuggcugcucuuggucaggacacuaguucaguucccaguacccacaugguggcucacaaccuucugugacuacaguuccagauaaccugacacccuccucuggccuccucgggugccuguggugguccaccuggugcacagacaaacacccaauacacacaaaacaaaaguaacucaagaauagccugggcuacauagcaagagccugucucaaaacaaacgaaccuaugaagagccaggcagucuaucuauuuacauggcaguauacuagagaaacucaggaagcaagaguguucaucacuguuguaauuucaaaugcuccuugugauuucuggcaucucuguggggugagguguucuguuacucuucacauucaaagacugucacccaugaacgucagacuuugcaaaggggcucucuaagcugcacuguuguggcuuugucuaaaauuuuaaugacguuucugagaaccauguucuuuuuauacuaaaaucuggggaugggagggcucauuuguugauaaauagcacuauuuucccacaccucagccuccuguccccguccuggucuucccuacacagucuggagagggcucugaaagguccacagaguuugacagacacgaaagcaacccauugccccguugaccugaccuggaagaagacugucagcaaaaggaaaauaccagaauaucuggaaagcuugaaguguaagaugggaucucguuggggaauuggaugaagaaaagcagagcgccucugguaggugacucugcagccugccagcgcccgcccucuuucuacacagcagagugugcauggcaaggaaaugagucaccuccuugggggauggugcuguuuuuaugaaaaccucugauccuugguguccuuuaauugaucuguucaacaaauauuuacuaaacacuucuaagcuaacauuagggcagugacugagguggaaacccagcucuuuagacagcugucauccuaggauagcuuccuggaagcagaaccaagaagccagaagguucuuccuaggguggccuuggcucccugaaggaaucugaaaugcugacccugucacaaccucccagcacagcuuuggaaugagacaucagccuggccuccagcagagcagaggcucuggagcuccacauccugccugcagggagcccucagggugcccuccagaguacagggagaaacuaaaggcaauaacagaagcugcucucagagccugacugugcacaaaacacuagugaagccugcugaacuaauucugccucuggaaaucuuuucugguucuuuacaguuuguuguuuuguuuugauccaagcuuaguuuguuacuaugugugauuuagcaucugucgcacuuguguaaauauggaguaaguauuguaaacuauuuaauugcugcgauuguuggguuauacauacauuuaggacugcaauuuuuugguauuuuuuguauuguaaaauaacagcuaauuucaucaggaacaagagaauuaagggggucugcauuuuaaaugcagaugugaagcacuuguauauaaauaaaaguaaauacuauaauacaaaguuccuucugaaauaaaaguagaucugguaaaaaugugc

SEQ ID NO: 1103 - RNA, 9649 nt, Mus musculus
ugggaccuugaggauuguucccuggaggcagggguggagucaggcaggggugaagcugacucacaagauggucuugccuuucaguuguuuccucucgcugcuucugguggcugcaguggucuggaagaucaagcagagcuguugggcauccaggcggagagagguaagcccaaguagacaaacuccacauaaaacucauuuuuuuccuucuuucuaggcagaucacuuuuaccuguugagugaugacuaauauucauaugagaagcaugcuguuuaaccugcauucugugguuccacuaugugccaucaguagauuuuaauuauucuugcauaaagugucauuaguuuugccacugcuugauucaagucuuccuaagagucuuuccuaagaauaugaguguagagacaaguucagcucagugacagagcacuugccuggcauaaacugagucccuggauucuagucucagcacccucuaauagcacaacacuagagacaaagcuucuaaccugugggucuugggcagcagguaggggagggggauuuaaaaaacaaaaacaaaccucuagcuguagccugugucauuuguuaugacuaagcacuagaguggguacuaguagacaugccauguggacauugagcaccucuccaucccaggcacugauccaggugguucugcuuuaucuucaucuccacccuaggauauaagggaggcuacguaacuacccaucaccacacagaugcugagguacagaacugagggguaacuagugccucugccuucacagcacagguuccuaaacacguuuucuacaaacacuucauuuguucuagucuguucauuuaagaaucucauguucugacugaaugagcuagacaacucacccuagacuauacauucuaaagaagggcaacaaggcaguuuuguuacuguugagaagaaaacaaaguuauuuccguaugaguuauugagauagaauaguagagauuugucugaauacaaaauagaaaguauauaaaaguauauaaguggaucauaaagaaagcaacaaucaacuggaaaauauuugcaguaucaugagagagagaaaacuagaagaugaacccccucaaaaaaggauuuuuaaaauaugcuuagacuguauucagucagcuaauaaacuuuuuuuaccuuuauuuggaauuuacgaauagcacugaaccugaccauuguaaaugcacgaggucaggcaugacuuguucccaguaggaaguuguuuuuaguucuugcuguggccuggguccugauggaaguucuuuacccaccuuaucuccuguccucuuggcagagguucuagaauagugcugugaugggguagcaacugucuuccugugacccugcaccuagauuauuacagaacccagacuggguuugcugaguuaauggaaauucuuucuagguucaguagagagaugugcugacacauacuaggccaucuaguuuuucaguaaugcucagagaccgcaauaggauauguaacagcaacaaaauuuuuaacauaaaauuucccuucuaaaacagagugaugauuuauguagcuucaggauccugccuccuagaagaugguuugaagcaaggccaguuugucuucccuagcauaaccucagaagaccucucauauuauugaugguauaggaaugaaugcccacauucuguauuugagaugugugcuauaguaucucaucugacccaacaugaaaacauuucaagccaugugugcuuggguaagguaggaguucaaagucauccagugaguucaaggccagccugggcugcaugagacacugucucauaaacagacacuugaaucucauuuaaagaagacauugaagacuugauacuuugaacaccuauccuaacguauccacccccaaauccagaguccuucauguucuuguccucugcaguuccacuuucauuguguucucagcagcagcucucuccgaggagaguugucucccauccuaucagccaucuuuuuuauuguuguugcucugacaaugucugguucagguuuuaacacaaagcaagcuagagugauuuuaaucuagcaacaaaaauauaaaaagguaaguuuuugcccuuuuauauauucaaucaacagauaucauagcauuauauccuccacuuuaacuuuuauuucuuacugguaagggcuuuuuauaaaaauauaauaguguuaccacauguaacaaaauuugauaccuugugcuaccuagcaccuugucauguccaguuuuccucagcugucacagaagcgacacugcaucugaucaguuugaaucagagagaguguagcaugucuaauaucuaguauucacuaauaaaaucucaguacuaagcauauuaauaauacuauauuauucauuagcaacuucuucgggagaugcaacagauggccagccgccccuuugcuucuguaaacguugccuuggaaacagaugaagaaccuccugaucucauugggggaaguauaaaggugagaaguggcucaaagguccauauagcuuuucagaacucaggccucaguuugcuaggcuacagacagcaagcgcucugugugucacuccugucuccucucuaacaguuagucagcagaagcaaccccgagcgaccguaaggggcucuguguguggcuuuacuuuucgaguuguugcaugucagauuuuaacaugcaaauuaagcuuguuauucuuacuuuguggcauaauacuuuauaguuuuuauuuggaaauaucuaaucugggcuaggugugauggugcacaucuuuaaucucaguucagaggaggcagagacagaggcaggcaggaucuccuugaguucuagaacagcuggucuacauaaugagacccuauauguuagaaaaaaagaaagagggggugggggaaggcagcuaacuuuaaccauuaauugaaccaacacacacacauuuuguucagagccccaguacucaauuaaaagccaggcaggcaugguaacaguacuuagggagucagaaacaggauucccagaguaagcagucugacuaggcuagcaggaaauggugaguuucagguucagcaagaggcccugccucaguaaguaaauugaagaacaacugagggagacuugcaugugcacuugugcaugcacccacacaugcacuugcacacauaccauaugucaccaugcuuagacuauaaaauguagucacuacuggcagcacaugccuacaauacagaugcaggagaaucacugcaaauuugagaucagccugggcuacuggacaagauuuugucucaagaaaacuaaaacaauacaaaaguguacuggggggguuauucuaaugccaguguuuaugacagcacauucagaacugacaguaaaggcaaucaaggacugucagugguggguauauacauaggcagaggagcaacugcuacuagaaacuguuuauccuuuaaaagacuaauguaugcugcagcauagacaaacguuaaguuguguuaaguaaaagaugcuguaucauuccacuuacccaucgagaauaaucaaauacaagacagaguaaaauagugacugcuagaggcuuaaaagaaaagaccaggggguggggaaagggagggaaggaagugggagagggaggaagggagagagggagggagggagccagacuuuguggcuuacagcaucaagaggcugaggcagaaggguuacaaauucaaggcccuacugggcuacauagugagaaguaggauuuccuugagcugucuuucuaggucauaaucucucauugggggaagucagggcagggacuugaggcagaaaccauggggaaugcuauuugcuggcuccuucccaggcuccucucuagcuuuguuuucucauuuuguuuuuacugucuauggguguuuuaccugcuuguuuuucuguguaccauauacaugccugcuacccacagaggcacugaugccuggaacuggaguuacagaugguugcaggcugcccugugagugcugggaacuaaacucggguccucuacaugagcaaguguucuuaaccauugagccaucucuccagccuauaaaauucuuuuuuaaaaauaaagucugcaacagaaaaugaauauuuucuagagcugaagcauucaaugaguggauaaagaauccauuugaugagcuaucuaccuuucacaagcucuuaaccccuacagacucaggacuuaguggcuggaagaugaauguaaaacagguagcucucuccauaauaucuggucuguuugugccaggugugcagaacugugcaacaggucaccauacaaaccggcgugggccuuuccugacacucacacagcucucgggacagugcccguggggaccucuuauugaccuuauaagcaccugacugugcaguguagcagggaguuaaggugcuucuguuuucuuccuccagaccguuccuaagcccauugcccuggagcccugcuuugguaacaaagccgcaguccucucuguauucgugaggcucccucgaggacugggaggaaucccuccuccuggucagucaggugaguagacaggagacaaugacagauauuggucugugaaggacugagucuuagacacuucuucugguauagaaccugggucugggcacagugcuuagugguacagagcuuugguggaacaauucuauaguccccaaacuguguucugagcacugacauuccuguccugggguggaaguucaggaccuuccucacggugcacagcguccucagacauucaugcucugguccccuugacucuauugaucccugcuuucuuuuuuuuuuuaaccccuuguucuuaucucaaauuuaggcuuuuucuuccuugauacaagcuccuauucaucuccaugccucuggcuuccagccauguccucaaagcuuguguugccaaguacagaguucuagucaugcuccacaucuucuuaaggucuugcuaugcagccuuagcuggacgagugcucguuauaggccaggcaguggugguacacgccuuauguccuagcacugaggaggcagaggcaggcagaucucugaguucaagaccacccuggucuacagaguaaauuccaggacaaccagagcuacauagggaaacccugucucaaaaaaauaaaaacaacaacaggaacaaccccaaaaacucauuauauugcccaggcuggcuucaaacucauaguuauccuccuacuucagccuccaaagugcugggauuaugggugugacccuucaugcccagauugucuuaaauaugaggcaugaagaaguauuaugaaaacauaaaggauauuuugaaaauuauaauucuacuggguuaaugcagauccauuuucauuucauugaaauaaugauacagccuuuggagguagggggagccucuccuguuuucaaacugacuuugaacuucugaucaucccgccaccaccgccaccuccuccuccuccuccuccuccccagugcugagauacaucacuacuccugguuuauguggcacagaggcucaaacccagggccucaugcaugcuaggcagacacucuaccagccaaccuacccacagcuccuagaugugcaccguauuacaaacauuuauucuucagcauguuuuuuuuuuuuuuuccuaaaaaucaucucuacaggaaacaaguaccagugguguuuuagggcaggaauaggaagaaaauauuuuuacuauauacucuuuuuuuuuaaucauuuuuuagauuuuauuuauuuuaaaauuuauuuacuauuauuaauaaguacacuguagcugucuucagacaacccagcagagggcaucagaucucauuacggaugguugugagccaccacguaguugcugggauuugaacucaggaccuuuggaagagcagucagugcucuuaacuggugagccaucucuccagccccuacuauauacucuuuuaaaugacuuauuugcuuuuauuuuuaugugcauugguaaucugccugcauguaugucucugagagaggaucagauuccuuggaauuugaguuaccuugugggugcugggaauugaacccagguccucuggaagaacagccagugcucauaacugcugagccgucucugcagccccuacuauauacuuuuuuuauaguuuugaauuuuuuuuucuuuuuggguauugcuaaggaucaaauauagaucuacuauuuauuuuuuauaacauccauuaguauuuuuauaacuuacuacauaguuugccaauucuuuuauacauguccaucaaacauguaagucauaauuuauauaaaccuuguguuaaagcuggaggcacagaaggaagauugcuacagagugaagucuagacuagccagggcuauauagugggacccuguugcaaagaaaaaguucucucuuuaaacacaaaggcaguaugaaaagacauaccuugauucugaagcugugcauaggaaugccucacacaguguucugcucaggacuauacucagaugcaguggucugagggacuugguggugucucagccaaaauaaccuggaguuuaguaggaaagucuccuuuauccguguccaguccugaagggaagccuuauuuauguaugaugagucaggacccauugucuucaucuuacuuggcauccccccagcacugagucucugaguuagccuuacuuggacagagugacucucugggcacucuggacagcaucuccugcuucaaaagggcaagaucuuuagaagacacagagauggagcaggucuuacauggagauauagcagcuuuuccuuccugacccuugacccaaugcuucuuuggaaauccucaugaaacccugcuccuuucuggagacccaccccacagcaggguuauccaugccaagcuuccuguacuuucucuuuuugaggaagcacauacacacaaaguuuuaguagcucgcacaucucacugugaaguagugauacuuucauugcuaucuucuggaaacaggcaggaguaggcacacgcucagagcauagcugcacucucauucacuugccacccugaggcagagcacacgacuuugugaucugcuauggaggagagagaaaugaguaguuagguguguauaaauaagcuaacaccaucaccccuuuaucuuucacuagggaaauguaaaaagaaaucugaaauuauuuuguaaaaaaguaagcugcuucaugacacauguccccucuuguggguucuuccaaggucucgcuguggccagugcccugguggacauuucucagcagaugccaauaguguacaaggagaagucaggagcuguaagaaaccggaagcagcagccgccugcacagccuggaaccugcauuugauacuggggcaggaauucgcccucacagagggcgugugguccacgaagcugucuacaggggaggcugcaggcaggaagcaggcguggggcagaagacuggggacccuugaagcguccaacucaugugcaugaucaugcaagcuguuuucauggcucaccccucuguguccagcaucuaaccuuuuacuucuguguaggaaauaauuuaauuacaaguccaggaauggucugcucuacucauggguggaggagaccagugccgaccccgugagagcugaaggugaugcugaggucccuuguggaagccucucuugggaaucucaacugcagaggagcugcccucugucagcagcucuccagcaugguccucugacacuccucagaugaacuguucucaucggaagcuugcugucuuuuuacaagaugagcuuuuacucucuuccaggaaguagcuuuuuuucuagcugagaauuaauaauggucuuucucuuuggaagucauaucaaaguauaauugaugggggccuuguuuuguuuuguuuugguuuuuggagacagggucucacuguguaguccuagcuggccuggaacucacuauguagaucaggcuggacugaacucacaaagauccaccugccucugccucacaaaugcugggauaaaaagcaugaaccaccaggcccagcaaagagggcuauucuaaaugucaaggucaauggaguuagaauauauauaaaaaaaugcaauugauaauucucuauagaaacuugauuaauuuuaauccauucuuuccuucucuuucucucacucugucuuacacacaugcacacauacacacacacuaagugccuagacuuugaauagaucuagcaauuggacauuaguaagccuaaguuuuuacaugauugcauuccuacauucuuguaaacuuuaaguaacuaccauugcaguuuguucuuuuuuuaaagucuaauuugcagccaagaacgaguaauucucaccccaagcaacaucuaauagggacugagugaccccagcccagccuagugucacuuuaggccugacguuugagcaacccucggcucuugccaaggcaccacagaaugcacuugcucaugcccugugccucuugagcagaaaagagcacugacaacugggacaccuggcucugucuuccuacagcugcucgcacugaccugugggaaccugugggucauccccaggcugaauggaguacacacuagaagagggaugaugccuagcauuggggcagcaucugcucagcacauggaaagggaccugguuccaucuccccugggcaggaguugguccagccuccucccagacccagcugguggcugugaggagguggggaaugcuaaugagaaugaaaagcacauggguugaugggaagggacaagauuaccacguuaggagggugagcagcccucugcuaugugcccaggacccugccuggacauugcauuuccccauuuauggugcuccguauucuggcauuaugcagcagccucacacaccuguccucuccuucuucauguccuacaguucugcuaucaccugacuagaauagcccucuaggcaacagugcucaaauguaugaguuuggagaaguuaacaaucagaagaacaaaaacuguaguguuucaccuuuaaaugcaguguugaagagggagccuuucucuaagcccugcacuaacccacuccucccaagacucuuguggagugacaguuccaagcugaaccauaaaucacugaugcacaaaacacugcuagaaggcucaccucucaaaacacgacucuuugcaucacuauuaaagagcagaaaguucuagaaaugaucccagccucauccccuauacaguuaggagcuccccacaucucuaccaaaacccagcacauaaguaucugcguggucuagccuuucaucuccguaacaagccaggggacucuuggccaaaagaaagaaagggaaguugcacuagggcuuguccguccauaaggaauuccccucugcuuugcucaaaggaccaaauuucuuuggccaaagaaguugcuucuauguuagucccauacccugaaguaauauguaccauggcucccaccuaccuguuuaugcucucccugcccccagggaaacuguuuauucuuucaaaagaagcaaacagcguucauuucugcuccuguaauggagaaacagccagcuccccugcaucccuu

SEQ ID NO: 1104 - RNA, 37343 nt, Mus musculus
caguaucccuaauaaaacagcacagcugcuuccccuaccuucuccaggaugacaaaagcuugccccccaguccuaaucagucucuccaggugccuggaccagcugccaucuuccucccucuccuuaguuggugccugugcuuuugaagcaggaaagcauguaguaagagaucucuuaaguccccagggcuaacagucauucugcaaaugagacauagaagcaaauacuuuguauagaauuuucccacacccaacucuuuuuugcccucuccccuucuaagguaaaaguucuccuucaggcagccagugagggagaaagcauaccuguaccuugcucuccagcauccaccacccaaggucuccccuacucaccugcuucccugcagccuaagcugcagccaguggguaaggaggagacucgccccuuuggcacuucaucgacucuagccugguuaaucuucccugauaagaaccuccugaggagcuggugagauuguucaguggcucagagcacuggccgcucuuccgaugacccagguucagcucauagaacccaccuugugacccucagcuucaaucuguaacuucaguuacagaucuggcaucugaguguaccaggugcaaacauguacaugcaagcaaacacucauacacauaaaaauaaauuuuuauuuuuaaaaaauugcuuaaaugggaccaucaaaguauuuaacuuaaucuuagagguagggaccuaaaaugccagguaaagguuuuuuaaauaagauuaacaggaccuaucaguuuucaaguucagcuuuagaacccaaauuauuucaagaugcuuuuauuccaguuagcucagcacguauccaaauucuucguuccuuuguucacaggaucaggaaaagcuaccccugcuguuucaaagacacgcuguagcucagaucaugaccucaccaguguuaagggacucaugugguugaacccucagcgccguccaugccucuccuuccaggcugugguggagaaugugacggcuuggggccauugccucugucugaggacauguccaggaagguggaggaauggcacuuuagucuugucguuuagcccuauggggcuuauuuacuagauauaacucccucaaaaaagguuuaugaaaugcugagccucagguuucauagacguguuuguacacuaagaauucugcagcagaauauuuuuaaacauugguuuuuguaagcuauauuuuuguauauuuaauugcuauuuuaaaacuuuaaugcauuuuuugcuaaucacuuguuuaaaaauaaaacaugcauguaaucgacccaaacguguaaauaaagagcaaauuuugaaauacuuuguauuuggaccugucaacuuuugcacuagggcgagguaagguguggcacacugaugggggaaaggcaucaggccacaccacaccaugcauugcauuugugguggcuugauguauauagcuuuguccuuugacagucugccacauucccagaacuugcccuaacccuaaugccagguggugagcggcucugaacucagcuuuagcccauggcuucaccaaggcacacguaacccuggagcuaccuccaagcaaccuuguaacccaucucuauaaccguuugcucuuggacucccggaucccuguaccccagguuguuuucccuguaaccugcuccuucacugccgauuauuauuauuuucuugugcucugggguucacuaacuccucccacaaauaaauacauccucugcguugucucugacccaaaugacccgugcuuuagggguucucaaaaccaggcguucuaaaaccaaacuagguaucuucaagcacccccuagacccagccacugaugcccacaagacauuaccucuuugcguaggccagccuccucccaucuuaguucaagcuacuuugugcuccagggccacaaaccuuccuuucugagugggagaagugaaguggagcuuuaggcuaucaaaacaaugaccuggauuggacagcuaagaaaagacaagaugguucuaacagacacugcaaguggcucccaguucagaagugguugugagguggaauguguguauuucugcaaauagugcuggaaucaacaggaagacagcuuggcgagacucaguugagcuugaaaguggaacugucagaguguagacagcagccagggaagcaggugagaacuggaaaagaugaggcucugaaacaaacccuuuguauuuauggaguuuacuaguggcgcacaccuauaauccagcacuucggaggugaaggcaacuagaucugcaguucaaaggccagccucagcuauacaguauuaaugucgaguuugagguuagcccucaccacccgagacacuauuuaaaggaaauagaacccauccccagaaugacccugggcugagcacaacugaggaaagaaauagacagugauggugugggucacaacagcaccacacauccuguugggcucugugauccugaggcuuguucgucuaacacugugggaggagcuucaauguaggaagacagaaccaugaauacaaagcacuggucacaacugucaaauaggagucaccugagggauggcagggaagaacacagcccugccccagauggagaaacuuucuaauaaaagugcaguuuugaggaucucucagaagcaaagcagggauuagcaggagggaaaacuaccaucccugcaacaccccguguacugugcugccagcacaauggaacccuuaguccuaaugggccaaaguauguaauaaaagccaacuauaucccugugggaacugagaaccaucaagcaggcuagccagccaaauccaauccuaguucccauaguccaaaccaacaagagccuucuguugccccagagcuggcaccagaacccauggcugaauggcagaauccuucccagccagagcucgaggucuccauuccagcuccaaggcugcugugaacaggcccacccuugccuucagcuacaaugcaggccaucucuuaacaucagaugcagaacaauccugccaaguuuucagaagcuugaaauaacccauuuucaguauguuaacauaggcuaaacaugauccagcgcgcaaagaaagaugaccuccaaggcauacugaugaaagcgguuagauucucacauacauuucaacaggacaagcagucagcugcuggugggaguccagaaagcuccacguaugcccaagugggugaugcugggauuccaaagcaccucagggguuaauaacgcugcccugagaauacccuauaaacagcaaauccucauacugccuagacgggggugggaugggguguccuuagacaaaauuuuaagaauuuaucuugaugucuuagaaaaauacauuuguuucuugcucugauuugaguaguacacgaucauaaaacuugagucucuuaacaaaacaaaacaaaaaaauccacagaugucucuguggcagguuucaggaaguccucucgguaagucaggguaucuucaacagcucgaggagugcuccaacggcuccaaaauaucccugaaaauugacagaccacaaguaagauuuuuuuuuaauuaaucuuauauauauauuuuaagauuuauuuauuauuguaucuaaguucacuguagcugucuccagaugcaccagaagagggcaucagaucucauaacgggugguugugagccaccaugugguugcugggauuugaacacaggaccuucagaagagcagucggugcucuuaaccacugagccaucucuccagccccacaaguaagauuuuuuaaaaauuauuuuuaaaucugucugggaagggguagugugcaugugcauacaggagccagaagcaucagauccccuggagcuuaagcuggcgaggcagcugugaaccacccaaacgggguacagacaaccaaacaucagucuucugcaagggcaucgugugcugucagccacugagccagcguccaacccagugaggucauuaacucccacaauuaggauuacuuaaauaaggcuagcacgucccuuuaacacccaacccauuuguuucccaagcagaaagagaauauccagucuggaaaagcccuaaggaacucucuugcagggaagggcuggauguuggagaugcccaacaagaagaagguacuacagcagcugagggaagaaaggucuagcaaagaucuuguucugcuuaguuuuuuuguuuguuuguuugguuuuuuuuuuugucaacuugacauaaacuagagucagauugaggaaaggaaccucaauugagaaaugccaauuagacuagccaguagguaaauuuauuuggcauuuucuucauuagugacugauguaggaggacccagcccacugucggggucccaccccuggguaagugguucuggguucuguaagaaaggcuaaacaagcccugaaaagcaagccaguaagucuuccuccauggccuuugcaucagcuccuccuuccagguucccacccagucugaguuccugccuugccuucccuugauggacuugcggccaggaagggauauguaacccaaauaaaccuuucuuccccaagcugcuuaugguuauggucuauaucacagcaauaaagccuuaacaauaagcugggcguaguggugcacaccuuuaaucucagcacucaggaggcagaggcagucggauuucugaguucgaggucagccuggucuacaaagugaguuccaggacagccagggcuacacagagaaacccugucuugaaaaaaaaaacaagccccccccccccaagggaaaaaaaaaaacuaacaaugacagauagauaguggcucuccuguccugggacagggccuguacauuuccaacagccaaccacugaaggugagaaauggaggaugaacaccugaauggucugggagggagggagggagaaguggaaaaguccaaaccuaccuauacaggaggggauaaggguggaaggugaguucaacagcuuggucuauggaguuccaggcuagccagcuacauagugaagcucaguuugaaaaagggggagagggggagauacaugccuuacuguguccaacaguaaagaguggccucaagcaggaaccaaaaaaggauaaaaaauauuaaaugagacaaaaacccuaaccaacagaaagagaaugauaacaggagucagaagaaucauacaaaggacugacugcaucagucuccaagcaggaugucagaaauuaaaguacugcaagaaagaacaacugggcuggguugucuguugcagacugucaggcuggaacauagagccagggucugauuccccaggcccacccaaaacaacaaccggagcaggaaaaaaaaaaaaaaaaaaggcaaauuguaagagucugagguuuacuuuacaaggggaaaaaaaaaaaaaaaaaagcaacaacacgcccaagcuacauuagacuaaaacccagaaccuacugccgaguaaagaaaaaagcugcaguagcuauucaucacuguggaaaggauuagguaccaaagggaagcuugagaagaagacacaccuccaaacugcucaaccaacugccugcuaaccugccugccuugccuugagagggcagacaagagaguguccucaggaccacaauaaugaauggcaaggcagauaucaacaugcaaaugagaagccucaccaggcaaaggagccaagaacaaauggcccaagcugagcagaaggaaaaaaugagcaaccaaggaaaccaacaacaugaagaugugacuacaagcucuguuuccuuuauccaaacugcuugggaccagaagugguucugguugggauauuuuaauguaucugcauagacugacuacuguaccacaucuaauccaaaaaccucagcacucaaguuucaaauuugcugcccagagauguuuaaucuguagagauggagaggaaggugggaugcuauucuaagaacuauuucccacgguuuaccuagaaaaagguucaaaccagcccuggaaagcagagauuagggagacuguacaaaguuaaaaccaguuugaucuauauagcaaguuccaguacaaccauggcuacauagcaaggcccugcuuccaacaacaaaacuguuuaaacuagcucaacacucaccucaguacacuggugagaaguaguuucagaaccaacaguaaaagcccagggcagugagaacagagggcucccugcagcccaagucaguccucucacucugcgcccuugugucuguaggacgguaucagaaacaagucacucaccucgugcucggaaaacagugcuuucagcugccccuuggaccaguaauccagcgcauacgccagaagccgcauagcaaucguguugacucucaggaaauugccgacaaauacgaccugguuaauguucugagcacagaaaggcaacagugaguucacacccugauuucuguuuccucauaaaguuaacccggcagcaucaugcaguuucagcagcaacuugacugauggaucaaauucaauccaguugguucaggucuaaugagaucugauauuuagacaaugcugggcccacugcaagcuggccccaaaguguacacagaaugauuagcuuaaaaaacuuaaauaugauaaacaguaacauuacaauaagaaaaauauaacaguaagcuaaaaaaaaaaguagaauuccugaugauuaacucugucaaccuauuagauuaagauacccuggggcauuagugaggcacaacuuuagguuuaucugugaagguacuuacagagagguuuaaaucgguggguggggggcacucugaggaaaacagaaagccugccgagcaccaaaauucaccaugcucccccucacuccugguccauccauuuguguucaggagccucacagucacacugccacaagcacaagcaauucccaucacuaaacugcccuugcuagaaacuugccaacaggaacaggaauacagagagucugagacagacaccucaguaaguaacggugcuuguucugcaagcaugaaggaggacaugagucaaaugccagcaccuacaucagaagcucuuggacugcacaugcccgcaagcccagcacugggguccaagacaggcagauccucuuucaagacaguaagaugcagaaagauaaagacaugcaguuuccggcucuggccacacaugagcaugaguaugcacaguuaguugcacauucacauguauaaaagagagaaacagagguacugagaaaagagaagagaaaggaaugagggagugagaaaaggagggacacucuuucuagagaaaagaaaacagaaaagcagcacauugguaccaaugggccagugaaauggagaaucgggaaaagaugcuuaccucaaacccuaaaggcccagaacccacauaaagguaggccagaaccaacuccacaaguugcccuuugacaucugaaagcaggaugugacacguauauuuccacccccauaaugauaauaauuacacuuuaaaagaaacugguuccaagaaguaaggccaucauggggauaacacugacugggcugcaggcauucugggcugcuggaagcauacggggaggucuggaacuugaagcacuauccaagaaacaugaaaaaugggcaaugugaaaggagcauaaauccuauaaagugacuaacuguuacuacagagagaccagggauaguauaucgagacaacagaaaagaaagaagcugaggcuaagaauacaccaucagagcuccagggccuaacaauggagucuuauuggagaaacucucaucuuaaaaaacaaacaugccggcaugguggugcacgccuuuaauaccagcacuugggaggcagaggcaggcggauuucugaguuggaggccagccuggucuacagagugaguuccagggcagccagggcuacacagagaaacccugucucgaaaaaacaaaaaaacaaacaaacaaaaaacuacccaaacaaauuagugacaccuugcuccaaaagugcuggcaguuuuuccuagguucagacucccagaggccuggccugucacuguuauaaacgacacaguuacaucuggagcugaaggcagcaugcugaggcagcaagguacucuucugcaggcaucacaaucucagaguuagguugcuaagauagcucaguaguaaaguguuugucaucaggccuuauaagccaaguuugauuccacaugguaagaggauggaaccaauucccaaaagcuguccugacuuaacacaaccucuggcauacaaacacaagcacuguuggcauuucaucuaggccccaccccacaguuaccuggcaauagcuaaguaugcaugacccacuauaaaaggugcugcuugcccccuccucacucucuugcuccugcccccuuacccucuucccugucucuccccaccccccuccucccucucucuccaagugcucauggcuggcgucuccuccucuacacucuccacccaccucugccuuucugucuccaccacucccucaacuccccucuccauguccuaaauaaccucuauucuauacucuaccaucugaggcugguaccucagagggaaaggcugccucagcaugggcccacagagguacccccuucccccgaccauacuaugccuccaccaaauauacacuucuuuucuucuuauaaaacucaguauguaauguuuuuaaaggauacaagagugauggcgucacuaaggcucuagauagcuaauggggccaagcaauaugggacaagguugaauguaaagucuaaaaggcaauauagacuugaaaagacuggagaugccaggaacauggguuauuugccaaagaaaacuauagacuccaugugaagucagcucaagaaaaaaacuacaccugccaccaacaacagcugaaagagaacuaggaaagccugcuggagccuaaaugaugucaucaugagcccacagucuguaaucuccuugcuaugcuacuguuucuccauauggacuaaaauguuuacucugccuaacuguacuggaaguuguacuuuggguuuugauuuuuuuuuuuuuuuuaaguucuccaaaaacuuaaaaaaaaaaaaaaucaaaacccaauucauucccacccacccauucccacuuuuuggcccuggcguuccccuguauuggggcauauaaagcuugcguguccagugggccucucuuuccagugauggccuacuaggccaucuuuugauacauaugcagcuagagucaagagcuccgggguacugguuaguucauaauguuguugcaccuacaggguugcagaucccuuuagcuccuuggauacuuucucuagcuccuccauugggggcccugugauccauccaauagcugacugugaggauccacuucuguguuugcuaggccccagccuagucucacaagagacagcuauaucaggguccuuucagcaaacgcuugcuaguguaugcaaugguuggguuuugauuuuuauagaaccucaccauuauucaauuauggaagucucauaacaaacuuuguuuugcuuuguuuucuuaagauacauucuuacuauguacucccagcuagccuagagcucgcacuguagaccaagcuaaccuggaauucagagaucugccuaucucugcuaccugagugcuaggauuaaaggcaugguucucuauguccagcuucagaaccaaguugccuuacucaaguagacaaugcccuaccuaugcaagcaacuccaauuaaaugcagugguccaaaaacaacacaaugacaacaaaaaccaaaaacaucaaaguagguggaagaucugggguagaagaagguucaaugaaagacaaaacuaguugcugaggagcacaaguaauguggcagacagacuguggacacucagacagcauguacucugaugacaaaaugagacacuaacagugagaaguggaguauuaaagugagguauauggugccaaguuaacaaggcauaaguuugagaugggcaauacugauugucagcauaacuggaguaggaagcacccagagcauuaguguggcagaccuuuggcugugucuuguguagaggaguaauuaagaagacuugucuugaaugugguaauaccauccuacacugaaaaaaaggggagaagagacauaccagcugagagccagcauucaucuguucccuagcauauucagauauaaauaaacagcgucacacuuugccccaagugacuauaccaccaugccuucccuaccaugacagucuauacucucaccugucagccaaaguaaauccugcuccuaagugacuuuugucagggauuuggucagagcaaggagaaaaauuacccaaacaggacaugacacaaaauaacaaauuaugcaaaguaugggacaguuaaaaacaauucaccuucaucugugaaccaagaaagcaaaaucuuacagcuguuuaacagagugaaauuccacccacagcaucaguaaagcuguccagccaucaaugcuaaagaugcugcucugaaugggcacacaccugugcaaaaccccuugguaaccuacuaggauucauuaaguacaaucacgauguaggaucacaagguuugcucccaagaaagccccauaucaagaauaaaacagccaaagaacaggcucauacuucuaaauacuuaccacagucccuacuuccaagaaaccaaaugcccaacucuauuuaaauaauuaugacaaaauaagaaucugaucaaauauacagugaugaccucagaagauagcuuagucagcaaagugcuuccaugugaacaugaggcugaguggaauucccgaguccacauaggaaagcaguggcauuggcacauuuauaaucccagcgcuagaaauugaggcaggcagauccuagggauucacuggacaguuacccagccuaaucaacaaguuucaacuggugagagaccuugucucaaaaacuaaggugagccaggcauuguggcauacaccuuuaaucccagcacuagggaagcagacacagcaaggucucuaggaguuugagguccuuaaccaguuuaaaaauaaaaagccgggcagugguaauacacaccuuuaaccccagcacuugggaaacagaagcacacaagucugagcuggaggccagucuaguauacaaaggaaguuccaggauagccaggccuacacagagaaaaccuguuucaaaaagccaaaaccaaaauaaaauaaaacaaacaagguagacagaaccugagaaacacccuagguugaccucuaaccuccacaccuacacauguauacacauguauucacauaaacaaaauguagccacaaaccauguauuucaauuaaaagcauaaaauguaugcacaacaacuaaaaguuuuugauacuuaagcccaggaaagcaaacauauaagagugauguuauucaaaugaagauggaauuuuuaaaaucugguguuuaauaacuucuaaauaaauuaaaauuuagacaaauccuuuuaggucuugaggucucuuuuuaaggcacaugccuauauuauuaaaagaauuauuguaaaccaaaguguauaaauagggacaagccauaagcugcaccaacuggauccuagauccucuuucccuaagggcagcccauucuugguucuuucauagcccuguacaaugcugcuugaccugaaugcuacaaggcagcacuguaaagaagcugaaagcacgaagacagcucugcugagguggagaagaaccaaggugggccuuccucugaccgcucagucuucucccagcuccaguggcuuccuguggcuuccuguccacaccucaacagcacccagcaaacacagcgucuagucaccauugugacccgucauucaucccaucaguagcucaagacuggccuucuuccuggcccccucuagagucuccucaaagaaaccauucaccucuugcaguagugcuuaucuucaggaagagacaaggaguaugguggggaaugggaggacaaucaaugaagaggaggaggaaucugaagaguguaaaguucacauuucaagucuaccccauauaacuacauuugggcacguuuuaagaagacagacacuguaaggucaggguaggacccauuuaggaaggucagcauuucccuagagugaacagaacaaucucaugugcccuuacuucauuaagggcacacauucuugcuauggagccaauguuguuggugauggugaucaaaguugcucuggcaagauccuccuuacuggccgccucucucuucuccuugcucaucauguuuccaaaacugugguggaggaaaaacauuucacugcugaaacaaaggcaacacaguccaggagaacuucaauguuacuuuacuaugauaaaaugacuuuacaucaagucuuucuguuuuauuacagaaugaugggagcauccacugaaaggaacucaguuaaaaaaaaaaaaaaagccuacaaauuacacucuaaaugaacagguagcauucccugucauacuaaaauucaacuuugguaccagauaguucccuauccaagugcauucaguacaauuuccgaaagguagcacugccugaucuaacaacggaguauuccagggagacauaccugacuggcaggucaucgcuacugugcaacuguucuacucagacagucacaguuacaucuagucuagaaaacucauuugaucagcacacaaaguacaaaacagcugaggcccacaguggcuacuaaaguuccaggcugcccuagaaaguaaauaaaagacuucaaauuucuugaccagcaaaagggcuacaauaguaacuaugacccaaacccaaggacaagaauaaggaagagaugaccagugaucaaaugcugccaaaaaaacaaucuauuuuauuuauccagugccuauuucccagcuugcacaugaaugccuuuucuauuauuaaaaaccaaguacucugcugggcaugguggcgcacaccuuuaauuggcacuuaagagacagaggcagauagauuucugagagucuaaggagagacuggucugcauagcaaguuaaagucuagacagggcuacauagugagaccuggacucaaaaacagaacaaaacagaaaacacaugugcucuuaacacaaaaauacaaaaauugcauacguaggggagcuggaaaacuggcucaguguaagagcacugacugcucuuccagaggacccuuucaguucccagaacccacauaucagcuaagugucuguaaguauuuaauuucaguccuaggaaaucugaugcccucuucuggucuccauggguaccuggcacacacauguuacacagauauaaauucagguaaaacacccauacacauaaaaguaauuauuuuuaaaaacuacauaccuaaauaaacaaaauaaaauauagaaaggcccaugcuaagcaugguggcacaggccagcaucucagcaucugaaagaccaagacagaccugggcuucacagugaaauccugacucaaaaacagcaugaggaagacagagaaaaagacuuccacuuuuuauagaauuaaagagaacuaaauaggcauuuacuuagcaaaagaaauauaaugcuuguguacuaaaaucuuuugcaguuuaaagacaaccaccaccuaaagaaauggaaagaaguccaucuuccugaaccaaagacuugacaguguuaagcugguaacacucaggucuauagagauggcucagcagcuaagaacacuugcucuaaaggacccagguucuauucccaacacccaaaugaaggcucauaacuguguuuccagaucgauauccucuugugaccucacgaccaccaggcacaccgugaguauacauacaaacauccaagaaaaacacaaauuuuuaaaauaauuaaaaagaaaaauugaaaagaaaauuaagauuaaaagaaauuaaaagaaaauuuacucuucaaacuggucaacagauucaauacaaucccuauuaaaauccuagcuaucuucuuuacagacauuaccaaguugauacuaaaauucauauagaaagucaaagaauucaaagcagccaaaauaauuguggaaagguagagcaaguuagagaagugugcccuguaccucugccaccuuccccuaaaaacuuagugcaaggcugcgguaagcaagggaacaugguacuucucuaaagacaaauguacaggacugagaaucaaaaauucaacugagggcuggagagauggcucagugguuaagagcacugacugcacuuccaaaaguuuugaguucaaaucguggcucacaaucaucuguaaugagaucugacgcccucuucuggugugucugaagacaacuacgguguacuuacauauaacaauaaauacaucaucuuuuuguuguuguuguuguuuuguuuuuuguuguuguuuuuuuuuuuuuuuuuuuuugguuuuuugagacaggguuucucuguauagccuuggcuguccuggaacucacucuguagaccaggcuggccucgaacucagaaauccgccugccucugccucccaagugcugggauuaaaggcgugcaccaccacugcccggcaauaaauacaucuuuaaaaaaaaagagagaauucaacugaaacaucuacagucaacugauuugcuaacaaagggcucaaaagacuagggaaagcagucucagcagaugggucagcuggaccaagugagaaacaccauguaagagugaguaugaaacucuaucacacacuauacagaaaaacuaacccaugaauggcauuauaaacucuuagaagugaauccucacaaucuuagauggggcaaaugacacuaaaagcacaggagauaaacacauaaagacagguuucaccagaacuucugcuggcuuugacagcacuugccucacucaggaggcagaggcagaaacagacuccaaagucuaaggucagccaggcccacacauugaaacccaaucucaaaaaacccaaaugaggcuagcuauguagccucaaucgguagagugcuugccugucacucacagggcccuacauaugauccccagcacaaaacaaacuggacacagcacucagagcuguaauccaaguacugagaauuuagauacaaaaagccagacaucgcaagaucaagaccagccugagauacaguaggccuuguucagaaaaagaaagaaacaaagaagugucuguaauacaaacaccaaggcagugaaaacaaaaacaaaaacaaaacagagaaaauacauucuuaauuauauguauguguguguauaucuauguauauguauguauauacauauauacacacacauacauguuguuagauacauauauauuaucuaguaaagaacuuuuaucuacaacauguaaagaauucuuggagcccaauaaauagaaaaauauaauuuuaguuagcaaaagacuucagcaggcauauuccuuaaaugauaaacagaaaaacaaaacucaagaucacaauuaauuagggucuggggccauaccccuguuauuuccaacagucagaagcugauacacgaagauuacaaguucaaggccacucuggccucuguugagggagacaaaggcuucaccaaaggaaagaaaaggagaaucagaaguagaaaugaaugaaaaauucaggaaacagauaagagaaauuaggagaaaacuuaaaagagugucugucuuugaauccuuauugugggagcccucaaaucucaaugacaauaggaugaauucugcuugucugacuucugccacuuuccaaguaacugccacugggauucccaggguucucuuuuccuuacucuuugcuacuaugccagugucuaacugcagugucaauaauacaguuuuaagcauuuguaugggaaaaaugaaguuacuaaagcaguuuauaaaaagggguggggacggggugguuccucaacaacagacagagacagagaauaagaaugucuggggcuguaagaugguguggucacacuggaaaguagucuauuaguucuucaaaagauuaaacaaagucacuaugcagcacagcaauuucauuccuagauagagaccaagaaaauuaaagcagggcacacauaucuuuaauuacaugacucuggagguaaaggcagacagaucuugaguucgaggucaaccuggucuagagugaguuccagguuaauuaagacuuuaaaaaaaaaucccugaaucaaaaaacaaacaacaauaaauaaauaaaauuaaauuaaaaauauguccaaacaaagacaagcacacaggucuucagcacuauucacaacagccagaaacuaugaaaguauccaauguuuauuaacuaauaaauacauaaaauaugguauaucaacaauacucaacaacaauaauaauucugcaaauauuacacuagcggagaugaagcuggucaugacagaucauacuaugacaccacacauaugagaaacguucagaguaagcaaauucauagaaauagcagcucugggaaggaugagggcugaaauggaagagugauaugauagcuaagagcugugaaguuucuuucuaaaaugauaaaaauauucugaaauugaauuacaguaguugcaaaauucugcaaauauacaacaaaucacuaaauuauauacuuuuaaaaagauaagugcuuauguauaccagacuugccucuaacuaacuacgaagcagagaaugaucugcaacucccgauccuccugccuccaccgcaggacgggacucuaggcauuaucggcauguaccauacucaguuuaugcacugccggggaccguguacacuaguacaggcuucaaacgcacuagcauauauucuacuaacucaacuacaucuucagcuacaaauaaaaugcuuuaaacaaauaacuuuauauuucaaugaaacuguuuaaaauaaaacauauaccuaauaggauuuuaguucuguauuucuuacuacauuacauauucccuuaccuugaagccacagcccagccuggcaagccaaaccucucauagucuccuccauaaaugucucgaacuaauuuguccacuuuggugcuaucuccacgagaugccaucucaagagcuucuucaaaaguacuacagccaguaagaagacagcagagaccaaagaaaguuccuccuccaagacuaugauuaaaagcaaacaauguaguauuuuuaaaacauaggaauggaaauguuggacuuaugaacccccaaacaauauuuauauaucagcuacucuugccucaauuaaaugaugagugauaccaauaaguuaaguuugcaagaagauaaauccaagugccucauaaacaaaaaaugcacauauucacgugagccaacaaaguaggaaaauauauguagccuaucucccuguauguguccccaauguagucuaccccugcugaguauggaagcucagguacacauaaggccaacauacccagugucaugcuggcaccuuucuguauucaaguacagaacgaccucugaggucauucaagcaccugucauucuaacccacgagacuccacuacugacaucuguugcucucccaaacuacucucauuuguuggcuuguacucauuagguaaauccagguuauucaaauccuuaguuccuuuguuuaccugaaguaaccucugaaccuuaaccaaaacauccauucuuguucacuacuucucccuuuuaaaaucauguuucuaguuaucuguaccucaacuccuagauccaaacugucuaaguuacuuuucuauugcugugauaagacaucaugaacaagacaaccuauagaagaaaagaauauauuuuggggcauuacaguuucaguguuagagucccugaccaucauggcagggaacauggcagcaggcagccauggcacuggagcaguaacugagagcuuuuaucugagacacaacaugaggcagggaaagcuaacugggaacugcaugagcucuugaaaccucaaaguccauccccagugauauaccuccucuaacaaggccuucuuaaucguucccaaacauuucaaccaccuggggaccaagcauucaaauauauaagccuaugggaagacauucacacucauaccaccacauuuccacucccuggugccacagguuugcagccauaucauaugcaaaauguauuuuguccaccuucaaaaguucccauaguauuucaaucucaacacuguuuuaaaaucuaugucucuucugagacucaaggcaaucuuguuacaguaacuccauguaaaagcaaaaaguaaaucauacauuagcacagaauauacacauuagcuuuccaaauggaggaaacagacagagugagaaaauacugagucaaaccaagacugaaaaccagcaggacaaacugggcauccauagucaacauugcucucggcacugcugucuuccuauucagcccugcuuacagcauuuaacuacuuuccuaauccaaaaauccacauauugagccaaacaauagcacagugaagccugucacagcaauagcccacucccugguaccaccuucugucgauugcugugguaagacaccauaaccaagacaacuuauaguagaguuuauugggggcuuaagaguccauggccaucauggugggaccaugacauuaggcacaauaguaguacuugucaggucuggcacuugagcaauagcugagaacucacaucuuggacacaaccaugaggagagaaaacuaacugggaauggcuugggcuuuuaaaaccucaaagccuacccaguaacauaucucuugaaauaaaaccacauuuccuaaucuuuuccaaacauuuccaccaccuggggaccaaguuuuaaaauaugugagucuaugggggccauucucauucaaaccaccacaaccaucccagggccauuccuugccauaugcccauccauccccuggacaccuuauaccauccccuguuaugaauacaugcaugcacauacuaaagcguacaugcauguaugucacaaagucuacagauuucaaaggaaggacugucuuugcuuucucuucaaaggacuauuugguuaacagcuacucuauauaugcacaucauaaacuauggauggaaugagucuguuaaggcaacacuuaaugaaguaauaauaaaaacccuaagcaaaagagauuaagaaaggccaaugauaucagaauguuuaaagagaagcaauaugcgcuugcguaguuucaaaacuuuaaaucuuucauauaauuuuaaugaguguuguugugauaccugacaacuuaguaaucuauuauaucaaguauagacaauaacuauaugaaggauuuaccuggugccugugacccucuuauaauuaucuuuggaauacacugcuaagaugcuaaccccugagccgauguucaccagaagcagaggauauggauuuuuuaaaucaaaugguaacuucugacauuuuucagaaucagcaggguuuucaaaauaauagcacugugaccguccauugaauccaacugagucaauguauaaaauuccuuuuauuaagcaaucuaguucauccaguuuucgaagcugaaggucaccuaucuguaauaaaauaaaaaaguagucagacuuucuaauaaaccaacauuuuuuucugaaacaaaguaucacuguagccuaagccucaaauucuuuugcccccacuuacuaagugguaggacuacaggugugagccacuacaucuggcaaccaacagaaaaaaaaaauguaauuccauuuuaaaagacaucacuacacugaagaaccauuaaaagugcacccacagaugugugacauuuguaaacacuuuguagagcagaucuggggaaauggaggauggaccaccaagacaaacucuaguuccuauagacacaaauagucuacauacauacaaaguccuaagugagcagcagaaagcaggaaccucugcugauggggacagcagagcaggauacaguggaagccauggcuuaucagaauaccuagcaacaaaggcagaacuggcaugcuggguggaaagauagcucaguugguaagguuucugccaccuagacaagaggaacugaauuccauuucuacacucauaaaaugcuggguguggccagguggugguagcacaagccuuuaaucauagugcuugggagacagaggcaggcagaucucugaguuugaggccagccugaucuacauaauaaguuccaggacagccaggacuacacagagaaacacccugucuugaaaaaaaccaagcauacaaacaaacaaaaaauuaggugugguggcacauaccuguaauccccuagagcaggggggaauccccaaggcucccuggcuugauggcugaguuuaaucaaggagcccauuuggacagaacaauaccaaggcugaccuuuggacaccauguaaaugaacacacacucagggcauaugcacauucucucucucucauucauucauuuucucucucucucucucucucucucucucacacacacacacacacacacacacacacacacacacacaaauaccuaccuucaaaaagaccaucuaaaagcuaucaagcaguaucaaagacaccacauuuuacuacuuaagaaccugaaacugaagauaguucaaaguaaaguucaccuauaaagcaugacacccuggguucaguuaaaaagcaguaacaaaaaacaaaaacaaccuuuugugaaagaccuacaaaguguccaugaaaaguagucaaguccuauggcacauaccuguaaucccuauacucaggaaggaggaagcuugggaguucaaggcuagacucaacuacacgagauuuccagcucaaaagaaaaggcaagacuucuuacuaucuaauugguuaugacuauagcuuuuugaaagagcaaagcuuaauaugaucaaguuuaaauccuuucaucaacuuaauuccuuaagggaauuaauagggaaauguuaauuauucauauaauguaggaaauacagcaauccuaccuaagcagggaaaaugucaagacauauuuagucaaauaaggaacuauaaacuacaacuggauuugucuauuuuacagucauguucauauguauaugucuauguccaugucuagcuacuuaagauacagaaguccucacaguaacccuggagaauggcugacuaguuugaaggcugacuagaacaugcuaacacauuacaaaaguaggaaugccacacagccacugaagaacccaauucuguuacaaacuucgcuccucuuuaugcaacaccauucaauuauauuuauacucaauuuauuccagucuauuugagcaacaaaaguuaguaacuucagaugaauucuuaauuuccaauuagauauauuaagcucucuuccuacagaacccacucuuuagaugaucacugucgcucuaccugaccauccccucucaagguaauuccaugcuauguauguaucagcauuuucacuuccacauuaaauaccacaucacacugguagacuaauaauauuagaacccaaguaguuuuuuguuuguuuguuuguuuguuuguuuucccaagacagaguuucucuauguaacccuggcuguccuggaacucacuuuguagaccaggcuggccucgaacucagaaauccgccugccucugccucccaagugcugggauuaaaggcgugugccaccaugcccgggcaaguaguuuuugacacugaaugucaaacuaauuuuucuuucccagaauuuguuauucugaaacaugcagcugacuuuggcuaauuuguggguucuuguuucucccacccuucuccacccuuucaaggaacccucuaacacuagacaaaagagaaaaaagaauagaggggaagacaauguuguuguuaaacuacuuccugcugauuaggggcuuccaguuccuuggagcaaguuuaaucuucacugucagaauaucuaauuucuucuuugugcaggacuacucaacaaacuguaacuaacaacaaacaaccccaccucucaaugucacagcauuuauauaaccucucaaaugucacacaaucacagaacuaucugcagcuggcaaaaaucacaccccugaaugagacaaaucauagcuagcaacuguggacaaucugaaguagccccauaucccacaccugggauuagaauaaaaacauuauaauauuucuguguuuuuuaaagaaaccaaaauucucacuacagaaacauccuacugagcuacuauuccuaaugaguaucagcgcagaugucacacccaaggacucaucugcaaauauucuacuaguccagcuuucucagaauguaaguucaguaccaagaaucaaaaccaggaucaggaaaaccugaggagucaugguggugcacaccuucaacuccaguacucaggagacagaggcaucucugugugagucuugagccuaguuccaggccagcuagagcuacauugugaaacucugucucaaaaauaaggaaaagaaaaucugacucacauuauaaaagaaacccaauuaaaauauauauacauuauuaacuauuuuuacuacuaauacacuuguagcauuuccuuucacauguuuugucuguauacauuguguguguguaacuuaugugcacacguggagcuugaaagucaacaucaaggcuuucucaauagcucuucaccucaucguuugauucaaggucucuuacugaaccuagcacuugcugacugccuagaauggcuggccggccaccucugcucucuguacugagggcacaggcacagucucucagcuugcuaaugugggugcuaaggauucaaacucagucuucaugcucgaguggcaggcacuuuacccaccgggucacuuucccaacaucuuuucuuccauguaguuuucaucacuugagaacaugaacagaagacacccaacugccuaagcaccuacucuuuauauacaaaguucauuuugcacucuuuccuuugauucucacacaacugaggcuuguuaauggucugaaugauuuucuaauauguugcaauugagccucuacagugucuuggaaccagaaguuuucucuaccuaucaguuaugaucacugggagacucucacaaaggagaacuuacuauucuaugccucacccacauucauagauggaaaagaaaccacuaaaaaaaagugaacaacaacaaaaacaaaaacaacagugaacaagggaagaguauaaaacccuauuggcuaauucauguaucuucuaugcuaggauuauaacagucauuuccaggguggaguuagaggaugguggggagguggggggagcacaucagaaaagaacaaggccucugaaguuacacacaggggaaaggaaugagacauaaagacacuguuggagauucugcauacuaaccgguuaguuuuuuuuguuuugguuuguuuuuguuuuucgagacaagguuucucuguauagcccuggcuguccuggaacucacuuuguagaccagguuggacucgaacucagaaauccgccugccucugccuccccagugcugggauuaaaggcgugcgccaccacacccgacucaguuaguuguucuuaguuguucuuuaguccucucaauagccauugucaacucuuauauguaaccuaacaucuucuuaagacugucagcuaaaaccuuuggaauguguuaacagaccacuaaacuuaagcuuaagaauaucauuagacaaaaucugaaacuuauagcaccugcugaccuagugucuccaccaaugcauaaaugguuuccuucuguucuuuaaccucuuccacaaaaagaugucauuaaugucauucaaagcagcccaaauuuguguugccaagccuggcugcucauauuugguucagaauaacuuuaauuccagagaaguaaaagcuaugcuuugugcugacagagucaaaucuuccugugagaagcaguuacugaggacacuguucuacaggcaccgcacgcugaaagcuaggcuaggagccuggccaauucacuuguuaguucuugcaccuuugccacaucaaugcucaagagcccuagucucaagccuuuguaggucacaggagaaaagcaaaaccuaaugcccaguauuauacuggccuuaggaguuuagauacaguugagaaauuugguuggcaagcauagcacaagcugggacuauauuugccuaguuugaguaaaacagaucggcuaucagcuuuaaugccugaaacaaaccacuuuaaaauuuuuguucuauuuuuaaauauguguaugggguuuugccugcauguauacauuuaccacauguauuuaccuggauccccugaaacuguaguuacacaugguugugagucaccauguggguucuaggaaucaaaccuggguacccuagaggagaagccagagcucuuaaccacuuagccaucacuccugccccacuacuccucaaaaacacaaacuuuuaaccagacaugcuggaaaauaacugagguagcagaagagacaauaugagguacacaugauuggaaacaguuuugugcccagauagugugugugcacauuuggaaaucagaggacaaccugagauguuacuucucgggugucaccaacuuucucucgauucuucacuagccuggaauuccucauguaaggugaaaaaacuacccacugagccccagagauccacaugucugucucccuagugcugagacacuaccacccagcugcuuguuucugagauggucuauguguaucccugacagaucugcaacugcuauguagaccaggcuagccccaaacucaaugagaucugccagccucuaacuccugaguccugcugagaugaccaaaauuaagccaacuuaauuuuuuauuucugucucuaugugugugcgcugcccaagacaaccgcaaauaggcgucauauaucguagcucugaagcacaggcggcuuaugggcuguucugauguaaguacugggaacugaacucagguccuuccugagcuacuucucuggcccauacccaguuauuuuauguagguucuaaggaaugaacucagauccuccaaaccuuaccaacugaaccaucucccuaugccaggacuaaauuucaaaauguuguuucuuaacuccuuaaugagauggggugauguuauuccuuguaggcucuuauccccuacucuuaucccacuuuuaugcuuaucccauacucaaaaguuuucauacuaaagaaaugguaaaaugcuauguugauauauaccaauauaccagguaaguacacuacccaacaaucgcuacacaaucaacuccugacugccuaguuuaaauauauguucauuuccuuaagaauauucaagcuccauuagaaauggaaaugauucuaccacuuuuaaucggcaucauuuuaaacaucaaauuuccauaaauuguauauaagcuaaaagaugcauacugugagaaaauccugcucaaauuuguaugauccaccuccaguggcacaaaagacaguguggagacuugagaaguuuuuaucucugcccaucugaauaaaagcaggcaugucaugggugggaaagcguauaaagugcagauugccuuugcguccacacagagucagguccuucagcucaaggugcacgucccgaaugccuguggauccguaagccacauuggaggucagguacuuccggaugcuuuucagacucuccacuuccuccuuuucuucuucagcagugaugucuuuagguucaaaauaaaccagcuugaccaagguuccuccaauauccaagccaaaccauggaaaaacuaaaugggaaagaaaaaaaaaugucaaaauaccuuuuucuaaaaauaaagcuuauauuuacuugacuggcaacuuauuccauaugcugugguuugguuucuaagggauaaaauuuuaaacuaaaauguuuugaggaaaaaaauguaaaucaaaaauaccaaaguggggguggguggauaugggggacuuuugguauagcauuggaaauguaaaugaguuaaauaccuaauaaaaaauggaaaaaaaaauaccaaaguauuuugaaguauaaaugaagaaaauaucuaauaaaaaaaauaccaaaguauuagccaaacuaacucuucugugcagacaugcccaaacuauacuaugaacacuuaaaagcuaacaaauuaaguuucaacccugaaaaccaaaaacuguaaaugaaaaccuucaccccaccuccagcucagaggaaggaauguaagcgcucuaggacucacccuaacgugcuaggaaagccuaucuccagggucaaguccucuaagaaccuacucugggcuucguguacagcuuagugguagaguacuugucacaauacaucaggcccuagcuuaaaaauaaaaagcuucgaugaacuuuacauccaagcuaccugcuacucaaaaagaauuccaaacuuaaacaaauagggggcuagagagagcaccuacuuggcagaucaugaccacauuuaacuacaguuccaggggaucugauacccucuucuggccuccauuaauacccucuucuagucaugcacuuggugcacauacauacaaaccauauuuauaaaauuaaauaaaaaaauaauagcuucagaaacauaaauaaauauggacauauaugucccuucccaacccuaaaucaagaaaugacuaauaaaagcguaaguuuacugauauucuuuccuaaaaaaaauucuggaaaacacacacacacacacaaaaccagcuagucaguggcuguccagaaccaucaaaaggaaugcuaauaaaacagaaagcaacugugaaagugggaaagcgcacaggguuacucuacccaacaacagauggaauggcugcccagagcaagcagccacgacgauauggucaggaaauacauuuggaggaacucaucaggccaccaauuucucucuaucaagaguacuucucugacagaggcaaagacucucuucccugaguacaauggaucugagucaagguggcaagcacuuggcugcugccauccagagaaaagacagccuccaaaccuggccaccuacaccccaucucccacuacacuccaucccauggccuagaacagaaucuauacccacugacagauaaacagcaacucucacccaaauaugaaucacaaaaaagaacacaaguacccccaaaaauaaagcgucugaagaaagguuucuaagaauagugaaucgcaaacaucuucagacacaacgugaucucauccaugaaacaucaaaaacuaaaaacuguaagaauugccgggcauggugacgcucgccuuugaucccagcacucgggauuucugaguucaaggccagccuggucuacagagugaguuccaggacagccagggcuacacagagaaaaccuaucucgaaaaaccaaaaaauaaguuuaagaagccagguacagugugaugcacauuuagucccagcacaggcagaucugaguuccaggccauccagugcuccacagugacaccucgucucaaacaacagaaaagaaaccauauuaaaauuucagaaaacccuaugaagaaccuaguucuuaagaacagacauaaacggcugggcaccuuuaaucccagcacuugugaggcagaggcgggcagauuucugaguucgaggccagccuggucuacagagugaguuccaggacagccagagcuacacagagaaacccugucucgaaaaacaaaaacaaaaaacaaacaaaaagaauagacauaaacuacacaaagguaaacagugcugcucuucaucagcaacaaguguguuaggagacaaagacacauaaacuucaaaaaaaaggggggaaaaguuuaaaaaguguuaucuagucaagcagcuuccaagaagaaauccaagagagacuucacacacaaggacugccacucaaagagucucugaaucaugugcaugcaaagcagcauaauuuuauaagggcucuaagaaaaaauuuauccauaagcuauaagcagagaaauaaaugcaugcugacuuuaagaccuaaaauacuuacacgauuucaacaaaggccaucaaggaagaaaggaguaggaagugaaugcagcacgucugucuuguaggggaaggaaagaagacaagagagcagcuggagacaagaacagaaaagggaugcuuuaaaacaaaacaaaacaugcagugguggugcauggcugcaauccuagcacucaggaggcaaaggcagaucacugcaaguucuagaccaacaugguuacauauggagcuccaggccagcuaggacuucaugagaccccaugauagauggagggaugcaugcaugcauguaugcagccccagaagagaaaaggaacauaacuagauacagggaauaacugaggguggggguagcucuguggaucuaaccuaggaacucacauaccauaauguauauaccccaagacuuaaauccccagcccuaaaagauuuugcaaccuuucauauucuaguagcuucauuuguguggcugugugcacacacgagaggcagaaaucaucagagugucugccucagucauuucucuaccauauuguuugagcuucucacuaaaccuacaacuuggauauacuagcaggccccaggauccucaucuccaccuccgcgaucaugggccugcaucaugcuuguaagugggugcuagggguacaaaugagguucuuaccucagcaccacaagcaccuuacaacugaaauagcaaauuuuucucuacaaauaauuaauuuacaaaaucaaagaugagggcugcagagauggcucagcaguuaagagcacugacuguucuucuaaagguccugaguucgauucccagcaccacaugguggcucacaaccaucuguaaugggauccaccgcccucuucuggugugucugaagacagcaacaguauucacauauauaaaauaaaucuuuaaaaaaaagucuucucucucaaaaucaaagauaaaaaaguucauauggagagauuuuuaaaauuaaguagcuuugcaacaaaaguuuaaaagggaugcuaagauuagcuacaagaaaaaaacaaacucauuaaaaaaguagcucaaaggacagaagcugacuucuguaaaaacaugaagacaggguuggcgagauggcucaguagguaagagcacugacugcucuucccaagauccugaguucaaaucccagacaccacaugguggcucacaaccacccuuaagagaucugacacccucuucuggugugucugaagacaguuacaguguacuuauguauaauaaaugaaucucuggggccagaucgagcggggacugagcaaucaaaguugaccagagcgagcggggcuaacuguagugagugggguuuaccaguucuaaaaauucaauccccaaacaaccacaugaagucucaaaaccaucuguacagcuacaguguacucaccguaaacuaaauaaaugaaucuuuaaaaaaaacaaacaugaagacauaaaccuuaauccccagcacaaauguaaggagcugagcaccucagcucccaucugcaaccgcagcauuccuaaagauaaaugggaaacagagacaagagaacccccagaaauuuaugagccagcuagcaaacaaagggauccuaucucaaccaaaauggaagacaaggaccuacacucaagacuguccucugacuuucacccccgugccaaggucccaugccugcacuuauacacaaaucauacgcacacacaaaagauuuuuaauuaguucaaaaugaaguagaaaaaaccuugaagaucaaaagcacuaaaaguuuuuaucacugaugggcaguagggggcaggcccuuuugguuuccaaacaaaaagggacacuuaugaaacaacagcucuacucugccaacaccaauguucuccaaaagccaaggaaccccuuuucuaaauuaguauugccaagcuacaaaaagcuucauuuucuaaacuaaugaaauugaaggguauccugugauugucaaugagucugaaaaucaucaaguucuaaagaguuccaugugcucuagcauacaaggaguccucuucagaggcagagcuuguccuccaaauacaagggggcugugaucccagagcucccgugcuucuuacauacuguauacucuacuauacagacauugcuaaggcaauguauuaccaugucuucucuuucuuucuuaaaaaaaauguauucauuuauuauauguaaguacacuguagcugucuucagacacuccagaagaaggcaccagaucuuguuauggaugguugugagccaccauguggcugcugggauuugaacucaggaccuuuggaagagcagucagcgcucuuagccacugagccaucucuccagcccaccaugucauaucucaauaaaaaauuuagagguuuaacuaagucuauuuuuccaucuggaaacugaaagaaggauguggcucggugaauaaugacuuaugcucugcaagcacaagucccuagaaaccauaauaaaaccaacaaggacaaaacucagcacagcugugcauucauguaaccucaacauuagagaaugaagaccaguggauuccaagaucucacuggcuagccauccuuucugacaggguauaugaugagcuuuccauuggagacccugacucaauagcacagcaauggaggaagaagauaccuuauauccugcuugggacuguguguacacuuagaugcgcacacaccagaauacucacuugcaugccacacacacacacacacacacacaccuaccucacuggaugagaccuagauaaaauaucugaggguuggggggagaggauacaguguuuaacacacaaucacuguuaacuguagcuauaccaccccaucagcaucuugcugccauaauuuuuuaccuauuuaaagcaaugguaaaccugccaaguauuugccaggcaagaacucuaccaacugaguuauaccuuuaccccauauucccuuuuuuaaaagacagaaucucauauucucauacaucucagacuagucuugaauuuacuguguacccaaaaaugacuucaacuuccuauccuccugccucacccuccuugguggucggauuauagcgggugacaccacaucugguuuauacaacacuggaguucaaacucauggaauccugcaugcuacagccccagucuucauaauuucuuuucuuuuccuuuucuuuuuuaaagauguauuuauauguaaguacacuguaguugucuucagacaccucagaagagggcaccaaaucucauuacagaugguugugagccaccaugugguugcugggauuugaacucaggaccuuuggaagagcagucagugagugcucuuaaccacugagccaucucuccagcccccuuaauuuauuuucuuucuuaguuauucucuugugccacagcaugugugugacacacacacccuccucaaucacagaacuuuccagaagucgguucucuccuuccacuguaagacagggauuguuucuauuucuggcugauucuccugucucugccucccaucucaguguaaaaaggcuuggaguagagacggggucugaggaucaaauugagguaguaagguuuguaugguguuguauaagcacuguccucugaaccaaagagccaucacucauuccaccugcuaaaauuuauuacaacugggcucgcugacugcuaauauucccucacagaaagaggguagggagggucacuggacccucaccuaaguaccaagccacuccucccagucaucugugugcaaugcugcuguaacugaugauugcuucuagggaaggggccuuacggaagccaucauucaugcuaagcccagacuuugcaauguggcugcuuuaggcuguaaguaaccuuaaccaacucauugguucaucagugugaacuacugugggacugaacuuugcaguuugucacuagaacuuugggagaagagggggauagaagcugucuucuccacccaaggcaaacuucucacaauaccuaagugcuuuacccacuaaaccaucucccuggccaauucccaaaauuuuaacaucgucuuuauuugguauuuucucauccugugauauauagcaacuaccugaucuaaaagcuuuaaagaacuucuaggccaguaagauggcagguaaaggcacuugucacuaagcuugacaagugaguucaauuccugagacccacaaaguggaaggagagaaccaacuccuaaagcguguccucugacuuccacaugugugcccaaacacauacaauauuuaugcuuuuuuucagaauucaguauaggguuuuguuuuguuuucagauuuuauuauaguauacaaguguuuugcuugaaugcauguaugugugccuggugcccuaagaggugaaaagacagacagauccucuggaauaguugugaaccaccaugugcaugcugggaauccaacucagacccucuaacaaaagcaacaaacuuaacuacucaacaaauucuccagcccaaauuaauaucauuuuuaaauacuuuacauuucauacccaugccucuuguaauacagaaguccaggaugaaaccagucuggaaaccacacugcucaauuaacaugugugguagaacauuacuauaaaccgggaucacaaguuacaaaacaaaugagcuccuacuaguuucaacugccuaagcaugggggcaacaugccucugaucaggaggcagagcccggcagaucucagugacugcaaagcaagcucaucuacagagugaguuccagcucagccaaagcugugcacagaaacccugucucagaaaggaaggaagagagaagagaagaggagagaagaguaguauaagacaauaaaacuaguguuucuaaccucggauggcuuucuaauagacaaauuauuaguuaucaguggauucucucagaguuaugacuaaaguaugccauuggaacagccaauaacugcauucuccauccaguagggaauccuuggguaauacagaagaucaaaugguguaaaaacaaacaaacaaaccaauauccuguuugaauccuggaguaguagcuuuguucguaaucuuagcacucagaaagcugaagugggagaaacuguuucuucagcacauucauuaucugaaauagucuuucaugauuugucauacaaucagagaaagcaaagaaaaggaauuggccaauaucagacaccauauuagaaaaaaauaaagaaaucagagguuggcaggauaggucaauggguacaaaugccuauuuucaaacacgacuaccugaguucaauucccaaacucaccaaguagaagagaaacaauucccacagguuguccccugaacuccccgaauaugcccucacauacacacaaauacauacacaacaaaauaaguaaauauacaaauaaguaacuaaguguaugugguuuauuuaaacuuggaagggagggagggagggaaaagagauguaguucaguguauagaacaugcaaaaagcccuaaguucaagacccagaacaaaacaaagcagccagagaccaaaaaaaaaacaaaaaaaaaaaaaaaaaccuauaaucccagccuucagaaguucaaggacauccuuaaccauaaaaucugaggaucaccuugggaaacauaaaacacaauuucaaaaaguaaauacagaaacucaagcuuugucuauguaguacuuuuuaaaaaguucugaaaccauaguaauacaacacucccaaaugucuuucagaauuucucuuggaucugaauuacuuauuuguaaggcagcuuuuuuugguuucguuuugauuuuuguuguuuuuguuuccugaaacuguuuuucuauguagcccuggcuaaggcagugucuuaaacaccucucaagauucauauuccuucuucucuuccuuucuuucucucguuuuuguuuuuuuuuguuuguuuguuuguuuuuguuuuuugggguuuuuuuuuuuuuuuuuuuuuugagacaauguuucucuguguaaccacccuggcugcccuggaacucccuuuguagaccaggugggcuuugaacucagauaaccaccugccucugccugcugagugcuaggauuaaaggccugcaccagacagauucuuuuugguuuuugagagaggguuucucuguguagcccuggcuguccuggaacuugcucuguaaaccagccuggucaugaacucaggaaucugccugccucuaccucuggcuugcugggauuacaggcaugggccucacaucuccaauuccuaauccaauuacugaauugggcccagcaacuuguguucuaacucuccaugcaugugaaaaugugcaggugcaaacuaauguucauuugugugugugcacggguguagcuccucaggugcccucuacuuuuugagcuagugugccucacuggccuggaacuuugccgaguaggcuacacuaacuagccagugaauuucuagggaucugucugcucucccauguggccaucaauggcacaagccacuguaccccuagcuuuuuuaccuggguucugaagcaagcaauuuacugaacaagccaucuccccagcccuguaggccauuuuuacauucaguacuugcuagucauaacuuuucccaagacagccuugaacacacacauacacaagucauguuuauuuuggucuaaagcaaugggaaaaaaagaacaauucaauaaaacaguagauagagccaggcagugauggugcaugccuuuaaucccagcacuugggaggcaaaggcaaucagauuucugaguuugaggccagccuggucuacagagugaguuccaggacagccagggcuacacagagaaacucugucucaaaaauaacaaaaaacaaacaaacagaaaccaguagauagaaggaaaagcacaaaggcuaaaaaaauuccucaauugcagaguagcuacuugucagugggcaccauucuuuuggucagugaaacagacuaucaccacauaccuaccacaggaguucaccaggcugaauugugccagacuaacaacuaaucaaaaacaacacugcaaauuuggugacauaaucaucuacauauggcuaauugucacauuaacccucuaacauugaugcucagguuaauguaauacaaacccacaaaggaacuucagguuuuucuguugcuuagaaaucaggugcuugaugcacagccuauaacuucagcacuugggagcuagaggagaagauauccuggaacaugagauugucuuaaaacaaaaacaaaacucaggugcuuggacuggagauacuauauacagcucagagacagaacauuuaccacauguacaaagcccuguguuccaaccuacaacugaaagaaaggagaaaggggaagaggagccuggcacuggcacaguauauacccagcacugaagggucugcccugaggacgaggccaacuuggguaauucaucagacugcucucagccgggcgugguggcacaugccuuuaaucccagcacucgggaggcagaggcaggcggauuucugaguucgaggccagccuggucuacagagugaaguuccaggacagccaaggcuacacagagaaacccugucuugaaaaaaaccaaaaaaaaaaaaaaaacaaacaaacaaaaaacaaaaaaaaaacaaaacaaaacaaaaccugcccucaagucugacaaccugagcuccauccccaggacugggcaaaguuguccucugaccuacaccaauacagacacacacgauaaauaaguguaauaaggaaguuauuuaucaagcaaacgauucuacaacaggaacucuuugaaaauccguuuuccuuuuuucuuuuaggacagggucuuaaauuucauauuccucugccuccaccucccaaguggcugguauuauaaaaucucuuacaagucgagaaaagaaaaaaaaaauauauacauauagugauauaaaguacuaaacauacauacauacauacauccuccaaaccuuccauggcaaaacagagcuacauccaaucgcucaaaucaucgauaaaagcaacuggggugggggugagcagguagggcugggcgcggacuauccaacagaccucacacaucaagccacuucccguaauucucauagccugccugcacucagcauuuaccuuccucauaccguaaucugauauccaggucuuaaccacauguaaaacacagacagcuaugcugaaaaguuccuauuacaguauuaggacaauugacacuuucagcaguagucguggaugcuagacaacagcccuaaaggcuuuaaaggggagaaaacacacaagacaagaaacacaaauugguaauaaaaugagaacccgauucucugaaaagaguaacucccuaggcuuaagaguaacugaggaacaggucgacucccuuccaaagaaaaggcuuuacugcccagaaugcuauggcugaaaccggaauucccgugaacuaacggaagggaaacgggggaaaaccucuggaugcgagaugaccugaauucucucgggaagaaaaccgagcaaagcuuagaagcguaucgagcccagagucgaguuuugggccugcugcgccucaggggcauuuucuagcaaccuccaaauuaaucaccauagaaaaggcuucaguugugagcgcgauggaugauucaaagggacuugggagaggaggagccuucucaagaaaaaaagagggagucucaggaaaagaacaccccaggggacagggaggaaguggcggggagcccucgcgcgggcaccgccggcgcgcaaacaacgacggccgugccggggcacuuacgcggccgccucuuccggaggccuucggcgcgcgggcggccggccgagguggagccgccuagagagccgggccgcucccgucucacacucuccgccuccccggaccccgacggcgccgcgcuacucgcccggcgccucagcgggucccgccuccgcgcuuccgaguccgcagacucgccgaccgcggcugagguggcggcagcccugcccuggcgcuccauaggcgcgccaaaccggcccgcucccauccgcaacagccgccgcugccgcccgagccagccccccagcgccgccuugccgccuccgcgcagcccgcuggagcg

SEQ ID NO: 1105 - RNA, 1821 nt, Mus musculus
aucagauuuggccccauucauccuuugaguaaagccaaagagaucauaggucauuggcuggaucacaaguuggcuaauacggcaucaaaucuaacagagugaggcagaugggaguaggagggucacagaggaccaaugccaucugugcaccagcaugggagagagugggaggagcagggugggugacagugacaucccucagcacacuggaucagcucaggagaccaugacuaugaaggacacugaucacugccuguguaauccacggcauugcuuuucucaccugacaaacgaagggguaaaugggcugcugggacugccaagcuugccaagcuugugccaucugcuuuaaagcuuucauugagagcuuuuccccuuuguugcgccaugcgugaccaguggcuugcuguucaaggauaaggacagagaggcucuacugcagugcucagcuagcaccugucuccaguuaccccgcauuaacuggcccagacccacaccucuccuacagcucucacacaaggccuucauggccagagguagaucacacgacuaccuugcaugaaaaacuggggaaguggguauggcuaguugaaagaagugguccaaaguucugccagccaaacccagccugccaccugacucaguaccacccacaaacugaaagugggggaaagucaaaagaauacuauuuuauggcauuaugugaaccugaccaugcaauaucuucaguuuugccucuugauucacaaaaccuacauuuauuaccuuaaccuuuauaggaaauccuacuaaccuccaucuuaggauaccauaggggaaucacugacugcuuccuggacuacuaccuggaccagaacaggguucugccuagcaagaaaccucagaaaaaaucagcccuaguugucuacaacacuuguauuccguuauuuaaccuuuuuacugguguauauucauugugcauagugaugaguuauuuaaucuucacacagcauaaacuaagaguuaaccccucuuuccagucccagggacuggaauguaucugccucaaggauauuuucucagcuuggccaaauuguaggauuuagaaagagaccagagaaaacuggaaacuaaccagccaccuaugccaagguggcagaucucacuguuacaacuacaggaauaggguccggaagcuggucccaucagggcacucacagggaagugaagucuguaagcuucgacucucacaaguccuaaugacuguaaaucauugaagggaagccuaaaugugucgggaaagcaacacaguaagcuugugggcagaggcugagguugugggccugggccagugaucuacagccuagcggauccugcuucuguuccugugcuucauuccucuccauccuccuggaugcucuccucucugucguccauagcgcauccuucuccaucccaccccaacccgguggugcugaguccuucauaccacugacuuacauuuccuucccaacucuuuccucuuguucugugccuguauguucacuaugugugucucuaaugucaucuguuguaagucuauuucagaguggaacaccaaaagacaaucuuaagaguuuuauuucuaaguuuguagucacccugguaggccagcuuguguuuguugugaacuccaccagcacaggagggaucgaaaugccuucugacucucuuugaccagccaauguucucuaaccagcagcaaacaaccuaggugaggucacuggauaaugcacacccuugauauuuacugagcaccugccauaugccagauaggugagaauaaaacaauuuauaagaaga

SEQ ID NO: 1106 - RNA, 17047 nt, Mus musculus
ggaccgacgggaccggcgcgcggggcuggcucgggcgcugcggcgaugcccgcgggcucccuccccgccacuugcucgcccugugccugggcucgggccccgacggcugcgccgugagaugacuuuccgcgacauccugagcgucacuuucgaaggaccccgggcgagcaguagcacugggggcuccggcgcgggcggcggagcuggcacgguuggccccgaggguccggcggugggcggcgugccgggugccacaggcgguagcgcuguggugggaaccggcagcggcgaggacaaccagagcuccacggcagaagcgggggccgcggcaagcggcgaggugaauggcucggcggccgucggggggcuaguggugagugcucagggcgugggagugggugucuuccuagccgccuucauccucaccgcuguggcgggcaaccuucucgucauccucuccguggccugcaaccgccacuugcagacggucaccaacuauuucaucgugaaccuagcaguggcugaccugcuacugagugcagcuguguugcccuucucagccacuauggagguucuaggcuucugggccuucggccggaccuucugcgacguaugggccgcgguggacgugcuaugcugcacugccuccauccuuagccucugcaccaucucuguggaccgguacgugggugugcgccacucgcucaaguauccagccauuaugacagaacgcaaggccgcugccauucuggcucugcucugggcgguggccuuggugguaucugugggaccgcuacuagguuggaaggaaccagugcccccggaugagcguuucugcggcaucaccgaggaggugggcuaugcgaucuucucuuccguaugcuccuucuaccuccccauggcagugaucguggucauguacugccgcguguauguggucgcgcgcagcaccacgcgcagccucgaggcgggcaucaagagggagccgggcaaggccucugaggugguucugaggauccacugucgcggcgcagccacuagcgccaaaggaaauccagggacacagaguagcaaggggcacaccuugcgcagcucgcucuccguaaggcugcucaaguuuucccgcgagaaaaaggcugccaagacccuagccaucgucgugggugucuucguccugugcugguuccccuuuuucuucguccugccucugggugagugauucccucacuuuagacccuuccccucugggcgguccuuaccuggaaagcuuagaugacccacaaccuaacuguggaaguuuaucaacuuccuguucucuuacuagagagagagagagcgcgcccgagggguucuugauacuaauguguuuucccuuaaacaggcuucucacucuuucuuacccuuuguagauguuacaaaccucggucuugcuuuaguuccuuggaaaucugagcaaacaucaaucuguaugaugugaucagugugugugauccccauagauacccaucucuggaaauagauugugggugagcccacaugcauucacuggcagcagacccaagccagccagccaccuuguagcucagcagaugccagaagugcuguguucuccauagacauccauuucaguuggccccacugguaucugggagaacccugugggcuuucccuucugaaaucuucucuggaagagguuagaggaggggacuugugggggugggaaggacaggauaggaagucugucagguggacaauuacuauuguuuauagucauuuacagagugaacuaguucccuuacaagggcccugcaguccuggggcagguacaacugcucucaagggauucuucgcacccccugagccucucugaagguccuggagcagggcccaagggccagaaccagcucagagaggagaaaggggcagccugucucaggcuuaugacugcaaccucuccuggugcaaccagggccucuccucccuuucccccaucugacugcuugaaccugugagacaaagucaggggaagaaacaaugaccugccuccugauccacugcaagucucucaccuacacacacacacacacacacaccagcaggagcagcagcagcagccacagugacuuuuguauaucguaacucgguugugugacccuucuacaagucccugaauguucucauacuacuugggaacaaaauccaaaaacugccuuccauagucuacagaagguagccuucaagguuauuauuguccauaccgaaauaggucacuauuuaguauuuacaguaggaccaugggcaugaacugaaggaauccccaacagauguccuccccaucugaaaggggcuauuccaggaagggcugccucucucuguccugcccugacccucaguggguuaguuccaggccaagccugucaccaaccucuguucuucccuuugauuauuucagucuggacuggccccaaaccucuuaccuaauuccaaaccugggggucucuacuuauaugccccuuuggcuuguguuucacaccuucacuggcuuuccagcuuuuccuuucaacuguauggucacugaacccagaacagcacccaggacggugccuggcauaugaggacauuguuccucacuggggcacgggcccuggugucaggcagcuugaguucaaauccccacucugucucucaccagcuauguagccucgggccuccgugucuucaucuuuaagugagaguggugaugguggugauaaccuugaccucgacauguguugugagagccagugaguguuagcaugaguguaacugaggcauaugugaaugccauacaccaacccccagcucaggagaaggaauaaaucccccacuugaaaaucaucaagccuggguccucuuugggaucggagagugugacagcagugaaguuggaagaggggaaagauguugcaaucaccugugugugugcucucccucccccaccccaaggccaucccacacagccccgcccuggcuuugccuuuuggaaccuguucaaagcaccuaauuccccuaccugauugugucuuggcucaccccaguaccuacagggaaugcucggccugguaggaaaugucaccuaccuuuuuuacauuuuucuuuaauucuuuucaaugcuuuccuguugcagaauaaagcgcaaaugaggagaaacuaauauaauaaguacccauggucuuguggucacccacacugagcuuguacuggccuggccauaucuaucuucuagccccucuccucacugcuuucacagaauagaugacagcugaacucagugccccuuccucuuccaccuccccagagaggaugcuggcacuuaccacucugaccacauacauguacugaugcucggacuacacaugugugcugaugcucggaccacaugugugugcugaugcugggaccacacgugugugcugaugcucggaucacacgugugugcugaugcugggaccacacgugugugcagaugcuuagacuacaugcgugugcugaugaugcucagacuacacaugugugcugaugcucggaccacacgugugugcugaugcugggaccacacgugugugcugaugcuuggaacacacgugugugcugaugcacggaccacacacaucugcauucauuuugauccgcagcacuguucugugugucuucggaaucuguaccaauggcacccacugugcaucuccuuuucagucugcauuuuuuauccaacauuauguccuugagauucaugcaguguggggccauuauuagugcauuggaaaguaguugcauggugugucgauccaaucuccuccugaauauuacguuguucucaucuuucguggcuaaaguaaacauagcaaaagacugcuacuaaagaggcccagaucacauguucccaucuuccaggaaaucaugucuaaauccccaugacucuugccccuuguuggcaugcacugcucuuucccugucccugugucugcugcuccuccuacaugcuaugggagccuuaaagauaucuauaucugucuccaagaggggauuacauggauguaugaauaugcaaagcuauuaaguuguauguuuuaggaugugcaugccaacucaaauuccuggcagagcuuaauccuggggaguuggcagugacaagcaaacaggacagaugccaagcaaagaagcagaauauuccacucugcccuauguaguuuggagggcaaagaggaaggcagaggcugcugugggagagagugcccuggaggccguugaggcaggaagggggccaggaggcacagacaugcccaaggcuugcaagggaagaugugcccaugaaugagcauucuaagcugcgacacuuuguggggaauauggucuucaaggggccaacacgucuuaccuuggaggugauaggauaaaggcuucagggaauuuagacagagagguuugggaugaggguacuuacaggagcaugggguaucgucuuccaggaagauagcaggagaaggauggaagacaggggagcaacuauuuagaaagaaccaaaaggaagucaggaaagacagcuucgagaagagggaguacagcugcacaggugggaaaccuucagguccacaugagugugccagcugugacaagcaccagacagaggcacugggaaagcuccgaugucugucuacaaaggccauggcuauagacaugaaacaaccacacggccacugucugggagccacuagcagcccacagugcugucauucacaccauucauguucaggagacccagaagcaaugcagauguagcuggugagcaaucacaacagaugugggguagguagagcuugagaggaaagucugggaucccagaggaugcuagaacugagagcugcagacugugaccuuccagucccaccaugcuggcaggucauagcaaauguaaccugaacacugaggaugccgaagcaaucugcuuagugagaccuuguccccuccagaaagaguaaugugcuauuggucaagcaaauauccugcaaagagggaccaacaauaacaggugugcugaauugugaggcuucuugaggacagaugccaggcacgcaaaaucauaaaggucccagacaagcgacggaucaucuuauuacgucauuuaugucuaccucacucucuccaugaggaauaagcauggggcauauauuccacagaaggaggcagaggguacuuaaugggaaccuuagacauuaccugucuauacuacauacagcuccaggcagcacaggaaaggagcuuccggugccauucugugggugcacaccagcagcccuugcccuggcaaauagccacaggccugucugccuucuugcugugcaucugcacagcagcacccccacagacaaggcugaacugggcugugcuuccugaucacucgaagaaacacuccaagucagacuggaaagaauacagacauagccuauguggggggaggggggaaagagcucuugacagcccugccaaggacagacacauuuccucuggucccaagcaagcuggcauaggucuaggugccaugaagaacaucauaagaagcuauauaaauggacccugguuacuucggugugugugggcaaagguagcagucagagccacuaccuaggacuucucugaaaagcuucaagauggaggaugcuagcauaagauggaagugccaccugaucagagcugcugucccugggacauguggugcaugggucugaucacccccagccauucaggcuaaguguuuaguuagacauaaggcagccucuccuaaaugccuguuaugccaaagggagcuaggggacagggaccccggccccucgcaagugcccaguugcaggaaagcaucuguuaucuucagggagccuuugggggucauaccuguccucagagucuucgaggcucuaugaucuauauggcaagcaccccucagugaggcucagaaguagggcugcucuggaaaccuccacauacagggugcagccucaccucuugccuuccgaugacacuggcagauccuagcuuuucauuuccaucucucugguuuuugaccaagcaucacuggcuucugcagauauuuuauuuuuugcagugaugaagacuaaacccuaagagaugugcuccaccacuaaauuauaccucuaggacccauuguuagccucucaaugccaccacccagggcagcuucagaggcucugucaaaaguucacacagcccauccaaaaccaugagcccauuccgccaucugggagccauagcugggccucucuuucauagccugucuccaugguacggagaacaucucugacccucagacauaguucauugcuugucccaaugcacuaggcugucaacauucaguguacaccagugugaggccaaagaaucuuaccugauaggcacagaagaguggcaguguuggugggaaacccaggcuugacagaccuagaaugggcagucugugggaaaacauauccagagaugaagcccaaacaggagaauggaaaaauaaacagcuuagucauagacuagacuacuauacagcaagggggaaaaaagugaauuuuauggacauucuacuggacagaguuagccagaucaggaacauaguauguauuauaugauucuauguguuagacauucaaaaacaggcaaaauccaaucaaagugauaauuuuuuuuaaaaaaaauaucuggauagugguuguguguaauggggacaaugagugccgacugaaagugaaugcuagaacuuucuguggugcuggaaauguucugugucuugcucagggccaggugcaagcgucuucaucauguuacauauuuaaggcaugcacacuuaccuuagugcaugcaaauccaaaaaccuggucugugucuguguggcaccuuagcagaguaggugcucugcaaaucugugcagcucagggaagugacagagcccgugccuuugcauauccugcguuccaagggucuggaggacacagagcagccccaugguuuauuccauuucauuuuaguuuaucagagucuuguauugguuguuugcuuuauacuaaaaucgugggugcccacaauauuauuaacuauagagacaguguggugcagcuggucccuagcuccugucaucuuaccagacugaagcuuuaacagcuccuguugaaaaacugagguccaagaagaggcaucauucucugguguucaagauauuuucuagugccauggggggggggggcaucugugcuauuguguggugccugugaggugugugcuugaccacaaauugucuucagaaaccuuuugagaugccuucaggauccaugugugcccuugcuuuccaggcgacugagaguuucaggcuuggcugguacuuuuccggcgccagaccuggcuuucacuguuucucuuucaugggaagaugacaguuagcaggccacaaagugaguccucagcugcugacagacacugucaucucguuuaccaucaguucugguccagguucagguuagggauagaguuaagaaauacaauacuuuuaggaaacccagaagcacuuaucauaccuaauuauuagggucacaaacugucucccccaacucuaauuccuggucuaggcaucagcgaggcaccauuaugcugagucuggucuaugauggcaccucacccuccagacuagauugacucccucuccucuguccuuccagggccauguuagagucccugggcccaccuugcuccucucucaucgcaguggaucucugugugaguccaccugcucuguccuccauccuuggcucucaguauuuugaguucagccucagcuuagcucuugccucccugucucuaaccugugccucccauuccugagagccagccaagcccaugacuuagcacuucacuugcucugagcaccuuuaacuccuucccauaucuuaauuccuaugagucucaaauccagaacugggcccaccauucucccaggcuguaccgugaugugcugauuaaugcguucucauuggcucuggggugauagggauuuguagcaucuucccauuccuguaguguaacuauccucaucauagacaauuguguuacugaaaaacaccaacacccagguuauaagauucuugagaaugggacagucagcuuuaagaguuacuacaaaccaucuagcugagaaugccaaagaguuaacaacucuaccuagcucucagcccaggggcagccucaggguguccucgggcaccucuguagauuuccuucagcuuuaauucucuuaaguucuuuccuuucuaguggaucugcuucuaccaguuucugccaacccucuguaucuuccgucucccuucauacgugcagcacaagacccaccuagagcugucuugagauaugcacucgcucgcacgcgcucgcgcacacacacacacacacacacacacacacacacacaccgcauaaggacuuccuuuccuuaugugggguaucuuuccucccucauagcuacuuguaaaacaucccuugucacuuccuaaagaauauucugauauugcuccuccuccuccuccuccucuuccucuuccucuuccuccuccuccccccuccuccuccucuccucaccaucaugucucagcccucucagggcuagcuuccucucccacaaggcacauaccugccuuuggcacugucaccaguggcaacccaggagucacacuccagggugguuucaaguccuuucauccucuccugaugugucagccuugccucuugaacucucagcaucccuccggucuuacccucccugcacacuucucuggugguacccucggccuccuuaggagguccuucuucccccucugagccccauuuaacuucagguccacauucgaggccuucagaccauaugaauuuucugucuugcaguaacaaauggccauugauuuagaggcuuacaacaaugaaucaucuucugggguugaaggucaaaaguccuccaaucaagguccuggcaaggcugucucccuaggggaucuagggaaaagaugucagcugaccuucugcagucugggagacagcucuggucccuccuccuugcacgaguucuguagugugcacaucacccccugacucucacccccugcuugggacccuugugccaaucuggcuuaauuguagcagcuaugaaaggucuggacauccugggucccucaccccaucugcacucucacaccccaacacuugagcucacucccccugagccugcuaguuaccacgugcaagccaagccgcaucucucaucacccucuggugcccacagcccgagcaucacccucacuuccucuuccacccccacugagcaucuuucucuucagccugucucguuuucccacucccaccgcccuuccuaaacaaaucagccaaauaucacacguguccucugugccgacuacugucaaccuuccuagcaggagcugccccuccuaacagugccaugaggucagugcugcugugcgcgugagaaaauugacagggaggcugaauaaugugacaaagcucccagcuccuuagcacaaggucuagcauuggaacccggggcacuuuggccccagaguccuuguuauugcuugccugaaugagagacuggguugguccaggguaaaaugucuguagccauauuuucagcguuaaacaucacccagucccucagccccugcacaaaucccccaggcuccgugccaaaugcccuucugcacuagcugcgggucgugaggaggaucugagcaugcucauagauccuagcuucuuccuggguagccugggcucugacagaccaaagcugaaaccccaugguucuugaguuaagcccuggguaguggaagauuugccuuccccacuuugccagugacgaaacaaaacagauguuggcccugugcuugggcagugucaagguugcucaaugcugggacaccugcccauggugaccacuuccaggaggaaccuucuguccuaggcagaaguuucuauccugcacaaacccaggagcacccuccgugcuguccagagaggcuucuuagagccagugcagccucagugagcacagggaccacugcaugccugcagacccugucacucaacaugcaugaggccacagaguggcucaggggagaccaguaagggagugacacagagugggggaagaaugggaccagaaugggagcauaaagggauagucagguggaugagaagagauaaucuguagaaccuggcacauggcucacaggaggccagagucugagagccugggcuuccauccaucgugaacucugagagcugcccuaccauguccugugucccucagcccauaacagaggccaaggccaagguucucugccagcucuggagagccaaacaguccugaagcaggcaaucuuggagcccugaagaacaucuggcccauuccugaucuaucucaaacaagaagacucugccagugacccuucaucucagugcccuuucaguaugcccuucuguguccucuuaaucucuaugggguacugaucucaccuaggccaccucuuccugacagcccuccaugauuguuuucaaauguuucuuuucauucucccuacuucccucccucuccucugcggccaucugaacuucuuggauuuuucucugcacuucgagguauucuugcugccucaggaccuuggcucaugcucuuuccucuaccugaaacuuacuuucccaagaugaaugucuagcucgauccuuauggggucucccuuacagauccucaguucaaguacuuuaucagagacaucugucuggcuguaaaggaccagaaucucuugaggaggagagucugugagcaccaaauguccaacugagagauaaggggcauccuggguuuguguuccuucucuccugacccugcuagugggaugaggcaugaaggaguaucagaagauggcagguuucuaccuccuuggaucucucagccagagggcuagugcucuccagacaucaguaauggauggagugcaaaaguggggguggggggacacagccugauaguucauggucagccgcaacuuaugcucagggcuggcugugaauucugauaaccugccaaggacaugcuccuuucuggggaugccagaagagacuguuagucacagagccugccccucggccuuagagcugccuguccuccccagggcuugaccuauuugcucaugucucucucugucuuagcccagaucccaggagcuccucagccugccuuuuugcuccuugagagagaacacuggccugggauaaaccagcuaaaaggagccccugccuucacuggcccagugugugccaggcugggccagccagcacauuuaccugcugaccggacagaugcuuuugugaccagcaauguccacacugcaggacacuaaacuauaccucuuauaccucuuauugguguuaggguguuagcaggcucugugacaaauccugagacagcuaacugaaaaggggagagcuuucuuauugggucauugcuugggaggcugcagucugauuggcuggcuggccguuugggggcaggugguggggcagcaugucauggcagcagugaguggcuaaaaacagaagagaaugaaagagagagagagggagagggagagggagcuaaauccucuagcuagucccuagucccuacuuuuuuuuuuuuuuuuuuuuuuuuuuuuuuuugguuuuuugagacaguuucucuguguagcccuggcuguccuggaacucaccuuguagaccaggcuggccucaaacucagaaauccgccugacucugccucccgagugcugggauuagaggcgugcgccaccacaccaggcuuuagucccuacuucuuaaagguuccaccaccucccaggagcugcauagacuggggaaccacacuuuccagaaaacuaacaccccucguacaggacuugugggaaggcaggugggugcaaccaagccagcaggguggaaacugaacaggggugugggugaggggcugagggaagcccaaauaggaggaccuccuugugucuaaacggaaaguagguggaaggcaccccguguggagcugucacuucuuacacacugccagguauguaagaagagcaucagggacaaccaugcguaacaacccaaaagcaagagaagguaggccaucacagagaacagagugcccacauagcucaugcaaagacacacugcagacagagagugccagagcagggcugcagcacugggggacuggagaaagguagaggcuacagcuggcagcacacaguagccuccuugguaaaaacaacuucuaaagcaaguuugcccagcugggcuuuguacccauaagaaaucagagaaugauguucaggaugggggagugagcccacuagaaccaaggaggagugugcccgaguacugagagugguauagccucagccccaagacuccuguauacccauugagacuuucauagccuuagucuguacuguguugcuauaacaaaauaguugagauuaacaaccuuauaaagaaaagagguuuauuugucucucaguucugauagcugggaagcccagacaacaucaucaucaguaucuaggaagggcuuaugggaacaacacagaauggaagagaauggaaggggaaauggcagaguauaagagaaauagauauaugugguggucuugcuuuauaucccagugucaugagaauuaucccagucuuauaagaccuggcccacucccaccagacagcauuaacccuuccaugagaauggagcugcccccgccaccaccaccaccaccaccuaccuuccacaaggccccauccauuacacauugucccaccucaauaugcacugagggccaagcuuccgcagcaccgguaacaaagcugaugcacugaugggggaugagcagguaaagcagcugguggauccaccagcugucucuggcagacugcaacaaagaagccugaguauccuaagcaguauaucugcacaccgugguuagaaagagaguaagaacugauuguggcagaggcuguggggcccaccuguuucccucagaucuccgguuugcacaggcccacuccuaagugccugccugcaucucuuacccacaggcuuccguaacuuacuccuuuuugcagcccauccaaaaugcaguccauauaaguggggaaauuuaauuagugaagaaaucagcuagagaaugauggagaugaguguuagguacccacaucccucaccauuggugggaaaacccaaaacuccccuuagggguuaagccucaguuucucacauuagcaacugacuuaccagucagcagcuacccaagguguuucacuaucaggcuaaacgcuugcacuugaacccuguccuaucucagagcuugcuucugagaaaacucaaaguaagucagaccucaagggaagcagaaggaaauuguuggggcuggaagccugccuuugaaucccagccccuucgggugugagaaauucccuguuccaggaagacucugcaaaagucaguugugcauaaauuaaaguaucaaugucugcaguaagacugggacagcacuaaaacauggcaugcuguccacauaucugaauaaaaccaggcuggcaacaaccacuggacaacauaguccacugaugugucagccacugcuaaacagaaaaaaaugcagucugagucagaauggcauuuccagcauuuggcuugacuuugcagccauugagggaugcuauccuugagggugcucuuccugcaggacaggauccuuccuucgggcauuuuccagggacugccuaacccuucugcagggggaaauaagccuugcugagcccugguacccauaaccccgccguauuucagcuacuguuucugaccgcucucuagauacagucaguaaguccuuucccaagucugugguaccucucugaaaagccacagggcaggggagggauaaguaggggugggugaguggguagguggguuguuugguggguuaguuugcuugcuguucuaagaauugaaccuggggcucucaaaugcugcaugaguucucuaguacugaucuauauuaucucuaccccaacacauuuagauuaaaauccugcuaagcacugagcccugaaauuuaugaaucccauccagagaauuauuauugucuccagcucacagaaaaagaaagugaggcuuucaguggccaaguagcuugccaggggcagcaugagcaggugggaaaaggcugggcugugugguggguacuguccucuccuuccaccaucucuuagcaucaggaacuguuucuccauguggguaguaggugauaugcaagggucucugccauauugggguaaaucagggggagaauuugucagagaaugccaugccuggccuucucugucucucagaucugcaggcuuuguccagagugacgcuugugcugaggaugagauaggugagaggugaccucuaggcagcaccuuugcacucagucuccuuccccugagaacggcuuccuuggaguccguauuggggauacuaauggagauauuuguggaaaaccaggucuuagugcccguuugcacuugucugguguucuguucccccaccuaaaaccaucccagcuuuuccucaacacuuucccgggcacagcccuacagggcuacauuuugacagccauggguauugugcucugaacugggucucucaccagcuuaaaaauaaccagagcucuaacucccccacugaaggaaagcugugccuuaauucaagguccuccauuauggagccuagaugagaugugagcucacccuacaggauagccacaggcuccgugccugucccauccugccuaagucugagaugguuggaagcugucgcugagccuacgaucagcccugugccccauugguagucacacugucacccagagccagcaccacaguuucacgacuccucuacaguaccgagcacugagcaaaccucucccuuucugugcuuaggcaguagaguacacugcagagacugagugcuguaaaaugcuguacaaaagauugcuaaugaacucauuuugcuggaaaagguugucaaaauauuuuuacgugagacuuguagcagaaucguacuuccacaucaacgucuuaaagaacaagaccugcuggcguccucuagagaccgcccucagcagagagaccuccacacuggcggcaguaacuaggcuccgcagcaaagacugguggagccgguuucuggcagucucugggcgguugcuguagucuccaggcucaugagccuggcagaugacagccuuuguccccaucuuggggaacguuuagggacauuguuuccacuuuucgagcucagggcacacgcagucuccaguuucuauacgaaacuggcugaaugugguuuggucucuuucugguugggauucguugccugugcccaaauaguuuucuaacaggucgaacucggaaaacaagagaagaugguucuuuuuccccaucuauguucauagagagaaacacucccgcccccuugauagcacccaccucgugacucagcuucugaggucggcagcaguccuuugucaaccucccuccuaaccccaucaguuaacuagccuggucucuguucuccgcagguucucuguucccucagcugaaaccaucagagggcgucuucaaggucaucuucuggcugggcuacuucaauagcugugugaacccgcucaucuaccccugcuccagucgcgaguucaagcgcgccuuccuccgccuccugcgcugccagugucgccgccgccgccgccgccucuggcgagucuacggccaccacuggcgagccucgaccggcgacccgcgcuccgacugugcccccagcccgcgcaucgcaccccccggggcuccccuagcccucacugcacacccaggcccgggcuccguagacacgccggaggcgcaggcuucggucuccggccgucgaaagccagccuccgcccuccgggaguggaggcugcuugggccgcuacagagacccacgacccagcugcgugcgaagguguccagccugucccauaaguuccgcucugggggcgcgcggcgcgcggagacugcgugugcccugcgcucggagguagaagcagugucccuaaauguuccccaagacggggcagaggcugucaucugccaggcuuaugagccgggcgaccucagcaaccuccgggagacugacauuuaaggaccgaaacucaggcugaggagggugcuggggccagagguggggugcuuuauaggauucugccuucggauccaaaacucugaccaggguggcugcuccaucucaccucaaagcaaccggagcuggaccuggggucggagcacucggaaggugguggguuauggugccgccugcuggacauaguuguccagagcucuuccugaaauggaagagcugcgggauucgcccuucucauccagucuaaggaacuguuuagucagcuccugaugucuaggcagaagacuucaaguauggcuacuccccuugggggggaagagguacaaauucucguuuugcugcucccagggaaaagauccguggacaguuuuacuccuuacugccaccuggaggaagucaauggaccuacugccauaggaccugccauacagcaagcuuuggugguauauuggaugcccgccauacaaaucuguuguuuuugcccugggcucacugcccccuuccccacacuccuaacuguaugaaucccucaccauucccacccacccccccgccccagggccuuacuguuuacacuguguacauaguucauugugccugucugugcccaucacuucucacugggauuccaggcugccaacaggggagagccuuauuuaucauuuugagaccuauuuauugguaagaguacuuauauuuuguucagac

SEQ ID NO: 1107 - RNA, 4645 nt, Mus musculus
aggaaggaaggaggcaaaggaaggagaaaggggggaggaaaugauggagggaggaaggaaagaaggaaggaaggaaggaaggaaggaaggaaggaaggaaggaaggaaggaaggaaggaaggaggcaaaggagggaggaaagggggaggaaaugauggagggaggaaggaaagaaggaaggaaggaaggaagcaaaggagggagggaggaaagaagagagggagggaggaaaggagaaagggagggaggaaagaagagagggagggaggagcacuugacaaaguguugcgaggaacugagaaauguuuauggagagccuucauuuauucuuaaagggggauuuagauacaucauagcucuuugaggagaaacagguccccccaacuuggauuuggccuaugugaagagauuugaugcuugaguggaaagauacacccaugaacaacuggcaaagggaguggccgaaugagcuucuaguauacagugaguccuacacagugcgagaguuuuguaggguucaggaccaacgaucaggcauagcacuuggguuagaaacauucaugagcaaguauacggauaucaacaugccauuagcaacucaaaggcggucagagaaguaggguuaguaggaagcgagagagaaagguggugguaauacaaagugaugucagccagugaccucaccaucagggccaggagcggguauagcaccugguuugguuauagcauucaacccgaggaauuuggagauggaaaucugucuaaaccucuaaagaugaguaucuuagucuucuugucauagccuguaucccucucauuaugucuguagauaugacccucaaccccuauucuccaucugucauuccaggggucagggaucgaauacaugaccuuaguaugccaaucaaccgaguugagucuggauggccuuucuccuccccaucugggccaaguacuaugauauuugcagccccaguguggacauccuccauaauuuggguccuuacagucugagcgaguuugcucauauacgaaacaaauauauauaggagaggucauagcauuguaggguucauguauacauuucccuuggcaggugucccuuauaucaaaggugaggcuuauaguacuagcacauccugucaccagacagaagguagaggcuauggucuuguucugauuuucuauggcaauuaccuggaacuuccaugccuuaggggauggucuggucuguuuaggacccugagaaccuugggguuuugaaauuagauucgaggaaagaacauaaggaaauauagccagacaaaacagcauccuuagguuaaaacccaugguacccuuauuuuuaguggaucuuugcaaguuuuggugacaguccacuuuucuuuaacuagaucuuguucccaguggcacacuugaucugagagugauguauccaggugcagacuccgucuacuuugacagcacagggguggucaggaugaugugguggucucgucuagcagggucccagcgucucagcucagugucucuugauccugggaaggaugcauuaaagcaguggaccucugaaagcagccuuaacugaagaggucacaguguccugagucagcugaugagccuguacagauugaagaagauggugguuagaauuucaaauggaguuaaaccuuuuacgugaggaguagguugagcucuaagaaggguaacggggaggagccgcacacaucuuuugccaguuuccaagguuaauuuagucaaggucuuuuuguuuggcugguuguuuugguugguugguugguugguugguuggcuggcuggcugguugguuagguuuuuugagguaggcuuucucuguauaacagcucugaguguccuggaacucacuuuguagacaaggcuggccuccagcucacauaaagcugccugccucugccucugaguucuuggauuaaaagugugcaccaccauggccagcuuagucaaggucuuuuuacaggacugauguauccucucugccugugcugaacuuuguagaugguacgugcaauguaauuugcaauugauccccagaagagcagaauuguucucaguaaccuuagauagaaagaguccauugucugaucuuaugagcaauggcaguccaaagcuuaguauuaucucauccuuuacauacuguauuucuaccuuuaauuuguggagcauggaguguuccaauagagggguaugggcacucagcuaugacuaagaaagagugggucacaguccccuuucccagguccacaguucuuuugguggcccaagaacaaauuugugagccaguggcuccuuguauuacaaaucuguuucuuacuuauuggcccagcugccugcuuuaaaaccaaguaaguggcucugaucuccacgaggaaauugacaggaaacauuguccccuucagaguuauccugggcuggagguggugggaagguggugacugagccaacccgucagucuguaucuagcuggagcaccaaugcagaccuuugcuucuguuugagacauuugcuucuccuauggccgguuucuuugcaauaggugcauuggccuuucuuuaagggaguaucucucccagaauccauuucccucggcuuugguccuucuuucauaaaucguggaugcugagguucuucucccuggcaagaugccaccauaaucuuagcuggcuuccuagucugccacugucacuguauacccaggagaugaucuugacuagcucugauagugccuaugcuucaaagccuucuguuuucuaaaucuuucuccuaauguuugaugcugauccagacacaaaaguuauauugacagugcucugguuuucuggaaccuccugguccaugggguguguaaauuggguaagcuuuuaggaggcacuccagaaagcagacagugacucaucuaaacccugaguuaucugaccuacuuuagacaacucauggggcacuuagcuacagccucaagacuucccuacagagucuggugaaaaagguuaacagacagacucccuaccuuugugacaauuagaauuccagucugguugccaggaaggaaaaaugucuccaguugccaccagaucaauagcugaccccucccaucauuucccaagacuuugggccuuucaccagacucccuuccucuccucuguggugaagagaguuugaaguagcugcugacaaucugcccauguaggugauggauauaaaacaccauuucuagcagaaagaucaagccuuggguuuuuuucugagaaagagagagagauuuugaguuuccaguuauacagaucacuaguggagaagggaccauugcuauaauugauugauggcccuucccagcuuccucauccugaguggccccugaguguguggagaucucuuucaaagggaggauagcuguaggcaaagaccugggggaagcauggcaggggcaugguaggaugugucuugagaggggagccauggugacucuauccuaccucagugagagcaggcagggaugcagucuguaagagaaaggaggaggauagugaauggccaggagaugggucaggaagaggucccaccccgggugugaggggacucaggaugccucuggugucacagucccuggcuggugccccagccacacaggguggugguccaucuucuucugauggggaugguaggggcuggaggcugaaauuugucccaccccuuggucuuuaauucuucugaaacaaaacuggcgucauuaggggacugaguuggcugcuacucucucaucugggauagaaauuccucaccaggaacccccaggccagaauguugccuaguuggucccgguuuccugguuuucuaaagaccuccuguugcacucuguaaacaagagaaaguuugaagaagccuucagcaggccagcccaccugaaaugaaggcuaaaggagggagcagaagacaguuaguuuuccugaauagcucuguucucugcacuccuggggcuuuucucuggaaguccuuaaaaugcaacuuccucagaucucaggggggguuucuggguggaagguuuuuucccccaucuuuucaauuucuucaaggacaagaaaugacacaaaaaguaaggcacacaacacaaagccacaguguucucccacuuggcacuaaugcuucucgucagccuucccuugccuccagaaggaagcaacuagggcccagugguuccucugacucaggaauuaacucugcguccagcuuuccuaugaaucucacagacagaugccugcuaccagcaguaacuuuaccucugagagggcucccgaugccacucuucuacaauccaggcauggagaaccugucgacggccaccucuaaauguuagguuuauccaaauguucucagcuuccagaagaccagacuccucaguggaaucuaggugcugagggcugguggcuccuucggcuugagaaaagucuuggcucucaguacaccgaaagcccugggaucaaggcugaucagcaaagaacgugaaucgggcugaacgccuggaucuccguggagucuccugauguucuggaccuuuauuagauacuggccagcuacacaccggagacuugggauucucaaaguguguucc

SEQ ID NO: 1108 - RNA, 46487 nt, Mus musculus
gcuuccucgcuccguuagguaaccuuucauuuucucaacuacccauuauguaacgggagcauuggguacuggaucagucuuccauuaaagaugauuuuuauaguugcugagcgucgucagggagugcugacacugggggcgguuuaaacagauacaagcauuuaagccaguccggagcggugacucauucccccaccccccacccccccgcgagagacgcggcgcggccauuggugagcaucacgccccgccccucgcccagccuagcucccgccugccccgccccuuuccacucccggcucccccgcguugucggaucagcagaccgauucugggcgcugcgucgcaucgguggcagguaagcgggcugcugaagccaggccuuggcgagcacucagccuuccgucgucaagcucggcucacugcgccucucggggccuugaggccacggggacuaggacugggacugggacuggggcugagucuggcugggaggugacuguacacccccugcugcgcgacuccuggaggaaccgaaucccagggcagccaggccgggagccagccuuuccuucccgagccagauucacagcucagcaucgcuggggauggggguggcaucuuuugacuguccuuggcuguuuucuucucucuuuguaguagcuacagcgaacauaauuuuaccucguuauuccaccacagucauuacucccuugcacaguuucauucucaacgucgccgugcgccuucacugcccugucuaggcguuuucaugauugucuauuuucuuguacuuugaauaccgugguuuaauagcaguugcgggugcgcagaauucuccauuuccuuaagagaaacuccugggagaaugggacuaaagacgugcaaauuuaauuauaucgcaaacaggaaucaaaauuuugcauuaaaaugccaaacaucuugaaaaauuaacuauucaaugaagaaaaggaacuacuuuaccuacacacacauccgagagcuucgaggaggcgaaggaaauagaaagcuaagggaugauuuggguuguauuugaaucugacacaagcuuuccauauuauuuauagcagggacuaaacgaugagucauuuucugaauaagaugcaaauuaaagcaaguuuguuuguugucuuuacaucuauuaaauagacagagacaauggcaacagcaacccuaaccuagagguugccugaaagugucagguuugggaacaaguggcccugcuuaagggcuagaaagauugcuuuacaaccaacaaucaugacuugacauugccugggguuccuuuugucuauuccuuuuuuaaaagacuaguguuuauuuuaugugcaugaguguuuugcauccacauucgccuguauacacaccugguucuguggaggucaggagagggugcuggaugcccuggcacuagagccgugaaugguuaugugagccccugccacaggggagcucagaaccaaauccagguccucuggaagagcaaccagagcucuuaaaacuucuaaguaucccuccauccccuuuccaucauauuuggaaaggagaaaacugcuacccaugccuggcauuuauuucagagauuaacugucuguguaaaacuugacauugaaagugcacuauucuguuucccauucauacuuaguugagacuacuguaagucaguuagggcuuuuuuuguuugguuccuugguuaguuuggaguguguuugugagcucauuaacaggcuuucaguauguagcugaaauuugcuguguagaccagacaggccucaaauuuguggcaauccucccugcaucuucccagaaugcccugguacaggcauaaaccaccgugcccagcaguaaaacaaucuggugagguauuauuagucgugugcugugacccagaaaccccacuccuggcaauuuacugggaaggaacaaacaaagggcuaggggagccauauggccugcaguuagagaaaauuagauccaacugaaaaaucaaccuaaagguguaaaagccaagcaguuaagaaacugacaggcucaugauggaagccgaggccaucgugaacacucuucauuuuaggccccacguaucacuggggacaacugagagucaaaguacagguaaggagaccaaggcuuuucaggacucaggcugucucagugaaaagcccagaagagcaguaauugaaagagcucagacgaugugucugaucuccucuguuuguuuguugcuguauuauuuccacuaacuuauuugggaggaaaaaaaacaguucacaggcuucuuuucuugaaauacuggggauugcugggaucgaacccagggauagguuuuuaguuucuaaaauaacauagaucaugcccuguuugcuuuuuggaauauguuugcgcugcccuuauuuucauguucaaauacugcuccauuuugcgugacucuuuaguauugguuugaugauuugcauauuagauuagauuguauuucaguucucagacuuauuuaucaauucuaguuuucucuuuuuguuguuuuaaaggacuccugaguauauuucagaacugaaccauuucaaccgagcugaagcauucugccuuccuagugguaccaguccaauuuaggagagccaagcagacugugagugcccugugaaucaugauggucuuggggaggguugggaggggaacugaaaaaucaucaacuggggagaugggggccagaaaaccuccgugcuuguuccagaggccacuuaugccucacuguucagugcugucuugcgaagucagcuuaauucuaugggacaagggccacuguuucuccugaggacugugcugggccaaggaacugaaagcauuuuaaaaauauuaaaauagauaggcauuuuuaugacaaauuucaaauaagaaaggucgaaugaaggauuuuucuuguuuguuguuuguuuuuuaauuugggauuguucuuuuguuuauucuugguuugaggguugaguuuuuugguuuuucaacaggaucuccuaugcccaggcugaccuggaacucccuguaugcaaccuucuaguccugugccaaguuccaaguuccaagccagguuaccacacccagcuaguuuuucugaauguugguuuuaacuuucucauuccauucuugaaaggcaucugugagcuccugcauaauaaauacuuaaacauacauuuauaucuaaaacagggauggcuacagcauuauaaaguaaugcauaaauggauagugugggcauucccucucaaaccugggaguucuguguucaguaguucucugcucauugcuacugcaguauuguguggcuacuccaagggagcugcauccucuuaacagaaaguguaaaauguuagguuccggauggccuagcuuugcgagggagggaaggagggcgggcaggcgggcagcaggcuccaugcgaggcuuuuccaaccucucccauuccauccauaaauacauccaggcuguccugggcggauagcugauuuuuuuuuuccaaaguucuuaaaguagcucugauaaugagucagcuuacggacccuuuacucuauuuaauccagagaugggccugagauaccacuuaaagcccuaaaauguuuuccaugaucuuucauagcuugauccagguccuuaaggaccagugacaucaaaugaugagaaaugaauuaauuguacuuagcacaagaaagauaggaaauuuccucccagggaugggaauagagggugggucugucugucuaucuaucugugcauaugugugucugucuuuauguguuuuugugugugcauauugucuuuauguguuugcauguauauauauauauacguauauauauguauguauauauauauacauacauauauauguuugugugccuguuuuguguauuugugugugugugugugcucaaguguuauucucucugcuucauaauuuaacagauucaacuucaaguuguauguauucugagccuaguagguugcagagacugaucaauauauauggaucucagcagcagcaucuuaggcugccacaacuucaggacaaguucuuagcagcucugcuccuugaugccuaugcauagcaggaauagaauaacugagugacucguagaccuuuuguacccuccucucuaugguuccaugacugcacauguugcuccuaugagcagaaccuugugaugucugugcagguuuacauggcauuggaccagaucugcucuggauucuguucuuacacagaauuucuccaguuuuuaggggguuuguuuggguuuuuuuguugguugguugggguuguuuguuugguuggcugggguuguuugguuguuugguuugguugguuuggugcuaggaagcaaauucagagucucacauguagcagacagaugcucuagcauugagcuaaauccaccauccaguucuuuuuaggcagacaggcaggcaaggcucagcccagucuggcuuccaacucauuucauaaccaaggcagguugagcucuugaucccccugccuccaccuuucagucucugggacugcauuugugaacaccauguccuuucaggugucucugcaccauguuucuuaaaguccucugaauuuggauaaaauaguguuaacucuggauuauuuggauagaauugcaaucucuuauauugguuucuaaaauacaugucuuuuuauuauucuauuauuuaagaaaauauuuauuuauuuauuuacuuuauguauaugaguacacuguagcugucuucagacacaccagaagaguccaucagaucccauuacagaugguugugagccaccaugugguugcugggauuugaauucagggccccuggaagaacagucagugcucuuaaccgcugagccaucucuccaacccucuaguauuuuuuuaaucucagcaaaauuguauagcuuuccucaguaagucugcuauuuauauugaggcugagcccuagauauuuuguguucuuaaugucaaauguuacccacugugucuuuagaugcagcagauuucaaagacugccauucuagcgagcuuagagguuuuuuuuaacccuuuaaggccuuuccaggugauuuuccaucauuuucacguaggaaaucacaacucuguaagcuccuagaaaaaucuaaaaauggcaacaggcuugauguuuucaucacauuaaugaaaacgcuuucuuacuaggaucauagguguaggccaauaccuagcucugcuuuuuaaaauucauauaccaguuauucaauaaagauacauugaaugccgggcagugguggcacacgccuuugaucccagcacuugggaggcagaggcagguggauuucugaguucaaggccagccuggucacagagugaguuccaggacagccagggcuacacagagaaacccugucuggaaaaacaacaacaacaaaaaaaaacaaaaacaaaaacaaaaaaaagauacauauugaauggauucauucuaaagucacuuuuauaguuuauauguuaaugggaaggggucucauuucccagagauuuuuaguucauaagacaaauauaguuacugucucucuagagcuuucucguucugagcagauuuucccucucucauguccaaacuauagcugccauguuggggugguuuuauuuauuuauucauuuacuuacuuacuuuuugauucugggacuugaacccagguccucacacauuguagccaagugcccuaccacucuacuuuguugcuguguuuucuaaugauacaugugugucuauauuaucaaauaacucuuaauuuuauuuagaacguccacauguucuagauuuauuuuguaaauuauuucuugcaaauacaauacuucauuuuaaaauguucucuuccuauucucccuuuuuaguuguguaaccauugaucuuuucauuuuuacuauccauuucuaccauucauguucucccgcuggcugugugggcuccuggacccccaggaguccgccaucuugacaauauucaacuucccuuuuauauuuuguucucauuuuauaugguuccuaaggacuuuaauagcuuacauaccauuggcucucucacuacugcaaauuagugauuauauauuaaucauuuucucagagaauugauguccuacuuuuuguaaagcuucuuuguagacucuagaaagaacccuccugccgacuuuaaugcuacaaacaccgugagcauauguacauuagcaucuuguguguguuuuauuggcuuugcucaugguguuuucucauagcauugaacaagauuucuugguuauuaccaucaaauucaucucucugcguuugccugugcuuugugucuccuugucuggaaagcccuucuucaccuuccggcucacaagaacacucaucuguauuuuaauaucauacacaugcauguucacuugcaugcacacaugcauguaccaugacacacacaauuuugggcaguaguaggacauacagguuguuuuuuuuuuuaacugacauauaguaaauguacauaguaucgaguuguguaagaacauuuucauaggauauauaguguacuuuacccaugccugcugccuucccuuucuuuccuucugccucccagucuuccccuagacaaguucacuguccuuccaugccagccagacagacagacacuauuuuguguaucuauguaaaaucuaggaagcguaugugagagaaaacaugcaccauuugcccgacuucauucauuugagaugauaaucucugguugcauccaucucccuccagauggcaugacuuugcuguucuuuauggcugaaugaagcccuacugucuuaaucccuucucuguugauggacgccuagguuguucccauggcuuagcuaugguaaauggugcugaaauaaacagcagcacgcaggugucucugacaggacagcaugcaggugucucugacaggcucccuuggaauccuuuggauaaacacuuaacagugguacagcuaggucaugugguagaucuaguuucaguuuucuacaggaccuauauacauuuccguggugaggucuaauuuaaggguucccuuuucucagcauuugcuauuugucuuauucuaaccuggaugagauggcuucacuauguaauuuuaauuugugcuucugugacagccagugauauugaacguuuuuccauguguuuacugaccauuuguacuuuggaaaaccauccuuuucgauggccuauuuauuauuguuuuagguugagagauaggucuuacuguguuauccagacuggccuaaaacuugaccaucuugccuacguugcagagagcuggauuaaggugaugcgcaauccuccuacuuacaguuaggucuguggucuaucuagagucuccuuuugcauuuggggcuagggauucauuuggauucaguaucccagaaccaucaaaccuuucuuccuuacugguucaugguacccacugauauaucaaguacuuuuauaaaguguauauaugcuuccauauuugaacuuuauucuguugaucuguuucugaauuuuagugacuuuuugguacuuuauuuaaagauggcuuuauaggaugauuuaagucugaugugcgacauucuccacucucucuuuccuuuaagguuggcuuuugaugaauaaauaugucuucuuccauguaacaacuaugucuucuuccauguguguuuauuagguuauucagaaaaaaaucaaccuagaagguaaaguuuugaauuucugccauauaaaaucacuuuuuauuuaauuuugucauuucuagauauuuuacaguuugcuugcuauaugaauaucuauuuuuuucuaguuaauuguggcugguauagaaaugaucuugguuucuguaugcucauuguggugguuugagugagauguccccauaagucuuaggcauuugcguauuuuggucccaaguuggugacuguugggaaguauuaagaggcauggccuugcuggaggaaguaugucacuggaggaagggaggggcugugagguuuccaaagacuuuugccauuuccaauuagcugucucugccuucugcuuugggaucaagaugcgaacucuagcugcugcaguagcaccaaugccuuccugccugcugccaggcucccugucccccauggugguaccgggcuccuacccuucuggaaauguuagccgaauaaacccuucuccaaguugucugggccgugguguauuaucacagcgauagaaaaacaagacagucauccuguauucuacaaccuugcugaauuacacuauuguuguuuguuuuauuuuguuugauugguuuuuuugagacaauuucucuguguagccuuuguuauuagacgcguucucacgaccggccaggaagaacaccacagaccagaaucuucugcggcaaagcuuuauuucuuacaucuucaggagccagggugcaggaagcaagaggagcaagaagcaagagagagaagcaagagagcaagaagcaagagagagagaaaacgaaaccccgucccucuuaagcagcauucuccuucgccucggacgugucacucccugauuggcugcagcccaucggccgaguugacgucacggggaaggcagagcacaaguagucauaagauacccuuggcacaugcgcagauuauuuguuuaccacuuagaacacaggaugucagcgccaucuuguaacggcgaaugugggggcggcucccaacaucucccccuauccuuuuaauaagagcaaauaggccacccauauuaaugagaguggagauagaggucaaauccccaguguguagguaaaggagccauguacaggauuagcucuuaggcuuacaggcuuuuacccagagcaacccugaccugcucccgugucguuuugccugggggaagggaacuaggacacugaaccuucaugaaagaugacaugucucccuagaauaggcucauauaugccgcagagccuuuccauugcagugcuuagccuugcaacucucucgggcugcugaagcacacucacucuaucccgugcaaugagucuagccucaugggauauaagagcugaguggccagcgaccuauugccuaagcauagauaaccauauaucagggggagcuccauguucuaguccugcaagcgccugggcaauaaccaccuugucucuccuaguuuaggccuuaagcuuacagaccaaucaaagaagcaacacuaauccacagcaaaguguaucuccaaauaauauuaaucccacccauuuuuuaaagaaagaaaaugcugaggagauccaauuggguaauccuuuggucagcgacagguccaagcgcguggaguugaccugaagucucaauucccgaaggaucuguucaaauucagccauccaauucuguaacauauacugaaaaagacuuuuugacaauuuagcugcccuaguaaauuuaacauacugaauggaaauaacacacaaucccggaaacuuuuguuuacaucccugcugaguuauuugucauaauacaucuaguuguaucuggacaagaucuaugaguugauuaaccagcaugagaccucucuguaucuugacauuagcugaggccuguucaucuaugacuguagucacugaggcugacaaaguguuaauggugucaguugucuggaccuguccagacagagccaaggcugucugaauuaaggccaaacccaguuccuaguuagugguaaaaaagcaggagaauacuugagcauuauacaucaccgucauugggaguggaaaugucgacauuauuccccaacgcugcucucucuuuauuauugacgcccuggacaucaccaagacgagggacauuaguauucccuuggucagucuggauuuuucgggugagucuuucugguacccaaaauggguugucuucauucugugggaaaacacagauagcuccccuggaucuuaucaagauaggauccgggccauaccauuuauuaucaaggacauuuuuccauuuaaccaucucauugggccuaucuggcucugaacaaugacguucagccgcaguauggccaugagcaucaauauuuaaaaaauugaguguaaagagugccaaagacacagacacucuuggugcucgggguacagucuccucaaaaguuccccucuucuguuuuauaagauaggcuuugagggugcgaugcgcacgcucaacaauacccuguccuugaggguuguauggaaguccagucagguggguuacguccaucugacggcagaacuguuggaauuuuugagacguauaagcugguccauuaucagucuuaaggagucuggguuucccccaagcacuccaugccucaagacaauguugaaucacaugugaggcuuuuucuccgguuaacggagaagcaaacaugaugccagaacauguuucaucauauuguuuggauaccacuuuaccauuagccacacaggcaccuaugccaguuuuugauccaucaguauauaccacaaucccauuuuuaaguggguuucuuacuguuauuuguggaaacacaacagauugauuuugggcaaacuguaagauuggaugcuuuggauaaugguuaucuauuuuuccugaaaaggagguaacuaaaacugcccaaucauuagauguggcugccaagguuugaaccugugcagcgguauaagguacaauuaaaagauauggacuuugcccaaagugggugauugcugcuuuuagaccuuuaagggcaagcugugcaauugcaucaggauaccaaucuauuauuguauuagucaggguucucuagagucacagacuuauggauaaucucuaaauaguaaaggaauuuauugaugacuuacagucggcagccgaauucccaacaauuguucagucgcagcugugaauggaaguccaaggaucuagcaguuacucagucucacgcagcaagcaggcaaaggagcaagagcaagagcuagacucccuucuuccaauguccuuauauugucuccagcagaagguguagcccagauuaaaggugugucccaccacaccuuuaaucccagaugaaaggcguagcccagauuaaagguguguuccuuaaacucggagauucaaucuucuggaauccauagccacuauggcuuaagaucuucaaaccaagauccagauaaggauauccaauccuccagauaagggucacuggugagccuuccaauuccggauuguagucauuccaaauauagucaaguugacaaccaggaauaaccacuacaauccaccccuugucaacuugacacaaauaauaucucauguucacaugaaacaauaacaagguuguaaauacgccuaacaugauauaacuauuccucguacaaucgcaaacgcauuuguaaauuuacaaugggcauucauauuacuuuauaauccucguuucugcaacugguuacguggccuuaauugguauuuauaacuaccuuccucuacuacccauucuguauuuccuucuccuucagccagcaccucagcaggucuuggcucuuuuccuggaggauugacccauaccuucauuccugaugggucugcguccuuugucauccugcuuggauuaggcuguuguaguuucccauugacuuuaaucacaggacaugguaguacuaagagacgcccuaagggaucuccugcacuccagacauaaucuugcuuaccaccauugugaagagguaauccaauuuccccaugguaaucuggaucuaucaccccuccuaacacuguuauuccuuuuuuagccuguugguuuaagggcauuagaagcccaaaaugaccagggggaagucugagcuuccaguucaaugaaauguuuguuguagcuccugguaggagcacuccccucucuggagccaaaacuucuaagccagcagaaccuagaguuauggggacaggaagcaaaaauuuuccuagagggucacuaggagugauaguaaguggaacuauuccguuuuccaccccuugauuccuggacccaugaauccuggcuaugggugaaacuguaccauauaucgagcgcugauucaaagcauauacugccuucugaagaacucugccccagccuuccaagcuguuaccaccuaauuggcgcuguaacugcgucuucaaaaggccauuccaucuuucuaucagcccagcugcuucaggaugauggggaaugugguaagaccagugaauuccaugaucgugagcccacugucguacuucucuggcugugaaaugaguuccuuggucagaagcaauacuguguggaauaccaugacgauagaugaggcauucugucaguccgugaauggugguuuuagcagaggcauuacgugcaggaaaggcaaauccauaaccagaauaaguaucuacuccaguaagaacaaaacgcuguccuuuccacgaaggaagugguccaauguagucaaccugccaccagguugcuggcuggucaccucgaggaauggugccauaucuggggcucaguguugguuucugcuguuggcagaucuggcaaucagcagcagcuguagccaggucagccuuggugaguggaagcccauguugcugagcccaagcauaaccuccaucucgaccaccauggccacuuuguucaugugcccauugagcaaugacagggauggcuggggagagaggcugauuguccacagaacgggucaucuuauccacuugauuauugaacuccuccucagcugaagucaccuuuuggugagcauuuacaugggacacaaauaucuucacauccuuugcccauuuggagagaucuauccacauacuucuuccccagaugucuuucucaccaauuuuccaauugugaucuuuccaagucccugaccauccagccaauccauuggcuacagcccaugagucaguguauaaucguacaucuggccauuucuucuugcaaacaaacuguaauaccauguguacugcccgaaguucugcccacugugaagauuucccuucaccugugucuuucaagguugucccagaaagggguuguaaugcugcagcuguccacuucuggguggugccugcauaacgugcagagccaucaguaaaccaggcucuagucuucuccucuucggucaguugaucauagggaacaccccaugaggcuauaggugcaugcuuggcagcagauggcauuguaacaggaguagaaaccauaggcauuugagcaacuucuucauguaacuugcuugugccuucaggaccugcucuggcccgaucacguauauaccacuuccauuugauaauagacugcugcugugcacgucccacuuuaugacuugcagggucugauaguacccagcucaugauggguaguucaggucgcauagugacuugguguccuauugucagacguucaguuuccacuaaggcccaauagcaggccaagagcuguuuuucaaagggagaauaguugucugcagaugaugguagagcuuugcuccaaaaucccaaaggccuuuucugugauucaccuacaggggccugccagaggcuccaaacagcaucucuaucagccacagacaccucaaguaccaucggaucugcugggucauaugguccaagugguagagcagccugcacagcagccuggaccuguugaagggccuucuccuguuccaggccccacacaaagcuagcagcuuuccgagucacuugguaaauaggccuaaguaacacacccaagugagggauguguugucuccagaauccaaauagacccacuaaacguugugcuucuuucuugguuguaggaggggccaggugcaauaacuuaucuuucaccuuagaaggaauaucucugcaugccccacaccacuggacuccuaagaauuucacugagguagaugguccuugaauuuugguuggauuuauuucccauccucugauacgcauauguguuaccaaugaguccaaagugguugcuacuuccugcucacuugguccaaucagcauaaugucaucaauauagugcaccaaugugauauuuuguggaagauccaaacgaucaagaucccuucuaacuaaauuaugacacagggcaggagaguuaauauauccuugaggcaaaacugugaagguauacuguuggccuugccaacugaaagcaaauugcuucuggugguccuuauggacagguacugagaagaaggcauuugccagaucaauagccgcauaccaggugccaggagauguguuaauuugcucaaguaaggaaacuacaucugguacagcagcugcaauuggaguuacuaccugauuuaguuuucgguaaucaacugucauucuccaugauccaucuguuuucugcacuggccagauaggagaguuaaauggagauguggugggaaccaccaccccugcaucuuucaaguccuugauaguggcaguaauuucugcaauuccuccaggaauacgauacuguuuuugauucacuauuuucuuuggcagaggcaacucuaaaggcuuccauuuggccuuuccaaccauaauagcccucacucuacaguucagggaaccaauaugagaauucugccaauuucugaguauaucuaucccaauuauacauucuggaacuggggaaaucaccacaggauguguccggggaccuacuggaccuacugugagucggacaucagucaaaacuccauuaauuaccugcccuccauaagccccuacuuuaacuggagggccacaauguuucuugggauccccugggaucagugucaacucagaaccaguauccagcagaccccgaaaagucugauuauuuccuuuuccccaguguacaguuacccuuguaaaaggccguaggucccucuggggaagaacuggagaaaggguaacagcaaaaccuuugagugucuuaucaagauccuuccucagaggaaccuggccaccccuucauucaagggguuccggaucugcaaacugucucaagucuggaaauugauucacuggccgagauugcuguuuaccacgaucuaauguagccuuucuuucauuuguuugagaauuuuucugcuuauacagaucaaacaaauaugcaguaggcuuccuauguauuucauuccuggaaacaccaugauugauuagccaguaccaaagguccaagcgagucaugccauuauaaauuucaccucuccugugcugaccauuacuggguauguuauuauaaacauucuuuugucuacgcuguccauuauaauaacuaggaucaccuugucucuggcgauucaaugcugccaccuggcccuuguuaccucgggauccaacuaaacccagugaauuuaauucaucuaauugagcagaagcaucuccaaugcuaagaucuggcacaaggaaaagggaaagaacaaaacccuucaaaugugcuggugccccucucaccaauuugcgucuuauagagcuggugaaaggcauaucuucuggaccuucccauuguggacaauuaugcuuuacacaauauauccacucuagcauugcaauuucccuaagucuuaaaaucccuucaucaacacuaagccacggaauaucaggcaucuccaagucauuuccaguaggccaucuuuugauaaacaccucagccaaccauucaaacaaacuuuugacaccuuuuuuaacuaugcgagcuuccguauuaaaccuagaaucucuacucagaggacccaugucaauaaacucagccugcucuaguuuuauguuccuuccacccuuaucccacacccuuaaaauccauucccacacauauucaccagguuucugcuugaaugaauuagcaaacucauuaagcuccuuaguaguguagcgaauuuccucauggacuauacuuucuaccuccccucuaggagccuguuuugcuuugagucugguuacaggucuagaagaaacuauuggugggccgugagcagacucugcaaaauuaauuuccucauguggggaaggcauuauuucaagagguggggcugaggguacuacuuccucagguggggcaaacccuugagaaucugaggauucaaaauucucagcuucaacauggucuucccacacauccccgucccauguuguaggaucccauucuuugccaauuagagcccuuacuuuaacugucgacacacucugaggcugagacuugaauuuucucuguaguucagccaaccuuacaaugagaguuucuguuugauuuucugcaacuugagcucuauugcuacaagagagaagauucuccucaaggacacacuuagcaacuuuuagaucguuuacuugugucuggagccuuucgauuuuaucacacaacuccuuccuuucauucaucauuuuuuccacagauacuaagagcagccagccaguaaaaucauuuuucgauuuuuuccccaucuuguagaaagcuuugugcacugaaucaccuaauucauuaagaaaaucaagggcauuagcuucuuuaaguucggaauauaguuucaaccaugggucuucaaaauucucugagcucccaggagggagagaaucuggagagguuucaauauuugaaagugcugguggaucaacaagccaauuccaguauuuuaaaagauucauccuuguacuucuguuacucuagaaccacuccugguaccaacuucuguauuagucaggguucucuagagucacagacuuauggauaaucucuaaauaguaaaggaauuuauugaugacuuacagucggcagccgaauucccaacaauuguucagucgcagcugugaauggaaguccaaggaucuagcaguuacucagucucacgcagcaagcaggcaaaggagcaagagcaagagcuagacucccuucuuccaauguccuuauauugucuccagcagaagguguagcccagauuaaaggugugucccaccacaccuuuaaucccagaugaaaggcguagcccagauuaaagguguguuccuuaaacucggagauucaaucuucuggaauccauagccacuauggcuuaagaucuucaaaccaagauccagauaaggauauccaauccuccagauaagggucacuggugagccuuccaauuccggauuguagucauuccaaauauagucaaguugacaaccaggaauaaccacuacaauuauuuuagcuggggauacguuuggauggauccacaacaauggcccauucugccacaaaacugcaguuggcaauugugcugucuuaaagacacacaaacugaaaggcugcgaauccucaauacguuguaauugugcauuuuguaaggcauuuuccacuuuuuguaaggccugguuagcagcuagaguaagaguccuaggggaggagauaugaggaucuccuucuaaaauacuaaacaaaggccuuaacucagcggaaggaaucuuuaaaaaaggucuaagccaauuaauaucucccaacagcuucugaaaaucauuuaagguauggaggugaucucuucuuaucucuaccuuuuggggcacaaucuuaucuggggacaccacagagcccaagaauuguccuguaucagaaauuuggaccuuuucuguggcuaucuguaaaccccacugacuuaaaguuuuaaguagaaaaggauaugccuuuuguagcaugguaaggucuuuauggcacaggaggaugucauccauguaaaggagcaaaauuaaagaggggaauuguucccucacuggcaaaagagcuucuuguacauaaaguugacacauaguaggacuauuggacauucccugugguaagaccuuccauugauaccucuuaucagguuccaugugauuaauagaggggaugguaaaggcaaaucugggccuaucccuuggacacaaagguauagaaaagaaacaaucuuuaauaucuauaauaauuaaauuccagccacgugguaaggcggaaaguacagggagaccccucuguacugggccaaauaaguucauuugcucauuaauggcucugaggucauggagcagucuccacuuuccugacuuuuucuuaauuacaaaaauuggaguauuccaaggugagguagaggguucaauauggccuaauuuuaauuguuccucuaccaguugaaucacagcuucuaguuuuucagaggauaggugccauugaggaacccacacuggguccccuguuuuccaugguaugggucgugcugccccaauggccgcuaaggaaaacccagacccugucugucuugguuuccauuaggugagaugggcucuauccuucccuguucuugauguccuaacccuuuuccuucuuuauaacccaucuuugccaugauauuuuuugcuuuagcugaauacccucccgauggggcauuuucauuggacaaaauaaggcccaaaugcugcauaauaucccuuccccagagguuaaccgggagugggagcacauaagguaugaauuucccuugcugcccuucagaggauucccacgucaaggcaauggagcuuauagugggacaugauugauauccuaggcccuguaaugaaugagaugacucuguggugggccaugcuuugggccaccaauguguagaaauuauacuuuuaucugcuccgguaucaaggaugccuucaaacucuuuuccauuaaucuuaaggcggagcuuaggucuaucauuuaaagauacaaccaaauaggcagaaucauuuccugaggagcccaucuucuuuaucucagguccugcagauuucucccugguauuaucagggaggagcagcagcugagcuauccuaucuccuuuacuaauagaaaaaacgccuuuagggcuugagcacaggaccuguauuucaggggaauguugacaauccauaacuccaggguggacuacuaagcccugcaaggugagugaaccucggccgagaauaaggcccaugguucccgggggcaaggaugguauaggcuccaccggcaccggcugaauacucauuugaggcauuaguaggaagucggaggcggcacgcagguccacccuugugggucuuccugggucgccucucugacugcuuccuggguccugacaaaccgguucccauaucuuugagggcccugggaccgagggcccgaugacccguuuuuuggcacaucaguugauugacuaucaggugggggaaggacucugcccuuuauaucccucacagagcgacacuggucagcucuaugauaacccuugccacacuuagagcaaagagugagagucccucccuguuuaucuggagcucugcaaucuuucuuaaaaugcccaggcuuuccgcaauuaaaacauguccucugaucauuucugcucauggagcgguucugagauuggaggauggcggccgcuaagccugcauuggugagaggucccccaagcucucgacagacccugagccagucuuguaagccuuuguucuuucuuggggcuauggccgcucggcacuccuuuguggcuugcucauagauuagcuguucuaucagaggcgcagcuugcucugacucuccaaaaauacgcucugcugccucugucauucuggccacaaaaucugagaaggauuccugaggucccuggauuaucuuuguuaacugaccagugguuucaccugcucgagagagcgccuuccaggcccuaauagccguggaagaaaucugggcauaagcuccccaaugguaguuugucugaucagcagaauaagcucccugacccguuaacaagucaaaaguccaaucucucugcucuggagucaaagcagcugcguuugcucgggccugcgcuugugcagcuucgugccaaagcgcucuccauuccauauauuugcccauacuagggagagcggcuuuuacaaccguuugccagucagcaggaguuagugccaugccagcgagccugucuaacugcaccaagguaaaauuagcauugguuccguauuuacgaaccgacucggcaauuuccuuaauuuguaaguauucuaccggagcguggacacgcccacccucggcuccuucaaagaccggaaaugccuguuguauuuuccuuuguuccucucugggaaugaaugagucugcgcacugccucucugcgcacugccucucugcgcauugcugacgcacuacgcagggcggggacuccgcauagggcggaccuugaagccgacugcccugaggccaaucagcaaacuggccuucgccagccgcuuuuggcuuuuuucuugaccaauuagcuggcugguaaugggcugcuucuuccucccagucuguuuccucagaggagaauucuccaucugcuucagagcuacuaagagcuggcuccccgagcccauccagcgaugagcacaggcuccuuuuccuagagaccuccgcuaauugaucuuucuucuuuucccuuuuuccucuuuuucuucuaaucucucuccagguauuccuaccuaaccuuaacuuuuccucggguucaagacccuuggaaaggccuguauacuuauuuuguguaccauauuuccucuuuguuccuacucucucuccccacuuuacuucugauagcuuguccugaauuucaucuagaauccucccuaucuuaaccacuugauaacaugugaaaaggaacaaaagggcuccuaacaccagaaaaaauucaaggccaaacauuuuccacuuuacuucugauagacugucuugaauuucguuagaaaguucaagaucagacuuaccucguaaagcuguacucacugguacucucguuccccagcugaaaaguucugaauucauacaguugaauccuucuuaacagucugcuuuacgggaaccuuuauuaccgcgacccgcaguucugguucuggaaugagggaucuuccuugcgccagucccgaguuuuuucucgucccggaauucggcaccaauuguuauuagacgcguucucacgaccggccaggaagaacaccacagaccagaaucuucugcggcaaagcuuuauuucuuacaucuucaggagccagggugcaggaagcaagaggagcaagaagcaagagagagaagcaagagagcaagaagcaagagagagagaaaacgaaaccccgucccucuuaagcagcauucuccuucgccucggacgugucacucccugauuggcugcagcccaucggccgaguugacgucacggggaaggcagagcacaaguagucauaagauacccuuggcacaugcgcagauuauuuguuuaccacuuagaacacaggaugucagcgccaucuuguaacggcgaaugugggggcggcucccaacaagccuuggcuguccugggacuugauuuguagaccaggcuggccucagcuuagaaauccacugccucugccucccauguacugggauuaaaggugugcgccagccacccuuaucuucuguugugauacuguuaauugaaaaugauaucagugugaccucauucucuguagcuccugcaccuuugauuucuucaucuuuaaacauggcuuuggcaacaccuugagucuaugagcgguagaaguuuuuuguuuuuaaucugcuucugcucuuaaaaagaauguauucaaaggccauucauuauguguccugguuuuauugugauauuuaucaagcuaagggaauuaguauugcuacuguucuaggaguguucuuagugaaaauauagauagcgaccuuuauuaaguacuuacuaaaauaucuuagaugagaucacaacacagccaugaccucagaaaucuaaucuuuauucccaacaaccuaaugaaccaacaauuguuugcaguacuagggcuggaacucaggcaacugcugugccacuagcuacauccacagcccaggaacuaggcacuuaggugacccuauuuuuagaacaaggacuuugaauuuaguauuuaagcccccuuaggccuuguguaaggguugagucccucuuuagaacugauuuuguauaggcauuaaaugauuacaugguguuuuuuuuucuuauucccagcugauuuugaaaugacccuaucuugauauauuuuauaauuuucuaacauuagcuaauauccaucucaguacuggcaaacauggcucuguuguccuguuguauguauggggacagcucccgggcugauguauccaguugguggcuguucccuaucccagaugcuuaaaguucuucucccacauguuguuugacaucaguguagccaaaaccagauccccuaaccaccuccuccagaugggaugcucuuugcauggucuguccauguaacugccuagucuggaagccuaucccagauagauucuuucagucucucgccacuuacagcaggcacugugucccccccagaggcugcccacugaaucacauggcucugcuuccuuggcagcucccucccugcagcaguauaagauucaggcccuguucugcauacacauacaagccuagacuugaacacguguacacaaagucccugcuucacaaauguuccuucugaaaaacaaacucuuaagucagacccaggccagacccuucucagucuucucauaaggccagccauagaaccagcauccagaugggagggguggguagcaaugauauagcuucuuguuuucuuuguaaaacagauagucuugagacuaacagggauguugugauguuagaccaagaauggcagugaaucuguccuggaggucugcucacugugcacagauggcccuguuaccugaccccuccuugccuuuccacuguacacccaacaacuccagguucagguguccucagaucugccagugucccucuagccccgcccaccccacucuaguugcugucuguccccaucaccuucucugucaguuccucuccuguguccuuauuccuguguggugucauuucccacuccugacucucuagaucacaccacuguaacuuucuuuccuucguacugcaauaggcggauacuagggcauguccaggcaaacgcucuuccucugagccacaccccuagcugggaaccguucuggcuuagagaagcauaugcuucccagcagccuucuccgcccccuacccugucuuuuucagauaaugcugcaccuucagccagccugagccccaccacaguggauggcauaugaaauaagcguuuguuuaauucaguaaaacaguagaauuagcuggccaucguagaagaguguucuguaaauuuuuaaacacauucuccuuccccauccauugcagaugcagauuccuaguugcuccuuagcuaugcuucaguaaacauacuuccauugucaucccuuaaacaucuacuguaagcguuuguugaucagacccugugcuguaaacagacccaagacucugcccuggaggagccugccccauggaggagaaacuaggauaauaagucugcaguguugccgacaucaagcauguuucuugcucuggaaagaaaugaagcagggaaggaagacaggagagggacgcuaugcuagggggcacgccccucucccaaccacugagagccaugugaguugcugggggaggaggggcuaccgaggccaaggaagcagcaaaggcccagagaugggugagacccacuuguggaguuuaugaggaaugcuuauuuccuauaaaagguagacccuagauuccauaaacccccaccuuguaacacuuauccggaccuuuuaaucuccacuaccugguaaaaccuuuguuuacacaaagccccagcucccugcaaacaaugccuuccugcccaggaccugaugccuaaggcagcccacccuuucuccuuucccuucacuuccuuugugcugauucuuuuaaaacuagcccaucugaaagauugugagguaggauccuagccaaugaggcaaagacacaaucgccaccugcauuaggguaaaacagaagggaaguucuggcugcugagccuugcugcagcucccaguucuggcauugcccguuuuuuucugcucucacucuguucauuuguuucuuuaaugcugagaguauucuuugucucuaacagguuuaagcaggcuggggagaggagggagugaagccaaauccugugacauucaggcagugaggccaggacuuuguguuuuaaccuggauauagaagaaugccucuuggggaagcaguacaguguggacugcauguuaaaaagaaaccacaagauaggaggagcuggacagacucagggacaggcagggaggacagauggacagccgugggaggauucacaugagcagugauggaggcaccaaccaagauagagagcaguguugagaccaugaaaacccaacgggcuuaagauccacuguaaagauugaacugaaacgauuugcuacuaguuucguguaugcugagauaaagagaaacucaagaacuuacagcuaagguuggcucagugugaguggaaaagugauuuacauaaauauucuuuagacugagagauugauugauugaugauugauugggguucuggggauugaacccagggccucucacaagcuaacucuaucacugaguucuuccccaacacuuauacugaacucugaacuuacaguccuccugugcuggaauuauauggcuuuaccacgaaguccgggauagacugaggcagaaaaugaggggacagugacauggaggccaggagcugggccaugagaaaacagggccagggaacagagcuaugaggcucaggacuggagcuguggcaggggccuagcccccugacccucacugggagaaacuuccagaaaucccagcuggucuggucucaguccuucaaucugguuuguguuuucuaaaugaaucuugauuuucuucugagagcacuugccauuucagugauaaauagaaauaggaacagaccacuagcaauuuccuuauuaguuuuucucauauauaucauacaauuuaauugaaaaguaauuuuuucauauguggaauuuauguuuauauuuacauaaauauguuucauuuaaaaaaaacaauuuuuauuagauauuuucuucauuuacauuucaaauguuauccugaaaguucccuaugccuuccccccugcccugcuccccaacccacccacucccacuuccuggcccuggcauuccccuguacuggggcauauaauuuccacaagaccaagggccccuccuccuagaaaaguaauuuucuaauuuuuccaaugugaaggcauugucggugccagaagcaggacacaccagaguguggcugugugucaccuuuuagguuuuauggccuacuggcauuuugguguguauguuuugaccuagggugugguaauacugcucaaucgucacuguuguccuuagccucugcccagggaucucgucucagggugagugaggucacugaucugaaauguuauauuugaugaaggcacacacucaucggagggucggaacuugugggcgaggcuguuugguguguuugcuguuuucuaaacuguacuaccccuucuguacagaaaaucaaaaggaaaaaaccacccaaauacuaauacuagcugguacauaucuaugaucugaguauuaaagaggcugagucaggaggauugccaugaguucaaagcaaacccaagcuucaaaguaaaacccuaucucccugaccccucaaaaaaagcauucaugcugaacucaaacucaccacgugugugagacugccgcacuucuugugaaugcagcuagauguaucucagcagcccagcccgcccggcucucuugucuauggagagagugaggaauucucaagugagccugccaaaacucuagauguuuccugucucugauaaacuuagguugaaaauucccucaaggagauucuuggcuuugugcuuaggggauguuaauuccgucacuugacagcuguguuguguccuccucugugccaggcacugcccuuacccauaaaauauggcaacgaaacagaggcucuugguuugguuuggauucuggggcaugagcuguaaagcccagauguauuagaacucacagccguccuguuucagccucuacuucccaagugcuggggcaccaacgugcacuuccucaugccuggcucuggagaccuacugcuugucuccagggcucaaacacugagucagcuuucuucaaguccuugcuccugcuguagccacucaggagcccuccugacuagaccaugacucaggcccuugugguguuacgguuacucaggaccaguguacucacagcuaccccugcaggugacuuucugcauucuggggaaugaagccuacauccguggauaaagguucuccucuguguagaggcucacaccccacaggacccuggggccauuauagcagccuuauaguacagcugccaggcuccccacaagaucaugcccauuuccaaauuccacuacauuguuaaagcucaaagccauggcguaacaaccaugcaauaucaccuagaccagacgugguuuaccaguugggguaacucuugucaaaucuguccucagaggaugggaugagcuguguguuuuugauuuacuuuuuuccugaaggaaaagcuacggggggggggggggggcgggggggaggguugacgccaugacuuucauacauuugcuuuguagauagaugucaaggaccuucagccuaaauacugggcacugauaccuuguuccucauuuugcagaucagucaucauggcgaaccuuggcuacuggcugcuggcccucuuugugacuauguggacugaugucggccucugcaaaaagcggccaaagccuggaggguggaacaccgguggaagccgguaucccgggcagggaagcccuggaggcaaccguuacccaccucaggguggcaccugggggcagccccacggugguggcuggggacaaccccaugggggcagcuggggacaaccucauggugguaguuggggucagccccauggcgguggauggggccaaggaggggguacccauaaucaguggaacaagcccagcaaaccaaaaaccaaccucaagcauguggcaggggcugcggcagcuggggcaguaguggggggccuugguggcuacaugcuggggagcgccaugagcaggcccaugauccauuuuggcaacgacugggaggaccgcuacuaccgugaaaacauguaccgcuacccuaaccaaguguacuacaggccaguggaucaguacagcaaccagaacaacuucgugcacgacugcgucaauaucaccaucaagcagcacacggucaccaccaccaccaagggggagaacuucaccgagaccgaugugaagaugauggagcgcgugguggagcagaugugcgucacccaguaccagaaggagucccaggccuauuacgacgggagaagauccagcagcaccgugcuuuucuccuccccuccugucauccuccucaucuccuuccucaucuuccugaucgugggaugagggaggccuuccugcuuguuccuucgcauucucguggucuaggcugggggagggguuauccaccuguagcucuuucaauugaggugguucucauucuugcuucucugugucccccauaggcuaauaccccuggcacugaugggcccugggaaauguacaguagaccaguugcucuuugcuucaggucccuuugauggagucugucaucagccagugcuaacaccgggccaauaagaauauaacaccaaauaacugcuggcuaguuggggcuuuguuuuggucuagugaauaaauacugguguauccccugacuuguacccagaguacaaggugacagugacacauguaacuuagcauaggcaaaggguucuacaaccaaagaagccacuguuuggggauggcgcccuggaaaacagccucccaccugggauagcuagagcauccacacguggaauucuuucuuuacuaacaaacgauagcugauugaaggcaacaggaaaaaaaaaaucaaauuguccuacugacguugaaagcaaaccuuuguucauucccagggcacuagaaugaucuuuagccuugcuuggauugaacuaggagaucuugacucugaggagagccagcccuguaaaaagcuugguccuccugugacgggagggaugguuaagguacaaaggcuagaaacuugaguuucuucauuucugucucacaauuaucaaaagcuagaauuagcuucugcccuauguuucuguacuucuauuugaacuggauaacagagagacaaucuaaacauucucuuaggcugcagauaagagaaguaggcuccauuccaaagugggaaagaaauucugcuagcauuguuuaaaucaggcaaaauuuguuccugaaguugcuuuuuaccccagcagacauaaacugcgauagcuucagcuugcacuguggauuuucuguauagaauauauaaaacauaacuucaagcuuaugucuucuuuuuaaaacaucugaaguaugggacgcccuggccguuccauccaguacuaaaugcuuaccgugugacccuugggcuuucagcgugcacucaguuccguaggauuccaaagcagaccccuagcuggucuuugaaucugcauguacuucacguuuucuauauuuguaacuuugcauguauuuuguuuugucauauaaaaaguuuauaaauguuugcuaucagacugacauuaaauagaagcuaugaugaacaccuggcgggguuuguucucucuccaaugcuccgaguccacuguuuaucgccaggguggcuugggcucauuucacaucccugucccugaggggccucgggucuuaccucugguccugucuuguuuccacuggcuuugcaucuuccccuaaguuauacuuagcccugcugaaacacaaaagcacuccuggggaggagggguggggagaggagacaaggggguggggaguagaguucuccugcucgggaagagguuuguuuccuuuucuuuucaauguguaucaguguuuuugccuacauauaugacuguucaccacauacauugcccucagaggucaaaagacagaucagauccccuggaacugaaguuacaaaugguugugagccacuguggguuuggggacucaaacuagguacucugaaagaacagccacugcuucaacuccagggggagugguuuuuguccugaauccagauucauuuuuuccucuccucucucucccuccccucccuucuuccccauuuguuuggacauacugaucuacaccucaauccuuaauuauuuugagaucauguuaauuuuucuuacugaacgucaaaggcuauucuggaacucaccagguaaucuagacuggacuugagcccaaacuguuucuccugccccagucuuucuugugcuggcauuguaaaugcuaacucccauaccuggcucagacauaacuguuuuuuguuuuuuuguuuuuucuuuugagacaggauauuuuuacauaguccugguuguccuuggaacucacuaugucaaacaggcuggcuuugaacuuacagagaucugcuugccccuugccuccugagugcugggauuacaggucuacacaucuuagaaauagauuuucuugauuaaaaugaaacuuaagcuccaaagugccuguuuuaagcccucauagcucagauuuugcaauuucaggcucaaccuuuuggcccaaaaggccacacuugcaauucacuuugcauaccuguguccauuguaagggaaggcacgggcucauggugcagguguccauugugagaaggcacaggcucauggugcagguguccauugugggaaggcaccagugcagcuauaugaugcucacuacuagggauuuuccugagcagccaucauguacaaaggcaugaaacuugaagaagugguggaaaccacaacgugauagcgccaccugcaggcccguaaggaucacccaacccugcuggggaaaaucccacucacagaauuaagacaguccugauauucacaggucauauaggagagcucuuggggagcaacuccaccaagcagaaaagaagccuaaagacaaagaucugggcaagugcuuuuucuuaaagucagggaggaguacacagaagguagugggggauggggguacuugggggugucuuucgaugcuacuagaucagucagcaguguaagguggcagcuuugaccagaacaggucugaccacacugguucaccugcuccguuggacaggguacaacgguagaggaugcugaggcauugaugcccaccuccugcaggacucagucagucagucgacuuuguaccaggaaugaaaagauaaugccuugagacagcauuaauugcaaaacuaaacaaacaacacaaacucaaaagcuugacuuaacugaaaauacccuucaggaucaauccuuaacgaaaguuuaaccauuuucaugcuaccuuuugggcauuuuccuacuuauuuagaaguaaacucuucauuggcagucauaauuuucucagcugcuccacuaaacgagaagaccacgucagaaugagcaacuggggucaccaccuagcuggcccaccuuucaagaacugcagauucuacagaaagaauuuuuacuuaaagaauaacgacugcuagggagacagcucugucugggcuugcuuggcaaacauaaaggacaggaccacucgauccccagaacccacauuuaaaagucagacaugauaguguucacuugaacugcagcaagcacuggggaaguggacuugcuggcuagccaaccuagccugcucaaggggcuccgggacaaugaacaaugagaggaccugucacaaaaacaaaguagauggcuucugaagaaugacacccaagaccucuaaccucugcaugcacccacacaugaacauacccacagagaggguuuuuuuuuuaagaacuuaaguaaauaugacuguccuuaucuguccccaacagaguguucuagagaacagccaggcaccgacuuuaucuucccuucuccuucaaggacuucaaggugcccucugccuuugaaggaaaaagaucuguacaacuaucuacuuuaucaggaaccuuaauucaggaccccagcuuuuccagacucacagccugaccugaccagcuaacccgaacaauuugugaucauuuuccaaguacagcaggugaccucucuugcuacccagaacucuacuccacacuggaauuuggcugcucuacccuauuuccaucuaugaguuccacccacauuguccaggaaaaccaccaucuggcuggcuuucauggauuuguaggaugccucuugaauggaguagggcuccuugaaccuguacguauuguacguaugacucugcuggucccaacuccugggucuuauaaguuccuagaugaugcugugcugaacccaucaagcacaaggccuuguauguccacacacuggaaacuauaucugaaaccccugggaacuugcuauacaaugugaugggucccacccauagaguuucugauuccugagacuggggauggggccuggaaauguacguuucuaacaaauucccagauaauaacauguugcugaugcagacauuauccagagaaaucuccugcccuucuggaaaaucaagaaaccgaaggcugcccagcucugacacacaaagugaccagauaucugucugggaauacucccuuagaaggagagaauugggcaaaugacaaaaggcauguggagggugugggugagcccugcugugugaaagccaugaagcccagccuaguccugagguccaccguuacugagagguuuaauuaguccacaugaaagccaucccgccaaugcaggcuucuggaacugacaugugccuaggucacuuaggcuaguuaaacacgggcccugagacugcaggccugggugggcucuguaguucccagagucuguggggucugcaagcucccaggugauaaauggcugcuaagcggaaaaccagaagcugaaaaucaaagaugccaagguucgagucaccuguacuccccuagccuuggacaggcauuuggcggagucaucaagggagggugcagaaccuggcaaaggaaucucaggcucucugguuucuuucccuuuguuuguaagggggauuucugauaggaucuuaaguagcccuagcugaugcauggaauucuuccuaccucucaggcucagcuacccucuaucacuccuaaggaguucuccuagucaagagaauuagugcccuaugggcagugggcucguagcuuacuucagaacuggcaucaucaacucacuucacaggugagcucucuaaggaagacccagacacccucacacguucauuaucuucacccuucagaccauccagucucuuggauccucaacagacucacuuucucuguauaaguugcccacagguccuguaagggagcaaggaaaguggcauuuggggccaugagauuucucuaagauggauaugggccucauggauccaagagaaauaaaugagaucauaauuuucuuuucagaauuguagccucuggggacuuccggggguaucugccucaaagucaacaugcagcagagagaggcccggccucucaucccaugaacucaggauugagucuuccagcugcagcuucugaguccagcauuucaugacacuuuagaauugggccucggagguccauugcugugccacauuggcccagguuacacuuuuccugagacgcugacuucuccucaacauccuaggauccagguuugagccuuggcauacgcugagugcuugaagagucuccugcaggccucuccucugaucucauugucuucuuuccaaaaccauauccagguaccaaggaugcaggaaauuccuguccaaagaccaggccucuuccgccucuuaucugucugcuuuguccuggauggacuucaccucgugaagauuugacucuguguccuacagauagccaaaguuuggcugugagggacaaagggacucagagaaagcuuaggugggugagcugaaaguguucacaucugugagcucaagacccuucuacaagaugaaguagggugugaagaggaggggugggcacaggcuagucccuuccccuuuaaacucuuucucucagcccugcaaauagcacagauuuuuacaauaaagucauuacuucuuacaaaggccccaaaucacgaaaauaauuuuaaguucuccuuuaggaugaacugguuguguuaugaacccaagcuaccucccaaaccgagauguaaauauauuuucacacugguaccuuccagccaauucaaccacccuagacagucacuccucaccuucccagggaccuucuugaugacccucuagucgauggccaguguuacagaaaugucuuauagcauauguguuaguuauacuuucaauugcugucaucaacaccugaaagauaguuuaguggaggaaauguuugcuuugauucacuuccugaaguuucaauucauggucaaaauucauuggccccauuuuguaggugugcuacagcaaagaucacaugggaaggaugcucaucucauggucagaaagcagaaaaagaggcagacaagaccaggccaggaauaacaacccccuaaacacaccacuaaagaccugacuuccccuccugacagccccuucagugugaacuuauuaauggauuaucccauugaugacauugguguuggcaugauucaaucaucucucagugauugcauccacaagauaggaaccaccccuucaacacaggagccuuuuguggaauacuccauaucuaaacccugacaaccugucucagacugcaaggaacccacugaccacacagccgagcauaugcgcucccuaggggcacuugcuaacacuugauucugaacucugacccucagaaccaauuugauuuuaacauuacacuaaagcauauuuuaaaauuuaaaauacauauauaguauucucguggaauagaauauuacacagcaacuaacauugugcuucaaaaaugcuuguuacuuaaggaacuguacaugauauacauaauauaauuuuaaaguauaaaaaaauaaacuaaauguauauuauauuaugaaacucagaauacaaauguauaaauacacauauauagauagauauguauuuuuguuugguuguuugguuuguuuuguuuuuuugagacccgguuucucuauguagcccuggcuguccuggaacucacucuguagaccaggcuggccucaaacucagaaaucugccugccucugcuucccaagugcugggauuaaaggcauauaccaccacugccuggcuagauauguuguuuguuuguuuguuuauuuguuuguuuguuuguuucgagacagggucucucuguauagcccugacuguccuggaacucacuuuguaugggccauuuuuuguuuucuuaaaaauacauaucgccaggagugguggcgcacaccuuuaaucccagcacucgggaggcagaggcaggcggauuucugaguuugaggucagccuggucuacaaagugaguuccaggacagccagggcuauacagagaaacccugucucaaccaccccccccccaaaaaaagaaauauacggggaaaguagcagaauaaauuuugucagagguagcuacuacaaaauggugauuuuauuucuuuuuguucuuuuuuguauuuccaaacaacauaguucaguggcuacuucuaugugucaagggguucccagaucaaacauuagucugagagugccuaugggagugucugcaggugaaauuagcacuuagcucaacagcugugugaggcagaggacucccacuacuguguauggucagcuuucaagcccuugcagcucugacuagaacaaaagggggaggggaaggggggagggggaggaggaggaggaggaggagucuguccacuuugcuuccuaccuccuugcaucagcuggaguguccaccuccucagccccccagcugggcuuuucacgagugcuguugauucuuuggccuuuggacuagaaaccacccuggcuuuccuggcucuucaguuagcagagaucagaucaugggaugucauagccuccuuuacuauaugagccaguuucucacagugaaucuuccacauacagacacauauauaacauguguguguguguguguguguguguguguguguguguguguguuucaugugcuaugacacuuugggcuccguuucucagaaggucucuuuuucacaguggacagauaaugcuacuauagagggaaggagaucagcaacuauuccaguccccucagaggacaccucaaccggucccacuuccuucagggacacugucuuuagcacugacucagucuuguccuucccugugccucacccuugucacaccuggccucacuagguccucacaaaggucuccaguuuaaagagcugauagaugacagacucaucugucacuugcccaaaggcacaucauugguuucaccagaaguauacuauggaaaugcuuuaucacugguuuacuguggcacuuaggaaucuggcacagagcucaccaccucccugcaauggacuucccucugugcgugucugugucauagucaccuccccauauaaggacaccggcuuuguuuggauuauggcucacacauaugaccucauccuaaucacuuaaucucuccuuuacagaccugaucuccaaauacagucacauccugaggugcuagggguuagagucucagccuauacauuugugaggacacaauuccguucucgacgucgucucuuuguaaggauccuaguagugugccuguuuguucugcacagacccuaagacgacuucaggacugugcggacuuucuggguucucccccaggucucuccugaauauuuugcuauccgguauccucugugcccuugcacagauggaagucauugcucaguacucgcuucaggauugccaaggguaccaccugcuagugcccacugcagaacaaacagagauguucccauucuauacauagcucgaccacugcaccacugugucuggcgccaagggaaaagcuuccuguucaaccaaauuuguuuaguuugacugaugucugugaagaugcaaaaaaaccucuaaaccagauaaugucccuccuacacagauaauguggcaaacaguccuggcagaaagcuagacuaauuaugaguucucauggagcagugaguguuggcuguaauucagugggaguuguggaaaacuggcaaggcccuuugccuucacgaugugaagcccauccugugcgcaugccuaccacccugugcgccaacacuacucgagcaagggaugagcccuuacaugagggaggcauccacucagcuccauaaugaagcucagcucuccaagggcccaacuuggacagugagggaaaaccacuuggaaggucccuaagccuccaugccuugugucaucuucccuggucuuagugagcucaguggcggggagggaggacuacaagcacaauucuucucucacaacccagccugaaagcuuucucuacacaccagcucacuaaacuaugcauaaugaaaugguacuuucugguuuuugaaugugcacagacuaaaaguuaacucagaaucaagcgaaggcuuuucuggaggucgaguucuggaucaugauggaguggaggucgcuucgaguggaggucgcuucgcgcaccggguaagucccacggccaccgucuccucucauuccauguagcuccucauagugacuguuucagcaccucccuuccgccugggggaugcucggcuguuuucuuccuccugacugcccauucuguccagguguugcugcucuaccucacaaggaaauuauucaggugagggagggcacgcccucaucacacucuaaagauguuuggcgagccugagcugugugaauuccagguguugcaaaaggaggcuucgcuuggggcucggcuucccagagcccacacacaccacgcuccuccaccuguucccucuccuccaggccuugcugaauccuuaagcaugggucauccugucugcaugguccgggaugacuuggccuuuuccguggugacuuucuuuuguacccggccuuccuccccucugugucucucacacugcuugucacuuccacugacuguugguucagauccugaugcaaaaucagauucuuucccaugugucgguuaaagugaaaugaagacuuagccgauccuuuaaauugaggacguccauguuggaaguggaugucaccguaagaguaccccagaugccucaccaauggccagaaggccacuccuaaguauuugcccaacagaaauggaagcuaucuuuaccaagacaccuacacaagaacuuuucauucacaaaagaugaacagaaguagauuguggucuguuuauauagccaaauaccagcacugagaauccaaagagcaugucucugaaaugacaguguuggugacucucauacacaugaugcugaacaaaagaagccagccauaaaggagaaccuaucaugugauuucaucuaugcuccauauaaaaggacaagggagguuagccugguauuagaagucaagacguuggguggcaucgaggacccuaguguuugaaauaauagcauagauaaguagagguauaaaguuuguuuuuuaaaguuacuaaauugugucuuuguguuuguacauuuuucuauaugcuauacuucaauaagagcucuugaaauguugaaucccuaguuccugcucuugccagaucuaguuccaagaagugaccuuggcauuuuccugucugcucugcagcuuggcaauugcuuucuccgccaaagcuaacuugcauagaacuuugauuugagaccaaggcuuaucacagauccagucucgggcaccaaccuugcuguucuuagccaauuaccuuuacagcccuaaacacuuuguuaguguuucugguaggccaccaauuaauauguuaacacuugccugagcauucaaaacagccacugcacacuuacaaugcuuuauacuauuucaggggaagagcauguauggaacucuaaacucccaaguauaugugcucaguagcauuugauaagccuugauuguagcagcuaugaccaugggaccuguggcaccucaugaauggaugugggaaccaauugucauugucaacugugacaauggcaaaagaaugcaaauuagaugcaugcuaaagaguccuuccucagauccagagccgguuagccugagaagaguuggauaauaaggaggagaagagugaggugaagaagauaauggauacccuugcagacugaccuuucauaaacaggaaggggaaaauccacauccagccuaggugggaccuuaauaacgacccaguacugaacaccuggcaaucagggaugcucagcauccaagccacuugagcuggaaggacuuuuaaagaagcagcaauagcaucacagccugguuugugaggccaaggaagcagaugggacccacugagcacgguggaaacaggaaaacuggcuaauauggcugcccagcucuccucuaaagaaaggcugcaugaccugaagcaaaaucauggaaaaccaggauccgauggauugugagcaaccaggacacuuagucauugcccaguggggucccccccaaaugucaggagcugacagauacaggagggacagguauuauuggggaguugcauaugagaggguggugguagaugcuuaguucaccgagcugcauagggcuggagucacaggaggcuugagagagggcuggcucagcagaggccagggaccucaguaucuuugcugagauccaugguggaaugugauccuuaugaggucggagaagcuuggggggucugaaugguugagagcagcauggaaauaagauuaauuaauugaacucuagaggggacgagaggaggggcuaagccauucuauucuccuccuuggcacaaugcagagagugaucucacacaggaagcuuuugaaggagaguuuauuucaugucggagguugggucuugauggucgcuuuauuuauuuuuaaguguucuuaacuaaccgaagaucuaaucaaauggaagacuuuaucaaauaaagacccacuugugcauaccggaguuaccccuuuuucuugucacuucucaacauacuugaauuucuaauauuuguacauucacaagauguguaccagagcccgugggaucccggaacacccacaucccagggaugguccauuacaccuagguagccuuccugccauugucugggcagggagacaaugcccuuggcuaugaucucccugcuccuguacagaagccucccucuucaacguccuuugaggcaggucugggaggccaugugugaggcagggccagaugugcagacucugcaucugguucacauucuaauuugucuuguuagcaccugagcuucuagaauuccucuuuauucuccagcaugcucugucuucuacccuuccuggugccucugagaacagcccuuuguuaauaaucaagaggaaucugcagugucuucaguuugggcgcugcuucccaucacccucugucaaagcccuacucagaaaaggacuggaaagccaagggaggcgggcgguagcagggaugguucauagaugcaguacggaggaaugaggccccagaacgcauugccucuaggcuaaguggccuugaaccugucugagccugugucacgguuaguacagaguugcuaaacuagaagauucuggguccuuuccaguucugcaugcagcaaacccuaauuauguccuuaagcguguauauaaccaacaaaauuucacagauuauugucuucgaguaguaaaacguuagacauuuuuaauuuuuguuuuauuuuguuuuucucugaauuaauuugcaaauaauccucacaauggcggucuuugugccaugucuguucacaugcacagaaagucuguaagucuacaaaaaaaugcaaacaucuuucuaagagaggaaauaaaucaaccuuuaaaauaaaacaaacaaacaaacaaaggcaaaaagguggcagugaggugggggcacagcuagaaguccucaacacaacuucaauagcucuuaguucuguugggguagcuagcuggcgaguccaccuucaggcugaaaauucguuguagauuuuucuggugccaucugcugcccauuacaggaaaggcagcuucauuuaguuccguugaagacaaaggcugcauucuguuuugagacaaucuuaccuauccuuaccucuagaacucacuuuuaacuucaucuuccaguagugaucacaagaggaacacuccagaaagucccuguguuuaaggccuugggacagucacagguaccugugagcuuccugccauggggccgggggcaugauucuggcuccccuccccacugcaccugcgcaguagggaaggcccucgaggaauacauuuuuacugccgucaucuguguauauagacagaucuguaaccuauuggccuuagggcucaccuugaccucaaguaucccuagggaccccaaaaaagcccaaagucccgggcacucaaguuugucucccuccucacucaguccugcuuuucccacauacccaggagaaaguggugacuuuuccacuuuugggggcuccagcaacauggcaugguggauggggguggggguccagacaaauggcaguccuucuaaauugucccuucccaugagguugccugaaagaggccccuugucacuggcgacuggucuuaaggggcaggacaacagauguacccagcaaggcuuccuucagcccccuuggcugugggcacuggaagcugcccaggcuguaguucuucccaggccggucuuaacaucgagaucuucacgugguuuuaucagugaagaguaacaagaggcuccaaccuuccaggguggaggagugaugcaggagcccuugauugguccugcuguggagggaagggcuacccuauuuggagggcuggagcucgguagagaggcccccucccccugcagcgccuauauagcugagugguggccgagggaagguguuccggagaagugagggcuccaagcuucagaggccacaguagcagagaaccgagguauguggcggggauuucccagaccaagcaguggcuugugacuucccuuccagccccacccccuccugucccaggcagggagggaugcuaggagcgcccgcucauucauuccuagcugccucaguauuccuaugcucugaugcuacugggaaaugguagguacuuuggggcuaacuggugggaauuuuguugcugcuuuuaagcccuugccuaugaaacuaaguccugucucaagaaaccuguguuuucauuaaaaaaaaaaaaaaaugguugggggggggggggucagggcucacucuuaaaugucuuuuaugcuauuacucuuauuuaagauuucuacuaccacaagguagucugacaccacggugcuuauucggaagaccaaugaauauuuacuuuguacuugaacuucuuugggagaaaguugguuugaguucauuggggugagaggaguuagaagcuuugugcuuuacccacuggaggacugagacaggcagggcucacaaggauggggcagagaggccccugugcguccuacauacaugacgggguauguucuuagacuggaagagcuugggucuuccuuuguuuuuguuuuuuuuuuuucuuuuuaagauaaacaccaguguugccccccagagcuaaacagucuaacaugagcauugagccugucugagguuguuacaaugagugacagaggcaugccuacucugauaucccagggacccauaguaaaucuucaucuaggugacagcccugacccauuaugcuguaggacucucucuaugucccuggucaacacagacaacgacccugguguuggaacacucugaugcuggccuucagaucaggguggauuuccacaguggccacuguagcuucaggaacaagaugccacagcugcuagaaugguaaugaaggggaguggggcagauccccggagacuggcagcucuuuggacccugggguagauaaccuugacagucuuccaagucucaaugacaucccuuugugcuaaugcagugguucucaauauuccugauaccgugacccuuuaauacaguucuucauguuguggugaccccaacgauaaaguuauuucuuugcuguuucauaacuguaauuuugcuacugucaugaauuguaauauaauauaaaauaugcaggaccuuugauaugugacccccccccaaaggcaccaugacccacagguugagaaccacugcuuuaaccucucuggaaaucccucaacagcccugauuucuauuagcuaaggagccaucaugcccccagcaacacacaccauuagcaacaccugccccugaacuccucacagucaaugcaacucaguuauuggugugugcucucagaaucaauguugaauucgaauuggccaccuaauacaugcagcuuagggcaaauuacuuugauaucucugaaucccaggacaagcuacaaagauuggacaaaaguauuuucuccuugugagaauuaggucauaccacaaaaagguuuuacauaguauacgggcugacauuuaauaugcuauuagaaugagcagaggguacauugucccugggugaaacugggaaaguuccuaacagcacguuuugacagugauguaagagacugggaccccugacugcauguccacucuccuuuucuccuccaauuuagccuccuucucucccugguuucagaaucagcagccaguuucugggagcagaucuggucuggaacggugccaacucagggcacuagaaaguaagaaagacuaggucaggccauuugauuccaacucuugccucccagggaucauuaacuugaaagacugggaaacacaagagaaagcugccuuccuuaugcaucuguguuccuaugcaugaucagcagcucugucccagacaaccaaaaucagaccaagaggaguaaccccuggccaaaacaaagaaagcaagcugucagugaguugacccacugcagccugugcaauagacaucauuaugaucugaggauuccuuuaaaaucugucacuuguuggagggugggaggccaccugaggagagagugacagcccagccuuucccuugcagauucaccaugaagaaccggcuggguacaugguggguggccauccucugcaugcugcuugccagccaccucuccacggucaaggcaaggggcauaaagcacagguucaaguggaaccggaagguccugcccagcagcggcggccagaucaccgaagcucggguagcugagaaccgcccaggagccuucaucaagcaaggccggaagcuggacaucgacuuuggagcagagggcaacagguacuacgcggcuaacuauuggcaguucccugaugggaucuacuacgaaggcugcucugaagccaacgugaccaaggagaugcuggugaccagcugcgucaacgccacccaggcggccaaccaggcugaguucucccgggagaagcaggauagcaagcuccaccagcgaguccuguggcggcugaucaaagagaucugcuccgccaagcacugcgauuucuggcuggaaaggggagcugcgcuucgggucgccguggaccaaccggcgauggucugccugcuggguuucguuugguucauugugaaguaaaaaucaaugaagcuggcagccacagaggugagcuggugggcaaagguagacagagguagcccaguucucucuaucuagcccccgaguguucugaaaguacaacguguagcguuucagggcauuucaaaagucccucccaaguacucccccuacuccauguguuugauaauguguuucagugccccuaugcuccaccccugugagaccuggccuguuccugccuuugcagcuacacuaggugagaaaccagccaaaggauacaagaauuguccugugcacuccaccugauuuuccaacuccaggaaacugaggcucacauugcaggagucccuguccagcacaguuagaaaacagaagagcugggguuccccugcucugucuucccucagguuuucugcucuguguagccuagagcugccuccugaucccuccaagacucagguccaagugcagucccgaauguggacugaaauguggaagucacacccugaacuaagugggaagcccugagcgacaaccgugcaccuugacaccuuacgugagacaauauaacaaaaauuaagcuaaaguagacaugacacuagacaacggcucagaaaucagauuguagggaaauuugcuaugcaccucccggagagcagcuucagggcaggauguguuuguggugucuagaugcgucuucacaaggacugguguuugcugguugggccccugcaaugucugcaaaguuaagaaaaccuuuuuaagugacacauugugcgugcgugugcaugccuguguguguguguguguguguguguguguguuuauuuguuuucuagauagaaauuuuucuauguagcccagguugaccccauaaucaugaucuucuggccucugccuccugaaugcugggauugcagacaugccaccaagcccaauauguguuuacuucugauguccccuggcccuaugugcauguguguucuuaggcaucuuaagaugcucacugcgcacagagcucucugcaaacacugucuguuuuuaaaacccacuuugguaaaagcuaaucuccgugaaucauuuaacacucccaaaauauaauuauuagccaaaaagccuaagagaaaugucaucuuuaggaagacccaauaaagaaguggugucuaccaucauaagaacugauaugccacuuugugaacuuaaauauauauuaaaaauaugaauguuaccuaaauguuuaaaaaucuuuuaagauucuuccacagguuuuccucaccuuucaggacuccaggaguugcugagcgggaucuggaaauaacugcuacuggguguagucucuuguaaacggaguaucugccaggggggucggguauugucaaaggauucaucugcaacauuccagaacacgagugcugauagcaguacuucgagugcugaguucccagugcaaucgguucuucucaaggacaccucuggcaggugucacaugguaaagggacaugaagcagggcggaaccuuuaccacuggacagacagcccagagaaaccagccugcugcaguacgccacugcugccaagacacaccuccucagucuacugauccuaaaccagagagcaggcccagaucacacaguuuaccccuugcacgccauuuuaaauaucagacaauaaagaaggaauaguuaguucuuagauggugauguugguguuucagcuccaagcuuaaggcuuaguuacccgggugcacaaagcuguagacaaccaacuuccuuccagcgugaaaauguguaggcuggacagagucccgugcuccacgaucgcugaguucuuucagaccauugguugucacacccacaagccuaacugugacagccaaugaguguccaugugauuuugacugcaaauuucgcuuauuugauuuuuagcggagacguccuugcucuuacuuguggaucaggagagguuuucuuagcccuucuaaguguucccaacccgugcgcuguagaacagauugcgcaaacugacagcagaguaaaagggggcggggcuucacuuccggcaucccaccaguccacgcccgccguuuucaccucuccagacucgccacuccuuuauucauuugcaacugcaaauguagcaauuugcaauccuaauacagggccagggcgguggauaccuuaaaguuuuauuugacuucauuuagugcuuucuguccauuuuuaaugacuuuuguuuuuuuguuuuuguuucuccagccccaucuccucccucugcccuaguaugaaacuuguaccccuuuacuguguuuaaauauaaagaagagggguuuuguuuuguuacauuacaacccuuaaaauacaacgaucacuuguauaauauuuguuucucugcgguuuguauuccugauuuaguggaaugccauuaaacucucugggucaguaucuaacuaguuaacaucuaacuaguccuuuuagaugaccaugaaguauuccacaguacagaugugcugcaagugacuugauaacuuccuuguugacagaucuucagauuguucuuaucuugcaaacaauaaacacccauacauauacagacagc

SEQ ID NO: 1109 - RNA, 2047 nt, Mus musculus
cugucuguauauguauggguguuuauuguuugcaagauaagaacaaucugaagaucugucaacaaggaaguuaucaagucacuugcagcacaucuguacuguggaauacuucauggucaucuaaaaggacuaguuagauguuaacuaguuagauacugacccagagaguuuaauggcauuccacuaaaucaggaauacaaaccgcagagaaacaaauauuauacaagugaucguuguauuuuaaggguuguaauguaacaaaacaaaaccccucuucuuuauauuuaaacacaguaaagggguacaaguuucauacuagggcagagggaggagauggggcuggagaaacaaaaacaaaaaaacaaaagucauuaaaaauggacagaaagcacuaaaugaagucaaauaaaacuuuaagguauccaccgcccuggcccuguauuaggauugcaaauugcuacauuugcaguugcaaaugaauaaaggaguggcgagucuggagaggugaaaacggcgggcguggacuggugggaugccggaagugaagccccgcccccuuuuacucugcugucaguuugcgcaaucuguucuacagcgcacggguugggaacacuuagaagggcuaagaaaaccucuccugauccacaaguaagagcaaggacgucuccgcuaaaaaucaaauaagcgaaauuugcagucaaaaucacauggacacucauuggcugucacaguuaggcuugugggugugacaaccaauggucugaaagaacucagcgaucguggagcacgggacucuguccagccuacacauuuucacgcuggaaggaaguugguugucuacagcuuugugcacccggguaacuaagccuuaagcuuggagcugaaacaccaacaucaccaucuaagaacuaacuauuccuucuuuauugucugauauuuaaaauggcgugcaagggguaaacugugugaucugggccugcucucugguuuaggaucaguagacugaggaggugugucuuggcagcaguggcguacugcagcaggcugguuucucugggcugucuguccagugguaaagguuccgcccugcuucaugucccuuuaccaugugacaccugccagagguguccuugagaagaaccgauugcacugggaacucagcacucgaaguacugcuaucagcacucguguucuggaauguugcagaugaauccuuugacaauacccgaccccccuggcagauacuccguuuacaagagacuacacccaguagcaguuauuuccagaucccgcucagcaacuccuggaguccugaaaggugaggaaaaccuguggaagaaucuuaaaagauuuuuaaacauuuagguaacauucauauuuuuaauauauauuuaaguucacaaaguggcauaucaguucuuaugaugguagacaccacuucuuuauugggucuuccuaaagaugacauuucucuuaggcuuuuuggcuaauaauuauauuuugggaguguuaaaugauucacggagauuagcuuuuaccaaaguggguuuuaaaaacagacaguguuugcagagagcucugugcgcagugagcaucuuaagaugccuaagaacacacaugcacauagggccaggggacaucagaaguaaacacauauugggcuugguggcaugucugcaaucccagcauucaggaggcagaggccagaagaucaugauuauggggucaaccugggcuacauagaaaaauuucuaucuagaaaacaaauaaacacacacacacacacacacacacacacacaggcaugcacacgcacgcacaaugugucacuuaaaaagguuuucuuaacuuugcagacauugcaggggcccaaccagcaaacaccaguccuugugaagacgcaucuagacaccacaaacacauccugcccugaagcugcucuccgggaggugcauagcaaauuucccuacaaucugauuucugagccguugucuagugucaugucuacuuuagcuuaauuuuuguuauauugucucacguaaggugu

SEQ ID NO: 1110 - RNA, 92617 nt, Mus musculus
ccauuuugcaggcggcugccgcggggacccaaggcggcggcaggcacugcggcgcgagcggugcgaucggcgggacgcgagcccagcgagcugcaggcaggugagagccgggccgccgcgccccacgccccacgccggguccgcggcagcaccugccggcagccccgguugcucgccgagcccacgaggccggcccgcgcggcccccgcgcgcugucacccacccgcggcgcggccugcgcccccacgccggcucgcgcggcccggcggccccggcugcagugucaggccgugcguccccggcgcucacugccgccccgccgggugcccccgggacagccaccgugggcucgccgugcugcguggcuugcugcgcgccccuccccagguggugcgccccgcauccccgcgcccggggauucagggucagcccgaggggcgggggauggcggugcuguuuccagucuggcuuccuucccucuuugcggaaggcgacacggaguaauuuuagaugccgcugcaccaaccuugcgaccuuucacgcuggccugccccgcagggguccggggucgccuuguugccugcgcucuugaccgagaaauugacauuggagugugauaacuugaaggugaagaauugucuucaucguuuggccggagaugucccauuagauguguagccuaugggaacucggccuucauuccggaugaggggcuuuaagcgggucugaugggaaacuccugauuuucagcgcaaggggugagggcaagugcacagggaagaaaguuagcuuuuugaaggcuacuugggguuggggcauuuguaguagcuguuagucugcuuuuugcggugcugggagaccggaugauggcgaagaugcuaucccuucugacgcuuggguccucugaacuaaggcggccagggaugugaggaucugguaucugaguccugagacagccugguuugagcugucauuaacuggccaugugacuucccuuaggcaguuuucuccuuucugaaggcuaggcuagguggcugaaauuuuucuguuuuuuguuugagugcuauugggcugaggccucaccugcuccguuucucucaucugcccuuucaucuugugugacuuugcuggccugcuccuuuaagguguuugacucuggugaaguuugugagaggccuucuucaccucuuagaaguucaggauucucugcuggguuauaguugaccuuaucagggucacuuuagaacuacucucuaugcuuagcucauccaaaaguuaauagcuuugggcaguugaggcuguccaccguguuagcacucaugacacaccugguaguuaguuaaaaggaggcccugagcauccucaggcagacaucagcgaggcaugagguaucuguucucuagacaaugucuuuugcucaacuguuaacugauucuuucuuuuuauaccagaguauuuccaucaccccgacucccaccacuguuuuauucuugugggaaguaauuucuguaagaaaguagguguuugcccggcggugguggcacgaauccuuaaucccagcacucaggagucacaggcaggauuucugaguucaaggccagccugcucuacagagugaguuucggggcagccagggcuacacagagaagccuugucuugaccaccaccaccuuaaaaaaaaaaaaaaaaaaagggaggaaagaaaguggguguuugaguggcauuuuuuuuuuuuuuucuuuuuguccuggcugaccugaaacuugcuccaggccagccucaaagucagggagagcuucuaagguccaguuuaaaguuccaccccuugccccuuacuccagauacuugccugguacuuaguuuucugaguauggcacauuaugcugagauuaaaaccucuacuaaaaagcaauuaggcuggguguggugauguaaauguauaaucuuagcaacucagcccagcugguggagaugggaagaagacaggccagccugggauaaagggcaaggccuagccuuguaaaacuacacagaauauugauuuauuuugagacaaggucuuuauaugcagccgcggcuggcuggaauucauagaucuaccacaucccaguagugagacuaaaggugugugcguaccaccauguccaacaagaaaguuaaaaacaaacuagagggcuggagagauggcucagcaguuaagagcacuggcugcucucccucccccccuuguuuucuuaaauuacaggaucuggauuuaauucccagcaccuacacgaugucucacaaucaucguuaacuccagggacuccagugcccucuucuggccucugugguaugaacacugcacacaccugagacagcacgcuccggggacaccacccacacacguuuuuuucuuuuuuuaaaaaguacuugaaucaauaugacuguccaggugugagcugagccaggacgacaccagugaacaugcuaaagaggaugggaaaagguccacgaggcuucagccccacaccgagagcuguaggcaaccgcagaaagccgggaguggcagaggugguccucccagggacaguaccagucggcuguucagugccaaacggucagcccugacaacacacauacaaguaacugaacaguuauauguagguauauguaugugugcgcacacacacacacacacacacacauauauguauauauauauguacauauaugcauacuauaauaauuagugagaaaagaggcccugaauuuaaaggagauuggggagagguacaugggaggguuugaaaguaggaaagggaaaggagaaauguaauggucucaaaaagaaaaaaaauuaguguuguauaugguuuagauaguugugggguuuuuguuuguuuguuuguuuguuuucagauuuauuuaaugcgccgcaugcuuuugaucccagaacuugggaggcagaggcaggcaaauuucugaguuugaggccagccuggucuacacagugaguucaggacagccagagcuacacagagaaacccugccucgaaaaaaaaccaaaaaaaaccaaacaaacaagauuuauguaauguauaugaguacacuguagcuguuuucagacacaccagaagagggcaucggaucccauuacagaugguugugagccaccgugugguugcugggaauugaacucaggaacucuggaagagcaccagugcacuuuaaccacugagccaucucuccaguccccuugguuuaagaaguuuugaaugccauacugccucccucguuuguauagcagucuagugggucuauauuuuggaauaggcuuuuugucucauugguaagcuugugugcccccccccccaauucuucuguuaauuagguggcagcugcuacugaacaaaccauucuugaauuaaaaccacggcaucuguacucaaaagguguaagguuuaguuaguuccuugguuaugggaaguacugagucagcugucaucaacuccaccguguuucuaaagaaaccugggcgccaucagggguucuggauuugaucccacugauaguuuaaggaguuuugucauuuugguuaagaaaauuaacucuucaccaguaauuugucuuuuuauggcauuuugaaccgauaaguguaagcuuagaaaacccuauuuacucucauacuuuaaaaaaaaauuuuuauuuuuuucaagauaggguuucucuguagcccaugcuguccuggaacucacucuguagaacaggcugaccuugaauacagaacucugcuugccuuugccuucagugguaggauuaaaggcacaugccacuguggccgccacugccuaguuuacccucauguuucuuaagucuuccccagaguucuuuggucucucauucauucacucucuuaccccaccacuccuccaguucucuggugagguguguguguguguguguguguguguguguguguguguguggucuggaguucuuuuacaucuguccuucuugaccagguuaagccugugaagccgguagguuuaaaggagcccuuugugugcgcucuccauauccuugccauucuccuccuggcuuggcugcuucuaucgugucccagguucuagguuguuggcgacuucauaauuaagggcugcuuucagcuugaaacuuucaugggccuuuuacucuuuauccugacacugaaucuugcuagguugcccaggcuggccucaaaggacuucgaggauuuucccuucaccugaucccagucucaggcauucaucuacgucucauccauugcuggacugccugcuuuuuucagggcgguaaucuguguggucagaugcugcagggaggaacccuggagaguuugaugguacuugguuuuuugaauguggcacucucuaguggaggagucagaaaacaggacuuggaaaacaucuuaggaggccugagggaggcuggcagcguggggacgggagcagaaaggacgaggggcccgagcuagucugcucacacugcuggcacggugcguccauccgcuugggagggguuaaaacagucauuuauuucucacaguucuggagacugggaagucggaggucaagguucuggguaaccuaguucugaugagagcuucugucuggcucauagacagccacuuucucaucaagugguacucacaugaccguuuccuagugucuuuucucucccucccgcuccagagcuaagaauugaaccuaggaucuugugcgcacuguaccacuaaauuccgugccagugcuauucuuauaaucuuacuagauugagucccccuuauaguaagaccuuauuuaaccuuaauuaucaacuaaaaguguucucugaaucugagcacauuguagggguuaggagcucgguacaugauuucuuuaguuggaagagcaaaacaguucacuccauagagcagaguauggauagggcuaucuuuaauuuucaugcugggaauugaacccagggcuuuggcauguuaagcagggguucugcagaacuucaccccuggcccugauuucaguccuaacaaggacauuugucuagccauugcuguuugagaauugguguggauaggguagggcugagguggugggcaggucaaaccauggugauuuacuguggggagacaguaagaauugacuggauuccaaggcacggcuagacaggaggacgguaggagaaagaagaggaggaagaguaugucauggaggaagacagacagacagacagacagacagacaacagaggcuccugccugacaccuggaacaaaaguggcugaggggcagcuucccggugugugacgucgugcccaaacaugucauacuccagucaggaaaugaggcaaaugggaucucuuccugucuccagauguaaacuuuguaucuucucagugcccuuaacuuaacacccccaucccccaccccccaccccaguguaggcagucucuagcacuccugggaaguuuacuccaugaagaagaguaaucuuucuagugcccugucagagaaggcucacuuauagguuccucacagagcaccugaugacuagacuucugucucucuuucuccagggcaucucauuaaguaccuggugaaggguacaccuccacugugugugugcgugcaugcaugucugucugugucuguuuguacacauguaugaacaagaggacaaccuuuauuuauuuuauuuaucauuauuuuuugagauuguauuuuuauuuuguguggauagguguuuugccuacauguagaucuauacaugcaguauucuuagaggccagaagagggcaucaggucucucugggauugggguugcaggugauugagaguggccaugggggugaggguauuaaaccugggaccccuggaagaacagccaguucucuuaaccacccagccaucuuccccauccagaagguguguuuugguggcugaaggcgggacaggagaguaguaaaagucuguguuucuuuccugggguugggagugguagguucuguuuucauccaaggugcugccaaccaccccugcucuuagagacagcucugcccuugacucaguguuuggagccaugagugcugacauugaacccuagucuucaagaagagaguccaugcucauaacuacauugucaucucuucagccgcuauuuauuuuguauugagacaaggucuuagagcuuggaacuggccugguaggcuggguugacuggccauccagucccaggaauccaccuguuugcacucuaccaauugcugucucccuagacuagccauuuuuucuuaaauaugugugggaagcuuacagagucgaguccuuccaguuuugucauuggaagugagugaagcuaaauaagaguuaugucuguaggaaccgaucucagcaguaaaggagacccugcaaggaugaggccucuagcccaggaagggaccacugggaugauuugugugcugauggguaugggucaguagugcugagucuguuugauccauaccucuaggguaacuauuggguuugauuucucagauggccccaaaacucugcggacuuaaugauauagaacuccacuuccagaucuuauuccuggugguaugaagagggcagagaagccagcuggcugugugcugggugcucuaccugguacugugugugucacuacuguaguuuggucacagcccugugggguuugcaguucccauuucacaguggggaauuggagguuuggagguuucagcugcauguucauggucgcagugccauugaguagcggagucaggauuugauuccaggcuggucagucacaaacucaacaauuagacuggagcccugcugugcccuuuggucuugcaugcuugucaaggacuugagcuuuggaggugggguuugacugggagggugggaccagcagugauggagggaugaggugagcagagggaaggaaaggugaggagacugugggaggaagcaagcacacacucagugcagccaagagcagcuagaggugggguagaagaagucaaaagggcccuugacaccguccugguggaaggccaccagaagaugccuggaauggguggcuucuuuagauguucauucugaaagcuccagggugagugacugggaggaggcugugguagcuucuucuccugcucuucaggucugaguucuacgguugccugaucugugcccuggcuuggacuccuuuugcuaauguaguaguuacccaggacacuucccucugguuuguuguuuuuaaagcuggcuucucuuugcucaaauaaauauaugacuuaugacaauuaaaauugacuaggcaucuccuuccuccccuccccucuccccuccccucccccccucccuccccucccucccucucucuucucccucccucccucccucccucccucccucccucccucccucccucccucccucucucucuuucuuucuuugagacugggucucucuguguagccuuggcuaucuuggaacucacucucugaccaggccggccuugaacucaagauccaccugccucugccucucgagugcugggauuaaggugugugcacacuccuggcuuucaugcauuucuuuuuaucuagagcuacucagcuuuuaugagauggccucacagcaugucucacaaaugugcccaagucucugaggccauggcauuuccuucaagccauguuccaucuaaacaccgaugugaacuguuuucuaucccaucccuagucucugcacccagggucagucgcccuugguccuccccaucugcacccaguguugcaucugcacuuuuguccuuagguugaggauucuuuaacuuugauuuaaaaucuuuuccauaguuucucuacacccaggaucucauaaauauuaacucauauuuucucuuguuuuuaaaaauuuuguaguuaguacuuguauuggaguacagugugagguaaggacugucuccuccaguuuauuuccaucaccguucaugaauucaccuuauuaacauacccacuauuguaaguguuuggaccuaccgugagguauacuguuugaucgucuuucuucuccuuuauuuaugcagucagucauuuaacauuuauuuauuauuguaugugugcagucaaaggaccacucugaauugauucuuuccaccauugggcccuagggaucaaauucagguugucagacuucguggcaagugccuucaucaguuaagcugucucuguuuugagaaaagaucuuauguugcccagguuacccuauguugcuggggaugaccuuugacaucugcgucuccugccucuucuaagugcuaagauugcaaccaugggcaccauacacaggguucuuuuuuuguuuguuuguuuguuuguuuguuuuccaagacaugguuucuuuguguagcccuggcugucuuggaacucacuuuguagaccaggcuggccuugagcucagaaauccgccugccucugcuucccaagaguugggauuaaaggcaugugucaccacugccuagcuauacacaggguucuuaaauuuuacuuuaaaauauuuuaaauuuaaucuuauguguauggguaauuuuccuauauguacauguaccauaugcaugcaguaccuguggaggccagaagagggugucagauccccuggaacuggaguuaguguugugcucccaugugagugcuaggaauuauccuuuugaagacaaagaagcuagugcucuuaaccguaaccacugagaugucugucuagucccaucuuuaaaagauauuuugcugagaagaauggcccaugccuguaaucccaguacuugggaggcugagccuuaggucagucuaggaucugugguucaaagccaacuugaaugacacagaccuuaccccaaaacaaagcaaagcagagugagugccuuggaugcucugcuguggcuguaccuggaccucugccaacccugggcagaguggagggcuuuaaaagucuuacaagaacagggugugcggaucaguucucucuugccgcaugguccugggacugagcgcagguuguggaguucaccugcacgugacuuaaccccugagugucuguaggaaacacguaggacuggcccuggucacuggguagcucuccuguaagucccccuucccggcugguuugaggaugaccuuacauuucuugccaggaggaauuggauguguuauauuucccuuucagguccuuuccagagcuuucuagcucuuagccagaccauuauauuguguagcugcucgcccuuuucugucagacucuucgaaaacagucucuuccucagagaaguguuguggauuuuguuuuuccccauuaaaaaaaaaaagucauugcccgguggagauagacugaguagguccacagcaccagguuccccucuuuccccucuccccagcucgcccacucaccuugcagcugagcucugucaugucggaagccccuuaguuccugggaugcccauguggccuugcguucuccugcuuuccagacacugguggguacacaugugcucccuucccgcucccuccguuugggguccacuguagacacuugcagggcugaguggauuaugaguggaaaguucaucuaagcccuuugcuuuugccugggagguggaccgacugggcaggagucuggaacaguacuucucgugacugucaaacacaaguugaguuccuuguucagugauaacuuggugcagccuucaacucuauagaauuucuuuucacuuuugaaauuguacacuuuuauuucuuuugguguccgucaacuucuaaaauacguuuucuagauuucauuuugacugucccacuuuccagcaagaugucucugccacugcagucuuaugugagcucggguggaaagacuuucucucugcccagcugaaguuguuaagauuuauuucuggggucucuauuauauuccaguaaucuauauguauguccuuaugccagcauuggguguguccuuaugccacccugccuaaaucaccauagcuuccuguuccguuuugaagcuggaaaaaaccaagccucugguuuuguucuuuugcuauucuuggaccuguguauuuucugggaauuucaggaucagucugucagcuuuugcuacaaggcagaugggauuuugauagcgauugccuggaaucgguagaucagauuuuguuaauguaacgacauaaaaaguuauguggcugggugguggugguggcugucuuuaauccuaauacuugggaggcagaggcaaagucagguggaucucugugacuuggaggccagccugguccacagagugaguuccaggacagccagggcuauuacagagaaaccccgucucaaaaaaccaaaauaaauaaauaaaaauaaaaaaauugcugaccccaggccauugauuuacccggccccaucacccuuuugggggcauuuauuguuuauuugaaaaaaaaaaugcuuggaaucagugcuccucuggggacguggagaagccgaggaugccuggccucggcccagaauuugaggugcagcuucagcuuuccgucaaguguuggagcuuuaaagcuuauuuucaggcaaccuuacugugcagccaggguugagauccagugcuuuaaagcucaggcgugugucacuuucaaagccccggcacaguuaguugauaaugggauugaagggaaacacacacguuacuuacugacuguagagccucugucucucugcauggauauugugucugcuuugccaugucuuaauuuagugccccccccccccaauugcagacuuuguucugauaaauuaagugguuuugcaaauugaccuuuccuggcuguguauaguuuguccucauuggucuguguagagagcagagauagagggaucccuggagggugucauuucucagaaaucugacuuuguaaucagaaaugaauuggaaaaaaaaaauacuggcgauucauagcuguuuuaggaaugucauagaggacagugaagcugcuggucacaaucccgggaaggcucucgggaagugagaagccauccuucugcuccccaacaaugaaauggggggcuuguggugaaguagccauugcuuucugaauacucgggguugcuuguuuuaugugaacgugaaaugucugugucuguguauacauccacauauuauguacagcugucaacccagaggucauugggcuuuuaaaacuucuuuagaccagugagauugcacaguggguaaagaugcuugucaccaacagacagccuggcuuucaugcccauggcccacagguuggaaggagaccuuacugugacaaauuaguuccuuauuuccaugugcaugccaaagugugggcccuccuguaaagaaaugaagggcaguaaagaccaaaacaucgcuaaguacuucuuuaaaaccuggcuucuaacaacuugauugucuggaaugcaucacuuuuugcaugauaaauccgucuguugagucuuuagcuucugacuuccucuaccccccacccccacccccauuucucuugcugugugaauagagacaguggagauuagccuuguuuguaaaucuaggugcauuuuccugguuauuuaaauuuuugaaaggagcaucauuugcaauaugauggaauuuuauuuucauuugcauguguauuuuugugugcccuuagucucugaauguucuugugugaguguguguguguguguguguguguguguguguguguguguucgaugucuuucucaauugcucuccacuuuauuuacugaagcagggucucuugccagaaccuagaguaucaggaagucuugcuaucagcuugccauggauccuguauugggcuugcauguggcccacaugccugccagacuuucaugugugcacugggaacugaacacagguccugcacaagagcaguaagugcuccacagagccaucuccuccaguuucugaugcacuuuaaugauuuuguuuugaauuuauauuuugucaggcuuauuuauuuccaaguuuucuuagucgguuuuuccuggugguuuauaauaguucuucuuuguuuuuuguuuuguuuuguuuuucuuuuugagacaggguuucucuguguggccuuggcuguccuggaacugacucuguagaccaggcuggccucgaacucagaaauccaccugccucugccucccaagugcugggauuaaaggugagugccaccacugcccggcuauaauaguucuucuuauaucaaggauauuaguguuuuaacaaaauauucuagcuucuacaucuuuguaaucuuaugaugcauuugagaaaugaauuuuauugaagaucauucuucuuggguuuaguuuuccgauuugaacugucuuuucuuuuuucuucuuuccucccuuuuccccaucuggagacaagguuucucuguguagcccuggcugucuuagaacucucuguagaucaggcuggccucgaacucagacaucugccugcccgugucucccgagugcugagauuaaaggcaugugccaccacuacuugguagaaauguuguuuuucaaauaguaaaguuuagcguggcguggcagcauuggggagacaagaggcagguggaucuuuaacauugaaggcagccagggcuccauggagagaaccuguuuaaacaaagaaacaauuccuccucucaaagaaaguuuuuuguuugcuuuuuauuaaaggaugaagaaaaaucuuucagaccgugauuuuaaguauaucuuaagucuaagauauuaaauaucuacuaaaauaugcacagaaaaaccagcuaccaccugaauuuagacuuuuaaagauauuuauuuuagauuuauuuuauguguaugaacuuuuugccugcauauauuuaugcgugugcaccacaagcaugucuggugccuggggaggucagaagagggcaugauauucccuggaaguggaguaugguugugagcugucuugcagguggccaugauuccagcacccccagauuuuuucagugcuauuuuugcaguaaaaguaaggugggcuagaggcugugcuguagggagggguaguaggugugauucccagacuuucuguucagguucuaaguuuggguacauggguaucgggagcaccuaugcccuaaggcuuagcggcauguaacgucugucugggguugggguuggagugcucuuuuugauccuucugcuccaguagaaugacaagauacaauucaaaacuguccucauuaugcuuagauggaagccccagacgacucuaaugcuggauuuugggcuuuauuugaacugaggcuccuuuugccgucugaaaucaugucuuuaaucggauuagggcuuacugguccuucugacucugagguccuguuuguggcuuucagguauccagcaggauacaguguccuguugagggccugugagugcaccuuggcacuucucacaacugagaaaggagacagacaggucuguuucugcuuccugagcagcuggugagcugcugccagcaggguaugaguccaaccccucuguguccuccccugccccuuggaguggguggggcugcggccuuucuaagaguucccugauugguugcccucucacuugcggaggucugggcagaacccguuucagcgcuucgguuuugggccgcguucugagucacugcaaugugcuuaucaccuaauugugaucacgccaaggcauuuugggaaaggcuuuaggaaguuuugguucaugcagguacaauggccuuuucagagugauugaagguugacuguucacguggaagggaaagcaggauugcuguggguuuuuuguuuuuuuuguuuugguuaaagguguguuugacauugguaauugccauuggacuuuuaaacuuuaccauuuugccaagauauaauauaauuguauuuuuauuaugucgaucgucauaauuaggauggugaagcccuaauauuuucuaucuccguuuuuccagagaugagaacauauuguccuguuuguaauaugaaauuaaacaugauguccuggcuaguauuaugucagcuugacagacgcuagagucaucuguaaggcauuuucuuuaauagugauugaugagguccagcccauggugugugguggguuggugguccuggauucuauaagagagcaggcugagcaaaaacaauggaaacaagccaguaagcagcacccuuccauggcaucagcaucagcuccugccuccagguuccuccccuguuugaguucaccuccuggcuuccuucagugaugaacaugaaaguguaagccaaauaagcucuuuucaacuugcuuuuugguuaugguguuucaucauagcaauaguaacccuaacuaagacauaggccagugaagaaaaauaucuuuaaaaaauuuuuugaagauauuuacaacuagguuauuggauacaguuauacuuaauaauuugauuugcauauuuauuuauaaaauguagccuaggcauacagaaagcacauguacauacaucuuuuaaaaauauauguguuacaaguauuuuccacauauugagaguuuguaucaguaguggugugggccuugagugaugguagcucagugguuaagaacacuggaugcucucagggaacccaagcuuaaacuaaaucucgccacccacguggcaagcaguaaccacauaacaaccuuuaacaccagcucccagggcuacagugccaucuucccauccacaggcaucaggcagcgugcgugcagacaugcaggcgcucauacacauuaaaaaaaaaaauccuaaaccagaaaauaaagaucaagcuagaaguuuuagucugggauguggguggggcuucuagguccugccccugguugaagagcucuugacaguugcuggagggguagucagaguuggggaugugagcugggagggagagugcgcgugagcucgcugaggagcuggacauagacggugccuauguguggauggauaagaucaaaauacauuguaugcagguuucaaagaggaaauaaaaaaggaauucucaucaccugacauccuugagagucucauaguuuauacuguguguguguaagauuaauuuauuuucacuuuguguguaagaaugaguugggggcuggcgagauggcucaguggguaagaacacugacugcucuuccaaagguccugaguucaaaucccagcaaccacaugguggcucacaaccauccguaaugagaucugaugcccucuucuggugugucugaaaacagcuacaguguacuuacauauaauaaauaaauaaaucuuaaaaaaaaaaaaaaaaaaagaaugaguuggauccccugggacuggaugugcuuauaaggugccaugagcugaaccaggacccccugcaagagcagccagugcuuuuaacuacuaagcugacucuuuugccucucacccacaacuaggcuuuuaaugaacuaauuaaaaguuuuggagggcagggcuuuaugucguuuaggugggccucaaacuuacgacucuuuggccucagugucgagugcuggagcauguguagguguguguuucuauacucggcuggcuccagaugggcagacguggacaugagugugcucugcugguugguucccuauugcuaacagauggguugacucauccccaagccaacagacgggcaccauguuggcucugugguauuuaugguaaaaaauaauuguugucauaacuuauuuagacaauccuuaaauauuggucauuguucuacgaugaaagugaauauaguuauacccauuuaguuauuuuuccaaauaguuuugucagguauguauuuuuaagagguuuaaagaucccccagcgcuggggucacaggcaguuuugagucaucugacacgaaugcuagaaaucaaacucagguucagcaaaagcagucaugcucuuaacccccgccaucucuccagccauugauacguguuuguuuguuuguuuguuuguuuguuuuuuucuuuuuuuuuuuuuuuuuccaagacaggguuucucuguguggcccuggcuguccuggaacucacucuguagaccaggcuggucucgaacucagaaauccaccugccucugccucccaagugcugagauuaaaggcgugugccaccacugcccaauacguguuuuuuauucaagauaauuauauacugugcauggaggcauaccccuuuaaucccagcagucgggaggcagagacagggggaucucuaugaguugcaggccagccuggacuauauuagugagcugugauauuaaagguauggacugccaugccuggcugguugcuuuuuuuuuuuuuuuuuuuuuuuuuaagauagcuauuuacgauuuauuuucgacuagaaauauugagcugaaagugaugacuacuuuucugguuugcagaguggagggacuuccuaggcaugcaggucguauguaggacugaaagguacuagaucugacuucggauacaccuuuaacugcccuugaggaguuagagcagcaccacaacggcucaggcaggggaagcacccacaguucuuuaagaacuagauaugugggcccaaggagccacgcugaugccggugcucaaagcuugcuuuuagacagagaaagggcaggugagucaccuaacugggggacccucucuggucucucaggcuggggcaguucuuugcaucugucuuuuucuccauucacucaguuacuuguucaguguucaaagcaaaggaacaccuacaacaaaaaaagcauuuuccucgcucacuuccaucccagguguaagguguagcucucucagcccuuagaagcaggagcagcagccacugugcugaccuugccugcucagccugaagcugcacucaggaccuuuccgucccuguuauuuagaucaugacgcggauucguggauucucucggcugauuacuguuucuccuguuaaacugacgccacagccuggcagcugagagggcugacguggggcuaauacccuuccugacucuuuuuugcugcugagcaauaaaugucucucagggagacgaugaugagaucaguaauugacguuaagccugggaaauagcaugcugauaauucucaauuauuucugcuccacacuuuuugguaauuuuauguguuuucugugugaaaucaaagauuggcaacugcagagguugaaaucccuuaucuagaauguccaggaccauaaguauuugacuuuuuuuuuuuaaguugaguuuguacggugagauuuuuagggauaggacccaacucuaaacaugaaaauuuuuuuuauguuuucuauauuucuaauacauacagcuugaagguaacuuuauacaauacuugaaaauaguuguauacauuaagcaaagucuugugguauggaauucugugcacuuuguuaucagauugggauuuuugguuagagaugcaauagucuuguuauaacugugcuacuaaacaacagggaugcaugcuccuuuggguaggaggagugggaugacacuccgaggccgccgccgcccccccccaccccccauguaaggccugugaccugugaauggagggugaguuuucuugucccagacuguggggugggagggagggacucuaaguggaaggaugcucucucacugucaggcccgguuuguuccuuagaccccuuuuaguggcuaggaagccacaucugucagaucagcguuaaaacacuucccccaaauaagucuuucacgugucugggacuuuguuugcacuuuauauaauuuugaggcuaaaacgagaucuuaacugugaauuuugaaauuugcccuuggggaauacuuauuuuauuuuuaaacgaauucuuuuagcuuuuucuuuuucccuuucuuucucucucucuucucuucucuucucuucucuucucuucucuucucuucucuucucuucucuuuucuuucuuucuuucuuucuuucuuucuuucuuuuuuauaagaucucauuguagcccuggcugacccugaacuugugauccuccagccuccaccucccaaguaugggauuuauagcucuauaucaaaagaagcauauacauguuagaaauguauucagaauuuucagaauuguguuuauuaggaaggucucagaaucuuaugcuccucuucccccugcaaagcagccugagggacgcucucaucggcauauauaaauacauguauagauaaauacauguauagauaguuacuguugcucaauaagggauauugugcagccugcaguuuucaaagcacuguacccuuacuuuuagguguaagcaauccauuuuaaaggacuacuuuuucauguuguaccuauuauacuuguuaguuuuacuuuaaauuauuuugcuuucuauuuaugcguaugugccugugugaauuauucaguguggugcuguggaggccagaagaugguaacuuacaagccuuggcuuuugccucacugggagucuggcaacaagcacucaaccacagaggcuccauccccugugcccuccuuauaccucuuguggugguuugagugugcuuggcccagggaggggcacuauuuggagguguggccuuguuggaggaauuguguuucuguggguggcuuugagagaccuuccuccuagcugccuggaagucagaaugcuagcagccuucagaugaacauauagaacucucagcuccuccugcaccaugccugccuggaugcugccauguuccugccuugaugauaaugaacugaaccucugaaccccaauggaaugcuguccuuauaagauuugccuuggucauagugucuguucacagcaguaaagcccuaacuaagauaccucuugacucauuuauaguggugauugcuacagugugccucuuuucugguaguuaugaagauuuuauuuugguaaguuacauuuuucugacuuugcauuguuuuagaaagaaaaauacauuucuuuaucauauucuaaucacuuaaaaauuuuccuuccuuccauccaaccacacauccauacauauuucugaauacaaacagaacaaaacaaaaacaacaacccagguucaugcuggcuuauugagggucagacuggaaucccucugcucauuugccucuagcccacuggagaacgcuggacuagcucgcccaagagcaguuggugagaguggaaacuaaugagccugagaguucccaucagucuggauggccaggcucauggcuagggcugugcuggcucuacccgggauagccacuaagucuggcuccagguuuucguuguaaauguauguacagguacaugucacuuuucuguugccgugauaagauacuauggccaaagcaacuucuagaaggaagagggauuguccauagucccggcagaggcguggcagcagguggucagagcaagaagcugagagaucauauguccagcuacuucacaggaagcagagagcaaacuggaggagggcuggggccgugaauucucuaagccuguccccagugauacguccuaaaaguuuauaaccucccucaaccgugcugccagccaaagagcaagugcugaggcacauaugcgugugggugacaguccucacugaagccacccgauucuagaggaagccggagagauguccauccuuuagcuuuagaagcagggcaugaccauccuaguguguaacaaaauccuaauuuuggugguauucgagcaacauggagcacugguaaauuaaaugcaggggcuuugcuguccugaugggcacaaacuccuacuuucucacucugugucccgaggccugucaggaaagaagcccuuuacucuaggauguggaccagucgguccaugaguugugcaugggcacacagacuucagaguaccgagcccugugugaacggcgcccuuuccuguguacagauacuugggcugaaguuuaguugguaaacugugauaguaacuaacaaccacaacuaagcauaaagcggaagaguugugauauacucuaauaaacucaccaacacugcuuuagaaaugacuccgugugcuuggguuucuaaucaaagcccugugcuaaggacaugauguuuaaauccaugaaaaaaaaaaaaaaaagcccagccgggcguggugacgcaccccuuuaaccccagcacuugggaggcagaggcaggcggauuucugaguucgaggccagcuuggucuauagagugaguuccaggacagccagggcuauaaugagaaacccugucucgaaaaaaacaaaacaaaacagaacaaaaaagaaaaaaaaaguccaacugagagcaaaguugauuuugcagguagucuucuaaaguaauauuuuugaaacuauuuuguguacccggugguguugguggucaggggcaggggcaucugaauuugaagcuagcuuggucuacagagugaguuccaggacagccagggcuacacagagaaauccuguccugaaaaaaaucaaaagaaaaaagacaagacuguauuuugugcgacaagaggagaguuuuguuuuguuggcacugagguuugaacaugcuagguaaauauucuaaccacugaguggcagcccuagcucuuaauuuuuauuuuauuuuauuuuauuuuagacaagaaauuacguuguuaccaagacuuaccuacuaacuuugaacuuccauaucccaggcugaccucaggcucacucuguagccuaggcagacuuugaacuugugagcuuccugcuugagcuucagucuuguagguaguugucacagacgugaaccuccacaggagugaacgugucguaugugaccaagcuugguuugggcuggagccuugaagacguucuguaauagagaagccacgggaagagcuuuaggacugggcaugggugggugagaaguggacuccaucccugcagagcaccuccggcuaggucuaagguugcuuuagauuuuaauccaccacuagcuuuucuccagcuaggauuugguucugcuuccuagaacuugcccuucagcuuccauccuagagcucaacugcaguaacagugccuggaccgguccagagcgccauggguguuccuaaaacacaagcagcggagcugugugcuucuucauagagcucugccgggagccccuuauuccuggagccccguacugaccucguccauuguacacuuuaggaagagccugggagugauggacgaacuguuaggugaaugcugaugauaggauaauggacuccucuaggccaaaaucaguguccgcacaggacaccccaagaccaaguucucagcacaaaggagauuuaucuaccccagaacaaagggcagggaaugugagacaaaggcaggagacgagggaggagugaagggaacaagggagagugagaagggauauuugccccacagaaggcucuacaaaggacugccucuggauagagaguggacagauguggcccauaggcaaauggugguuaggggaaacccauguuagggugaguuggcucguuugauuggcauguuaaguaggugagccagagggggccuuuugguugcuggacuuugguacuuugauagcuggaccuugguggucagccucaggaggaggaaguggccaagggaauagacuuugguggcuagcauuaggaauguaaaguuuagcaagaaagagggacuaggggaaggggaaggucagccagagccauguuugccaugcuggggccugcuagagccugucaguaaguagauuagaaaauaaacguguacgaucuugacccucagauuaauuacaagguaggagguaaauauuuguuuugcuuuuuuugcuuuuggcuuugcuuguuauuagcaaagcuuuguugaguguguugcuguuggcugucccggggucaccauggcaguggccugcucucucacccuuccuagcacucugcagugugguugccggccuugaacccuugcagagcacuaagaagcuuuacucccucuuuguuucuacuguucuuaccccaaagcuugauggacaggcagugcaauguuuuuguguuuuguuuguuucacuacaagagauuaaacucaugcauggccuuuggcaugcuuaaccuccaagcugugcccacagcguaccccuccccgccccaccccccuuuuuuaacuuuuaaaaagauggggcaaggucucucucaccaagcuauuuggcuggccuuaacuucuguagcccagauaguccuguccugucucauucuccagggaaucugggcucacaaacgugggccgccagccucagcccuagucuuaguuaaguuuuucuuuuucuuuuucuuuuucucuuucuuuuucuuuuuucuuuuguuugauuucuuuuguuuuuugagacaggguuucucuguguccucuuggcuguccuagaacucacucuguagaccaggcuggccucgaacucagaaaucugccugccucugccucccaagugcugggguuaaaggcgugcgccaccacugcccggccaaguuaguuuugacauucuaaaugauacugcugcagcaucucuuaugggggacaauggccuagugguaagguuguuagacaguaccuaaaguguugauagauauuggcaaauuguccuauagaaaaguuacaagaaaggacauuccuaguccuacauucucuuuuaucaaaaccaaaugaauugaguaugcuaugaaauacuaugucaugauauuuuuauuuaguuuuaauuuauauauugugaaauccucuaaguguauaguuacaagaccuguuauaaaugcauagaaguguggcaaauacucucaaucccaggcacaagcaggugaaggacagguuugaggcugacguggauguagugacuucuaggcuacucagaguuacauggugagacccugucuuaaaaaaacaaaaacuaacauaccuaaucaaucaauaaauacaaaguaagugcuuuuaaaaauauguacauacuccauauauauacaauucaucucccauucaccauguggguucucaagaucaaacucguguagucagauucaguggcaaguaccucuucccacuaagcuauuccuccaguccaaucauuuauuugaaaagaaauuacuuuauuuucauuuauaguaaaagacaucuguguuuacuauuaaaaauaagccuagggcuggagagauggcucagcagcuaagagcacuggcugcucuuccagaggaccuacaguugauuccuagcacccaccugacagcuuacaauuuacuauaacucuaguuccaggggauccagccuccuguccucugcagcacaaggcaugcauauggugaaggcaugcacauggugcaugaauacagacaaaacaaucauauuuauauaaugaaauaauaaaaauuuaaaaagacagcgcauuauaaaaauuaggaagacauauccuugagccugccacuauggacauuuuuguguguuucuuucucuguccguuugcucucccguguaauguuuucucugcuuaagccauugucauuaaauaaaugcagauuauauuccuacaccuuaugugcauugaugcuggaggcaucagguccaucauugucuuuaaugggcauuugccaaguguaucaccagcucagcuugucuaucaucccugggauuugcuucauuaaauacacuuccuuauuucuuuuuccuuuuuaagauugauuuauuuuuuauguuacguacaugaauguuaugccuaugcauaugacagugucccauguaugcaguggaggccagaagaggaacugcagucgcugauugugugcugccugccaugugggagcugggaacugagcuuuacugggagagcaacaagugcuguuaaauacugggacauuucuuuggcacaucuuccuuauuuccuucuuuuucacuugguugguugguugguugguugcuugcuugcugagacagcgucucacuauguagcccuggcuggacuggaacucauagagagccacuugcuucugcccuuggguuuaucaccaccacuccuuacuuaauucuguuccuaaucuuguuuuuucuuccuugccuaauguuuuuugucuagcuacuucccaguugucaagagugcuuuauauuugcucuuaauagccaugguuuuuauagauugaaucauuaagggaucaaaauauuuagaauagggauggaaagauggcucagcagguaagaguucaaacuggucucgcaaauuuuccagguucaguucuugauaugcauaugauggcucacaacugccuguaacuccaguucaaggggauuuaauuuaucccuuuucugaccucugcuggcaugugguguacauaaauacacucaagcauauacaugcacauaauaucaaauauuuuaaaguuuuagggcuucugagauagagguguuugugacuguauguuacaugccaauacaguguuauucauacaaggacuuaccucugccuuguguuuugguuuggaggauuuucuagaagcaauccacguuugucuuaguuaggguuuuguugcugugaagagaugucuugaccaaggcaacucuuauaaaggaaaacauuuaauuggggcuuacaacuucagagguucaguccauugucaucaugguaggaagaaugacagcacccaggcagacauggugcugaaggaguggaguguuuuacaucuugaucugaaggcugccaggaggggacugucuucugcaggcuagcuaugaggagguucucuuccacacugggcagagcuugagcauagagaccugaaagucuaccuacacugugacacacuucccccagugaggucacaccuauuccaaccaugucaugcuuccuaauagagccacuucccaugggccaauguucaaaccaccgcaacaucugauaccaagagucaaccauauauaaauuuauuuuuuguuucuucuucuucuucuucucuucuucuucuucuucuucuucuucuucuucuucuucuucuccuucuccuucuccuucuccuucuccuucuccuucuccuucuccuucuccuucuccuucuccuucuccuucuccuucuccuucuccuucuccuucuccuucuccuucuccuucuccuucuccuucuccuucuccuuccuucuuucuuucuuucuuucuuucuuucuuucuucuuucuucuucuuccucuuccuccuccucuuccuuuuccucuuccucuuccuccuucuucugagauagggucucacuauguuggucuaaaacucacucuguagaccagacuggcuaugaacucagaucugccugccucugucucccaagugcugugauuaaaggcgugaaccaccacaccuggccucauagccucuugaucuuccuucuugagaugauugugcagugaacucugaaacuuaggguucccaaagcuguguuccauuuacauucuugagauggcucugugaaggacaguuuuccuucacuuuccugugugugcuaugacuauuuuccaugcuuggacacucgacucuacauaccucucccuacccacuagauuuucaugagcacuuccuucuugauucugguccaccugugggacuggcuccaagucccacuggggcucauacucauauaguguagauuguaugcucuguuucucucauucacuccagacuguccaguuagauggguccauucccaccuugaugcauagaccacagucacagucagaaagcuguaugauucaucucauuccauuugcuuuaagacugucaguacuauagccagagaugccaagucuguccuaaacuaagagcagacuuuucaucuucaugacugagagcaagcaggugacagacagcacaguacuuggcuuccuagcugagggcaccugcuguguuuggagccaggagcaugaugcuuaaggagcaguauagaaacaccuaggacuacacacauguagaaggauguggggaucugccccguuaacaguuuugagcagugaggaggagcucuuguucuauugucaucuguucccaagagaccuuacuguguuuggaauuuugcuuugaguuugcagucugugugguguugacgucaccuucuuacuuucugacuaucaaacauguuacauaaaaacuguuuauggugugauucuuagcaacaagacaauuaaauauuuaccaaagaaauuaaguaguuucaggaacccuuguaaacucauggugacuugcauaagaaggacagaaaaaagauggcugguuguguaauaguggucaugaaagagauuacagguaggucaggacucuugucuuuucaacuagagagaaauaguuuuaaaucagcaaguugguguuggaucagauauccuacacaucagguguuuacuuugcaauucauaacagaaaacaguaaaauuacaguuaugaaguagcaacaaaauaauuucaugguuggggcuucaccaccacaggaggaacuguuuuaaaggguugcaacauuagaaagguugagaaccacugaguucgaggcuuuguaugugaaacucaguuucucagaugauaauaugcugugguggucugagugagaauggccccauaggcucgcacgcuuugaaugcucgauccccauugccggcaguuuggaaggaucgggaggugugucacacugcugagcuugagaguucaaaagacuuugugucauucucagcucuuucugccuccuacuugccauuugaaauuuaagcacuugcuguucugcugcugcucuaccaucauggacuccgacucucuggaacuguaagcccaguuaaaugcuuucuuuuaugaggugccuuggucaugaugcccugucaaggcaaaagaaaaguaauugagauauacccuuuuuguuaugacuuauuuuuauuuuauuauacguauggucugugugucuguuuguuuagcuuaaauguauguauaugcaacacaugcacgccuggcgccugcaaaggccagaaggcaucagauccccaggcacugaaauugugggugguuaugaacugucauguggguacugggaauucagguccucuguaagagcaacaaaugcucuuaacugcugaguuauucuuucuuuucccuuucccuuucccuuucccuuucccuuucccuuucccuuucccuuucccuuucccuuucccuuucccuuucccuuucccuuucccuuucccuuucccuuucccucucccucucccucucccucucccucucccucucccucucccucucucucucucucucucuuucuuucuuucuuucuuucuuucuuucuucuuucaucuuaucuugugaucuugugguguuuguuuguuuguuuguuuuguaaagacaggguuccuuuauggcuauucuggaacaagcucuauagaacagguugaccuugaauucacagagauucaccugucucugccacccaaagugcugggauuaaagguuugugccaccacacaucccuacucuuucuuuaaaaauacuuuaauuauguguguguguuguggggaggguauguauaugcacuugagucuagggaguguggagcucagagguuauggaucucuagaguaaucaguccuauagaagaucaggacauacucuuaucuuagccacuaagccauaccuagaccuagaggcucacagucuucaacaugcaguguggucgugagacaugcuuaugucucugaaacagcauuuucuucucuaauuuucuaguguguacuaauugagauaaauuacacaauuauacuagaagucacauacuuuucugguagugauguuaaauaaaauaaaaaguaaaauuaauuguagucauuaaucugugugagaagucuaccauuagauaauacauuuuuggcuucuaagcuuuggaauuuaggguucgcauaauguaagccagacuuucaggagcuguggaguaaaauccauuuguacgguguaucguaguuuccuagugcccagagagugcuguggaccuuuucagcuaaaguguuacugccccgcuugucuuccucccuaggauuuaaauguucugugugugauuugccugcauguguauguaaggguaccaaguaugugccuggugcucaugauggucagaguaggagcaggucccuuggaacugguguugggaugguugugagcuacccuguggguucugggagcugaugcugggcugccugcaagagcagcaaaugcucuuuagccuucuuaccacauugaagauguauauaauguauguguauauugaagauguaauguauguguauauugaagauguauauaauguauguguguauuacauuguauauaauguauguguauauuacaugcuuccaugguuugcacaggucuuuauuuuuaggcauuaguguuuucccauuugucuuuagaauuuuagugagcauucuuaaugaaaaauuugaguauauucuauuuuaaacuaagauacauucuuuaaaauguacuuuuagugcuuuugguugaugauauuggaugacuagagacaccgucccaguuggcacucucacuagcaguauuguacguaugcuuuccagcuagagcuuugaaaauuauuuugucauuuuauuauuuguugguuggauuauagaugccacaccuacuuuuacauauuuuauauuuuuauaaggaugcucaugcauaacuguacuccuguccgcagugcauugagacuccucagcacagaaggagagguggggagagucuaggccaaaugagccuucucugaggcugaugagucuugaagauaccaagaaaggaaagggacaagaacacagcuaaugugaaagucagagagugucccugagggcuagcucaucacagcgcagcagggcucaguugggaaaugcuguggcccuggagaauucuuggucauacucuagauuucgugugugucuguguguguguguguguguguguccagaaacccacuuuuuacucacaagcuccuucagugggccaguccuauuauuauucauuuauuaauuuggcuuaugugcaggugccggcccguggaggggucaggcccuccuggagcuggaguuacauggacucagaaguaggcgugagucucaugauguggaugcugggagccaaagucuacgaagagcagcaugugcucugaguggccaagcggucucuccagccccaacuuacuuauuuugugaguuuuuuggucuguugaauucagcuggagauaaauuguguaaaaaggugacauuuuuaaucacacauuuacaauguguuaauuaaaucucauuuuaauuuuuuaaaaaauauuuuaaauuauuaaguuuccuuccccuacagcuuguauaacauuccauuagucugcuaccucaacccuggccuucauguucuaggucauuaagucgucagguauaccacccucccccaacuuccugcccucccaccugguguaggcugaaggucgaugucuguagacaucacagcgagauuaugugagauuaugcaguagucaccucaaugaacaacgcuauauacccacagcugugacccccucuucccuuacagguuuugaauacagguuaauuugaaguauccuguuugauuacuagaaaugaaguaggugccuacaggagggggcaucgcgcagagcaagcagguuuuuucccacuggauuaccuuacuucagucgccugcugcugcgcaugcuuuagagagggccucuggcucucaagcaugugaauguugguucccacucuccuucccgcccugucccaacugggauacucggauagggucugagcgggaggaggccguucgugugggugaaguaacuuccaccuuacuguuucaguuuuccaagugcucgcaggcacacauucagucauacauaccuugagauuauagaucagugggcagcguuaaaugaugccaaggcaaacagugccccauucuucucccguagauccuggccuuucagugugaaccuucaccugccuucagcuucuccccacugcacucccagguuuggguuacuuugcccagauucuguuucuacauuuauuuuaagugugcaacuugauugucuuugaaauaugaucauuauaguuuucgugcauauaaaauguuuaaugagcugggggacagcucaguaauacuugucuggugugcuugaaucccaggcacuuagggagcaggggacuaugagguuucuuccuuccuucuuuuauuuucugcugugcugggauuaaacccguggccugcagauggcuuuguauaaaauaucucugcacguguguggguggggaguaguuugggguuuaauauguccuaauaaugaaacagaaacuucuuuuucacagucugccaccacacccuucuucuucuuuuaaacacacuguuuagaacuagauggucccugcagucacaggaagaaggagaggcuuucuuuucucccucagccagcccaucgcccaggacgggcugugucuagcucugugaugcgcuggggaacgcuggcugggcugcacagccaggugcugguugaguuauuaauugaaugagagguaaggagucaccuguuaauaagacagaaguugcugugugagucagcaucagaaguaaguugaaaauauuuuaauacucuucuguauguugaaaauguccagaauacauuuucuuuaacccugucccaacgcuggggucccgucccaggccuugcaaggccaggcuagcacucucccacugacugaacuguguggcuccagaucagacaauuuuguuuuuguuuuuguuuuuuuuguuuuuuuuuuaaaccuuuaccagugccaacuaauuauuacaacacuagagggcgcuguuaauuaauggguucucugcuuuuggugcucauaguggcuccccucauucauuagagucagcagagguuuuguucguccgauaauccuaaauuucucauguucucagguuaacaagagcacaggccggaaaugucaguuguaacauuuguuugcaaagucacaaucaagccacacagaucuauuaauuuuuaaauuuaaauguuuaauagacguacagaauaaccccuuccuuuagcaaauucccuucucacuuacuuuugcuugggucagcguaggccagaugcuccucugugucucccagcccagcccagcccagcccgguuuguuccacucagccuaguuccccuuccguguucaagccacagcugcucuucuaccuuuccaucucucucaugggccaccuuuuaguuuccuggucugaacacacacuuauaaaauuacuuauguuuaaaauuagaagcaaugugcgcaggagagauagccuuauuugucuuaccucacuugauauguuuucuaaauucuuagagaaaaagcaacaaaaaagauauuacauuaauaaaaugagauguuuucaagugcguacucauuuuuuuuuaaacugcauguguguuugugugcauauaugugugugcaugggcauguagaggccagaggacaaccuugggugccauccagcaaugucauuuccuuugagauaggggucucucacuggccuguagcucaccagucaggcuaaaccagcugaccagcaaguccuagggaccauccucacucccuccccagugcugggucacaaccaugugccaccaugccuggcuucuuaucuuugaaagggguucugagggucuaacuugggcuucagguucacaguuagcccuuuauuuaaaaagccauuuuucuagucucucccaugaugguccuagccccuucuuucaacaggauuucucuguauagucuuggcuguccuggagcuagcucuguagauccaccugcccuucccagagcgcugaauuuaaagccauaugccaccaugcccagcugguaauuucugaugaauuaaaucuuuucauugcauuuguccaaguuuacucuuuuaauuguuuugacuuauuuuuuugucuugaauuuaacccuacacaguugguaagaacagagcugcucacuugccucuuacuacacugagagagacauaaguagagcuuaaauacaggcaaacaugaacagcacaggagucccacuguagagauuaacaggagugcucugccugcacgcacagcucuucccucgacacaggugcagugugggucuagccggugggaaauccugugaggcagguuuguguuaggcugugggaguaucauaguuuauuuguaccauuuuuguuucuucaaggucuauuuaauuuuaugcuuagauguguuuugucugucugucucucucuguguccaucuguguguguguguguguguguguguguguguguguguguguaucccuguccuaugaagucaucauagaggccagaggagggcauuggauccuucaggucugaaguucuagugauugugagccacccuguggugcuuggagcuaaauucugguacuuugcaagaacaguuggugcuguuaaccagggagccggcuccacagcccuuucucauuucugcuucugaguuccucuacauccuugcagcgccucuucucuggaauccccagagcauucugacuaaugcuuggcucccuggguccacugacgcuucaguggguggcaugcggggaucaguguccuggcccucuggggucccauucuucuccaggcuucuccugcuccaggagucuucuccucuggccccauggccucuuuucccuccacacaacagcaauuucaucaagaaauuggacaguggcccucucuguucuccugguucuucucucucuggccgaggguccccucuucucaggugugcagcucugcuggcagagccucuucugccucucaccugagccugucuguguucccucuggucugggcagucuacucuaagagauggggacagaugagggaacgucccaggaggggaggugcucccugccucacuucagugccugcuggcccugugauggaaucaagacuaggaaggguagucugucugucugucugucugugcagucuuuuccuccucugggacuguagauagguccugucuuccacaccccagggacuuggguugugugguuuguugugagagcuuauuuuuguugacuuugcuuacuuuguaaugaugggguccugccguggcaucacugcaauucuuuaaguuuugcaaucugaugucuuugggcucugauagggggaaagaaaaacugucagugaguagaaguaaucucccuuuccacugagcuggcagcagcaagggcagacuugcucaucugaacugucugaaaagauagguuuuaauuucucuucuuugucuggguuugagaaauacaaccgcagcagcugcugggauucuaugacagacccagccugcucugaagaagccugcugcaagacugguuucaagacgauaauggaggccugcaguaacugcuugucaccaggcgguggcuguuguguaauacaaauagcauuugaugaggugcgguuaguuauacaauuuuggccagcucgugugggauauaagagcugaaauuacuucagcaccugaaagcagcuccugcugcaccucaggacagucacagacugcacaggcguggugggucgcacacugacuggaggacgguuuuguggauagacugagauuccguugaagguaugaccauugcuugguauaagagcucugcuuugggggaugaguucugaggcuuauuggacugugucugaauaugucugugccuguuucuuaugugcauuugugaccguguggauaccuauguggccauaugucuguuucucucucucucuuucucucucucucucucucucucucucucucugucuuucucucucucucucuguaugugugugugagagagagagagagagagagagagagaugcauauacacguguuuuuaugagggagacagagacaagacuguaguguaggugggugaauaguuuauaguucagguucauccagauguguuacuagaaaugucuagacuuccucagugcugucagggacuauuuaaaacuuggugacugaacacuagcauuuuugcaacugucagaaggcagugccccuggucauacacgugagagccagugcagagcaugacaggcugucuguagcaaugaagcgucaccugacuuccuggucuuaaguccuguugggacuagcagggcucuguguguucugucuguuuccuucuuacagccuuuuagaacuuuggagaaaagcaagaauaaaaacaaaaggaaauguaaauaacaaauuucauaaagagcuggggccucuuuuauaauggaguacauuaauuuuuuaaaaauccuuacaaauuauagguuuuuagauuuuaagaagauuugguuugagaguuuaaagaaaauuaugauuacuguggugucugacucuaagugauuccaguuucuguguuaggcugguauuauuauuauuauuauuauuauuaacauaggguuuuguaauguuaccauggcuugccuugaguuuucagucuugaaagcuugcugggcugggcagugguggcacacgccuuuaaucccagcacuugggaggcagagacagguggauuuuuuaguucgaggccagccuggucuacagagugaguuccaggacagcgagggcuacacagagaaacccuaucuugagggggaaaaaaaaaggaaaaagaaagcuugcuugggcuuagaauugugugccacuggaaaaaaaauaccuugaaaaggauuucuuagggaucccugugguggagggagggugacaagggcaacaaaaguaauugcaguguaguuuaggcaaaccauagcaucaaucccuuaggaaaauaccuuaucuaggaaaaaucugcagaugaagugcagucuaggugggugggcaggaaaagauagagguuuacagauggagggggaaucaagagaacugagcaggcaaaaaucuagcaaaaguagguagacgugugaauaaacuaggguguaaguaaguggagaggggcucucugggauuaugagaaggagguuugacuuugacguuuguuacaaggaaaagauaggaacaucccaaugaggacuggugugguccaaagaggagcucagagggaugggucagaaaugcuucuccaauaggcauggcuucucucggugggggaguagagguggagagccgcccagagcucacuggugugcuccuccuuagagggaggguucauggugcugcaaagagaggcuggagcaagggaccaguacauuagagcauuagagaccuggaaaaagagaaagcuguuuguagcucuugacaauaaaucaggaacuuaggucuuucguuggcuuguuccaaaauagcuaccagucuucagagcuuugcccuuuuuucauuuucauuuuuaaaaugauuucacuuuuauuuuaaaauugucugugcauggaugcaaugccuguggagaccagaacaggucauccuggaacuagaguuacagguaguugaguuaccccacacgggugcugggaauucagcucaggucuucugcuugcuaauuuuaugucaauucaaugcaugcuagagucaccagaaaggagaagucucaacugagaaaaugccuccauauggacucuuggcaagcuuguagggcauuuguuaaauuacugaaugauaggggaggguuugguccauuggggccgggcaacccuugaacagguagguggaccuggcuucuaucaagaagcaagcggagcaagucagugagcagcaucagcaucacucauggccuccgucagcuccugccuccagguuccugcccuguuuggauucaguccugaccuccuucagugaugaacaugauauggaagcgcgugccagugaccccguccccgcuuuggucguggugauucaucaucacagcaauagugacccuaccuaggccagggccucuagaggaggagaaagagcagaggcuuguucugcaggaagccugcugugcucucggaauccuugccuagcccacuuuugcucuucggcacgaacauaccaaccucuuagccucaguugcucuacuuuggaauagagacaacaaccccuaccagaguuuuuaaaagaguuaaaggaaaucauauuugcauuuagaauguacauucauuuuuaccuuauugcuuaguuaggguuuuauugcugugcacagauaccaugaccaaggcaacucuuauaaggacaacauucaauuagggcuggcucacagguucagagguucaguccaucaucaccaagguggaagcauggcaguguccagacaggcaugguacgggaggagcugagaguuuuacaucuucaucugaaggcugcuacuagaagacugauuuccaagcagcuaggaugagggucuuaaagccuacacccacagugacaaaacuauuccaacaaggccacaccuccaaauagugccacucccugagccaagcauauucaaaccaugacacuuacugauaaaauuucaugugaaccuugcuuuucagaaggauugggacaagcucaguuggugaaguguuugcuacacaaguaugaggacccgagucugauacccaugugaaaagcggaccaugcuauauuuauaacacgcauauuuguauuuauacacugcugguaagguggagacagguggguccugggcucaccaacuacucaggagcuccagaccuaagagagacuuuguuuggaaaaacaaggagggcauuuccugagaaaugacaccaagauuguccuuggccuuccacauacaccuguaugcacacaucccccaugaacacacuccguguacacccgugcacaguuagcuuuccauggguuucuguaaugacuggugauaaccauauuguuauuuguuuguuuucgggugcuagagaggaagcucagggcuugugcaugcagagacugccagcuucggugcggaggugcucucggaggugcuccgagcccuacauuuaggucuuaauucuagcucugccucuccuccccuuugauguuccagccacgagauuucccggaauaaaccgggagaacaacugcuaaguguuguuuuucucugugacuagcaugcccuuuagaaaaaguuguuucccuaaaaacugugaaugccuuuuauauccuugucccugugucccucaucugccugcugaggaagcugaacugaugccaagugcuguggaaaugcagaaaaggaagaggcaauucaggagugcuuccgaggcggcggccgccugaguucaaaucuggaaacuagagauagccuggaaaucagaccgagcauggccaguguagauggcagcuggagcugaggaggcaaauccaggaugaggaggcgagagaugguuuuaccaguuuuauuuaaguaguguuuggggaagcaguuucugcuggaagacuccaggcggacuuagcauaaaucugcuguguaaaguucacaggauacuggccuugcaagcaugaaggucuaagucugaacccagccagggaaagagaugcguaaaaucgucacauuugugaccccggcaucccuggggcucagcaggaggucaguguagcuugaguuggcuuguuccaggcucagugagagacucaaaagaccagguagauuguaauugaggaaggcacucauugucaaccucuggccugugauccauguuacacauacaugugugugugcacacauggggaggggggagggagacggagagagaggagcuugcuaguagacuuuguaugcacaagcaaacugugcugacacuuggaugguucuuccucuucccccagcugaguguaagugaauguguugaccucccgugggcugacugucaccucguggcaucucuaggcauuggggcaauggcuucuugaacaauuguuccugccggggcucugcagacagaaccugguuucagaaguggaauuugccaugaaaccuggauucccccaucagaaaccaggcuucaucugauccucuugaaaugcucuuuucuuuuucuuaaaauuuuugggacuggagagauggcuuagcaguuaagugugcuggcugcucuuccagagguuccaaugcccucuuccugccuccaugggcaccaggccauaugugguguacagacaaacauucaguuccaauaacuguaaaaguaaacugaucuuuuccuaaagagaacaaauccuuaagcuaagacagugacagagcgcuugcuuaccagccuuugguguaugaaggugacccuuuucaucaaagcaggggcgagccauuuguauaggagccaggcagauuuaguuuugugggagacugcacugcucuuagugggcacuucccaugccucuuguaacuaguguugucaucuugcugugugcauucaugguuucccugaguguuuaaguuacaguccauccaggcucaggacuccugcuuuugcgucacuauagagcuuuuauauaagugguuuucagacuugauuuaauugacccacagugcaaagauagcauuuuaccuugaagcuugcuauagaauacccaaagcuuaguaauuuaaaacgaaagagauuuaucucauaauuuuggagaccaaaagucuaaacagaaugcugcuaaugugcaaaaggccagauccagugcuccagcaaggccaggggcuuggcugacuguaauuaccucaugccaggugacgucauguccagggucaggagagaucacacaauaggacuggaagcuaaaaguaugcugcaggauuugacugcuuuguuuauagcaucuuuuguaacuggguuuccagaacugcccgaguccuagugucuuccuguuggcuccugugacaucagcacacugaggaucaaauccccagcacaggcgaacaucuaagcaccacgcuaaguugcucuuaucuugggaguugugcucagaaauugcugcugugucuguuuuuguauguagcccuggcuaguuuggaccuuucuauuuaguccaggcuggcuuuaacuccaccccuggguuuuaggcuuugccacuauaccugaccuagacugaaaccuuaccugugggacaacaauucuuccugcccuggcaagcugcuggcagccuauuuauuucugaguuugcuuacccuagacagcugauaucaaaagagaaacaggcgagugaguugcacuuguauggugggcuuuucucacuuagucugaguaaguguauuacuguuuuguuuuguuuuuaauuuucuuuuuugugugaacaauuucccacaugaauaaagguuucugugcaguuuaaauuuuuucuucauuuaucuuauauguaugaguguuuuugccugaauuuaugucuguguaccuugugcauugcuggugucugcaaaagacagagcugaaucccuugggacuagagguaagauaagaaaggcugugaagcugccaugcggguacuaggaugaaccgaguuccucuguaaagagcugccagugcucuuagcugccgagccaucucuccagccucugugcagucuuuaaauucagcucuauggcauuguuuuuaaugaguggaucguaauuuuaccgugccacuaaguguuugucuuagucauuaccuuagaauauacugcuggaaguaguguacuuucaagacauagcauaugcaaggcccugaauucagucccaggacucuaguaugagccuuaugguacacaaaaccaaaucaccuucucaucaacucauuuuucaccagaaaucuaugaguaucuguucuuccccgugcuuucuuccauugagaguguaagaacagaugacacuggcaagguggcucaucauugcauuugacuuuaaguaggacucagacgucuauugugcaguuuguacucaggggacuggagacggaagcacuguccugcucaucguacacaggggguuaugguuucuucuuauuuguaagauugacuuagggaguaaaaauauuuaugugccauuuuauaucuauugcauuuugucccuuaauuuugauuugucucuauaccuaaaucuaaagaacuuuacauuaugaaaucuaucagucuuaauuuaaucuuuaaugauaagccaagaaaagaguucccuaguaacucuuauguaauuaauuauguaauuauguaguagacuuuuaaaaucuuagcucuuucacugauuuuugugaauagugaauugucugucaugaccuggauuacauccauaccuaccuauaccuugaugugccacugcgugacuguucuugcucauuauuccaagacguuuucgggguauugagauuacauguuuaucaguucugcuuauugaaaaaugaaucuccuugcaguagccccaguaggccucuguuccagcggucacucaaaucaaauaagauuauaaucacagaccagaaauaauuguuauuuauguaauaagaguuacacagugugccuggcauaaagaccacuuaacaaauagaaaauggauaucauuacugucauugucgucauuacccuucaaccaccuuucccucuaucaaguggucagugcccagacagcaagaagccuggcgcauucucuguccguuuguaaggaauaguagcagccucgacacccuucauuagggaacuuaucuagugcuagaguucuggaagacuuucuuuuuuuauguuaacacaacacacacacaauuuaagacuguuauuacuuguguauaugugggagucugugcaaguguauguaccacuuguguguaaaagcccucagaguaggagagguguuggguguccuagaauuggaguugcagacaguucugagccagcauguaaguguuggggacugaacaacagguucucggcaagagccgcaagugcucuuaacugcugagcuaucuuucuaguacccacaauuuuuaaaauauaguuuucuaaugguaauaauauuauauguauauauaauaauauauuauuauuauuuucuuuuuugagauacagucugucuacauaacccugacuguuucaggacuaacuauacagacuaggcgaaucucuaagucacagagaucugcaugccucugccucccucaugcugggauuaaaguguucacugccauaccauucguucauucguucauucauucauucauucauucauucauucauucauucaugugugugccugaguguggauucauuaccuugaaugcaaugcuuacagaagucagagaaggaguuggagucuauaacuggagucacaaguaauugggagcugggaauaagaauaguuuguacucuuaaccuaaccugucagccaucccucuggucauguguuaucagaaauuuaaacaagucccuaaacuucccucugcccuugucccuucccccuuuuuuguccuuucaccuuugcauuucccccagaccuuggcauuucccaugcaaaacaacucccugugugguugaggucauugaucuuguuaguacacuguaucugaccccguggcugucccugugagccaugcauacauaccacauucauuuguugucccuguaacccgaagccuuccacagagcguggucugcgaggacggccagcacugccccagcacugccgcugccuccugaauaaucagcucuccccaacuugcggccaaauacaaacauugccauuggagcucaaaaguggccuuguggagaacuauuuuaaguuaaguagauguggauacgauaagaauguaagugagcauuuuucacuccgggaagguuugaugggugucuuggagucucucuguucaagaaugcaguuuggagucugggagauggcucagugguuaauaaugcuaccuucucucccagcaccuacauggaggcuaacaagcauuuguaacugcagucccagggcaucuggugcucccggcaccaggcaugcucacaacacaggcuuacaggaagguagaacaccuauagacauaaaauuuagaacuuaguggauuaaaaaaauaagacuguaguguggcacgcaggcugcugugucuuguuuucccuuucuguucucgugacugugaucagcugucacgugccuuugcuuaaccaccccaaauggagaagucuuuaaaaagaaaguuuccuacuugauucuuacacacccuuuaguuuaguuagacuuuccuucuuggaggggagauggaucccacauugcuugcuguaauaggaagcaccuugagugugcucugcaccgcccccccgcccccccccgcccacucaugucagucuugcuucauauagagccaggcacacuggggcuuguuguguuguaugugugccagcccuugcuuguaugcuuugugcguucucaucuuugaagacagguuuuucacauguuuguuaauccccgguggauuagcuguauuguccagguuauguuucgugguuugaaauuguuuuaauuuuuuucuccuuugaaguguuaucuaccuaauuguugcaagaucuuucugcuuuugaauuuuucuuuucuuuuuuuuuuuaaguuugggauauuggguguuucuuuguugaauauuuccaucucuuagauucuucagccuugucauauccaucucggauuuaguaguggugaucucucucucuucccacgccuuguguaccuucucuuuagguauuuagagggaggcccuggguuuucuucugaaguguauuuauguuaccuaguuaagcaugacugcucugacucccauuuugugguucuuacgaacugagaacgcaugcucuuguuuugcuugaagucuacauagccaugugguuauuuuuaucuuuuauuagauguugaacgccuucugccuuccauagcauagguagaggauuuagaauuauuuaagucaccuuuuauuugugauaaauuggcuauaucugcauugucuuaaauuuuaauuaaaauucauuucugcauuggcacaagccacuuuuuaagugccagaugccuacaaauaucagcuggacagggcagguagagaacgcuuccauugauggaaaugaucuauccggaagcucaggguuaaugcacauuauaggaaugccuuagcuguuuuuuuuuucuucuuccuagaauucuaauauuuugacauaccauuuuccuucuuucuccaggggagugguaacugacuauaguaaaggggguggguuccugaaaagcacuggugucuugucagcuguuugggugcaacguguaccugccuaagucucaugacuguugcacugucuuuugcaggugauaggagaugacaggaaccuccaucuaagacuccagugucccuggugcugacgagcugccucuggucuuaaacuccuggcuugacuaagcccucccuguaaccacuccaggccaaccgcuguguagguugcucagccuuccuugaugauggguaucggcaagaacacggcauccaagucaguggaggcugggggcuccacggaaggcaaauaugaagaggaggcgaagcacucgaauuucuuuacucucccgguaagaguguuuccugccugcaguucuucucuggaguauacguaggacacacuuuaacacuuguguuuucagugaacauuguggcauugaaaaaucaaccgucucucaugauguuauauuggcuguacucuuagccagccucaggggaccugcuugaguuaacccaggaaggaaguacacacugcuauuaauguuuuuuuuuuuuaauuccuuaauuuuuuauuccugguaccacuaccacaauuuacagggcaauauaccugauguaaugaaaagaaaaagacaaagcuacaacagauaaaagaccucaggaauguacaucuacuugacacuacauugcauuaaucaauagcugcacuuuuugcaaacuguggcuaugacaguccugaacaagaaggguuuccuguuuaagcugcaguaauuuuucugacuauggaucaucguuccuucuguggcagauuuuuacaguuccucuaaugcauuuggggcgacugucucaaaguaaccugcagguuuccugacaacuccucgcucucucuccugcuaagaacuguagccguuucuguuuuauuuuaaaaccuucugcuaccauauccaccacuucuaccuccagauccauagcaacuaccauagggacugccugagcuucuuccaccaaaacugccccccuucaugaguccauaauuugauuguugcuguccacuauaauuuccaaagucauuauaguucccaccuccagcauagucaccuccaccaaaauuuccuccuucauuguaaccaucguauccuccuccuccaccaccauauccaccacccuaguuuccauauccuggucaccaccuccauaaccuccucuacugcuguaaccaggaccaccaccauagcugccaccaucaccuccaaauccuuuauguccaccaucaccaccuccauaacuaccucugcugccaccaccucuaccaccauagccaccucuuccuccaaaguuuccuccacgacccauaaagcugccagcuccaccuccacggccucucugagauccagcagacugcagcucguguuuagaaagggccuuuuccacuucacaguuaugcccaucaaucgugugguauuucugaacaacaauuuuaucaacuuugucaugaucaucacaaguuacaaaagcaaaucuucucuuuuucccacucugccugucuuccuuaaccucuaugguuucaaucuugccauacuuuucaaaguagucucucagguuauauucuuccguauccucuuuaauaccaccaacaaaaguuuucuucacuguuaaaugggcgccaggcuuuacagaguccucucuagaaacagcucucguugguuccaccacacgcccaucaaccuuguguggccgagcacacauugcagcauccaccucuucaacacgagaguaggucacaaaaccaaagccucaggaacguuuuguguggggaucucucauuaccacacagucuguaagugugccccauuucucaaaauguucucuuaagcuaucaucugugguuucaaagcucagaccaccaauaagcagcuuccucagcugcucugguuccuuuggaucauggcccuccauuuugagaccggacucgccucuuccaacucgaguucaauaucaauuaauguuuuuaaaaccauuccagugcuuacuguguucuggagagagucuucauuuucucuccaaaacugugcuguuaggagauguaguucagaucuaacauacauuagcuaccugaaacugguugaugguucuuugagaauuuuauacaaauguaauuugaacauacucauccccccugcucccacccccugcaaaguccucuuaccccuggcuacccaacucugagauuucucuuuuguuuucuuuucccacugaaucaaguuuguguugcccagcuugucuugggaguugacugcccugcugugugguugaccacccgugacucacaucauaaggaaacugacucuccaucaacagccaguagcuccucaggacuggggagcucuggcccuggggauuccugucuuaaagccucuguucuucuuacagaccucugcaacaccuaacggccacauuccaucagagugcgcugcaggagcugcugcucagcaagagugcacaggcucuugcuccucuccgcggggucuccucuggguauuccuguuggguuguaucucaccuguuccuuuaaugcuacuugcgacguggcuguuccuggcccuguaggcugcguccagcuuuacauagagagggauggauggcaauaaggaugacuaaugugucuggcacuuaccaagcccuugggucaugaauuucaacaucuucucuacaaagagaggcuuacaagcacuggcuuagagcuagcugcaugcuguggccucgguguggucugguuccucuaaaacuuauuuugaaauguaauccccauuaggaaauaugaagagaugguaccaaguaggacuuugaagagaagacuagaguucugcucuuuugaauagauaaucuguuugugaaugcaauuaauagauuaaugagcggauuggcugugaaagccagcuuagcuaggucucuccccaggugcuguucuccacagcucccagacucuucaggcaaaacacuagacacagccccuugaagcugggucagaagcacagccauuuuccuucuuuucuuuaaccuguauuuuguauugauggaugcuuugccugaauauaugacugugaaucacauacagacagugccuagauccccugguacaagacugugugagugcuagggacugaacuuaaaauguuuugugucucucaucucagugauguggaaccgguaugcccagaagcccaacccuaccccugcaagaccgucuucauccggcagcaccucacugcccacaucagcucaacaucagcucugcucagagccacuuccucaaccacccuacaagccacguuauuagugcagaucaaaaucaaaucuuagaaagcuuaaaaagcauuucagugucugugcuuggccccccuccuggcuccccaaggccucuugaguuaagcuggaauuuccuagccugacaccagugcucacccucgaugggcauccuguagagcaucaggauugagucuuauuugcccgggacauagcuagggucauugaaauaagcaucugagcuuuuguguagcccaaggagcaucuguugugugaauaugaauagacagagucagaaggacaguuggaauuguggacucuugccaaaaucuguauuuggaacccuuuuaaaauuuagaguuuagugagauuggcuacaguggugcuacuuuguuguaguccaggauucagaaggccaaagcuagagaggcucuggaguguaaggcuagcuugagcuacauuuugaaccuaucucaaaaaauuugucuuugagguacaguguauauaauauaaaauuugaaauagaguugucagagacauuauauauauauauauauauauauauacauacauacacacacacacacacacacacacacauacacauacacacauacauacacuguuauguaacuacuaucuccuccuaguuccaaaacacccguguuccccaaaagguacauuuacccacaaagcagagcagccuuaguucaugaguuacuccacuccaguugcuuuguguuauguuaggaaauucauccugcccguguguucucccuagcuuccugggccgcugagugaugcaggguggaaugcuguagcuucaagugcaaacuugaauugggcugggaaaguggggggucuugcugcagcuagcacaggcaaccagugucacauacccaguguuuauguaagaagcuguagugugauuagaauucuguguguuuuucuguuuauuuuggucugguuuuugagauagggucuuguucugguccagguuggcucuagacccauaauccuccugccucagccucugagagcuaggaugauagguaugcaccauucuacuuggacaggaauaguuuuaaaagcagaccuuugcuaaguaauauaagaaaauucauccccuuuagagcauguuaaauuagagcccuauuuagaucucuagcaugcuuuuaaacuuagacuugggucuacgugcuuucaaaugauaaauuuaauuuuuugcugcuacaaaagucaguggauuggaaaucucuccagaauuccucaggccaaggaacuuuauaccugcuguugcuuaguuagcuauuuagucuuuuuaaugauucccucuuggagaaagaacuuguguucguuauaggaaacuaccaaauguguaaaaggaaaaggaagguaaaaugaccuuuugacuaacaaccacggucacuauaugggaguaagcugucguuguccuuugauuaacagccauuguuacuauauaggaguaagcugucguuguccuuugaguaacagccauggucacuauauaggaguaaguugucauuguucuuugaguaacagccacaguuacuauauaggaguaagcugucguuguccuuugauuaacaaccacgguuacuauaugggaguaagcuguuguccuuugauuaacagccacgguugcuauaugggaguaagcugucauuguucuuugcuuuaaaggcaaugugaagacggugcacaugcugagucagcaggucugaauguucagggaguguuaagaguggagauuaaaaguugugcuguugcuguccuugacccaaaguuuauuguuucuggaucuuuugccaaccauauggcuagcuggggagcucuuggcuuugugugcuaauacuacuauuaugcuuuacauaguauuacuuggacuuuuuccuuugccaacaugugaacuucagaguuucuuuucucuccucucuccucccucugccucucauucuccuuuuucuuuagauagccuccugcuauguagcccagacuagucuugaacucagcaguaugcuuguuuuucuuuguguauuugaugagaacuuuauacaaguauacaauguauuuugaucauauucagcuuccugaccaccucuuaguucucccagaccuuccccucuuccuucuaauuuuaucccaugcucuucuuccuguugaacagaguucaguuagugcugcuguaaauaugugcauggguguagagccgugcuucucaaccuucuuaacaccugacccuucaacaugguuccccacgguguggugaccccaacuauaacgugauuuuguugcuacuucauaacuguaguuuugcuacuguuaugaaucguaguauaaauaaauaucugauacgcaguaugucuuacaugcaaucacugugaaagggucauucugcucccaaagaggucucaacacccagguggagaaccauugguggagagccaucaacugguuccuaggcaaccacaagggccagaccacuagagaaaauugacuucccuuucucaacagccaucagcugcucguguuucucagcuaggaguaggacuccgaagcccuguucuauucacgcuggauccugugugggucucucccucucccccuguugauuuggggugcucuuuauaaauaguugauucagccccccuuucucuguauuccacauacaguuucucuuagacugccaucaguguuucuguuuuacagugcugaaauuuaaacuguguuuuucucuuugcuaaucuacauuugguuguggugguugugguguuugagauagggucucauuuuguagaucuccuggaacuggaguuaucuauauaagaugguugugagaucccauguggaugcugggaauugaaccuugguccucugcagccacuguuuuuaaucacugagcuaucucucuaauuccuauauauggaauuuuuauuacaaugauauacuucuaaccaguacaaucuguacuaauugauuuaugaccucucucucucucucucucucucucucucucucucucucucucucucucucucucucccugaguaggaucucacucuguagcucugguugccucuauucuguguuucuaaaaacuauuuggaggcaguacaguggcagcauccuuagugccagccuugggagguugaagcaggaguaucccgagcuucaggauagccugggcuauagagcaagaccuugucccccaaauaaacaaacaaaauguaauucuguuguugccacuuauagcuaagcuauaggugguuuuccuugauguuaaccuaucaguaagaaucacucuccugggacuagaaagauggcuuagcaguuaagaacaguugucagaggcccggguucaguucccagcaguacccaagcuggguuagggagcucauaacugccugcaacuugagaguccgaggaucugaugcccucuucuggucuccccuggcaccuacaaacuuaaauacacauaaauguccauuuuucuucuaguaucugaauauaacuaguuuaugacuaguuauuguuacaccuaggaagugcuuguuuucuuggggguaaagccucuuuuacuuucaguauugcgucuuuagaagagaucccuaggaacggaaccauuugauuaaggaaugaaaauacuuguuucuagccagauaagucauguuguuccucaccaaaggaugcacagcauaaggcuagagcuccuuugaauagauuccaagauggggggcggggugaggugauguuucuccugcuucccaguguccuaagcagcugcgcauagcaggcugcuuaguuauagucuucugacggccacacuuccucuuucuagagcagacaggcaguuuccucgguuccugaggaagugaucuuacccaaagccguguggacacuaccacucagcagcagcagcucaccuacauugcaacacuggcuuaucggucacuucccucgcccuggagaguguugaggauucuauggcuagagguuucuuuggaauguuccauuucugacuucccuggggggcucuggcuuacccagcuccacccuacgggaagcuccacacuccuccauuuaaaguagccuauacauaucuauuucauuuaagaaaacaaaguuugccgcugcgauauguaaugcgcaguuuagggcucucuuaagaauuaugggaagccauuuagaaaaaccauauuucccuacagcagaauggcaagugcugaaagccccucucacuguagccuuucucuucagguggugaucaaugguggggccacauccagcggagagcaggacaacgaggacacggagcucauggcaaucuacaccacagagaacggcauugcagagaagguacccaugcuaccccuuccuacugcccggcccuguuucugcagggguuugggggugucuguauguuuguuuuguaauggaagagucauaauuacuagguuuuaauugucuuaguagcaauuaagguuaaaagcucuuaagagucauuaucuagguauuuguaaaagccuuggccagaauguucgagaacagugguuaagagcuugaggaccaaaagucaagucugauuacagaggugacucagacucuaaggaauuaccaugacucucuggguaucagcuuuucaccuauuaaauaggaauaaaaauauaagguaaguguaccuaagguggauaucugaaaucaaaacugccagcuaccaguguggcauuccaaagcaugaugcaggcaugcauacauucauguauguaugugauuauagagauagauuugcauuuacauauguacacauacauacauguauacaugugugugguuauucauuguuuuuuaaauaaaauuugaaugaccauguuuguguacuuuuuuuauuuuguaugacuauaaugaaaugaaguaaagagaguucuauucuggcuuaaaaggucuggaaggagaagauaggcaacccuaguuggcaucgccccagagagucucauggcacauaagaaccaaugcucauauccugacccagcaaacagaaagggggcaggggcaagcaggggcccacaaugcauuucaagaguucaacucuuugugucugugccuuuguuuguaugccugccugucugucuguuuuggcuaaaguggacuuuguuuacaguccucuaccccagcuuccaguguuaucuaaagucuauguuuuaaagguccaugguaucuuaggcuguugucacccuugaugaagccuuaaacacaugggccuucaggggcauucauuaggcaaacuagcauauacuaaggaagggcuuuauuuugcccuugguuuuauuccuuuguguaagauauaggacaguguggaauuuaccuuguguggugagcccaguauguccuuaguccugucuguguagaaguguuucaggaauugcaguugggcucagguguuucuuaaugauuuguagaauccauucaguucucauccucgcaguuguguauagagauaagcugcagauuaaaguccugguuggaaaacuacaacagcagaguuagagagacaccaggccucucggcaccuuucccccagugaaggcaggcgggcaguguuguaauucucccacaacaauccauaauaguucuuaugaaauauugccaacuagggaagcucaccugagcuuuggcauggaaaguuuuaucaggaaucaaccucuuagguauggcuggccaccauguagcugaauuuagagucuaguuucucaguaaacaagcugguaacaggugacccaagggcccugccauagaugggacuguuguguaaaccguuaccuuaccccaaggcuucagaggaaaaaagaaagaaagaaagaauauuguuuuuaaaauccaagaacaaaagcaaacaccugggagcuggugucaggugaggccagaccuuccucugaguuugaguagcucagccugcugagccaguccuguccuagucucucagaugcacgugcaguuucucugucauguccacuacuacagucucugaaagacacaguuccauucuagcacauuccgcacuguaggccugugagcgucugcugcuggaccagaggccaauguuuguucuauaacauuugugucaagugucaacuucauuaggcuguacuuuuuaaccguagacagugaggcagaauuccaguguuuauggaaagggacuuaacccucaaauuugcccccuuucaaggaacacuagguggcagggcauggaguuagcagcucccugugggcuagcuccaucggacaugggcuaugggcucacaguauuagcucuagccauuuuuuguggaacauuuucauuuuguuaccuauuauuuuguuugcuagguuagagaauauuuuaaaaguacauauuguguuaguuacgguuuaaugaauguggugaaauacugugacaaagguuuguuuggagcuaugguuccaugacuaucacugcagggagcauggcagcaggcaggcagcuaagcgcucaaaucaaaaccacgacaggaagcagagaagccugcacccaaugacguacuuccuccagcaaagccaugccuccuaauccuccccaaacagcccaaacuggggaccaguugagauuaugucugagauuaugggagacaucucauuccaaccaccagagauaugcaccucagauucuaagaaaugcaauuaauuauuuacagagucuuagaaacuagagcaauuuuaagacuccauggaaagaaagacaggguuucuucaagccaucuguuuagcugaugucaagacugaguacuugcuaggcugaguuaguuaucuugguggucuugacuuuuagaugcaugcaauacuuaacauuuuaaaaaucuuuauugccacauaaaguauuagaaaugguuuuuuuuuuuuuuuuaauaaauaaagccaaaaccaagauuucaagauuugggcagagacucuggucaggguuggugcucuugggaaugaggcaaugucaugggagucagagcccucguucugagaauuaucucucugagguacucaaaggacagaauggcuacaccagcagaaggugguucugggcaguagaggguugugcuaagucaaacggagcuaacaucuuuccgggcagugacuagccccucuuuucuccccucaauuccagagcucucuugcagagacccuggacagcacugggagccuggauccccagaggucggauaugaucuacacuauagaagauguuccucccugguacuugugcauauuccugggauugcaggugagaugauucuucuagggugugugaccucuggccuagagcuuauacuguuuaccggcuaaauguuuaagauagucaauguuuaauuuuuauuuuauuauuuuuagucuguguauuauguguaggcacgugacuacagguggcuguggaggccauagguguuggagucucagugccugauggggguucugggaacugaacuccaguguccugcaagaacaguacaugugauuauuaaacugcugagccaucccuguagucuccaaguuuuauuuuaacuaagauuuauuguaaauguauuuuacaagaauuguguauaagaauuuucaacauuaauuuccgaacagcagggaaaaaaaagaccugggaaguaaaugcucagggagugaaaaaugauacaggggggguggggugggggugagguggggggugggggcugcaggggaagcggagcgggggaggggaggcagcagaaacagaaaggggucaguagccuuggccuccuacccggccuuagcuauccacaauccuggcaaguaucaugaccaggaaaagaaggaaggcucaauugucuuuuaaaggaagggaacuuugcugccucccagccuuagucugucuuccauagcuucgaacaggugggggaugaugacaauagacaggucuauugugacuuuagugcuugcccugcucacuggauuaaaguggcuuuugagaaaugugggggugcucucuccuuccuggccuccuaccuggcuucugacuccugcguuggguuuggacccuguuuugaggucugacuuuccacacuuccuugcucagugugugaucaguucccuucaggguucucaggugggagaaagucaguuuuguugcucagaccccgugccuacugggagcuggacugugccuggucccacuucuggcagccggagggcugaacgggcuuggugaguaacccuggaccugauaugagaggcgcaccuuucaggcauuucuaggauagucacaugggagugacaacucuuuuaccuccuguuccuaacuauacacaguaccuugugcacugcauugaggaguuuucgacagaacacgccugcacauuugagcuacagucagugugcuucucugacuugggcagaaaugggaagcuuugggggaaaaaaagagggaguucacagaacagaaauaaagaacuagaaaauuagggggaggaagggaaaugaguugugagugcuggagcuaucuucagaggccaugggagggaggacaggguacuuagagggagagugaaucucugcccaagagugcuagaccacagagcaagguacaaaaugcccucugcucugaagucucuacgguauauuccccagaccugagagggcuaaaagcaaacgaaagagccccacaggcuaauaucuuaggaaugcagaugugagcaucccagcuggguuuggugcauuccuguuacuccuggauaacaggaagaccgaagcaggaagauuaugcguuugauuugagaucagcucgagccauauagugaguuugacacacuggauuccagagugagacccugacuccauaaaacaggaguaaaacaagaccuugucggaucacguccucaagcgugccuagcgagggucuccuucacggcaagaguuguucagcacaauguacuuaacaugcuggacaaguguuagugggcacaaaaaguaagugugccuaguaagaaauaucuaaacuucugugagaccuuccucugugcugaugugaacucaugucagugaugucauaggacauggguaauagggaaaggaaaguuacaaaauggcgggacaacucgcguaacuagagcgucuucauguggucuguauguccuacagacagcaggacaccaguguuaagggcaaauuaagcaaaggcagggcagguuuaccuuuccccuugucucuccucgagcagcacuaccugacguguuucaguggcacgaucgcggugcccuuuuugcuggcugaugccaugugcgugggggaugaccagugggccaccagccagcucaucgggaccauuuucuucugcgugggaaucacuacauugcugcagacaacauuuggaugcaggugagacagauguacuaugggauuuuuacaccccagcaaggcacugagaaagaugggcacuuugcucagggcuacuggacagaucaguuggugguacagcauaucccaguggccauuggucucagcacaccuuuacaaggugucccuggccccauauuuccucucuucaugaagggaacaauugugcaaguuggaaaaagucuuuucauuucuguggcuggcuggcaaggcacucuggucucuagcacgccguccaguccucugcuguaguucugacccagucucuuugacccaguuucuaucuggucucuugcacugucucugcucucugugcacuccccagcuccugccaucuuucuaucacuccccuccuugggcuacccaggcugcguucuuccuaguguacagcuugugcacucuuugcauuucccagguuucuaccucagccucugagccccgcccuacuucaugucccaguggccugcccacauagcaccccugcacauccucugccccacuuguuccccuccagagauuccugaaauacucuguucuccccugaauuuccacauguguuuuauguucuuuggacucgcucuucuaauguggccugcuccucugucuuugccccacguucucauggugcucuuuuuggugcuagcucuuuggcucauuuaccuuugcauccauagccccguaacaguguggagcugagcuaggaaguacaaguagcaagcauuccuagcuucuguaagccggccuuuucuucuuuuccacagucaguccuguucucagcacagcuuccuacuugcccaggcucugcugguuauccucagagcaaagucuguggaucucucucucucucucuccauuggagacagugcaagugggaauugcuuuucccugcuaggaugaggcagcuagagggacacugaguagcaggcagcugugaccuggaguccaaugugccagaauccucagaacucugaagggcuacccugccaggggcagugagcagcuggggugucuggcugcaguagagguggagugggaaggugaaggcaguuccuuugcaggucugcugguggagagaagcuguuugcacuggagaccauggggcuggcaagcuguuccuauuagacacugaccgaagggucagagauguucucaucugggguucagaggagaguagaggugucauugauaugcuagggagggagaugaacccaggcuuucauaaaacguccaagccaggcaggagugacacugguauuugguguugauuauccaagacuuugggucacagaucugguggaacaucuuuuguuggcuuuacauaguacacaggacauugcacuuugagggagguaauauuuuuccuaaccagcugaugugaccuaugguuguuaaaguuggcuaacauggaggugguggaagcucuuccuuauggcugcaucugccugcguacgcugcauuccuaugccaugccaaaggccuggccgggugacugcugaaccuguugggcagacuuacauaagaugacguagcaaguggaccucagggacuucaggcaaugcucuuggucuugaggguaucaggcuuuagccauggagaacagugaggucagcacaguucaccucuccuguccccuagagaacagccagucaagaaagaccuagagcgggugcugccaccugcccacgugggaacuggaaaucaggagcuacuuguuggcguggggugucugugcaguugcucacgaggcuuacauguccgguggagugacgagcagccugucccucuucaccauguguggcuacaugcucgguucucuaucaguaggccagcaucccaacuaagaaccaggcagugagugcauacugucugggagaauggguaccaugcuaucaagcuggaccugggaugugggauucuguggcuguugaggcaugggugguauccagucaugaccuaugaaggagggaaaguucuacagccccacagauaccuauugacccaucuguagaaagugcaagugacuccagguggcaggcagacaggaccaugcauguauggugaugaccauaccccagaacauuauauagggucauaagagaggcagggauagcaugucuaggacuugaggagguggcaguaguagagauaggucccagagacuuguggucuuggcccuaaaggaugagaguuaucuuucaccuuggcagagguggaagcaaacgcaguuuaaguuaugauccagcacaggauuccugucaccagguacaagccaggacuuggcugagcacuaagaccccguagugguaggacugugccuugaaggccuuagccauaugaccacagaagaguggugggacauaccuucucagccucaggacauaggcagcuaucaucuccuugggaggaugagggagacugccuucagugucccugggugacaguuacugucuguaucuuaaucaucuuuuguaacuucgcagauaauugggcaguuguggaguguaacugcuagaucgugguguggaccaucaccggugcugagaauuagcaucucaguuggcguuuuaaauuucucuguuuaaaacaagcaguucacaccaaggagaugcaagaguggauagauggggagggguguggugguguggggauggagcccagagcugggcugaucccaccgcucagcuaaaggauuguauguagaugguuuguguuuuggcuuacuagucauuuuuucagccuuccccucauggaaguuuuuucaaguuaaacuuuugugauuucuuggauuucccaacucuggugguuaucuguguuguguuauaaguucuguauuauguguuuuucuggcaucuguuggcaccugaugcuuccaucacauugggcagcuaaggugauugagcccugccucuucugaggaagcuaggaguggccugugcguagauccuccccgcuucauuauugcagccuugaaacuauuguuccauaaaaauagauucaggaaagauguuggauuugaaggcugagcccugcguguaccucccuggcagaccuaaggcuaagcccagagugcuccucucuggcaaaccuaaggcugagcccacagugcuccucucuggcagacccuuccuucccugcuuugcugccugagagugucuuccuugucucuggggaccaccaucguuuccauaggggguugugaggcucacucccuagagcauguguauguugggugggcugauuuccaggacaccucuucccgggcauccccucugccuucccgcauugccucucccuguacuucaucuucauugcucagcuccuuugauagagacucaacaguucuacauuugguuacuugcuugguuacauuugguuaguuuuagcuaccccuugagcuuguucuaagagcucguucuaaacccuuuuaaaagcucccuuuuccucucauccggguaggguuauucagauucuccuuaacccacagccgccagcuugcaguaggcauggcuagaggcccccaccucuguggagucaccuuggaggaagguucucugaaacccugugcuucucugccucacugauuuuucucacagauguggcuagaagagaaccccacugucuuuagaggaccccucaagccugcuccaggagccucacuacucggucauccccaauaauguaagagugcagguaggggcuaccaaaggggccucucguggucaggcacaaaccugcuuaagcagauagcagauuccuuugcugagccacugacacuaguucaguaucugguuucugauuagccacugcccauaagagaaagucuccugcuuucuaccuuauuagcuucuuguagccauaggguguguguggcaauguguaguauguauguagugggcugguggggaguggggucuugcacaagugguauacucccugagggcagcacacuuuccaggucuuacaucuggggauguugagcccucacuaucagagugcagagagguuauuuagggagguuggaaauuuccccacauuucaucaucccugaggaggaguccuuguguuugugaaccaguuggaagugaaguugcagauagcaugcuauuccacucuaaaugggaugauagucucugaguaaccacaaugccauuuaucaacuugagaaaauaauuauaccaucauaucaucuaauaugcagucuacauuuaauuuccccaguugucccuaaaagauguguuauagcuguuccccaagccucuccaagccaugguccaauuaagcuuguacaguguuuugcuugcuaugucucucaacguuuuaaaguccaggcuaggugucauggacucagaccccaguuugucugguuguguccuuauggugcugucugacugggugcauagucucucacuugcugugagcuggaagaugggccagaggcauggaugauucagggugaauguuucauccaaacugccaagucggugacaucaugaccuuuagauuacgccaugccaagcagcacauaauagcugguuguagcauuucccacaaauaaaaaguuuacugccuacguuacuaagaaagcaucuuaaguaguguggugaaguggaaggccacugcaaacccggaaggaaaugaccuugaaagacaucauuucuagucagcuucacugggugacuagacucaccauagacgugguggcuuggauuccuuuguaccacuuaccagccaugagaauucagccacacugccuagcuccucaaagaccauucccccggaugaaaaauaauauguagcauguuaaugaguguugugcacgguagugccugcccugcuggugccgugagcugucauuauuaccugggcucuggaagggagguagaaguuugguggagcagcgugucccugaugacuauuacaggauugggugugcccccugcucacacaggcagcguccugacuuggauggauuagaaaacagcagcggucauucgacccagcuccuccugaggccugagcccguccagccuccauugcauguuugcuggggcagggaugcuguccauguuuccacagauuacucuuuaucguuguuguuuuaaucuucaaggugucagggauuaaaagacugccugacucuuugcuauuuuuggauuuaacaaauuuuguucccucuacacuguuuuuuggugugugugugugggggggggggguuucuuaaaacaggguuucucuguguagcccuggcuguccugaaacuagcucuuauagacuaggcuggcguuaaacucacagagacccauaugucucugucuucugagugcugggaucaaaggcaggccacaucaccaucugucuucucuacaccucuuuuuauuugaccaugagauaugcuagccuggcacauuccccauaccacagguugcccauucucuuccuugaugcuucuccucucuaggcugguggcuaacaagggugaaaggagucagguucucaccagauguuaggggaaggaagcgccuuccacuucacacagcuuugagacuguuacccaguagcagugcuuuaccaagcauacccauaaacucccucaaaguauugauaaaaaguccugugcuaggugugguguacauaacuuuaaggcagauaggucucugugaguuugaagccagcccgguuuacauggugauuugcaggccagacaaggcuacauagugagacccugucuuaaaaauggauuaaauaaguaaauacccauuaucuaaugaguaauuauauuaacaccuaauuguauuaacaugcaauaaaaugcaccuuuucuaaaguguguagucaggugaguuuuccuguguacacagucacauaaccaguauugcagucaacagauagagagccgugccacgugaugcagccuuauauuuggcuucauuuuaugcuaacaauguuugcaaaggagauuauccaaaggaaaaugucaucugauaugguaaaaaaauguccgagaggugcugguuguccugggaguauuuccuucuugaucuccccgccccgagcccccccccccccaccaaucucaauucuggcuacuacacauagggucuagaaacagugagcccacucagugugcagaucucugguccucacuaccagucuuuaggccaauggacuaguuaguguucucugagcaaguggcugacuuagaguagggccugggaggacaaguugaaccuggaauaucucauacuggaaagcuauguucagagaacaauaggacacguggagcucccuuccgaagggacaggagccaacaggcucuucugggcagguuuggacaauucaguuauuaagaacaugcauaguaguaaguuauaaaacuuaaauucaugugccugcagugauguucaggaaaggaagguggagauacaguggagaaacagggaaacucuucuuuacagcaaauguugauuauaaacauagauaaaacccuaggaggacaguuugggccacauagcaagagugugguucaaaauauuauugauugauuaauuaccagaggaucguaauaucuaaaccucauucuagaauuuaaaguuagugguaaucacuucagauuauuugcuguuagugagaaaacaugucaccugaugaggagagucacccaccuuaaagaagcaccuucaccuagugggacauccugauggguggguuccagcgugacaaguagguauugagaggucuccuugucaggaugcugagcuugugguacacaggcuucgauuguccugggugugggaacuguagauacuugagaaacaauuagagaaauauaguuaugcuuggauauuagguuauguuacuguuuuauuguuggcuuucuugggagauauagacaguucuaauugcugcucagguguuugagucaaguagucucggucuguaaucugauucccaacagcugagugaugagugagcaaacagcaccaaagcgcugcugauuuacagagguucucuuuggcgcacugcuuugcuuuccaccaaaggcguccaguccauauuccuggugguugacucacgugaugaagcuuggucccuucaagcccagucuguuugagucccguaaggauuucuguuuuccauucuucugccauccaagccaguguucauuugugauugguaacuuuugcaccagguuuggucaucaucugugcugaggaacacagacuacacuucagugaggaauucugucagagcaaauacaccgugcaccuccauggugcuuccgugggacacagggccuuugacugucagagaccggucuccuuccauagggauagcagcgcuccugagaucugucgugcgcacuuccuuucugcucucuucucaaccugaacaaugccucacgcaggcggcacuguaaauccacaugugaggaaagccuaacuucuuaacuuuaacaaaauuacuuuccaagcaugcuuguaaauagcuccuuaagcucuuuacugcugguccugggaauaagauugcaagugaaagggcugugucuuucuguuaggcaguuguagcuucaggacaggacgagcagaccaguauggaggggaaccauuagaggcuaaaagaauagcagguccugguccuugccggcuugucaccagagucaacaccaaaggacuuggagguuggucagguaaggaccacaccuagagcuauggcacagccuguucaagucugagaauagcuuccaggugacagucaccaguccccauuucccucaaagugauccuuucagagcuuaauccccugagcauuuuccuuuuugccuacagguaccacuggucccuuuucaccuucacucugucccucucuuggacauccccugagguuuugugucuguguccuauggaccccauuuugcaccucuucucuuugccuggguucuucauagccucucggcauguggcucagugcuucucaaucuuuuaagagaaccauauuugauagguggcagagccucacacaccucccguuaucuccuaggugacugauguugucuccuucccacagcagcagcuccucaggacccaggaagcuuucucucugccuuugguagugcuugugucaggccgggcugccacguuaucagaugacaggauugucguuauccuuucaucuagagcagugcuucuccaccuuccuaacaacccuuucauacagguccucgugucguggugacccccaaccauaacauuauuucauugcuacuucguaacuauaaccuugcuacuguuaugaauuguaauguaaauaugugauauuuccaauggccuuaggugaccccugugaaaagauuacucauacccccucccaaaagggguugaggccaacaggcuugaaaaguccugauuuagcacaaggggauuggcccuaagggggucugagguucagcugcaccuuggaucagaaaugcagauuugggacuggaaaagauggcucagcaguucagagugcaugcugcucuuacauaggacccagguucagcuucugcccccaccaccaccaccaccacuugcaacuccaccuccaggggauccugugcccucuucuggcaugcauacacacagacacauaaacaaacauaaaauacuuuucaaagcugcugaauugguaucaccgccccagaaucagaaguugugcuguagacacagacaagcagcucauugauggacuucuggugcagucucucugggaaauaccccaccuucugaccuagcgagauuccugucaguuguucaugugcuccuguagcguuuaucccaggaauuugagucauguuucugauuugaaaugaggccagcugagcaucagacugcccaucuuaggagacuucauugucaccugcucaggaccccagagcagcauugucccagucagcacugcagccuagcucuuacauaaaaugcucaccuuaggugccaagauuagguucggauuaggguuuaauagaguggagcucagcaucagccuugacuucugucacuugccaggaggagccaaugggaagugcaguggguguggugcacaccucuaaccccagcagcacucaggagacagaggcagcagaucucagaguuugaggccgugcuuuauguauuugaguuccaggccauccagggcuacguuggaaugacaaccccccaaagaauauaaaugugaauacauauauguguguauacauauauguauucaauucaauguuuauguuauguuacccuaugaugccuuacuuaaagucugaaccugugguaaaaugguguuauuuggacuguucaagaugacguccauucuuaauggcacagugauaucucuuuauccuuaugauauauuccuaaaauuuugugugaggaauuuccauaagucaguggcuauuuucccuuugauguacauuuccacuaaagaggaucaauacauuuaguggcgcuauacuccagaccccucgagcacgguaauuauaaccacauggcaguggagggugugcccugguuguacuuaagaggcccaucuccaucuuguaguccgcauccuaccugcucuuacugaggucacuguggcuaauauggccaagaggguguuuuugacaaaggagcgugucagaaaggagcacaccagguucugggauugcuccgcugccagcuguucuuuggccaggacaacuucuauuucugugcacucuuugucucuggcacagaacuuaucaggaggcugcuggguccgagucagacuacugacaaggcugucugggcagcuaaggaugugugcuuagccuccugguccugcagacagcaggagcaugaucuauacuuuaccuucaaauacuguggaaaguagugauuaaguucuuacgcuaacugcuaacuuaguccacacaguuggcuuccaguaaaaagucauugugauuugauuaguugcauucaguuugagaaugugggcaggagauuuuauggggaguuuaccagguuucugaacccuuuaaaauguauuagaauauuuuaaauauuuuauaugauuaaugagaacauuuauuauagauacucucauauuguaacuuacaacuuuuuggauacauauagaucauuaauaugauuuuaauauuuaucuuauaacuaggacagacauuaacucucaaaaugaagcaauggaauaauaaaugagaauuugaaacggaggaggaagaagaggaggaggaggggggaacuacacugguguuuauuagggaucccaugagcucaggaaagcaggaagcccaaacccccacugagccaccuccagggguagaggaaacaguagcaggaacauuggggugugagcacugaggccagagcagcaggagcaggggggaugggagaaacuaguggcuccagcuaugugcugucagaggucuucacagaguuucuuuacagguguggcugugugacucaugugcugcgugucuauggaaaagacuguuaagcugucaaauagugaacuaccucgguaguucccgaugccgugaucaugguuuuggucucguuucuuuuagguuaccccuguuucaggccagugcuuuugcauuuuuggccccugcucgagccauccugucuuuagauaaauggaaauguaacaccacagguaauugcaguuauuuccacauaugucauugggguccuuuaaagcagguggaaagggggccuggacaccugccaauaacagcauuccuuccuguauugagcauagaauauaccaucccguaagcagcuuagaaugcuccagucuguggaccgugccuguuucugucuuuacaucuccucuucaucccuaaccuuagggcaagcuagggccagaaaugaccuuguuugccaaugaagcugauaaaauggguauaggaugaaaauauuugugcuguuuuccugccucucucuuucaguggauuuuauaccuaccauagucacucucucgcugcaucagcauccuucucugaaacaucuuugcuuuuuaaggaucuggcuacugugguuuucugcaagugacuuucauuccccuucguggugauugcaaagagccuuacggagccugauaaacucaaggagacgagaaaaucagacuuguacucucagagcaguuuauauuuugagauucuaggagccaagcuuuccuggucuugccuucccugcuccuagggguuacuuugugaccauggauuuuguuuaggaacuggaaaaggucccgcuuuaucuagauuuuucaaaccucagcccggcauuugcuuuugggcauuucagguagcuguuugcaaagagugguuucugugaagccggcacuggaugguagccccacuucagucagccuuugacacaccgaggagcucugucaaccaguacauuugguuacuuaguacugggaguccaucuccaauaaggccuauugucgcagguugagucuuaggaauuaauacuuaaugaaaugaagaaauaauuaaugguuaauaaauaugugcuaugaaacauuagugucacuccaaaggaaacucucuuuccuuuuuguuuucaagagauuacaguugccaauggaacggcagagcuguuggaacacaucuggcauccccgaauccaagagguaaauccacucaugucuuucuaccccucaugcuguugugcccaacaagcugcaguugcuuuuauuaagugccuuuuguuuucagcuacuggaaugccuguuucuacugucuguugagcuucauguccccagucaguccccaggccugccugcuuaugucguccagugugauggcugaggcuuguuggcucucgagagcaggucuggcuguuuuuugucuguguguuguuagcugucuuguugcuguguuggaaugcuaaagacagcuugaauggggaaaguucacugucccaggcuuugucuguugugguggggaggucauguuucagcucauggcagccaggaagagagugaggaacacaagaagggcucagggcgagauagaguucccagacacacaucucagugucacuuccuucagcuaggucccaugucuuaauaaugucucauguuaugagcuguccauuaacuguugucucuggaagcagcaugauggacacccccaaaggugagcucuacuaauacaggcaucucagaacaagcaaguuguuagucaugccucagcuuauugaaagaacuaaagauaauuuggggggccgaagugcacuuaagcagagcugacuaaaguucuccccagguacagaaaacuagcugaugagugcguauauauucauagugucaccaugaaaucuuuagauuuaguacaaaugucacuuuauuugacaaggacauucuuuuagaauuuuugucaguaacucugucuuuuggaugucuuucaggggcuuggucuuuuaaagaugucuauacugaaauaucucacagggcuggauugauaguaugcucauuugagagcucauagaucuguccaucucaccgugcaguggagaaagcagcagacuugucguuaguccccauuucugcaguuaaccuuauagcagcaauaucauguuagugugcugguccucaguuaccucagcagcggugucauguuagugugcugguccucaguuaucucagcagugauguuaugcuagugugcugguccucaguuaccucagcagugaugucauguuagugugcugguccucaguuaucucagcagugaugucaugcuagugugcugguccucaguuaccucagcagcaaugucauguuagugugcuguuccucaguuaccucagcagugaugucauguuagugugcuguuccucaguuaccucagcagugaugucauguuagugugcuguuccucaguuaccucagcagugaugucauguuagugugcugguccucaguuaccucagcagugaugucauguuaguucugguccucaguuaccucagcagugaugucauguuagugugcuguuccucaguuaccucagcagugauaucauguuagugugcugguccucaguuaccucagcagugaugucauguuagugugcugguccucaguuaccucagcagugaugucauguuagugugcuguuccucaguuaccucagcagugaugucauguuagugugcuguuccucaguuaccucagcagugauaucauguuagugugcuggucuucauuuaccuccacggaaaccuugcuugcagggcccugggaaguaucccagcugucaugcugcuaugugauaggacuuguugccuugaagaaaugucaguugugauugcaguucugaguguuugaucugaguguuugauaucacucucaaacuuuacccuuuucuguuucagauccagggggcuaucaucauguccucacugauagaaguggucauuggccuccuuggccugccuggggcucugcugagguauauuggacccuugaccaucacacccaccguggcccucauuggccucucugguuuccaggcagcaggagagagagccggaaagcacuggggcauugccaugcuguaaguguucuaagagaacuccaggggugggggacaauuuuuaccacuaugugggacagccuuguggaguacuugaaacagucacacuaacuugagaaugaagaaaucuauuaagacaauguucugacgauuuaaguuuaauucauuucaggccagggcuaguuaagugauuguuuuagaucggaguuugagacaugguaaagcucaugugguuccaaaggcagacagcagugaugugugcagaugggagaguugucagauuuguucaugguaugguccuugcuccugcccucugaggucauaagaagccucaugccaguuugcugugcugguacaccacauuguuuagaugaggcuggcagcagagagauguuguggaaggacuucugugcucuccucugcucucaacagagugcacugugauggcgaguccgcagccucacacagggucugcuugggcaguguugguccuucuguguagaaccaaaugcauuggagauguugaucaguaguguacauuaauaaagacauguaggacuuaacaaucuucuaagagagaauucacauucuuuuuuacauguguagaguagauguaaggauuauaucauaggugaaugcaucugaggaucugucaaaauuuuaccaacuaauaaaaaauuuaaaacaaacaauuuccauuuuuuguuuuguuuugggaaauauuucauauuuaauaacagagcauuuauuaauuucuuuuacugugccuuuguguuuuguuuaauggucacauagaagguagagacuaguguucugugugcuuaacaagugaagagacagaagcacagugaggcagugugacuugccagagucacacuacgagucagacagaagucaagauucuuugaguccauguagccugacugagagagacuuggcuccugcucacuccugccucugcagugugcagguacggaaaaauacccaugcauaauucuuuucccuuucucacuuaaaugaaggucggucaaaacccucuccauacaacauguguauauauguacuguuaggggauuuaacucaguuaguacuagaaagcuaacguuguguuuauaaaacauuaaaaauuaagaccaauaauaaaaagauuaggggaaaaacucaauaguuuuaaaacacauaaaaauuuauauaaauaacuccuagucaucaaagaaauuggagcaauugcuaaugauuuagcagaugacaguagcaauguuaauaacuauguagugcuuagaguguccuggagaaagugcauguaaacuuuccucuccaguaaaucauguguccaaagugggggaaauuaauauaaaagcagagaaaaggaauagaaguaauacccaaaagccaucugucugaacuaagaaccuuucagaccugccuggcaaagcugaguggaacagagugugugcguacauaugcagugagggcugacccuguagaccagagcgaucuagaccaaaaacagugaaauucuuccagagaaauauaaaaggcaaaaauggacuccucauaccauccccugggaaucccuuuaggagccccauaccaguguccacuaugggagaaauacauggacuuauagccaccccguaaacucugcagcuaacucucccauugcugcuccacagggugucuguuuuuagagggaacacaccccaggucccucuccugccuuucuccacacuugcaguuuguuauacucuccccugcccacugccacaugccgcccaggacagauucugcaucugugcuccuccccggggcuuugcucuucuuugguccccaguucuccuuguccugccucuuucugaccauuucuauucuaugcagggcuuagccaucaguaucucccgggaccgucccucugucccucuuuugaaaucccgguguagacucaagcuagacuuuuaucagaucuucucucuuucucucugugagucucuuaaauguauuugaaaagagaacacuacagugcagguggcuguuguuugaaacaaagacagguaggguuggggcucuuugggacauuguagauaguguucaucuugaauaaauaagcaguuucaaauacuauguugguuuuggugguagaauuucuguuuuguuuuuuguuuuuguaaauuucucugcccuagaggaacugaagugacuugggccccaugaguguucuuaaccuugaccuaagcucucagacuucaauggguuaccacuucauccagucaccgaugcgggcagccugugcucagccaggcuuugcacuacaccucauuagacacucaacaaagaagucaguguucauagcugguaauccuaucucagcaauugggauuauuaagcugagcucugaggacacucucuucuugucaccuuuaccuuagguggcaagugaaaaaugucgcuccagaaaggguuagacagagugcuaggugaucacgcacauccauccuccuaucuaucccuuugcuguuucuaugauaaugaucaaucgacccaccugggaggaugagaaauggccucccauuugccagccacuugggccuucaggucgguccagguguccugcuccuggaaguucaggaagaucaggaaguuuuguagucaacccaggcagucugccucuacaacaagugcagaagaagaaauaauucauccccaggcuacagaccuuacagucaaguagaucugaccgaauggcuggcuuagugccuguggaaugagcaugcucacugcaagcuccucucaggaagcugugcacuuuccuuucuuuuuuaauuuaauuuuuuuacuuuuuuuaagacaggguuucucugucaucccugacuguccuagaacucaaucuauagaccagguuggcuucagaccugagauuaaggacaugcaccacuacuacuaccaccaccaccagcagcagccuguguacuuuucuugaauauugaaguuucaccuuuuuuuuuccaaaaugaguucaauaugaauaaaucaaaaaauaagggaaagugggaaaaauagucaccagucauuuuaaaaugugacacuguucccugguggcauuuggugugggggggccacaugugcacucuuccacuggaguauguguacaugcgugcauacuucucuccucuuggcaugcacaacagccucuuagcugcuucaagcugauugccaguuguaaguauacgcucugguauuguaucugguaucauuuccuuccguggagugagcuuuccccuucucugggguuucuuacuuuagucaguaucaagaaauucuaggccagcuguuugugacgguuuucuccaggugggaaagugacauuuccaaacuguagugagaaggacuagcguugcaugccggugaagaacugaauacaugaaaucaauggaaacuuuagcuacaacagcuuuuaauuuuaugaauuuucuuucucuucucaggacgauuuuccuaguguuacucuucucacaguaugccagaaauguuaaauuuccucucccaauuuacaaauccaagaaaggauggacggcauacaaguuccagcuuuucaaaauguuuccugugaguagccaaucaugucucccucaccacaacaugccuuuguuuacacguaagacguuagguaaaggaagccuauagggagacccuccuacauuuguagugaugauacugaagggccuacuaccccagucagcacagccuugagggcuagauaccauccgaguaagggucugguuccaagaugagaucacauuauuuugcagugccacagaagcacucuuguccauggcucugggcugugacccacguggucuccgcaggccuguuacccauucuucucuuacuggccagaccuuggaaggguccaaugaguuuaccugcauaaagcucucaguacaguuccacugaagcagcucuccacgguagugacgacggcgggcuuggggugcuggcuccacaggaggaagggauauuuuacccaacgaagauuuugcccuugaccacuccagauaauccuggcuauccucguguccuggcugcugugcuucaucuucacggugacugaugucuucccuuccaacagcaccgacuauggcuacuaugcacgcacagaugccaggaaggguguacuucugguagccccaugguuuaagguuccauacccauguaaguaucaggagggcccaacugaggggggugggaagcaggcaaagaauucuacauagugaaaagccuuuuggaaugcucuuuacauagacauuuuuucuaaucauuuaugucuuauguguaugcauguguguaugcgugugugugugugugugugugugugugugugugugugugugugcaggcacagguauguauauaggucagaagacagucucaaauguggcucccacuuuucccuuguugagaauagggccuuuuuguuguuggccaccaugcacaccaggcuggcugugcugugagcugcaggguccucccuuuuccaccuccucucuggagaagcacuggaaugacaacagauaugcaguacuguguggguucuggggauuuaagccuguguccucaugcuuugcauagcaagcauauggcaagcucauuacccacugagccuucucccuaacccuaaagcuagaagaucauaacggccacuguggucauuagagaauuaguggagggaaguuguacccgaggucaaucauccacacacagucacugaccaguuccccucucagguuaacuacuuggccuucggagcccuguuaggcucugaaaugcuaacaaaugugagcugucauggcaaggguuugagggccacugcugagaaagacaagcacaaagcccuuugguuccagaggugggaaaaugagaagaccuggagauuagcucgcaggccgcuccugccuggcaguuuauguaaccguuuuacuuuggucacagauguagagguaaacugauacuuaauggcagccggaagcuggaacuuaggccucaguauuggguaacucaguggcagagcacgaaucuccccagaucuccugagugacaugcagcguucuccagcuccagcucugaacuguacucacugagcaguacaguggcuguaaugcugggcccacauuuugggguuuucuuagagaaugagcuuagccagguugagccaguuaucccauugagccauuuuauuuuccuauuuuacaaugagaaacuuaaaaaagaaagaagagccaagaauauuaagguugggucaagaugacuccuccaggcaugccgaauggugguaauauuggcagcucucuuuguuccugauacuuuacaaaagcuuuaaacaggcuuagccuucuaaaauaacauucucaucacguggugucucgggguguauuuauauauacuauucuguuuccagaaaaaugugcuugcuucauaaacauaccuauaauccaagagaaaaugagacuaaagguuacuugguaaggcaccaugggaggacagaguggagaaagagcuuccugagagggacuuuccaggguccucauggggccuguacaugcgauggugccaccgaauagccagguguggcaucaccaugagggcagaugagacuucagcugccugccaagaucuagcugucuucuacucaguugcucugaguaaaaagccacccucagcccucugcacuuccagcaguuuggaucagagaaaguuuucaaauaccaagcaaugcucucagccuagguuaaugcugauauacaaacuucugguccgagauauuagaagugccaagguugagaaucuguuguaccaccaugaacaaguuguacuuaagccaggcacaugucccuguagauuaccagcucugggaggcugaggcaaaaggauuaugauuuugaggucacagacaaacucaaaacuaguaguaaacaaagaucuaguuagaaggaucuuuaguaacucuaucuaucuuuuauugccaauaugaauagacuccugauaaacucacuugccccacuucuuggaacuauuaggaaugauaacccagaugccacacagugcagaacuaugaaacaugauucugcagcaggagucaacccuguagcucuguagcccugggcacucugagaugaccaggcacaguuaagacgggaaagaugacauucagaguaagaugcacagaccagggcuggagccugguaagcugcaaggcagaagaaaaaacgagaugugagugcacacaugcagaacgaaaacaggcagucgggcuggagagauggcucagugguuaugaguucucccagaggccuuggcuucuacucccagcagccccucgauggcuuacucuccaccucugacuccagcuccagcggggaucugaugcccacuuaggggcacugcacguacaaggugcaccaccauccacgugagaacacucaaaacauaaaguaaaaguaagucuggagaaacuuaaaaauauuucaaauuuaaauguugauauaaaagauuuuuagaaaucagacuuaaagaccucaaauaaaaggaauuuaaaguauacuucaugaaaaaugaggcagguugaguauccucuuuuuccaaacugauugggacucuggaugccuuagaauuagauaguuuuggauugggacucuauauacuguauccccagaauacugagaguaggccuaaacaugaaggucauauacauuucacccaaugacacucaaccugaagguuauuauacacaggcuuuuuaguacagcugcguuuauuuuauuuuuaauguauauggaggcuuugccugcaaguguaucuguacauuauuuuccuuccuggugcccauggaggccaaaguggguauuguaucuucuggagcuggaguuauaaacaguuaugagcugccaucuggaugauuggaaucaaacccagguucucuuaagacccagugcucuuaaccugugagccggcccccaggugccugcauuuuaaccugugagccggcccccaggugccugcauuuuaaccugugagcccccaggugccugcauuuuaaccugugagcccccaggugccugcauuuuaaccugugagccccccaggugccugcauuuuaaccugugagccggcccccaggugccugcauuuuaaccugugagccggcccccaggugccugcauuuuaaccugugagccggcccccaggugcauuuugacuguaaucuagcacagaacagaguuggaauuuuccacuugugaugucauguuaguucuuuuguuaaaaaaaagaaaaaaaaaaaaaaaaaaaagccgggcgugguggcgcacgccuuuaaucccagcaccugggaggcagaggcaggcggauuucugaguucaaggccagccugguuccaggacacccagggcuacacagagaaacccuaucucgaaaaaccaaaaccaaaacaaaacaaaaaaaaaaaaccaccagauuuuggaacauuuuguauuuuuuaguuaggaauauguucaacugaaagugguagaaucuaauaggaaucuuuccucaaaaucaggauacuaaagggaaaccaauguuaauauuguaacagccaaagcuuauuucaaaacuccaaauguaacuugacaaauaaggccccugaaccaacucugagagaaagugcagaccggcagugaggcuccucggacuguucccacugaguaggaggacagccccggcccagcaggagcacuccugccucaggcuccagcccuggucugugcaucuuacucugaaugucaucuuucccgucuuaacuguuccuggucaucucagagugcccagggcuacaggguugacuccugccccagaaucauguuucauaguuccgcacuguguggcaucuggguuaucauuccuaauaguuccaagaaguggggcaaguggguuuaucaggagucuauucauauuggcaauaaaagauagauagaguuacuaaagaaaaaugaguuaacuuuuccuaauauuauuuguaguauacucugacaacaaacaagcuugccaguaacaaggagguagggcuguggcacacuugauugucagauuagaguaccuggugccaguaccuuuuacccugauuccuaccacugaacuauaaaccccugggacaaauuucuauuccaagucaggaauguaaucccagcccuguaauccccacacucuggaaccugaggcagggggauugccuacacacacacacacacacacacacacacacaagcacgcacgcacacacgcaccagaauauccaggaacccuuauuucaaaaaacaaaagcaaaacaaauuucuguuccaccauagcaggcaguguuauuagaacugcgagggggagaacuccccaccucuuccagccaagugauggcuuucuuaagacgaggggucaacucucauccaaggcccuaacucaguaaccuucccacacaucuagugucucaaugauuuaagauuuaaaaguagcaaguuuccaagagcuucaaaauccugcagagcuguugcagaguucucugagauccuucuaaccuuugccugccucugagguaagugggcaugucucucauggcugucuucccuccucaguucagugggggaugcccaccgucucugcagcuggcgucauuggcaugcucagugccgucguagccaguaucauugaguccaucggugacuacuacgccugugccaggcucuccugugccccgccgccgccuauccaugcaauaaacagguauggcccaagaaagaccugcucaucuagccuuggggaagaagccaagagcucuggauaaugacagacaaaccaggauggccauuugucuuuggccaagucacugcuucagcacccuucuugucucacgguggcacagagcagcauccuaccucccuuccucccagucucuccagcugaaaggagagguggauauguuccuuaugaguuugaagccacuuacacaugaaacucagcaaaacaggcauacauguugccauucuuugcuuggcuuugaaaguagacacauugucuacuuugauuucuguugucuuauuuucccaaaugcucaccucacccugcccugucccaagaacucaaauuuuagguuguuuguaguagaacaacaucuuccugguuauauggagucuacagaguuuuuuucugaguugaggaaauuguguuuuucucccauucaguccuggccgccagagucaggccgauggcagggcguuugucuugcaucagacaguaacugcuguaggugugucaguggauauauuucaguugcccuucaggaugaucuguucacagucaugauucacagaaacagacaacagggagaggugaaaacucugaagaucaagagucugaugagcugugggguuugcacuuuuuuagcuucuguaagugauuggggaacugaccguaaggaagguacagagaaaggagcacaaggcaccccucccugucguugccccuccaacacaagucagcaugacuuguacccagugugggcaggggcucuguaaggcuuuucacaguucucucaaauaaaacugcuacaugugaggagacugcucauuuaaaaguuucaaaacaaaaaauuuuuuucaguaguuacaaagcaguuuuuccuaaugaaacuaucuuaauagcaaagaaucaaacugaugugucuuacuucaaagcacagccgaugcuucuuuuagauucaguaguucuuugguuucauuugaaauuauuuuaaaguauuugugucuaaugggcaguguggagcuagccuucuuagaguugcugggcauauggggaguuguccucagcccaucagggaagggaccugagauccugcaacugccacugguuagcaccccgccccucccaagggggcauaauucuuguacguuucaaacauuaagagcugguugcaguguuuccccaggaaugacgguuucucuuucuccccccccuuuuuuuuuauacuuuuagggguauuuucguggagggucuuuccuguguucuugauggcauauuugguaccgggaauggcucuaccuccuccagucccaauauuggaguuuugggaauuacaaagguauaaauguuuuccuaauuaaauggcugagcaucugucuauuucaaugacaggucugaccugacccuucccuugugauuaucuuccuuccccaucuccuuuuccccuuggaugaguuuggagugucagcuaggagaccucuccucucugggccaucggaguagcaggcaucuggguauagcugugguguccugcagucucagacauugauuaaacuugugccugcgucaggccucuguuuuaggcgcuuggguggguggugcaugaugaaaaagaaaguuggaguuuacaucugaaugagggaagaccccagaauucaacagagcauguuggaugagagaugccuguuacuacagaaaaccaucugucacauuaaauaacgucucugacuucugggacagaaucccuuuucaacgaaaucuguggagucacagugaagcagauccugggccugacuccuaaacucaucugacccuacaagcccucuaccagacccuaguuacugacauuaaaccuacagcugccccgcccccaagccuuacuucuauaccugucagcuuuauuaugcacaauuaaacuucauguccagccaaauagugcugcuugccaggauguuguggaguacugguuggcccagcagccauuggauguuguguaacuaaagacuguuaagauuggcuccccuuucuuuauggguugcaugagucauaagucuccuuaccggggcagccaauccggaagccuuccagaccuguuugaccucuagcucccugcaggauucuauaaccagauaaaaagaaacccaguacuguuugguucaucuugauuacaaauccgggugagagggagcagcauccagaugcaggaagcacaccugacuuguuuguugaucuucccauaagaggcagggcugacguaagcucaacuucacguguaccgauggcaccaucugcugcccauugcucccagcacauggcucggagggagggagacuuuauagguacuuccuucagugccauugcuggagucccaagugcugccuacgaaaggcagcagauguggagccuggggagcugaagguacggucgaaugggcaccguguggauuaaccagccaccccugagccucucuucucccauaagccuaugggcagauaaguaguuauaaauaggcagguuguaaaauugcugagagggccuuuuguuuaacaagcaccauccuucuguauccuuauagaggccacagaacagcuaaggucacugaaaggaaacaaauacccuugacaacaugaccgugguggcucagggggugacugauccuugaaugguacagccuuacugaaguggcacccaacagcacugacuuugucaugcagugcaauucccaggaggccagaaggcagccccagcgccccugggugcagagcccuaggcagcugugagucaucaagcaugggugcuggaagaacaggaugagcucuuaaccacugagcuagcucuucagccccaucauuuauauugcucgaaucccuuauuucuccaggcagaagcuguauccauucaagacacucacagucaagucccuagucuacaucugccuuagagcagggagguggggcuuggagcagaaauaucuaugugacccuagcccuguggcuagcuaggaaggcucccugcuugggguaagcggguaugagcucugcacuauauuagaccucucauccugcuaaauggcaugggacaaacaaccuuuaugaguaaggcacagcuucuacggccuacaguuccaggucuagauccacacugucuaauaugauggccaguagcuucauguagcgguguucacuuaaauaaguuaguguuacaguuucccuuacccagucacaaugacuggcucagucauauacuaguagacaacagcacauucagaaaacauguccacuguagcaaucuucuggacagacagggcugagccagugaaccagacaugguuugaaaggaggcuagucuguccuccaccgaucugccugcauuuuauggcagcucugcuguuccagcuuuuauccaguuacuucguuccuugacucggaaauaaccuucucaucagagaugagcuaccuuccuaagugugggccaugugccccacagagaggacaacagaacacaagcaggauguuguuucauccuuuuucucaucacggucacagcaggucaccucuuuggucuccgugccuuggucuguaaaaguagcuagcaagauguuagaauacaucacuugauaccaguuuagcauggcuuucuggcguguuccaaguacuagcuguaguacagauacuuucaaaggcgcaguggguaagcagaccagcagccaggcuccagcguuugcauucuuaggucucccuucacuauaccaccuuuuguggucagacagcauaagaggaggugcuuccacuaauggaagagugcuauauacgugacucaggaagguagagucacaaguacuucuggugaacuguuuugggugaaaagucauaugaaaaaagugggagagaagcaggaacaguguguauaacuguugcauccaugauccaugacuccagcccauaaggucauuucucucucucucucucucucucucucucucucucucucuuuccuucuuucuuucuuucuuucuuaagaguuauuuauugauuuuauguauaugacuacacugcagcagucuucagacaccccagaagagggcaucagaucucauugugggugguugugagccaccaugugguugcugggauuugaacucaggaccucuggaagagcagucagugcucuuaaccacugagccaucucuccagcccccaggagcucauuucaaccaggggcccugaaagcccacacucggcaaaagcacuauauccaaggaaaagauaaaaucuuaaaucucuaacuccugauuccuggggucaccuguucacagcugaaacagugaacugagguggaggagcaccaaguggcagagacagagggcaucuuggguugucucuauaguccauguuaacagaaaguuaaaaguaaccuagauccuguccuagacacugcuauauuugcgcugggcccugggagacuggguugaagaauggcggguaaaccugugucugcaccugguguguccacaggucggcagccgccgggugauccaguacggugcagcucucaugcugggcuugggcaugguuggcaaguucagcgcccucuucgccucccucccagacccugugcucggagcccucuucugcacacucuuugguaagagcccacuuccuugguagcaguuuaccaucacgugcugucuucagguuggcagacacuuuaaaaaucaaauguuuacuguugcucuuugcacacagacuuuucuacacaggcuucagucuucagacccaguagaaguuucgugcaauagaaacucagcacucaaaaucuggaccauaaaaacacaugcaaaacauacuugucugagaacacuuaucuuugaaccaagcacugagcuacacaaaugcagaaugaaagcaguguucuagcuucaccaaacacacucagcauaaaagguguaaaagaagccgggcguggugguacacgccuuuaaucccagcacucaggagacaguggcaggccagccuggucuacagagugaguuccaggacagccagggcuauacagggaaacccugucucuaauaaauaaauaaauaaauaaauaaauaaauaaauaaauaaauaaauaaauggugugaaagucaccuccuacacaguagcuaauucuuaauggaaaucuaacaauaaaucuaaugguuuccacuuuaaauuguaaaagauggugcuucagaaacauaaagauuugcaucagugcccaagcuaaagguauguuaaaaauagaagcaaucacuaagaaaaugauaugaaaauuaagauaaaaucuaaucuuuuuaauuuagaauuucuauuugacuuaacucagauauauugccccaauaaaugaacccuuucaacuggcauuuucauagugggacuuuggauuugaucugcaccuuucagauacagucauuguggacaugcaccagaguucuaguguggauuuaaucagaaugcuuagagaaagcaagagauggcucagcacuuagagcacucguugcucugagggaaccuggguucaauucccagcccccacauggugacuuacaaguccaguuacagagcaccugacacuucuggccucugggcaccaggcgcacacuugguacacagacauaaacuaagcugaaccauugccugucuacuugauucaaagaaaauauagugugaugcuugugugugauguaauaauucgggucagagauggguggugguauuucaccgacccucucuuucugccacugcacuggucugcaggcugauuucugagggccagagaaaggacacgugggagucuguucucggccuccgggguagccugugggcgugccgcagccgagcucagugcgacuguguucugacgcuucucccuccaggaaugaucacggcggucggccucucgaaccugcaguucauugacuugaauucuucccggaaccuguuugugcuuggauucuccaucuucuuuggccuuguucuuccaaguuaccuccgacaaaacccucugguuacagguaggcgagagagcucuugaaucuuggguagggcaguugggauuucaaccauagagucacaaauagcucuuguaaugggaagggaccuuggaaccucugcuguguauugccgaauguuuuuucucugccuuccuucugaaucuuacucugauuauuucucuggaagccaccaggacaucccauauuagcaugugccuccauacuugcuuggaggugccuucggauugguggacaguugauauggauggcuaaggucucacugcuuuguuuuguuuuuguuuguucaguugguugguuuuucaagacguggcuucucucuagcucuggcuuuccagagaacacuaucuguagaccagacgggccucaauguauagagauccgccugccuuugccucccaagugcugggauuaaaggcacccgccaccacgccuggcuuuucuuucuuuuuuucacuuuuucuguuuuauuuuacaugugugaauguuuucccugcauuuguguacaugcucaucagcugcguguagugccagaagagggcaucagcucucccuggaaccagagaaacagaaggaugagaggcaccauguagguguuagaaaccaaaccugccucugccagaacaguaggcacacuuacccgaugaaucgucaucucacuggcccucgggggaucauuguuuaaaugggugccucuccuuugucucuguaaaacuuuugauuucucagacucauacuguauuaaauuguauaauuccuuaaaacucaacuucacaggcucugauauaaauuuuucuguuuucaauucaagaauaccaaauuagggccuagaaagauggcucagccguuaugagcuccuuuuuaaaaaaauuuuaauauuuaauuuaugagcaugaguguuuugccugcauguauuuauaucuaccacaugugugccuuguaccugagaaggucacaugagggcuuuggauccccugggacuagaguuaaagacaguugugagcuauguguguucuuggaauugaaccugggucuucuacaagaugaucagguguuucuaaccagcaacucaacucugcauccagcccugugagcccuuaauagucuuguagaggcccuggguccaguuuucagcauccacauggaagcucacaacugccugaacuggaagucuaaagcugucuucugaccucugcaagcacugcaugcagauagugcccagacccaugcaagcagacacacauccacacaagaaacaagucucuaaauaaagagugccuauucagguucuacucuuuacaacccugcugucaugcagcauggacaaagggggaaccuuuuuaagaaguaucuguugcuacugauauauguuacaauugaguaauucaggaccauuuguucaaauauuuuaccuacauaggcuuucauauguaguccagauugucacugaacacacuuaauaggcaaggcugaccuugaaccuuuaaucguuuccuccucccaagugcuguggccacaggcauguacuaccuaccauaccuggcucaaaaugacuaggcagguaaucuacauuugaggccaaccugcuuacagagugaguuuaaggauagucagggcuaaauagaaagacccuaucucaaaaaacaaacaacagcaauaaaaauagacacccauuuuuaaaguggcaugaacagcaaggccugguggcucuuuuguaaucccagcacccaggaggcuaacacagcaagauugccaugaguuugauagcagccccagcaaugucaugaguuccuggccagccugagcuauguauagacugccaaaccuccucauaaauauuguuauccuuuuauuauucaccuuguaauuuuugcggcauuauaauagucguuuauuaaagagacuuaauuuuauuuuauaaauaugugugguuuucccuguguguaugucuauacauuaugugugcgguacccauggagguuaggagacauuggaucccugggaacugaagcugcacuggguugugagccaccacguggugcugggaagaacagccagugccuuuaacuggggagccaucuacuaagccccacaacagccauuuuuaguacugaaucuuuuguaaguccauagaccacaccucgguaccuccacagucuguuacaguguaaaagucacuuuaugugguucaucugcugggcaccauuguuaauaccaugggcuucuugccacaaguugcaguagcucuaaauguuacuggcaagaguauguacacguguagaacugagaguuucaggugucaaauccucuguugacuuuuagagcuguccaguccgcugccuccuccucauaacucuguucuauguccaggaauaacaggaaucgaccaaauccugaauguccuucucaccaccgcuauguuuguaggaggcuguguggcuuucauuuuggacaacaccaucccagguaugugcugucuguuaggcuuguuagaugcacaagcaguucuaagaggaagaacaaggccucaguguagcccaggucuugagcuuugucaccugccuuugccauagagaaacaagaaccgcaaauacugcucagugacccuugccagugaguaccagcuggcaggaggauccuccagcccaggaggccaaccuggguaauauagugagacccagucuugggagugggaauaggaauaaauuaguucaaagcugucacugcuaaaugcuguuuucugaggugguugagauggcacuccauccaaaugacugucacaagacagcacaucaugugagccugcugcugugcauuugcauaguccugagcugcuguaaaucucuuagagauggcugcugugcuaauguuagaugcugccuuuaaggacagaugacacaguccaucugucugucucccauuaauuccuccacagucuugugcaugagacauuuuaguguuggauugauuuuuuguuuguuuguuuuauuuguuuuguuuuguuuuuaaagaauuauuuauuuauuuuauguauggggguacacuguagcuguuuucagacacaccagaagagggcauugaaucccauuacagaugguugugagccaccaugugguugcugggaauugaguucaggaccucuggaagagcagucagugcucuuaaccacugagccaucucuucaguggguuguuuuaaggggcagucuuaaaaccuucaaauccaagaacaaaccaguaaguacaccucccaucccccauaucaaacuggaacaaaacagcaaaguuuagauaaguccaguggcucuuugaagacaauguguguuuuacauugucauuuuagagagccaguucuuuuacuacauuucaugauagauugugaagaagacauggugaggugacuagccagccaguuaggagacuggaucagcgguaaccaggaaaguaguuacuugccuaggucagacuaaagcagugaaaacugaguccuguaaaaggacagauaugaagucacgaagucacuugacuguagagaaugggggauaaagaggaauagccaccccaaauuuuacauuuuagcacuugaagagcuaaguauuuuauuuucagcuccucagguuuccuguuguugucauugggcagguuugguuucuagaaaggaggggugucugugcgcgcucaugcacaugucugucugucuaucuaacaagccucauugcuaagauaauuaaguauuuguuuuguguuucugugugugcggagcagguaccccagaggaaagaggaaucaagaaauggaagaagggugugagcaaaggaagcaagucucuggacggcauggaguccuacaaucugccauuuggcaugaacauuauuaaaaaguaccgaugcuucagcuaccugcccaucagccccaccuuugcaggcuacacuuggaaaggcuuugggaagagugagaacagccggaguucagacaaagauucccaggccacaguauagccuuugcugugcccuguggccuggccacagugaggcauguaucuguaguuccuugcugaauaacaagaagauauauguuuguauaucuacauggcauccugcaccucagagcuaagacagguugcacgucacucuucuguuguggguggugauuguguccaauauggugucucgcuuguguccuuauuggucccuuacccuuucuguguccauugcuggccauggucacugaacuugaaaucacagcccugccauuggagugggcguuuggaaucccuagugcuccugcuuucaguccccucugccuuccagugaucucuuuccuacaagcugcuucgagguccaggggccucugcuucuuaaacacuaugucccagucuucucaugugaccucagccugaacccuguggagaccuccucuggccagggggccacugguguccucacuguguugggauucuguuaucccugauaccccaggagccuauugaccugacugagaauagugacaugucugucuugugaccagauaugagugugcauaagguccugucuagccgagacugacugggggggacuguauaggagacugacggggagcagaaagguccugacucccucccucccugucacccuggacccguccaggccagcgcaccuucuuucuuacuagucuguuuuacuggcugagacacccuauuuggcauuuucacugcuggcuggugugauggguguagagugcccacagaugagucuauggaugucuuggcucugcuguccuguacuugcguguguuuuauuccuauuuaauguuauugacuauagcggaucuuugaaaucaguguuuuccgugugaauuuccaaccuugcaccccguuccuuguccuuacucuugacuccauccagaaaagaaccagcaucugcaaacgccaugggugccgucagcgagcgaagccucucgugucggcugauaaaagccaguggcagcugucguggcugugcuuuguacugcucucuaccaugaaaguguaaauacuguaaugucuaaucuauuuaucacaacugacuacuggaccagggcccagaaaugugggucaaguuacaugugaauuuguuuggugaagaagggaagcugggaugguaacagagcgucaccacauaggaugugccauuaucuagcuaaagucauuccuuccuuccuucuguuucaagucauugcugccagaucuggcuuaauaagacuugguguggcuuaucaggucacauguccaccacaucuugauucuugcaggagggaagauuugaucccuuagagaaauagccugugggacuuguuaaagaagauagauaguaagaaaagcagccauugcgugcccucugugaagaguucuaacuuggagaacaaaucucucagacaaaugacuuguacuaaauuuggcuuugguuuccaagccaagggaaaagcugaagacaugaguaaugaucuugcuucaugagauuguaccucuuaaguggcugcggaccuggcuaaacuguggguggcagugggcauccccaucacccuuagcaaggugugguucucagugccugucauugauguguguucccgugcccaggcugucucagugucaucauguugccaggucuuuguguuucugcagcccacaugauccuugagaguuuuggguuucgguaacaccucagggccacugcauuguuuugccaaaaucuuacuccagauuaaguacagaacuugguuucuaaccguauuuaguuuuauauguguauucagacaguuagaguuuuggaagcacacuggugaguagcuuuuugccccuccuuccuuagcaagcccguuugauugacagcucuccugcucugaguucacucugugccuccauuugcauuuugcuuaguugauccgguuucucuguucugacaagguggaaaacugguaagcaucucagaucugcaguauugugguggugcuccacugagcaggaguccacucagaagcaugagaacggccuguaauccaggccguguccugccacuaugccuguauugcugagugccacccaaguccucuauuuggcuguagucugcucuggggcuuucacugucagucuggggcaugggcugagcaaguauuuguguggucaaggaagugcuaugccaacaucucccauuggaaacaggguuucuccuccuugcuucaucagagccaaccuuugauauucuuggaggggacaggaggugggaacacagagggaguagccugcgaaugugccuccagucagugggauacuuucugcaccacucugagugauuguuaccuuguaaccacuaguaagcuuuguucaugcagcucauaguccucccaaacauauggggaauguguguuuauguaccagauggggaguguugaggggauaugguggcucugugaucuguuuguccauuuguguccaguguugaccugcguuacuggaacuuggagcuacccuguuugguuaccaguggacuguuagaaaguauuucagauacgagcaucuuacagggcauuccaucccuaguucucacagugaacaccugccuccucucucuccugagagcaagcauuugugucagccacaggaagcagaaguauuaagggaggaagugcugguagcugcccuguggggagacucccuaggaaaguaacgggcaccaggcuucgugacuuucauucucauuuauaaguuagacauucauucacuagaacauuuaugcucagaaucuuccuuaagaggguguccaguauuaacuuugauugggauuaauccaggcaaaagaagagacuuuaucagagaguggagugaagcauuguggguacuacccgugucccauguucacaguaacaaauucacaugcaggauuuacuuuauacuguagaauacugacuuucaugaugacaacuugauuuaugcaugaauaucaacaguauuuccauauaguaaaauaacauuucugcccaggauaauagucacaguuuuccagggagggaaugauauaauuuucaugacaaugucaugugcugauagaauuucuccauugaugaaccucuaguauguguguauacuuuauuuacccauguguauauuuuaugaucaugaucuaagcuguuaauucuuucauucaugucccugcugagacacugauauuagcaacuuagaguuggugaguuuaaucuucagucauaccagcuccaagagaugaggccucaguccagaacccaucuucauacaaaagcuucaguagccuguaggcggcuguacuuggaacagacauuuggcugccaguagcaggccuggcauggcgugacgggaggggccuaauuaccuagcuguugcuggacaccagcugugcauaccugagcaugcccagugcauguuggguccaugcacaacuccuggacccgagcuuucaccaagcucuggccuccagggagcugugucuuucucugucccauuaagauuugggcacagauaagacaucuuccacuuuccauccuuccuacaguuagagccccaguagugcgagaaggccccauauauggcagcauucagcucucacccaacacuugugcugggcuucccuucagcagccucccagaccuccccauucuuccaggaugcugucugccaggucaccacucugauacccagcguucucugguugcucucuguuuccagugauuaaacacccauaaccaacguugcugucugcugccacugacaguccagugaauccuuuucugucuguuccuaacaacuuuuauuugacacauuaaaaaauuucugacuguccuuaagacaguagagaugucucucuuuuauuugaguuugugacugacuuugccuauauaucuuucugggguuuuguuuguguuuaauuuuuauuuugcauacugaggguauuuggggugggguuguuuuuugagauguguaauucuuuuauggaguuuuuaaaaagaauuuucauauuguuuuuucuaacauggcuucauuaaacguuuaaguauuuuaaaacuauguaauauuuggaccagauguugugaauaacaguagagaaagcuauuuuauucuguauuuuuaaaacuguuccguacaaauaaaagcucuccuggauguag

SEQ ID NO: 1111 - RNA, 1076 nt, Mus musculus
uuuaaaaccuucugcuaccauauccaccacuucuaccuccagauccauagcaacuaccauagggacugccugagcuucuuccaccaaaacugccccccuucaugaguccauaauuugauuguugcuguccacuauaauuuccaaagucauuauaguucccaccuccagcauagucaccuccaccaaaauuuccuccuucauuguaaccaucguauccuccuccuccaccaccauauccaccacccuaguuuccauauccuggucaccaccuccauaaccuccucuacugcuguaaccaggaccaccaccauagcugccaccaucaccuccaaauccuuuauguccaccaucaccaccuccauaacuaccucugcugccaccaccucuaccaccauagccaccucuuccuccaaaguuuccuccacgacccauaaagcugccagcuccaccuccacggccucucugagauccagcagacugcagcucguguuuagaaagggccuuuuccacuucacaguuaugcccaucaaucgugugguauuucugaacaacaauuuuaucaacuuugucaugaucaucacaaguuacaaaagcaaaucuucucuuuuucccacucugccugucuuccuuaaccucuaugguuucaaucuugccauacuuuucaaaguagucucucagguuauauucuuccguauccucuuuaauaccaccaacaaaaguuuucuucacuguuaaaugggcgccaggcuuuacagaguccucucuagaaacagcucucguugguuccaccacacgcccaucaaccuuguguggccgagcacacauugcagcauccaccucuucaacacgagaguaggucacaaaaccaaagccucaggaacguuuuguguggggaucucucauuaccacacagucuguaagugugccccauuucucaaaauguucucuuaagcuaucaucugugguuucaaagcucagaccaccaauaagcagcuuccucagcugcucugguuccuuuggaucauggcccuccauuuugagaccggacucgccucuuccaacucgaguucaauauc

SEQ ID NO: 1112 - RNA, 368 nt, Mus musculus
cucaaacuuccagcccuuggaacggacauagggccuucagcuugggaaccugcagaauccgcacaucaucucugaccguccccacccccacaauagucuuguucucccggccaggaagcuucaucuuucggaucaugcgggacagggacagagguggccgguugguucggcucaugaacgaccucuucagcacaaccugauugaagguggagcugguccgucuggccagaaaccuguacagcuucacaagcagccgcagguagauguccuggcucuugggcuccuugcgccgaaccuuuugguccuuguuguggcaaaugucaacacccaugauggcgccuccugcucggccagauccagaaagaccg

SEQ ID NO: 1113 - RNA, 8318 nt, Mus musculus
cacgucacuuccgcugggcuguccuuaagaccgccccuuccgcuuggcuguugagcgagccuugcgagcgcgccuaacggagaacggggagcgcagcgcggguagggggcgggcgcgcgcucccggaagccagccgcgagaccuggcccugccaccgaggcugcuucccggagacaguuaguucacguuggcggcggcggagggcgacgagagguuguccacagcgccacgcuuagguccuugugggcccgggagggugggcagaaaucgugguggggccgguaaaaaguguagcagaaacuugggcugauaguuuuuuaaguugucauuuacuaugugauaacgccacucuagaaucccuugcuaagaaaaacaaaucuucccauuucguugucgugcugcaacguuuuuguuuuggugcgaguuuauaaguggaaaguacauaacuuuauaacuuguaauacaaaucaggcaugguuuaaugcuucgaaaauccugcuuauugguagcuucaacuuuuagauaugaggaauuaaacauguuaugggauggcaacaucaaaaaccuaguaccuaagguuuagaaauguaaauggauucccguugcuccuuuuuaguacuucugaacuaggauguaauuaaccaaaacgcagaaacacuugacaccaguuuuuugcaugcuaguuacuuaaggucgacuguaauaccagugucuggcagcucauuaagaucgaaaaaauaucacaugccauuguggagauuaugugcaaaacaucacaccagugaaggccacuuaguuuucuucuuaaagauggacuuuuugcguuuagaauucaaaugccauugcaaauaaaauagucuguuuuguuuacauaauuguaugacuuuauaaagaauccacacauuucauuuaugguaggggagagugucuggucuuccuauguugcccagacuggccuccaacuucguauauccacaccuuucuucccaaguaguugggauuagaguaaccuacugaaguacugagcuuaaauuucaaacuuuuaagauuuaaacgucauugcuuuuaaauuuuaccuacucucaaauaauucaguaguuaugauuuuuauuaugucugucugcuuugaauaguuugaguaaaacggauuuuuagauccguuuuuucaggagcuacaugauguggaauguaaacucacuuguuucaugcuugggaugggagcagagaggcagguggccguggaugucuagugugguauggauagccagggcguuucccacauggauaagaauuuguacauagaaccguaccacaccuagaaguagacacgaugcugaugugugugucauuccuuauccuccuccuccuccuuucauggcagacaaaaaaguuaugugaauuuaugcuccugaggaaaguuaagggguaggcaguacuguaagggagggguugaaaaugugaacauuggacuuuagaaaauuaggccagaaacaucgguagcagauugaacagagccugauucuuggugaagugccuuuggugucuuucugugaagucaaccuagauccauaaaggaagcaugcuuaguguguacaagaagugucgggucaccguaagcagugaaacgccuaagcuaccauggguagcauguggcacagcagcucggaacaguaucugacauccuuuccugggcuguacugggacugcugcagacaacaagucuuucccuuucagacuagcuguguuacucuguuaugaugccgucucguaccaaccuggcaacuggacuccccagcaguaaagucaaauauucaaggcuugccagcacagacgauggcuacauugaccuucagguaacauaaucaaucaauuaaaaaaauuggcuacuaucuggaccagcaagaaacaagcugauuuccaagcucuuuugagccccagcuuggagaggggaucuuagcagggcaguuucagauaucugcagaguuuuccauuuccaguuucaguugaagugcuaaagcuacauaguuauagauuuuauuugacucauccagaaaauucuuugcugacaucaugagaugcagauacagauauucuuuauggcaaacaagaaucuaagcaaguaaguuuguguccucuccugaccaguauugaguaggauuagcaucuccugucccugaggauaaaacagccuaggugacgccugagcuaaggaaggaguccguucuuuuaaauauaaacagaucaauaguucuuugcauuuaugugaagaggggagaguagcucuggggagcuuccaaaccuguaaugucagagcugguaacaagcugagccuuagaagguuugccucuuacuucuuuuuaaaauguucuuauguuauuuguacuaauaguggguuucauuguaacauuuucauaacaugcuuacacuguauuucagccuuaaucugucucugaagcuuaaccuugagcugaaucuacuuaugaugcggggcuuugggaaagcugaaguggaagcuuuagagguggcuacgcaguuaagagcacauacuguucugcuguuuuauuuauuuuauuaauuauuuaucauauaaaaauauauaauuauagacgcugcauauauaauaaauaguauucacaaauacuguaaugaaaugaauauauuuauguauuaugccuaugaguguuuugcuuucauguguaccacguguaugccuggugcccaaggaggcccaaagagcacaucagaucuccaggaaccagagauucagauguuuaugagcaccgugggugcugagaucgaaaccuggguccucugcaagagcaagaaauguuguccacugggccgucugcucuugccccccccuccuccuuauaaauuagaaaaaauuuuuuuuuaauuuaaguguauuauguuuugccugcauguaugucuguguacccuguuguaugcaguuccccaggaagcuagaagagggucuuggacccucugacacuggaguuacagauguugugagucaccauguuggugcugggaacugaacucaggucaucuggaaggcaagugcuuugaccuuagagccaucucucuagccuacaagugucaguguugcucaggacccaaguucgauucccagcaaccauauuacgugaccuacaaagcuauaacuccagcuuuugcaggauccaauuccucuggcuugaacaggcaucugcccucacauguacauacccacgcauaauuaaaaauaaaacacagcuuuuaaaaggaagacagaaaagaaagcuaaaauucuguuucuaaacuucugacugacuguaagcuaagucaccuucaaucccagaagucacuucuucaugucuguauaguguggugcucuuaauccuccacagguuaguagcagcuuccacgcaugggcacuuaguaaauacguaucaccagcuaggcgacaacaucguuuuaaagggauguccuuguuuguaauguggggucuguggaccagccgacgaugcuucacucucgugaacauccagugcagugcugacggacauaguuaagacacucgaagcuuccacuuugaugcucacguacccucccugcacuagaguacuuuaggccuggucuuuucuuaguguucuucaucauuuguguuuuucucucucucuuccaguuuaaaaaaagcccuccuaagaucccuuauaaggccauugcccuugcuaccgugcuguuuuugauuggcaccuuucucauaaucauaggcucucuccugcugucgggcuacaucagcaaagggguaagcuaaugggcgugugacaguaugccaugggucuuucagauaugagccagaacacuauuuuuauguucuagaaguacaauggauuccacuagaagaaacaauaaagcgcaucuaguuucuccucugauaauaaggcaugguuuuuuguuuuguuuuaguuuugguuuggguuuuuuuuuucuccuuugagcaaaugucuccauaauucuuagaaggugggugcuuguaaguaggcacacauagcuucugagauaguuuagaauaaugcagcuuugccuggguuuagucuuccagacuaguacauggcuguagcuagacuaacauaccaugguuguaguuuuaccgaaguguagacgugcugauggguguuaggggugaagcagugagguuuguguaaguguguggccacuacaccuuauaaguggguuccucuuuccauugauuugguaagaguucuguugaguuucaguauucaaacccuaaguggugcuugguggugcuuucccuuggauguuuauauauucucugucuuaaauuauccuaacuaggcugggcaugauggaacaccgcuuuaauccuaccacucaggaggcagaggcagaggcagauggaucucugaguuccaggauaaccaaugcuacacaaagaaacccugucuugcagggguggggugugacccuaagcaguauucuuuuugggggagggaagaaaagauuuauuuuauuuuauuuuauuuuaaaguuauaggucaucauugagagaaguuaagcaauauucuaaccauaauacagauccauuuuuuuucucucucacacuagaaaaaauguaguuccuuuuuggugcuuuacacaguuacaagcagcaaaaauaaagcauccaguuucugaggugacaauugacacauguuauuacagcugaagcacuauuuggguuaguuuuuauuguuguuguuuucuuuuguuuuugucuuuuaagauuuacuuauuuauauaaguacauuguagcugucuucagacacaccagaagagggcauuggaucccauuacagaugguugugagccaccaugugguugccaggaacugaacugagaaccucuggaagagcagucaguucucuuaaccacugagccaucucuccaacccuauuuuuauuuuuuuaagacagggucucucuacaaagccuuggcuguccuagaauucacuauguagaccaggcuggccuuuaauuuagagauccuccugccucugccucugccuccagagugcugagacuagaagugugugccaccacaccccacugccacuuaaguaauauuauccaguccuuagagacaagacaaaaagggugcuauguuuaaaacuaagaacuugaaaaaagugguagggagauugcuuugucaaaagagugcuuaaggggcuggagagauggcucagcaguuaagagcacucacugacugcucuuccaggguuccugaauucaaaucccagcaaccacaugguggcucacaacccucucuaaugggaucugaugcccucuucugaugugucugaagacagccacaguguacucauauauauaaaaucaaccaaucaaucaaucuuuuuuauuuuuauuuuuuucccgagacaggguuucucuguguagcucuggcuguccuggaacacacucuguagaccaggcuggccucaaacucagaaaucgccugccucugccucccaagugcugggauuaaaggcaugugccacuacugcccagugaauaagucuuuaaaaaaaaagaagaagaagaaaaaaagaaagugcuuaaggacagugaggcaggagugggugggugggggagcauucucguagaagcaggggggaggggugggguggggggguugcagaggggaaaccuggaaggaggaucacauuugaaguguaaauaaauaaaauaaccaauaaaaaaauuggaaagaaagaaagugcuuaaggaccuggaaucugacuccuagcacccacauaaaaagcuccaaguguugguaugcaucuguagcccggcacugcaggguggagacacaguugaguccccagagcugccuggccaagccauucuaggcagauuggugaguaccaguaagagauucagugagaggugagacucuuaucucaaaaaauaagauuaaggaaaauaagaagaaaaaauggcuucacuguuaauaaccuuuucugcucuugcagaggcccccaagccugauuacuagaccugagguugguuggcuuacaacugccuguaaccccagcucuagggcaauucuccaagccucugaccucuuucagcaccugugcuuaggugcacauucacaacauaggggauagcucuguagcuaaaaacacuggcugcucuuccaagggguuagguucaauuuccagcacccauguggcuacucacaacuguucaaaaguccaguuccagggcauccacugccucugugggaauuaggcacacuuguggugcgcagacauacauauagacaaaacaauuauuaauuuggggcuuaaguucuagagguaguuaaaguccaugacuaucagucucagaagagucuuuagaccuguaaacuguugagacugaacaacuguagggacuuuugaaguugaacugauauaguuugcauuaugauauagcuauaagucuauaggaaccaaggaguagaauaugguggcuuaugugagaacagcuuccauaggcucaaauauuugagugauugauccacaguugguggacuguuuaggaaggauuggaaggguuagcucugguguucucugucgugugcuuauagaucagaaguaagcuuguagcuacauuccaggguccugccuuuuccccaccaugauggucaugaacucuacaccucggaaacuguaagcaagccuccaaaacucuucuauaaauugccuuggucaugauugcucuuggcaauagaagagugaccaaaacauacccauacuuaaauauuuaaaauaaggcgcuguugaggaagucacuugaagucaaccucuggcacacaagcauacaucugcauauacauuugcagacaauaauaguauguaccggccaagcaugcaggugcgcaggcacacacacacagagagcuuggaagagcagaaggaaauaagccugauaucugaauaaaaaugcugauuucuuuuuuauaacuuugaauguauugcuuaauuuguaaucuggaagaaacugggaggguagugcuugccuaccacacccagcgucucuaacuugaucccugagacagaaagauaagaaacaaagagaaggugacaauguaugcugaaaagagagauguaaaggugugacuuguaugggacuaauguuuuccuucugccaccagggggcagaccgagccguuccuguccucaucauaggcauuuugguguuccuaccgggauuuuaccauuugcgcaucgccuauuaugcauccaagggcuaccgggguuacuccuacgaugacauuccagacuuugaugacuagccuucgccucagccuugagaagagucgcacacagugcaaccacuuuaagacaucaagcaagaacucuggcuaagggcugaagaagucuacaauuugcagauguuuagcaaaacaauggccagauuguaugaguccuucuccaaaacgcuccugcuuuauaauuagcuaauuaggacaugguauguuuucaucuccuggcccuggcuaaacuugacaaguuuuuccacaugagugugcaucauguaagaguugugaagcuaacugucugggaaggcagccuguucuauaguggaagguguuacccuccuuagagcugaaccuuucuuuugucuuccauugucugcuugguuuuguagcauaaugggaaauguauugucuaguuucuuauuacuaaguaauuuauuuuuaaaauuaccuaucuuaucucucacccucuccucuaccauuauauccuaguaaaauuaaaguaucugucuuaccuucauaugcuccuccaccuucauaucccaguaaaaccaaauaucuguagauccaucucuaauuggcuuuuuuuacauugacagcaaccuggaauuuuuaaaccaugaagcuggguauuaugaucccaguacuugggaggcagagccagguggaucucuaugaguucaaggccagccuggucuacauagaguuuuacgacaacuagggcuaccuagugagacccugucucaagaaaagggaaacuuccucugguuucuccauaguuugccuacuacaaaacucaggugaaucuguccuuuguaggucaagagauugugugaaucauaccucaaggacuagacuuuggcuguuucuucguaaaacuguagauaaguguacuuagaguuuauagcccuacugcuggcugguacuaugauaucauucugcuaaagauuacaagacuuggccaagaucccugaaaauguauuaagucaaaucugguucucagcuuauaaaaagugacaauuuuuucuaag

SEQ ID NO: 1114 - RNA, 4429 nt, Mus musculus
auuacauaaacucaagagaaacauuuuuuuauugcuaucuccacgauggaagagagaacaaaagcccauuuaccuaacaggguauaacuauucaguagccaugguacaaaggcggcacugcucuaugacuuuucaaauuguuaacuuuauuuaaauugaacaauauuucuuaaaacugcauuuagcgucaagaucauugaugaaaaucaccaguauuuguaaagcagaaacauucauguuaacaaaacuaguuuuuacuuuggagcuuauucuuuaagcaaauuauggagaauggagagaaaagaaaguagguuauuuacagaagauaucuacauauuuuauuuuaauauuuaagaauacucagguacaaacuuggugacagaaaagaccucaggacacgcuggcaucucaggagcaaucuucaaagguuuaguuuucucaauuucuagcaaugccuaagaugcuuccucaucuucaaucuugggagccaaauaauacuuuaagugucccaugucagcaauuuuauacucuacaacugaaagacaggaaaaauuaaaccaccgaauacuauaaauaccacauuacaaaacaauguucaaacuuaucaucuuaccaaggggcacaucugcagacauacugaguguuacuguaggagacaguggaguggcuuuugugaaaaaguucagguaccucagagcaaacguuaggugaacaggcucauucaucucuaugguuaccuagaggagaaaacaggcucacuguagacaucagaaacucacacuauuagaucacgguauuauaccacaaagcaaaacaaauaguuaucauuuuggaaggguugaugaaaaccuugacuaaagaagaaaaaagucuagcuugcccauccuguagagccacaccccaagcaaucaaaacaaaggagaaaguuguuccuauucagauuguacauacuucucuugcaaagaaugcaugaagagaggaagauaacacauaaccacuuccaaaaacaagaaccaacagcugaaugcaagcuaagggacaguaaaccagucuucauuguaugauuaucaauuuuauucaauucccaauccuugaacauguggauacugaaaaauuccuuaauuucuuuuguuguggaaaugcuugcacaucagacaaauacugaugaauuacaugucaguauuugagaacugaggagcugaaguugauauggaaguagaaauaauucagcagauuaagguuaagaacuaguucuuggguuguguguuuaucuauguucgaauucuuacacuuucauuuacuuuaaauucaugcagaggccaaguaacaccuuauauuuaccuuaaauacuugcaguaagcacucugaauuucacuauacuaaacccuaaaaauccuauuuaguucagacuucuguguguaauucugaugcucaggcuagcuagcaaaacuuaaaaaagaaaaaaaaaaguguagccaugaaauauacauuggauuccugagaaaaagccucgauucagggauacuuagaaauuaaagaggccuaguauguucuacuugaaugaggaggacucggagaacaucuuccuuugccuucccaauuucuuccucauucuuuuugagcuagauuuucugccagguugacuuuaagcugagaaucuuccugcuguagcuuugaguacuacaguuguggguuugagacaucaugcccagcuuucucuauggauguaacugucaagagcauuuaauacaacucuuuccacauuuugugaagucuuucuuauuucccuugggacugcaaauacucuugaaccugcaacacauaaagcuacauacacccccaaccauuuucuuuugcucacuugccaacccucacuuauuugccaagaguauuuccaggaagcaaaaggcuguacacuuagcuuuccaaaugcuaccuguaaaagcuuauggagucgucucugagcucuaagauagcuuggucuacucaagacuccaucucaaaaugaaugaauaaauaaaaacaaaagccgaggcuccaucccugcuucagacaccuaacuggacgcccccuuacuacucaccgccuccucuucuuuauccacauuacuuguuugugacaacuuaauguucccauugccaagcucuccacuugcagaaaacuucaccccauucuuugcacaggauaucacaacagcaucuccaauguggcuaaggucucggcauauacgugcaaauucacccgacggcaucuuuauuacacagcuguacuccuguuccuguaaacccacaaguuaaaggucagucuagaaaagggggaaggcucagcuucauguucucaagauuuagcaucuuaaccagaacucagaaugcaagacuucugguuucuuuaaaacucaaucaacuuuagacugcugugguuuagugaaauggcagugugccauucauccccaauaccaccacuccacucagaacacgcaucagcugguaucacagcaggguaacacacaaucagaaacaagguaacucacugggauuccaaguugcuccacaucuaaguccauuaacuucauuucauagucugaaacuuucucuugaucuaccaaaagaaggaaaauguuaccaaagcacaccacacgguccuaucuaugauggaaauuuuacaauauuguuaauauuuuuuuuugguuuugagaaacagaaacaacacguaacuaccgaguuuuaaagguguuuaacuuacuuggugcuucgaauacuagugcuaaggugucugcauuaucuucagcccuuaauguaaugaugucuucauuaccagcacauuuuagaauuuuggacaugcuaggggggaaaaaaaaaaagacaggcuuuaucaacauguaauccacaucuauauuuuaaaaagcaauuacaaguuguaccauuucacacucacgguuggagaacuguuaaaggggcuaaggguaccccaaacucucucaggggugaagcaaauuaccggguauaugugauucuuaaaaccgacuuaguaaaaugcacuaaaagccaacauucgagaaagcaucuuuuugagcgggguguccuugguuucuaguguacuggagaaugugccccaucacgucuggccuuuucguaaaucuuucaaaauguauacaaguggcacuaauccauguaucuguacuaaaauaagucacacacuguccuugaacacguauacaggaggcacuaaccuagguagcuguagcaaaguuaaaagcuaaaacugacagauuuccccucaaauccaugaugcgcagugagacucuggaagucaagaaaaggucuauugucacucuaagucgacauuacauuugcacuaagacucguuuauuaggcgcuaagaccagccacucaaagcugcaggcauuuaaugagcacagcuccggagcacucauuuucccgcggacucccgcuuuguggcuuuggcgcggaaacagagugggcgccacugccagcgcgggcuuuucggaaccgcgcgcuuuggugagggcugcccccgacaccauagaccaaucagaaagcgcggauggccaagccagccaaugagcgugcagagucacagccccgccaagagcggaagcgggaagaguggggccccgcucccgccacccgcucaccuggugagguucacgcccauggcuagguugcggucgcagcgguaugugucgaagccuucggagcgcagaguaagcuguaccaaggagacgugagacgaguccaugcucugcagguucacgccgcccgagcugacgucccagcaggccucauugaugaggucuuugagagccuccagcaccuucuucaggauggagcccuggaucaggcgugccucaaacaugguggcggaguuguggcgacuagaugagagcuacucuaagaggaacgaggucuggcugccaaggucccccgauucacgaugcagaagcggcagcgaaggccuacagcgacaacuaccaacccucugcgcccgcaaccgucuaaugccgcggcuuccuaggcgcgcgccuuuucccugcgcgaggucaugacgccacagcgcugauccacccaccucuccucaaggaccaaucguacccgugguuugagcaaggcccgccccaccgcguaugcaaaggcggggcugcgggguaggagccugggaggcgaggggcaucacgggguucgcguaggcugucgucaccgcccaaguuugugggaguuuaggcugcaguuuccauccuuaggaaguuuccgcgccacggaaguggaagucacaggcaaaucgagcugugcgcggcggccugccuugaagcuggagaguauuuuaaacacuacggagcguuuucccuaacguaagaaauacgcugcaaaauaucgaguaauaaagaggccaccauauuuuaacaccccua

SEQ ID NO: 1115 - RNA, 49143 nt, Mus musculus
uggcgucugggguuccaggcggagauggcggcagugcgcgugcgcgcuggcucgcagcuucccgggaggaggagcgagcggccgcuggggaaacagcggcuccgcucuccgggcaagggcggcggcagcggugcugggcggggccgggcucggggcuaguggcgcugcugcaggggcugugcgaggcacgguggggcugcgaggugcucgggcccgccgagagcccgugcucacugagccgacccccgcggccaccgugcugcucacucggggugacgucgcgccgggguccccagcaugaccgaacuacggcagaggguuguccgcgaggacgcaccuccggaggacaagguagaggcaucguuaagugcggaggggcgcgccggcagccucgcccucugaccuuuaucgcggcccuggguaccaggccuggguugcgcagagggucggcgggugucuuuugcuuguggggacagcggucugcgggcgcggggaguagcgcgugagcucuggagggucuucgccuucccuaggccuucccgauguggacgcuggacaccccacagaccuugcuuggggcccggagagcgcgauguaggcucaccgcuugcuuuacaaguauugcuguugauuggggaaugggggaggacucaggccauagcauuugucuccugggagauuaaaaccuucuuuugaacuugauuaaaacauuaaaucuguugguucuaucagagaggagucuugauccacuccgugagagggcggguuagugagcaggugugugcucccaaugguggguuuguuuacugcgccaagugugggcauugaugggguaaaggaggaagguaaggaggaggccauuuuggcagggacacagccaaugugggggcgcuccuuugguugaaagugcgagguuugugugaaguugagaaagguggagggugguuguuuuacuguggacauugaaugacggaccguauuugugguucggaucagugagugaugaguagaaccggcugagguagccuggaccagaaugauggagacugguuaagucagagauugucagcuugugaccugcagaagcucucguacguaggccugcgugcugauacggaaauaaggguuccguugaaggucuguuucuagccugucuucaauaaaggaggaggauaugccgcguuuccccugauuaauaguugacagaguuuaguaucuuuguuugcuuguucgagacuggguuucucuuuguagcccuggcuguccuggaacuugaucuguagaucaggcuggccuccaucccagagauccuucugagugcugggacuaaaggcaccccaccccccaaugcuguuuaaggaaacagcaucaagccuaagcacccacguuugacaucagaacuuuuguuuuagauagaaucucucuaggaagcccugcuagcuaguuuggaccuccuccaccucugccuauccugugcuguauaaaggcacuagcccccuagccagcuuguaccuuuuuacuguguuugaauugguuagaacaucaggaaggaaacaagcguaagccuuagggucaguaugccaacaguaauuuuacuaggaagaauaguucagaugaaagauaaaggguuuaaacaacucuguuacaguuguagacagugggucaucagaggagaacucucuuccuuuggagaaggucuagggcugagguccagauuugaggaguaccuugcaaagacaauacuuagaaaucgcuaaucuuccccgaggauaguggauuggcccugaagaaaacuguguucugaauauucuuugguggguuugaaugccaccuugucuaauuaagggugacuugaaggugugagaagggggagaagaaagaaagaaggucuagcugggucaugccuguggucccagcagaggcaguggcagguggaucucugaauccucuaaacccagccuggucuacagagcaaguuccgggacagccagggcuacguagagaaacccagucucaaacaaaaccaaccaaccagucgaagucugauagcuguuggaauacaucuucacacagguauuuacuguaacaauuagacaagacaaaacaacugugauauuaguaggggcgaggcagcuuuuacucuccccacccagcucuuuggcuccauuccccaaacguaaagugucaguugacucuuaacauucacuuccauauuuuagguugaggagcuguccagccuuaguaauuacaagugcauuuaaaccacguguacagugaaagaaccuugugguugguugugaggucugcuaggcguaugcucccuaaaacauaacaguuacgcauucugcuuaaaagauuguuguaggcaaucggcccacgccgaguagugauuacuuacuguuucugaauugucgugcauaggauuuuuaauagcauaaauacaaauauuaaaaaauaaguauuuuuuuaauaaaugaaaaaaauuuaauuuucuuucuuucuuucuuucucucuuucuuucuuucuuucuuucuuuuuuuuuuuuguuguuguuauuuugagacaggguuucucuguauagcccuggcuguccuggaacucacuuuguagaccaggguggccucgaacucagaaauccgccugccucugccucccaagugcugggauuaaaggcaugugccaccaccgcccgaaaaaauuuuuaaaaguuauuuaaaaauuaaaaaaaaugugcuuaggaaacagugaaaugccuuuuuuuuuuuugaugaauauauguagcaaaaauuuuaaaaucugaauucuuuuuuuuuuuuuuuuuuucccuuuuuuuuugagacaggguuucucuguguaguccuggcuguccuggaacucacuuuguagaccaggcuggccucgaacucagaaauccaccugccccugccucccaagugcugggauuaaaggcgugugcuaccaugcucagcuauaaaaucuuuauucuuuagaaagagguuugcuguaauuuauauuugcauguguaugugcauguguauaugcaugcccucggaggccagaagaaggcauuggaucugcuggaguuccucuuuugggugcuugugagcugccugauaugcauacugggaacugaccucugcuucugugcaagagcagcaagcccucucagcuguggacccagcucaccacccaauucuuguguauuguuuacuaggcuggaggaagacuuacugccacaauucugauuugcuaauacuguugugucacaauccaagggcucagaggugaggaagcauacaugacuuuuagagaaaugaauugugaaauuugaacuccguuacuucauaguacaagaauccaaaacauuuuuuucuuuucuucuuuuuuuccuuuuuaaagauuuauuuauuuauuauuauauaaguacacgguagcugucuucagacacaccagaggagggcacagaucucauuacagaugguuugagucaccauguguuugcugggauuugaacucuggaccucaggaagagcagucaguucucuuagccacugagccaucucuccagggcccugaagaacaauuuucaaggcaauucuucaaagaacaauuuugaaagauuccucaaaauguuauuauaguugcuaaaauguguuugcaaaucugaguuguuaauagacaaucaccacuaugaaaauaaucugaagaauguguuuguaaaaggucaggaggaauuuuguuauauuuagcaucuagaauggaauucucaaagcuaguugcuaauaaaggcaauguucucugggaucuagagucccaaagcaguugacaaacuaagaccuuuggaaguuaagcuuuaggacaggucgcugcugccugaccauguuuucccagcacagcccaggaagcuaaaggaugaaaccuggaccaaaacacuaaaaacacucggacuggcauuucaggagacuuuuuguuagggacuuaaauggaagguucuggauuuucugcuguacuuagaugcugauaugguuugaaaacauagcauuaguuguuuaagggguucuauucuagauggaugaaguuaguauagauaggcagcagguuguuugcuauuuauuaacaggguugugugcucuaggcuggccucagaguuguuauuuagcucaugcuggucuugaauuggaaauccuccugucucugucuucccaggcuuguuauuaaagguauaugccaacauggcuagaaaggagaauucacauuuuaauugcagauaaaucagagugucugugaaaucagccuaucacuaggcucugccauguuaccagugguguaagucaguugucaaaaccuaaauccuaagugggaaaauugaaugugcuucauggauuaguguguguacagguuaugcacuaagacagagcauggcuguuguaagaacauguuagcacuguugcugcugcugguuaaaacagauuuuaauaaaauuuaaauuaauuuuuuuguauguguugguguuuuuuacuuugugggagucuuuuuuccacccuuuccacccuuuucuuccaccucuuuaacacccuaacacuaguuaagagagaaaaaaggauguauguuuguauguauguauauguagaaccugugugccuggugcccauggagccagaagagagcauuggauccucuggaaguagaauuauugaugguugagagcagccguaugugugcuaggaacugaacccaggucccuugcaagagcaagugcuguuagccacugaagaauuccuccagccccauguauuauuucuuuuuuaaaaaguuuucacauaaggagugacuugggaauugaaaaagcagaaagccuuaaccacggcuuguagacauuauguagugaaauguggggaaagguagguuugucauauauccuagcauuuuagggugcuuaacauuuuuuaaauguuuauuuguuauuuauugucugaggugugcauuggcacaugcagaggucagaagguaacuugcagaguggcugcuuuuuucugccuguaagacccuggaguuugcaaugagcuuggugguaaacaccuuuacccauugagccaucuugcugguauauguuggagaaacaauauuuuauuuuaaagacucaguuacuucucaauuuaugacuucuugaaauccauuuuccccuacaaaguuaauuuuauucaaaauacuuugcauuugcaugcauuagcauauguccuuuuuuaaacaauuuuuuauuagauauuuucuuuauuuacauuucaaaugcuauccugaaaguccccuauacccucccuaggccuugcuccccaacccacccacucccacuucuuggcccuggcguuccccuguacugaggcauauaaaguuugcaagaccaaggggccucucuucccaaugauggccgacuaggccaucuucugcuacauaugcagcuagaggcacgagcucuggggguacugguuaguucauguuguuguuuaugacuuaauacccuuuaaaaauguuaguuugcuaucuuugacucggggucuuacagguuguugcuuccuguaagagguaccaccaucugccaaguuaaguuucuugccuaagguaacauaguuagguguagggcuugguagugugagucauguaaauuuuuccucucauguugcauaaugucuuuaaggauagaauuaaugcauuaauuuaaagucguuacagguucuuauauugacauguuuugguuuuaauaauuagauuuuaucuauccuuauuucuugauauuuuuuuuucuuuuuuuucuuuuuguaaagacagaguuucacuguauccuggaacucaguguguagagcaagaugaccuugaacucacagagauccugggcuuucuugaggacugggauuaagggcguguaccaccacuugaggcucaguuuucuuauguaauuauaaauaaaaaguugcaaaaaaauaucuuaaguauaagauguaaaauacaagugaggucucaguguguguggugugauugggggaaguuuuuuguuuuuguuuuuguuuuuuuuuuuuaagagaaaguagauuuaacaauucuuaaucauugguucucugauuuauacauuuugaaguccauuccagagaguagccacuaggccaucugugaguggcccuuuuggggcuuggccaccacagaacuucacucagggcagugagagugagguuacuagaggaagugcuggccaggcaugacuaagcagcagagcugucugucccagcauccgucaucagauugacaccucucagaacauacucuguuucagucugcagugcgcauugccuguggcucuaguauacauagugucucugguugaggcugaugucaguauguauagggucagaucuauaauuuuaucaggguugugagcucaugcucacacgcuggggguggaaccagggccuuguccaugcuuggcaggucaucuaccacucaccuauauccagccucuuuuugauucccagugagcugggguuguuuuguuuuuguuuuuguuuuguuuuguuuuguuuuaaaguuguuuuuauuuuuaaugggguaggaagucauaccuaggcucuaaugguuucuacuucagucauucuacaccccuaacccuuaaaacaaaaaccuaaaaauuagugugugagugugugugugagagugugugugugugagagugugugugugagagugugugugugagagagaguauguguguguauuuguguguguagaguguguguguguguguguguguguguguguguguguagguaaacaugcuaugcugaguguguggagguuguguuccuggguuugaauucaggucaccgucucucagccaagcccuugguuuuuggagacaacgucucucauguaauuuaagcuagcccucaacucuugaucauucugcuucugcuucuuaagugcuaagaucauaggccugugucacugacccugggagaaacucauugaaaaugaaucuugugauucauuucacaguucaaauaaucauucuuuagauuguuugaaagcguccgcccaguauuucuaguuuucacaacucuccauucuccugagguuguauaggcugaucgaauuccuucauauagcuuguuuauuuguacuuguccugugacaguuucugguccuugaguggcccaagaggcugugggguuaaaaaaguacagccacucacuccuccaguuugggaaagaggcuugggcucuugacuacuaagugugccagagacuuguugaaugaaugcugauuuguuccuggcauuaagcaggguuucagcucuccaaggccuguugucuaguagcugcuugacugggggaguagugaggcaccccaccccaccgccccauuagccaccuucccugugccagucacugaucuuugaccucauguuuauccaacaguagggauggcauugggcccacauggcugccuguccucggaaaguuaaauuuuaucaaauuauuauagguggcagugcuugcugggucaggauuuggagggaagggugcagugggaggcuccuuccuccuaucucccagagacacccuuuccauggugagcugaugagcucugggugcugguaucugugggaaggcuugaccugucuugcccagaucagauguccuuuugauuugguguuguggagcccccuuugcaauaggguccccauagagccaucuuggacuuuccucaagacuuggcugagaguuugaaaagguguugguggugcacaccuuuaaccccagcacuugggaggcagaggcaggugaaucucugugacuuagaguccagccuggucuacagagaccaggacagccaggacuauggagagaaaccuugucucgaaacaaacaaacaaacaaacaaacaaacaaacucacucuugggaccuaggauuuaacaauuauacucuuuuugagucucugauauugaaagauggcugucauggacucaccacugacucuuacugcuguguccucccaucuguguccugacuaguccugugguucaacggucugaacgcauuccccugucuuuuccuaagugcaagcuugcuugucucauaccugaguuugccauguucucuaugcugacccuguuccuauagcuucuuuuccuccucagcuagaaccacagauccuacaguuacuuaggcuugaaaucugcuagccuugggccccaaugaauaagcuugcugccaagucugacagcccgaucccugcauucuacaaaaagacaaccaauuauugcauguaugacuuccaaacauguagcauguguauaugugcgcacauacgcguacacacacacacuaaauaagugaaucuaaauuauuaagaagauaucuguuagucuuguaauuccuugcuccucucucugcccagcccaggacucagguuuaucugcugccuagcacauuucauuucccugaguucuggacuugaugcuuucgcucuugggaacuccucacauugagccuccucuagcuucaggaugggcucucggcuccugcuguucuagcccaucugugcuuugcgucuucuagcacuugugaagcuacucugugaauuauggaacaaagucauagacuccuuucugucuucuguggagccuccuucuggaugccuccgugucauugauccugggccuuggucccagcauuuagagcaucuuuuguugucauccucuuccacuuccacgcccagcuaacccauagaacucuucauaaaagaugaaccaccuugccguucaccacacguacacagcucaccucagucccgccuacuguagagaaucuggcagcaccguuucccagcaucuggggagaaucugauauaaagcacggucuuugcucucgggagccaauguuacugagguugggaaggucaguuggucugcccagucugcgagacacgagcagaugacucuccuucuuggacugcccgccaucuugccuggguccugguuugcagcugcugccacaucaaaacagcgcacuaaccugcuccagccaccauguuguuguugcuguuguuuuuuuagacuuaaaaacauuacuauuuuuauguguguguggcuacgugaguuugugugcaccacauaugugcaggagcuugcagaggcccgaagguguuggguccccaggaacugggauuacaggagaugacgagcuaccauauaggugcuaggaaccaaaguaacgucugcaagagcagcagguacuccugguuacuuaguucaucuccagugccccucucccacaauuuuaaaagcuauaggcuauuguguuuugugcugugcuuuagucuguuaaauucguuaagaauuaaaauuguuuuaaauguuuggcuauuauaacuagugcuguauaagauagcucuaguuuaaacaagcaaacaaacaaacaccccaccaacaaaacacuaaacucucccauucuugccugaucuccuuggaagauuguuuuguuuagaacugcugagccaguaaaggguggccauuguuuaagccuuugauacaaggagugcauuuucuucuacaggaaauugguagccuccacaguguguuucuugauuuuuuuuucaagaacuacuacuguauuauagcguggcaguggcagugcagacguggggguuuggccugccugcguuauucuguagcccuguacugauuugccuuacuguuuccucugagcagcagugggaaggaugucuggugauggcuguguggcguugucuuuccuucucuguacgaagcacacuucagagcaggcuacccuguuuucccagagaaauguuuaccuaacucuggguauauaugcaaacaaaguagcuaaacaaaucaaacauuuaacuaaguucggaaguuuauguuagggauggggacauccuucauagccaucaaauugcuugcuacaugagcugaggcacugagccugauaugagaacccauccaaaaaagcuggaugugguggcacagcuuguaauuuuggaggugugacagcagagacagaugacucucuggggcuuacuuaaugagguccaggcaaaugacaagucugucucaaaaacacagugaauugacuccuguguugaccuuugcccuuuacauagauacacacacauacaagcauccacauuuaacauauccaugcaugcaugcauauacacauucauuuuauuaucuuauuuuuuugucuuuuugaaacaggguuacucuguauagcccuggcuguccuggaacucgcucuguagaccagucuggucuugaacucacaagagauuugccucuuucugccuccugagugcugagauuaaaagcaugcaccaccauugcuaauacaaauuguauuuuuaacauuuauuuauguaugggguugaguauacggugguauguauuuggugauaggaucacuuucugaaauuaguucuuccuuuccaucauguggguuccagggauccaacucagguuuucaggcuuagaagcaaacaucuuuauccgccaagucaucucccugaccccagggguugcuaaucauagaauuuuuguucauugaacacaaaagcacaguugcauaugaauaggaugcuuuuauuuuuacauagaauuaaacuuuuuaaaaaagauuguuuuauguaaguacaccacugcugucuuaagacacaccagaagagggugucggauuccauuacaguuaguugugagccaccaugugguuccugggaauugaacuaagguccucuggaagagcagucagugcucuuaacugcugagccaucucuccaggcccaaaaauuaaaucuuaaauauuaauaucggcaagccagaugugguacacacaccuuuaaucucagcacucaggaggcagaggcaggcagaucucugaauuuuaggccuccuggucuacauagcaaguuccaggauagcuaaggcuacacaaagaauccuugucccauacuaacaaaaagaagcaguggccacagcagcuacugcugggugucuuagucagguuucuacgacagucaucaaacaccacaacagaagaagcagccaguggagcagaggguucauuucagcguccaacucuguggucacacuucaucacugagggaaaaacagggcaggaaccuggaggcaggaacagaggcagaggccaugagagaguccuuucuucuggcuugcuucuuaagcaccgggaauacuagcccaggaauggcacuguuuauaguuggucucuuccacuucagucaucaaccaagaaaaugcaccacagguuugcccacaggccauucugauagaggccuaaaaugacccuagauugugucugucaaguugacauaaaacuagccaccaugcuuaccuuuagaguaagcagauaguugaugagggaaaguuucucucagaaagcgguaaaggagucauaaaguaucaagggacugggcaauguagaucaguggucaggcccuagauucaaucuccguuacuacaaaaacaauaauggagcuguuucagccuguugaauuaaugggaugagauagcaauugugcuauccuagagauaccagauucauuccauagcuucugcuaggggagucuucuagaaaaauccuacucgaaaguuaucagaauuuucgauuguaaaggcuaauugacaggaaauugaaaggacaaaagaauacacuaaaaaccaccacuggaccaauagccuggcugcuucuguaaauaaauggcucaagacguuucacuucccugcugagacagggagugggaagggaaggcagggauggggaagaagggaaaacuacucaauacgaaagacuugaagaagagcaaugauuucugaacuuuacugaauagugagcccaucagacuuaggaagaaaaauaaauaaaauuaacggauauauuuaaauauuuuuauuuuuuuuuuuauuuuuuauguuuuggcaagagaucuggucuuagccgggugugguaaaagccagcaugccuauuaaucccaguacugaggagacagaucucugugagucugaggaaagccuggucuacauagugagcuucaggagugagagccugccucaaacaaacaaaacaaacaaacaaacaaacaaacagaaaccuaaaacaaaaggaguguucuugcuguguucagacuugcucugaacucucaagcaguccucuacaaggccuuaguagcuggaacuauaggcacauuccuucuuaggcucuuuuuuauuguacuguaaauaaacuuaacuuucuuuaacauuuuuuuuuuuuuuccuuuuuaagagucuuacuaugcagcauucacugucuuggagcucauagagauucaccugcuucugucuugcuagugcuggaguuaaagguguaaacuacagugcaaggcuuaacugcugucuucguuguuuguuugucuuaaagauuuuuauuuugcuugugugugcauggccaguggcugcaugggcuugugugugcaugggccagugacugcaguggcugcagagaccagaagagggcgcuggauucccuagagcuggaguucuaggcaaauuaggagacauucaauggaugcugggaaacgaacucugguccucuguaagagcagugagcaucuuaacugccaagccaucucuccaguccugaacacuuuuccuuacaguuccacgagguguugguuuucuuuccagcugcauuuccauuugcuuuguuggggcacuuuauccauucuggaaaugaaucccaugucagguauguuuuauagaaagucuucauucucuuaagaguucaagaaacagaagguuagcugggcauggugguacacaccucaggaggcagaggcagaggcagguggaucucugaguuugaggucagcguggucuacagagagaguuccaggacagccauggcuauacagagaaauccugucucgaaaaaccaaaaaaaaaaaaaaaaaaaaaaaaaaaagaaacagaaguucagaaguucaugucuuugucuccacaggcaccugcacuuaaaugcacaaacccugccacacacgagcauguaaugacaagaaaaggaaaaggcacuaaagauacuuagagcccagccggggcagauccacagucccagcuacuuuggauccugaggcaguggguuuguagagaguucugggccagccugggcacuuuagugugacugucucaaacuuaaaaaggcugcggauguuagcucaguggaaagguauuugcuugaccugugugaggcccuggguuuacacucuagcaccagaaaucaguuagucaggccaguaucaguaccugucaucagagcacugauaauuaaagccuaugaugaaauauauccaucuaaaugucuaaaacugaaaagggcugaaaguacuaagaguuuacauaagucgggucagugcauuauuugggagggugaagugcugcaagugcuguaggacauuguugauuuguguggaagcuaaguauacccagaccagccaggguccgaggcgugcacccucuagggauaccucuguaacccuagcauuggaagcagggaggguucacggucaccugaccuacauaguggccauacuugaggccagcauggguuguaugaaacccugucacaaaacaacaauaacacuccuccauuguaugaucaagcuuuuucaaucauaggugauugacugccugauagaaauucuauauucagagccucuggagaacaaauuuaauauauaguauuuauucaacguaagccaugcaguagucaguguugcaaauagugcuguugucaauacaaguaggcagggucuuuauguagcuccagcugccccagaacuaacucacuguguucugccuggcccugaauccaccugccucugccugcugagugcugggaucaaaggcauacaccaucacgccuggcucugcucacaaugcuuuuaguguauagccagaaccuaagucauucuaauuuuuuuuuuuuugaggaaccacauuacuuguauucuuguauuucagaaauuucucaguuuuaauuuauaacauggcaaguuuugauagaucuacauaaauaaguaauaaagaccuuaguaauuaagagcagccacuauaaugaacgaagcaugugccuugcuugucauggagcagaggacugaagcugucacugucuuggguauaaaagugauggugugcgauccaucagaucuugagcacagugacacacgcccgcugcucccaguguuugguuuggauggcauugcagugaugguacaguuucccugaguaccggugauacuguccgucacucuuuaguuguccuguagacucuggacagucaagcugugggcgagugacacuucauuauaaacaagacuuaauuggagcuguuaugagauauuucauuuaaauauuggaucuguguuuuaaaaauauuuacguauuuauuuuugugugugugugagugugccugagaccagaggaggauggggaauucucuggagauggaguuacaagugguuguaagccacccccacauuggaugcugggaaccaacauucagguccucuggaagagcaacaaguguucuaacuaccgagucuuuguuuuuuguuuuuuaaugaaguacaguaucucaccaucuuauugcugcagagaacaugcuacuaaugcaagcuucaaaaugucaguagcuuugacugucagggacuacacauuugaaauuuccauguacuuugcagaauagaugguuucuuggauuuuaugugaauuuauugugaggauuuuuguaugcauucauuuaaaauguugacuggguuuugaguuaauagauauacacacacccuuugacugaaaccauguugaagauaucuucaugaaguuuguauauuugucuauguaugcaucccaggaaaacauuaaugaggaagggucugcagagcacgugaccuugaucaacuuucuccuuucuggucuugcagaacacauaaucuccuaagucaguuuucuuccuggguuuggugaaagagccauccaaagaaggaaggcuugaaugucuccgggagaaccugccuuucucugcaucuguuuuuguagagaggaggcagugacagugcccagaagucuuugagguuuucaucccggaagcaggagcauccuggaacugugcagugacugucacagagccccaaucuucugagacccagaccaacuccagcuucuucuaggaaauucucuggacucuugcagcccacuuccacaucuccuuucuuccccuugcuccuguggaaaucacuguccacggccccguuagguggcgucuccugcugucuucucagcacaugcucucuggaguuggauuccugacuuagauuucuucagcugccgcagggguuaggcucacaggguuggcuuuggucaugcacuccuuucccauggcuggacccaguucccagcaccuguggcuugucaggagguugagguugaguuggugcuaaaucagcugugaagauuagcaacgacuugggcagugagagccaggccucugacuuaguuugauaugcuuagugacugauguguugugaagcacaaagaaaaucggccuguguuuuauuuuagugcugaaguaccagguaaaauaugcguuaaugcuacauuaacacaacccuaguguuucauuuaaaaaugcguaggauuuaagaaaaucaagugguucaaauauuuaacuuuuugacauaccucagaaugguaauuaaaaacccaaguuaauaaaaaauauaauuuugaacauuaauuauucuuccuggguagguuaguagacaaaauuuaaauauuauuucuaaagaaaauuuaccaagaugucccacauuaacugaguuuauuaaauauaaaauagauuuauuuuuuuuaaagauuuauuuauuuauuauauguaaaguacacuguagcugucuucagacacuccagaagagggagucagaucucauuacagaugguugugagucaccaugugguugcugggauuugaacucuggaccuucggaagagcagucagguacucuuagcaacugagccaucucaccagcccccuaaaauagauuuauuauuuauuaauaaauaaauauuagaucuuucuguuuaagguguuuucccuguaugagcugacgcuaggaggagaagccaagggaccacuaagcugcugcccuuccucuagucagacauugcuagacuccccugugcuaugcuaacuuugaggacuugaggccagugggcugacuguagucuuuaguugcuaguaaucugcguuuuuuuuccuccaaaacaggauuuccugcuugucuugaugcccuucaguuucaucuguugagaaagucuuugagcucuguugagacuuaaucuucaggcagaagcuuugcccuauuggcugcuuuucuuccuccugaggauuaugcagggaggucaggcuucuaaaagaggacacugcaggugagccugccagcuuguccaggcuuucagagugcacuguaucacgccaugggaggaggggguggggguacuggaggucaagggcaggggcuggcacaugcugcccaagugcucuccugcugagccuuaccccccaaacccaagcuuuccuuaaaaagaugucuucuaucugcccccacacccuuaauggccccaucacuaggauuuggaucuguguaugucagcuuguauauacaugugauuugggaacaaaagcuucaaaacacagcacucuuucuguaaacaagucaaaguuugcuacucuuugauuucauuaucauagcuacccuuucugaagcucuuuuguugagcuauaacagaaaugugcacauacuguccuuucccagugacuuuucauaaauuaagcacaucccgcagcagccgcagaucagacagaacauuuccagucccuggggaggcucccguggggaggcuucuguguggugucuucuguucacugaccucucccgugggagccaccaaccuacuuucuggcaguguguguguguguguguguguguguguguuguaaaacccaguaaauuaauuucaagacccagugggucucaacuugcuacuuggaaaaaauauagccauguuuugucuaauuauucuuuuuucuuuuuuuuuuuuucugagacaggauuucucuguauagcccugacuguccuggaacucacucuguagaccaggcuggccucgaacucagaaauccuccugccucuuccucccaagugcugggauuaaaggcauacgagacugcccggcucgucuaauuauucuugaaguaggaauuuucuucuuuuguagaugaaaaagaugaaguccaagaugacuugauuucccccaggaucccauggcuugugcuguguuucuuuucccugagcugaggagugucuuguuucgaaggucagugguagcuguuucuguuucaugcucagccuuucccucuuaaugugcuccgggaauggaugcucauuaugaagacagcucaguggauugccgguauuagcacucugaacaugagucagaugcagcugaugguugcuuugauggugucuugggaguuuucuuggcauuaguccucuggucucaggguagaaagaaccugcagggacauggacagccugggcugucaccaugcaggacaagcucagugccucucaugucucucugguguggcucauugagagauccugucucggggccuuagccuucuuucuggacagucuaucccgucauccuuacauucugauugagaggccgauucuuugaaccaacaccucuuggaguugcugaggccgugccccacagucuguaccuagaaauuccugcuugaguaugcgccgagggacucagucaggccggaaauguuugcuaacuuugucagugcuucgcugagacuuaguuccaagaaccuugaguuuucagguucuucccccaugguagaaugaccugguuggcaaggcugucagacauggggcauagcagugaguaaaacaagcuccuuccaacauagaguccauugucugucugucuuucuuucuuucuuucuuucuuucuuucuuucuuucuuucuuucuuucuuucuuucuuagguuuuucgagacaggcuuucucuguguaucccuggcuguccuggaacuuacucuguagaccaggcuggccuugaacucagaaaucugccugccucugccuuccaagggcugggauuaaaggugugcgccaccacugcccggcuagaguucauuuucuguugaagcgugcagaugaaggcuuauugucaagagcuaaugaaguuauacaggauaaagcagguuguuguuuugaggcugggucucucuauguugcccauucuguuggaaaacccaagcucacaugcuccucccacaucugacuccucccagguagcugggacuacagguaacaugcugccaggccugccuccgucugucuuugucuuuucuuccuuuucuguucuguucgugacagucucacuguguagucaaggcuggccucacauucuuccugccucagccuuuagugcugagacuuacagguguguggccaccacgccuggacuaacuagcuguuucuuaccacaaggguagcauuuucaaguguuagcuguucccggggcuuuccaguguguagucuaguuugacugagauguggacauguuucugaaccugucugagaaacaaguggaaauguaccuagaccuguuaauucuguagugcugggugggagcacugggaacucuaaaaggcuuuguguuuauucuuuguuccuggcugugcauuagcugauguucagaagugcaucucaguacuuuauuucuguugucuucuuaacugggacuguugucaaacugucuucuagauauuuauguuuaugucaguugucuuaguuacuuuucuguugcugugccaaaguaccaugaccaaaguuguuuauuacugagcccgcuuagauggcugggaggaagugaugagucgagaaaggagggaagcaggggguugagucaaucaagagccaggcgagcacacggugaccucucagucacuuuccaggaaccuggcugggguauguggucggucaucagugccgcauccuuugccaaugcccuuuacucccuugaaauaguuuggagauaguugauagucaaauaggguuguuuuuuguuuuguuuuguuuuuuaaaguuuauuuauuuuauguguaugaguacacuguagcugucuucagacacaccagaagagggcaucagaucucauuacagaugguugugagccaccaugugguugcuggcaaaugaauucaggagcucuagaagagcagucagugcucuuaccuacugagcagucucucuccagcccaucaauuagguuuuuaaaagcugaaucuacgccccgcccuccccacccuuaaucuuuccuuucagugcuguuacuggugagggagccuguaaugaauuccgucuuggaaagcccagugcucuuucuguagaucucaguauugauuugagacuuucggcaggcaggguaugcuagggugggggugccucugcuaggucucagaaaugauaccccaguguguggcaccuuggcauauggagcguuucuaagucagaaacaacgggguuuggugcuucucuuccagggccgcucugagcaccuaacucugcugaugccuggagggacuugaacgcugcucuaccgcacaguugccagcagaguugcgucuguaacuuucuucucucagacucccuccccagcagccagcugcugagccacaucccaggaaggagcauuugacuccacgcaggguagacgugguggauuagcacugacucucugggcccucaaaauugucagcuuguucaugaagaguguagauaagauucuguuuucugaguucuugaaguucacuggccugugaguaccccucucucuggagcuaaaaucugugugccccuucuuguuaaucuuuauagggcaaagagaaaguucacuuugcuucuguaguucccagcucacaguaaauucaucuuugaccuuuucuuuagacacacaaacuugucaaaugggauuaguauugaaaagcaguagaaguauuucuuuguucuuccucacaauacccgccccaccccacacgcaugcaauacacgugcaggcuuuaucuuuuuguccuguaagaacucaguucaaccuacugggcucucucaucaagaucgacacagggcuccugacaucucuuaagcacccucuagcaguuucuccccucuguacuugucuccauaagugggggggggggggggcguugauuacgcuggcagcuggccagaaggcuugcuuaagauggcaagguuguauucagcacuaagguuacgcuuagguuaagucugugcuccaggaggagacuugcaauuugcauuuaaagcagugcaaaaaauaguuuguaaguuguggagucauuucagcugcuggaacuuauggauuggacugucagguccccagagaggagcgagcuucaggggcauaaccgaccagugugccacacgcccgccaccacguggaagugaaugagagucuaguggguggcgcugcuuccuuccuugucccuguuuuuagcuuuucuuaagacaaacugggauaaaauaagagaauuuuaacagguaucaaaagagaauuggugucugguaaagaaauaggauguggagucggcugagucccaccuaccuggauucccaguccggcccagcuucauuucuucuaaaaggucagacugucacauggggagcuuuaaaaggcuuuuugugagccagaggcaacccuucgugaaauacugagaauuaagagggaauuggaagaaaacaggggcguacugcugauuagguagucaauuuaacacaggcuagagucuucagagaggaaggcaccucagcugaggaaaugccuccaugagaucccucgguagggcauuuucucaauuagugaucagugaggaaggguggugccuuuccucgcuggugguccuggguucuauaagaaagcaggcugagcaaggcaugaaccagccagucugcagcaccuccguggccucugcaucagcuucucucuccagguuccagcccugcuugaauuccuguccugacuuucuucaaugauggacuaugaucuggaaguauaagcucaauaaagccuuuccucuccagguuuguuuuugguguuuuuaucgaggcaauagacauccuaacuaagacggugcaacuuaaacaacagucacaccuagaaagaguagcgggcaugagcuggcagggacuguugcggccuuagugaggucccuccccagcaaagcccagaccaugacacagggguuucuugcccacccacugucuuucugcuuccuuccacuuuuucuucuguuggagacagacuucugugcugcucugagacuugugugguacuaggcugagggggugaagagacuggaagucuucucagagccacauuuugaguaacaguuuaaaaacauucgugccuuuugcuugagucuuggugucuagagcucugcaugugccuucacgcuaagugcuucagucuuucccugaagggucugugugacccagaggggcagguucccuuccuuacagaggaugcuguuuccuguuuacaucagcaucaccaccccucugggacuggcucaggaacugugggaggauggguggaggcugaggggcuugcucugcuuauccugugcucugcgccuggggaacgggaacgggaacgggaacggggaacgggaaugggaaaggaaggaaggcucuugaggaagaggcggggcccuggaaagaaaugggguuucuaggagggaagugugcccugggaaggaggagaggcccugggagcagccuauucugcaugcacugaccuauguccauuaaggagggaggcgaggaggguuacaggagcucugaguagcaacggagggagccgguguguuguccaugugagcugggagugguauggggacuguguguucaguagagucuuaaguguguaaggucuuaagugugaguucaaggaggacacugagaugcauugcuggggaaggacuuuauuugaagagcucagaccacggcaccagggaaaaagagcaugguagaccugaagagagagggagacugggccugggcagaucacacugcccucagcaggccugucacagacacccacacacacucuacgguggcagguccgacucccagguccaggaucucagcuagaaagugaauguacaucagagagcauugguaaagcuugggaagcagauggccuggcugcaggcuugugauuugaaaccaccuccacuuccacucucagaagugcuugagagacccaggggcuagaaaaaugccuccgugguuaagggcacuugcuguucuuccacaaguucuggguucaguucccagcacccacaugguggcucaucuguaacuucauuucauggggacccaauacccccuucuggccuuucaggauauaaguaugugcaugaugcacauaauacacacagacaccuguuguggaugggccagguacuugagaaccaauccccuaaugaauaaaggagccaaucacugggcgaguaggcaggacuucuggguuggaccgaggaagagaggaagcuggcgagaguugguucccuuuuuggacagggacagcacgaugguaagauauagcugcuagaguuuccugguaucauggcggaucugcaagaauuugccaccagaggaaucagauuuuaauaaggcuuacaagauuagguuuuaguuguugugcccagagacugaguuaccauuguuucugaaggaagucuguguugcauuuuccuucacgcagcucgucuggguucaagagagaaugguacagcagcaaagugaggguucgccagaggugcaccacaaaggccaugggggauuugaaguauauggggcugguguggaagcaacaccagugggaaccuagagagcuggguggagagauuggaguucugagucagagucucccuaagauaaaaacaggccggccaugggcugccagugcauggccggccaggcugcuggggcagaggcacaagcaugggaacaugcccauucaucuuuuucaauauuucccgcaacagguggcgaaccaacaugcugggcaagaaugcacuagaaauuaagguuauuagccugagagaguuuucuuucuuuucuuuuuuaaaagugaguagcuggguagcacugagucacgugagacaagucacaugagacaagucacaugggcuuaagugcaggaauugaaucagaaacugcuggcaggcucugaggucgccugcugugaggaaugcaggcugcucugagucagcuguagaauagaaggugccuacuucuuggggcagagauugaacugugaauuuauaaaauugggauuauuugcuuuuaggauagguuuauauacagauuuugucggaaucaagucgggaauuucgccugugguuuggaacuaggauagggaaauuuagucauugacuucaaguagagagggcagugaacagguauuaauagaauaaacaucugugacuccaggcagagagccaaacagauagaugguauaacaaguuggcugcuuuagacagagagcugaaucauaauaugauauaaaauugcuuuacuugccuugugggauacucauauucugucuaacgugggcuccacgggaauacuggguuuuauauccucuuggcaagauaggaaaggccuaaguauagacacaguauuuuaguuuacuucauuuguuauggauuguuuuaguuugaacuagcauaggggauauuaguaacugacuccagaguagagaauacagugauaaucauugccugcuuugaacagguauuaauuaucgaugucuguggcuccagguagagagcucaacagacagauauuauauagguauuaauaaaauaugucuguggcucugggcagagagccaaacagaaagaugguauauauuguuuaaccagccacaggaagcuuauauucugcuaacgugggcucaacaggaaucuugaaugucuuuuccugcuuggcaagauaggaaaggccuaaguauagguacacacaguaucuuaguuuacuucauuuguuuuagauuguuuugauuuucaaaaugggugugauuuugaguuuugugguuauauuauuccucugggagagaggucuaaauaaaggguguucagauuaugggcucaaggauaugaugauuugggaaaaagguuuugucuuuguguuuuuggaaaagguuauuaagguauuuacaccuuccagaguucaauggaucagauuugauagagggagacccccugaagaacuagauuccagagaaucaaacaaaaagguuaucuugauaaugcuaaaaaauuguuuugagauuuguauauuauagaauauacagccuuggugagucuccucuugaacucuggaugucuuggacuuagagcuggauccagucaagacagagauaucagaggcuaaagcaaucauugguauggccuucuuaaggccaaccaacucuuacccucccuccccaaauaucucaaugcccauauucagcuugaagaaguuaugaaguguuguugccccaguucccugggcuuuggggcuugaggggguuauuauagauuguuauucuagggaauguagaaauggucauaauugagacaggaaggaauagcuauaaacucauuuuguagaaaucuuuuuaauuguuacuaaguugaagucauuguuucuuauuuugguacagaauauauuuugaugcaaagucaagguuuauauugguauaaauuucuucuauugauacaaaaauuuugaaaguacagggcuuagacccaguccuucuguaacuguuaugauaaacugaccuuaggugauuaagccugugaguuaagggccaaauagaaaauucauggcucugaguuuauuguuaggguauuuucagagauuuuaauuagaaauagcugagaguaguuaacggagaacagucuagauugcuuuauauagauaguugguuuucaaaaacaucagaaauccacagaaugugacaauguuauuuauucacuuguuguugagacagaucugcuccuaacaguuucccauuccuggauucaaagaagcaacugaguaucuaaaccuccaagugaaguugcacauuuguggcuaggugaucaccgggcagaaaauugcccguuucuccugcagaccuuuagaguucuugaaaggacacaauuuguagguuaggacagcuuaguucugccgagacagaauaugcugguccuuaauauuucuguaucucuaaggucugucagauuguccugggccagaaggcugaagauugaugcgccaucuuccuaacuuacuggggcuguauagguaggcaguggucucuacaguuugucucaguucuggaagcaguguuaggcuuccuauauguuuucaguuaauguuggucauucuuggauuucugaugggguugaaaaacuuauaauugcauagccaacccaggcuauuuacauugagagaacagauuugagaggaugauuuccagauggcauacuaucuaaagccaggacauaaaucaagguagaaucuuuuuaaaaaaagauuuauuuauuuauuauauguaaguacacuguagcugucuucaaacacuccagaagaaggagucagaucucuugacggaugguugugagccaccaugugggugcugggauuugaacuccggaccuuuagaagagcaguugggugcucuuacccacugagccaucucaccagccccaagguagaaucuuaagucuuuuaauuuaggauagaugacaauguucuauccuaaugccauaaauccuauaucuuguacuuuguagauuacgaaaugguaaugguugugcucuguauuugagagaaagguuuuguuuauuagaacagaaaggggaaaguucugugcacggaccuggugcuguucuuguaaaccaauccccuaaugaauaaaggagccaaucacugggcgaguaggcaggacuucuggguuggaccgaggaagagaggaagcuggcgagaguugguucccuuuuuggacaggacagcaugaugauaagauauagcuguuagguuuuccugguaucauggcggaucugcaagaauuugccaccagaggaaucagauuuuaauaaggcuuacaagauuagguuuuaguuguugugcccagagacugaguuaccauuguuucugaaggaagucuguguugcauuuuccuucacgcagcucgucuggguucaagagagaaugguacagcagcaaagugaggguucgccagaggugcaccacaaaggccaugggggauuugaaguauauggggcugguguggaagcaacaccagugggaaccuagagagcuggguggagagguuguggaguucugagucagucucccugagauaaaagcaggucagcuauggccugccaggccuccaaguuaccggcucaagggugggagugugcccuuuuuuuuuuuuuuaauguuuggaauuuuaaaaauauuucccacaacaaacaccaacacagacacguaaacuaaaaccaaguaaaucugaaggggaugaggcccucacuucuggcauacacacuggcaaauuguguugugugcaucccaggggagagugagcacacacaugcauucuuuuuuuuuuuuuuuuuuuuuugcauucuaauccuagguuuuauucaacaguccuuucacucuacacaaguacaaacacaaccuuaucuaaaaugcuacaaaguuauaaaacucaaaacaaauuuuauaguacugacuguacaauaaaagcaaaaaggggcaauguacacacugccaagguuaaccugcaacaucaccaugaauggcaggugacugcuuuaacagguagccugcguuuguuagacaucacaagugccuuaaggggucuucaauuuugguuggguugcuugugugaaaugaggucacccaggcaaauucugcauucaaguaauuuguaaagugccuagcccagaguucucccucucuccccccaccccuugggaauggugcucacuuuggccggcuguugaagguuuuguuuugcuucugaccuguguguuuuguuuguuccugagaggugggagcaggagcggcugaugggauagcuacccugguuuccucuaacugugugagauaagggagucuuuuuccuaauggaggaccagagaaggagaccugugcuaaguguggugaacaugacccagccuuccuucccagacuagagcugccaccugcugcagacaguuuuccuguacuucugaauuguuuuuguuuuguuuuguuuucaggguuuuuuuuggggggcggggaggcaggguuucucuguguagcccuggcuguccuggaacucacuuuguagaccaggcuggccucgaacucagagauccgccugccucugccucccaagugcugggauuaaagguaugggccaccacugcccggcuguuauuuuuuuuaaauguguauuuaguuacuuauugugggauggaggcauguguguggaagccagaggacaaccuuuugcaaguuggcucucguucucuguauacuagagaaugaagucaggccaucaggccugacagcagcugucuucccacugagccguccucucggcuccacugcugacuucaaagcaagcaagcaagcaagcaagcaaacacuuacaaugugugugggugcugcauguguguuggucccugguguggccaggcgagcucuugagcugggguaacagaaagaugugaaugcuguacacugaacucagaucuucuggaaggggagggagcaggcccucuucaccgcagagcaagcccuccagucccucauucugagcucucugcccaguaugugcugcuuuuauuacgggccagaauuugggcucaggucugucuucagcccagcauggaagcugcuguggggugcuucccuuugacagcuauccugaguggaaggaggugccuguggguuaaggagaggccagaaaaacugcaggcucuagguucuuggugugcuugguccugaccucugccuggcuguaagggugaguagcggagguggccagcuucagcauucccagcuguggguaggagccugaaugggcauuggccucuugccuagcgguacuccuaagaagggcuccaagguguuuauuucagagacuuccugagcuugcucauuggaggcugguaaaaccuggggaguucccuuccuugaggccugcuucuucuagacuuacuccgugucuuggucccuuaucccagucauccugagguaguggcagcagccauagugcuuugugaguucuguauccuuuuccugacuugagccucaggauaccucucuuuccucuucuuuuaagaggaaguagaaucaggucagggaagauguaugucaggcuugggguccauaaaagacuauuuuauuuauuuacuuacuggagacuauuuuuugguuuucuaaaucaggguuucucuaucuagucuuggcuuuucuggaacucaauaaacugagagauucgccugucucuagcuucugagugcugagacuaaaggugugugccacuaugaccuccugacuucuuauuuuauuuuuuagacauuucuacuguauacccuugacugauuuggaaauuugcuguagacccaugcaagccucagacucaaugcagucuccugccucauccuuuugggagcugaaaucacaggauuguagauacaugccaccuuauauggccagagauucuuagcauccucuccguaaaccaacccucacccuucucuccccaccccccaucacuagccuuuguuuuuguccuuuccugccuaggaacccagcagucucagugagucuccuugacaacgggauagauaaguuaaaaauaacccugugcugggccuucucugaugcuuggcucaguuucuguggcuucuggaugcuccuagagugugucuguggguggauugcaggucgggcagggcaggugcuuacaguuugaagcccugagguuuagggaucagagcuacaauagccaccacguggcauuauuaucuagucuuacuacagguugccaguaaggugugaguguaaauguuaacgaauggaaaguugauguuggugccaggacuucacuuucucugagaggagcagucauggagguguuaguguuuaaagccugacaguggagugggacacagcucuggcgccauuugcuucucucuccucagggaaucccuacacuggaccggaggauauagaucagugguagauaauguuuuggucuuacaugaacaaggcccuaggcuuaauuucccaguacuguaaaacaagacaacacacaaaggaaccccuaaggaugagggggacccuuacugaguccuuucauaaaaugagaauaucaaaguguucagcuaucuuggucaguggugauagaggccgugguucuuccccuugguuaggugcaggugcaggaggagcaggguuuucagaaauggacagcuauuucugcgugcuuaggcugacauaggggugagccugggauacuuaaacgauggcaggcucagggccaggcccucagaagucagucacagccuccucucuuugcauucuuuggaggccauuucugucuucuuauaccuccuccaggguccacgguguggggcuguugacagauuggguauggcaucccugucucuacucaugucagaacacugucaggauuacuguggcccaucuaucuugucaccucacuaugccagugcacugaguucuuuuaaugggaucuccugugacaacuguucacuuuuaguaguuccccagcaguuuugaccuuugcucuuuauuuuugcguuguguaggaaucagaguccgaagcaaagcuagauggagagacagcgucugacagcgagagccgagcggaaacagcuccccuaccaaccuccguagaugacaccccagagguccuuaacagggcccuuuccaaccuguccucaagguaaccuggcuuagugugcauguguccauugcuggguaagacaggcuuuuaggguuugcggcucaagguuauuuucucuccuccauguacacccacugugaacauuuccuucaguccaggaagaacuaagaagucuaagacuccugacccccgcccccaaaaccaguccucuuaacaacagcugugugcaugccugagaagcauaaaucaugagauugcaaagcauucucugaaagugucccuguguccuugugucccucccguggguagggcaucgugaauccuuagccuuaccacuagcuugccguggagucuguuuucauuucucagcauaauauguacagauauuacgugcugauuuaaaaaugcauuugaauuaaaaccuauccaguuuguuguguugauggugggguggguugccgcauauucuuguagacaagccuggugcauauuuguggcagucggcauuuguggucuaagacagcuguuaucauugugauuucaggaccaugcucuguagaagccagcugcagggaaaccgauuuuagcuuccucuuuucagauagaaguggccacaguaccgggcaguggugacacacaccuuuaaucccagcacuugggaggcagaggcaggcagauuucugaguucgaggcuguccuggucuacagagugaguuccaggacagccagggauucacagagaaacccugucucagaaaaccaaaaaaaaaaaaaaaaaaaaaaaaaaaagaaguggccacagacacagaagggaaggacacuaccuucucucuggcucucccugcacugccgccaugcuuugaggagugugcuaguggcuucugcaccugcugagugacagaugugagcaggcaguggugcugaggucuugcccucaccagcugugccucugcugaggugaugcuguggagaggguuacacuuaggggccucuagucccaccuccuuggcuugugccugacagaucuuucucucuacguagguggaagaacuggugggugagaggcauccugacuuuggccaugaucgcguuuuucuucauuaucauuuaccugggaccaaugguuuugaugaugauuguaaguaucguugacaagccauguuaauguugcauucagcuuuucuugggauugucaucuccagucugcugcugacagugccugguggaaaguugcuucugggacucuuuggagcuccagguuucucagaacccucugucucggagcaccugugacuuuuccaugugccagcuguagggucacuggcaugaguggugaccccggcuguugguucgugugagacucuggcuuuguuucuuguguucuuggggcuugacucacagacuuagaacacuucauuaagcaguugcaggccaaaggacuucaguccucccgccuguuuuaguuuggcuuucgguugcugugaucaacaccauguccaaaaacaacuuggggaggagagaaaggguuuaucugguuuacaugagcugaccaccuccaucaugaaggauuuggggcagaacauuggaggcaggagcugaagcagagagcacggaggaucacuguuggccugcuugcuccccauggccggcucagucugcuuucuuauacaucccaggacuacucagugauggcaccaccugagguggaccgggcucuuccacgucuauugucaaucaagaaaaugcuccacagacuugccuacaggccagucuaguagaggccuuuucucaguugaggcucgcucugcucagauggugcuagcuugugucagguggacaaaaaccuaaccaacacuugccaccuuuaaagacaggucuaggugcuaccagcagggugcgagggaagcagaugaggcccccacacauauagcuugaaggucaaagaagaaaggggauuggcugagaacuggaagacucuagaauaaaagguuaaucaggaucccaggacugugcauuuuaugugugacaugaagggcugcagugcccggugggugguaugagagaguaagugaaucagugggagacugaaguguuccuuaaaugccauggcuuuauugaagcugugaccugcugguuucucuuucugaagacccuaagaagagcucuuugaugccucuguuuuuuucagguuauguguguccagauuaaguguuuccaugaaauaaucacuauuggcuacaauguauaccacuccuacgaccugcccugguucaggacccucagcugguaagcucucugcuccacuggggcaggcaggcaccuugccugauuugagugaugugauuuguggcagguacuuacagugcugguggagacauugccacaggcuugcaggagauugagccuggauuguauggcacguuugaggagacuugaguagcugaggacuucgugucgucugugacagacgugucgucugugacagaugugucugugacagaugugucugugacagaugugucuaugguugggcuuagcucagcagaagggucccugagcuccugcagccagggacuguauugugcaucgcacccgaggucagcguacuuuuuaugcugcagcccagcgugucacuggaguccucugggagcuggcaggucccggugccgguguggcugucucuggaacuugauuugcucaucacuacagcagacuguugagguuacucucuuuaaggcacucggggccggcgugguucagaucugagcuccuucagagacugcuuuuuuuuuucuucuccuaaaaaggauugucuaacagcaaacugcuaaauaaagaacuguagcaaaaaugguuucugagcccuuucuucacccaaagcucggcuguuggcaucagggccaaagacccacugacggugagaauugcucugugacuuaaugggcuggacagugaugauuugugcguaggcaacaugguuauggucaaggaagcugacacacuccacccaugugugugcaucacucagcaguacaagcugacucucagcguccacccgcccuccgggcucagaaguuguucucuuuguggcuguucugaagccagagagcuguguuuucaaucuugauaauguacucaggaggccugaccuuucucaauggucacuuuacaaagaaauuuuuucccuaccaaauaaacccaauaauuaaaaguugggaaagagaggagcuucaguuucucccugcucagggcuggggugauggcugcagugugauccagcacccagaccaaaguagagggaugcacaaggcuguagcuugaggcugcccucaggucuucaguugaagagagggcguaaacaaaugcgcaguuggugcugguugaaggaucugggucacagccaggcuucggaagggggauguccugagauggagccugauugccuaaugaggucaucaguuucuugcuauagaaauaaauaaugugguagaugucagggcaugcagcuuuuuaaaacuuccauuuuuauaaaaugguauuaauaacaaaggaaauugaugaguggaugaaggggguguugcagcaaggaagaguaaaccggaagugaaguaacaaagccaaaugagccgcuuuggacaguggagggucuuguguggugguaggggugagccuagggagggggcugagguuuagcugugggaacacaaaaggggagaaacugccgaccagguuuguaacgaagggagagugggagaaaggugccacaggugucuagaucaguucucaagguggggcgggcuggucucucuucucggggcugucugacagcaucgugaaggagagcugcacaaacucuacugguauggucuucacuguuuccagguacuuccugcugugugugaacuacuucuucuauggggagacagugacggacuacuucuucacucugguccagagagaggagccuuugcggauccucaguaaauaccaccgguucaucuccuuugcccuguaucugacaggcagguaucacgugucucuccaguucucugggcauugagugccucugcuugguuucuaagaguugguuauaguuuugugauguuaacucugccauacuaggaagugagcugacagaucugucuuacauugacuguaaacuaacuuuuuccuaugggcuuugaaauuaaugcauugcuuaauuguuacaagugaauuaaucaauggacuucuuaacccagcuagagagaaagaaaugcaguaugacugauuuuauucucucuccaacuaggauucugcauguuuguacugagucuaguuaagaagcauuaucggcugcaguucuacaugguaagaggagcgugcacgugugugugugugcgugcgugcgugcgugcuugugugugugugugugcuggggccgugugaaauauugaauugagguugauuucuugguuuacuugacaaucugcagagacuaacgcauggggcucgcuggccaggcgaucuguagacacucagcugagcuuucacgcuuuaugugacacaacuugacaugguuuguucuguauucaucgggagccuggagcagggagaaccggaguccugcauuucuucaucuagcuaggccagacacagcauacacccugagggaggggucuuuccucugggccucugaaggcaggcucccuacagggacagagucacugcuguagggacuccaucuaauucacuguuugccucccucugagugggacaauguucccaggccugagagagcacaaggacucacucacugcuuggguacagacccuacugugauguuucuguuguuguucgauuggguauugcuauguagcugagggugggcucauuuacaauccuccugccuccagauuccugagauuucaggcaugcauuguccaugucugucuuaguccuuauuuuuugguaagacugugccugggaaagacuguauuacuuccagaaguuugcucugcccaugucacugccaguaagccugauauuaaagcccugcuucucaguaguugcccauuuguuccuuauucuuugaagcuguuauggucauaaacaagguagggagaguucauuuccuucucuugcaguuuggcuggacccaugugaccuugcuuauugucguaacgcagucacaccuuguuauccauaacuuguuugaaggaaugauaugguaagugugacagaaguuuugcuuauuuucccuccccggcguugggguugucucucacacaugugggccacagaccuuggccucuguuuugaagcuuuccaccuaucagaaguuccugugggcugcuuugcauuaguaucugauugaguaagccugcaguggcaccugauuugaauuucuaguacauucccaggugauauugacgccaugggucagagccagacucugagaagcucuguucuagcuuuacaggugaagaaaccaaaggugaagaacuggcagcaggcuugauaacauaggugagacggucaugguuuccuagcaauguguaaacaagggaagugaugaagauacacgugaacaaauaguuaggugcccucagugggaugaucaugacacacuugguaugaugagagaagcacugagcauugugggugacaagcacacaagcuucaucucagaauuggaauguguucauccuuaaagagcgccugugaauguuagccuuauuuauguacuauauuuaaaacaaguggaauggcucagggaggcaccaacuaacuagugccuucucugucuggauuuuuauuggauauguaaagugcuaaguugagccuuagggcuaaguguaccacuaggaucaguaguaacuacuaauguuucuaaugaaggcuucaucauagcuguguagagcagagacuacuggaagcuuugaaggaaguguuguggguuuuggcggugaauagagugaggagguuguguuaggguuucauugcugugaagagacaccaugagcacauauacuuuggguuggcuaacaguuucaguccaucaucaucacagugggaagcauggcagcaagcagacagacuuggugcuggagaaggagcuaagaguuguacaucuucauccccagacaucgaucagaaggggacugugccacauuagguguagcuugacuugaaagccugccuccauggugacugacaauaaugacaauaaugcuaccccugugggccaagcauucaaacacgugagucugugggggccauauuuacucaaaucaccgcauucuguucucuggccccuacaggcuuuuagccauaacauaauguaaaauacaucuagucccagcacuugguuuuugaaaccuuaaaccauguuuucugugacacaccucccccaucaaggccacaccuaauccuuccuaaacaauuccacugacuaaugacccagguuucacauaugggccugugggggccguucucauuuaaaccccauagggaauacuagugcuaguaauaaccaauaagauguuaacuaugacacugauucuguauacuauuuaaaaacauaaagucaauugcuaggcaaaaaagucaaaaugaguuuaaauggaagucaaaauggcuguuuuggggaaugguagaacugaguugggcaguaagcaguuuuucuccuaucuuaaacaguuuauuguucauauacuacuuuguaaugcaaaaggagcaaguggcuuuuguagaaugcugucucagucacucagucagucagugaacaccagugccaggcacuagggauggcauuuugguguggcuucccccacugccucuuuuggauguggucucugugugcaaucuaaaccagccuugaccugagcucagcccuuccuuccccgucccgguugcuuuuagaggcuugugcgaccauagcugacugacuuuuauuuacagacaucaguuaaaauaggaauguauuucauuuugcucucauaugugugcacagugugucuuugucguuucccccuuacuguuuucucuuacuuccuucccaccuccccugauucccaccuccccugauucccugccauuucccauguuuauuuucuucucaucuuacaccuuaacgaauuauaaacacaccacgaggugccuuggcacugaguuauuguugacccucugagaucaucuccauagagugacuccuuuugggucucuccuagguuuauuguucccaucucgugcgucaucugcaaugacauuauggccuauauguuuggcuuuuucuuuggucggaccccacucauuaagguaaguggaucacccuggcguggguagugggugguaaugcuuucucuguggcgugucaguggauacagaggaaaacuagcugguauguauccaugugggccugucuucaccuuacucuggggcuguguaagagaagaaaaggaucaaagagacccuggcaaauacuuuaaaaaaucuaccaaggaaaauauuauuagguaggcauacuuuuauggcuuugcucuuugacuauuguuuuaauguggauuuuuauaauauaauaaauguguuagccacuaauggaauagaaagaaaacuaaccugaagaacauaggauaagaagcaagaaaaaacauuuuggggaagaauuuugaaagugacaugacuaauugaagauggacuuucuauagaaauaguuguuugcaugguuuugagacagggucccacuguguagcccuggaggaccuagaacucacuauguaguccaggcuggcuucgaacagagauccuccugcuuuugucucccucacacugcgauuuaaaggugugugcugucauuccaggccugaguuacagaaguucuuugcugacauuguguucuccaucugcagcucucuccaaagaagaccugggaaggcuucauugggggcuucuuugccacugugguguuuggccuuuugguaggugguagcucccaucuggauggggaggggacaaggacucaaaggucugggcaggaguagagaauaugucuucccaaaccagagacucuugcccgaugcugauccuugcucaaaagaacgcauucuguaacugacacggcagcuuucagcuuucaagcagcuguguaggggcucauguacgucuuaugugcuuaugugcccccuuacacccaucugccagguaacacuaauauuggggugacaacagcagcuuggaguagggggugaggugagauauguuguuucaacucagauuuucuucugcauaugacuugccuggaggagugcauuuucuagccccuuugaggacaccaugcccugcugcugauucucagucccucccuuuucuaguguggcuggcugucacugugccucccacacccccaccauggguuccauguagcucugaguuuagcgauucuuagcacaguagggcaggucuucccaggugggaagaauugucuuacagcucuucguucagcucuuuccugggcuuuucaaggucuuugugucuggacacacguauuguguguguaugugugugugugugagaucuugcuuaacaguuaggugaacuacacauguggugaaacauaaaccucucuuugagcccaugacuuacggugaacaucgugggagggaggcacuccgagagucauggcccaaucaggugucggccagccaggcuggaggucuagaacugauguucuugccugcccucugcucuucguccuuagcucuccuaugugaugucuggguacagaugcuucgugugucccguggaauacaacaaugacaccaacagcuucacuguggacugugagccgucugaccuauuccgccugcaggaguacaacaucccuggggugauccagucggccauuggcugggugcguacccuuuacaugagugacggcacggaggaguuucccuccuagagcucugagcuuuaugccaggguaaggguagaggagaccuuucugugacuugaugucaguuagaggaguggcccccacauuguguggauuccuagaggauccugcuuacugaguaauaugcaccuuuuccacugggcugacauuuucuugaugacacauuagugguuguaaagccaguggcagugggcagagugagcugcagcacggccuggaccacaggucauugcuugcuucgugcugcacccucugccaguguacacaagcucgcuacuccugugaaugcccuugcugggacucuaaaauuaguaaugucauuuaaauauuccugauucuugacaccauuuuaauauucacuguacugaaauggaaaauacacaggaaguauuucugccaaauacugaagcacagagugucccaaagagaaaacuuguacuguugauuaaguugugagcucaacuggcugccaagcucucaggauaggguuuuuauuugaaaagacuuggguauguaauggauauuuuucuugaaaagagugacguaagucuaucacuuaaaaaaaaaguggcugauagcaguugauaccagugauaaaaaucugcauuucaggugaaaugagaagugugacaugucacaugcaccuaucauugugaggacgguggguuucuggcacguauccgcugcucugacaccacauaacacaguggccaauagugaguugggaguucuuaaauggccaguguauggugguccaccgucaugucugggaaaaagauggaaccacagugcauuguagaccaguggauugugugaggaagcacagaacauucguuaggaggauuucagauuccacacuguucccagccucugagggcagugugcguguguguguuggggggugugguguggugugcagacaggaucucacuauggucuuggaauccuucugccuccuucugaaugcugugauuguagguaugugagacacuaccuggcuugcagcuauuguguguguguguguguguguguguguguguguauggauguaugcauauuugcauauauacacacauaugugugaaggcccaagguugauggcgaaaucucucucaguuguucuuuugccuuauccuuuugaggcaggguucuugagcucauccugcuggucagcuugcucugggaucccccucaggguuugcugcuggcugccugccaugcacauucaguauuuacauggcuucuggggaucugaacucaguccuguuguagggcaaguauuuucacugaugggacucugcccagcuuguaccuaacuuuuaggggaguuaugccugucaaguuccuguauaauucccacauuucugagaagacugcuaaaaacauucauccuuuugaaauuacauucucuguaagcuaaagcuggaucuucuucauauauugccugcaaaacaguauaagacguugauuccagaauuucuccuuuuguuuguuugugagcgguucuuauguaguuuaggcugaccuuacccuguagcugagggcgcccuugaacuugagauccuacugcuccuaguuuccaaaugcugggauugcaggcacuccagacagaauagcccccacuccagacacaauagcauagugcucuacuauugagccaaaugcuagagauuuaaaggugugggcucguuuucuuuguuucuuugucucuuucugucuuuuucuuucugucugucuuugucugucugucugucuuucauccuuccuuaccccccuuucuuucugucuuucuccuuuuuuuuuuuuaauacucagucucuuuagauguaugaauguuuugggugaguguguucguguguccuugaaauagaguucuagaugguugugagccaccauguguguuagaaacaacccagguucuuugcuggaacagcaggugguccugaccaccagaccaacucuccagcccugcagucuuuugguugauugaaaaaaauggagaccuuguuuuaugaagcucugaauuaacuguaagaagccagacaugcacacuugcugacuuugguuccacuccuucuccucagaaaacggugaggauguacccuuuccagauccacagcaucgcccucuccaccuucgccucgcucaucggcccuuucggaggguucuucgccaguggauucaaacgggccuuuaaaaucaaaguaggggaacucugccccaccugccucucccauuucacuccuggucgcccaucucuuccccgcccugcuccaucagcuugcaccccucauaccaggucacgccccugcacuuacugugugcuuuucuuuacccaugugcugaauuugggggacaguaaaugaaagugcaaguaucugguuugcuagugcuucuuucaaccagagaccgcguuguaauuugcaguccuguccugugaucaccugggcauuugguuguaugccucuguccaucaccuucucugcccagcaggguuuuggucauggguggauccauuagucuggaguuugguuguuggugagcccaggcccauccuuccuuccuuuuccucuaacaggauuuugccaauaccauucccggucauggaggcaucauggaucgcuuugacugccaguaccugauggccaccuuugucaauguguacaucgccagcuuuaucaggugcggaacuacuccaccggauccagauauuccaccggauccagcugagugggcuuugaaagcaugaguguuuacaaauccucugaggucucucucccuccacuaauagugaauccagggcucauagcaccccauggguaacugggccagcgaggcagcuggccccugcucaggggugccuuauguucuguuguagggguccaaacccaagcaaacugauccagcaguuucugacguugcggccagaucagcagcuucacaucuucaacacgcucaagucucaccuaacugacaaggggauucugacaucugccuuggaagaugaguagaguccaccuggggcccagagagcuggagcaggauggagugggggccagucgccaaggccgcccagcugcugugacuuagauaaugaaaagcuucaacucaccaccgucauuuuuuuuucuuuuuccuuuuugugcgugugugguuuuuaaucuguauauacugucuguuuauagugugggcagugaguaagcuguagcuuugaguugcaaagaagucacaggaaagaaccauuuggguuucugaaguacaaguauugagcaacaugaagggcaguguugcccagcucagggugucugcuugguggcucuaaccccugcccauccaguuguuucugggcugugcgagagaucauacauugaucugugugugaugaguugagggcuuucccaccugcacgggccuucacgggcuccacgcuuuugcuguccuugacaccucucguuggggcuucugcaggcaucucugucugagagcagugggggcugcccucuguagagcugugagagcagugggggcugcccucuguagagcugugagagcaguggggggcugcccucuguagagcugugagagcaguggggggcugcccucuguagagcugugagagcagugggggcugcccucuguagagcugugagagcagugggggcugcccucuguagagcugugagagcagugggggcugcccucuguagagcugugagggagaggcuuucugaucagaugaacaucuguccaagccaaaauucugcagagggcaggugagcuuugcuuauguaguuugcuuucaccauauagacugagagaagauuucagacuucuuuuucucagaaagcaugaagaauuuaugaaguauggaaaagaagcccuuacauauuccagaugugugcagcagggggcacugucccagcccucucugccccagccaggcacaguggccucuagagggugguccuguagaccgcaccuuuuagagucgaggccucugugguugugccgcggguuugcugcugugcugaguccuucugggggagcccuaagagguggggagcagaggacuuuugcucagacacccuuugccuggaagcccacuuguguugcugcuguguuguguauauaguauucucgagaugagcguaugugugucuguuuaaaagucaccuuguuuccuacaugauuuuagucauacccaaacguccucagaaucccuacauccugcuuagaacuguggccggccuaaucugucaagaggcuuggcucuucaagacucaguguccacuuuaucaaaugugaccgguguagcuguaguuuguacuuuccuggggaccuucugcugggguuuguguaagcugugauucuuucccuuccuaauagguugagcuugacauggaaaggagcaguuggcagggaaggaacuuauuccccaagagugguaacuaacccacagcccugcucggugugcccaccgcugagaggcugcagugacuuccccaaguaccguggucugugcuaauuuguuuucagauuagucuuccuguggccuccaacacucagccagcccucagaguguccgcugugcgcacgggggcggggcggggcgggcagcuccuugucucucagcuuugacugacuuguccgcauuggggauuuuuguucucagcucccaggccgcacugaacacaguguugcugccuucaguuugguucuggccaugaggccccuagugggagcuuugcccuuagggcuguccucugacuugcccucaaaguucaccaauucggcaacuccauggagacggucgugucacucucagccccuguugcuauuaagucaugucaugggcacccggaaaaggaaauacacugagguguauuuuacaauugcuccuuaagauucucaguggagauuaggagcaacacugcacuucugauagaaaaauggccuuggaucacuaaacuagguagagaagggcacaccacaccccagcgccccaggagccaaaacucacgcucgggcagcagcagcugaggcuugaggaagcugguguccuaagacacugaaacccagugcucauuggagcugccagccacagguuucuauucugaguucuccagucuugugaaagaggagaauuucccagucagguagccaggagaacagugccacccugcgauugugccacccugugauuguauagcguguuguuuguuccaguaagcaggcaggcccagagacugcuuucucagcaccgcacagaucucagugggucacauaacuugcuuuacacucaucuuguugugucagaaauaaaguguucgugcuuuuccuugucaggagucccguguuugucacuuguugugugguuuuauguuucccgcugugugagcauaaacacugugcaguuuuccugcuugccagccugugugccaucuguucucacagccucugagaugucucaggugagagccaugggguggaaccauaaaguccccaucucaaagugugccugugggacaggguuaguagcuacuccccgaggccccaacccgggaaauacugcaguguuccuuccugcaggccuuggagcccugaccaggccaguccugggcacugcuuagauggcuguuagcuuagaacuggugaaguaaagauuuggucccagaaaccagccugacaugagaacaagccagggugucuuccuggugaguucuacucauggucguucucaggaaaacuguguucccuuuguguguacguuucucaccccuuaaccacuucagugucaaaaaaguucccauugugucuucugaaagugaagucccauaaggaaguugggagagaaugugcagggugcacacacgcauguacaaacacacacacacacacacacacacacacacacacacacacacagagccuauuucacauucucagacuuuuaguuucugcuuuauaaccgcauuuaaaauguauucuuaaugugcuguagugugugugagccgguguccagaggugugaaauauaccauguaaucucacacagguggacuguggaaccguuuuuauggauuuugccccugcuugcuuucauccuguaaccuagccuguauuauacaagaaaacuugagcaggacauuucaagagaauauguuggccuaauuguuggguuggcugggaccugcucugaagggaucccucaguucaccgauuggcaagccaaggucaguccuugcuguugauggagcugggaggaggagggaccuaaggacucaggacagagcaucucacgcgaaguucuguguggcagucaaguguuccucguggagucagccugagguagauuuccaggaaagccuuuuccucguuaccagugugugaugucacaacugaaacuuguguuaguaacgucuaaggccauguugccuuugucuuuagaguaauuccuggcugugccuaccacuccugcauacugugcuuaugugcgugcugcgcuuugauggggaggagggcaggucccugugcagccaggguucuugcuccuuccauggcaggaugagaaggaaggccuaagaggcuggccaggggccugguguagacacaguagaagacagucaacuaugggcgcauucugucuggagcucccagaaggagcugugugcugcuggagaggaggcuaauuguugguucagacuccuccgcuuggguaaaagacuccccuuaucacucuccucacaguugcucugcaucuuuaaagaguauuagcuucugcuuccggacucagucuuuguugagugggccacuuccaggggugugcccgggguuaggcaaguggcagacgaggguucuuauuugaggcuuugcuaggcucaucugcuguguccuggguaguccacucauauucuugcagggugaguccaugcucaggagaaugcgguccaccuuucuauguacucuagcuucccucucuucagguugauauagcgacauuaccugggcucugugcuguccuguggguggaggccauuaucacugggcugcugcuuuccugggcaagccacucucuauuuuucugcaaaggucaaaagacccugguguugggggcccuuuagagggugugcuuuggacgcugaccucuuagggcuuuaggacagagggacgauguugagucuagaagggcacaauaugccagaguuuuauggccagugauccucaaauccauuggcuguuugaagacccuguccucacuucuccuuuuuucaggugacucucugcuuggcucuuuaucuuacucuucagcuaaugaaguagcaacaguguguuacuaaugauugcaaucauacagugcuuaauaugugccagacacagugccaagggcuugcaugcauuaucuccuuuaauccacaagcagcucuggcgaggugguauuagcccaucuuacagaugggaaaacugaaguucugugcuagagauugagaacaauguaaagacuugaggcuuagguagugcucuaucuggucaggcuauaggcugcgggcagccuucacuuccaaccagccgcugugaggauuuagugagcuaacgcauguaagcauuuagcaaggugccuggcacauaguaagcacucaauaaaugguaguuuuuuuguucuuuuaaacugagcucagcgaguuuggcccacacuggugggcugcuggguauucagccaccacacucuucacugcuuggaccuaguugguguuuguguucuguaaagugagcacguuguccucccaagagaagcacuucaguggugcagugguaagagcccacagcauugaggccagccugacugaaggaugaugugaggcuguuugucacuucuguucuuuuccccgugguugagacugcccacaggaaaagggcuggcugcucugacaugguggggcgucuccuggggccuggcucgcucuggacccugcucuccccagccacguucuguagucuguuguacaucucaggaacccucgguuccuccacggauggacgacugcagaauagagcagaauagagaaaguaagccugaagcugagugccucagccacaaaccuaaaggagcugccugugucugacagcacagccauuccaucucuuccguccgucugucugucuggguuguuuuguuuuguuguuguuuugagacaggguuucuuuguguagcccugacuguucuggaacuugcucugaagaccaggcugaccucgaacucagagaucugccugccucugcuucccaagugcugggauuaaaggcaugcgccaccuucaccuggguuuucuuucuuaaaggaacagguuagagcaagugaccguugaggacaggugaugugaauguuuguucuagauuuaauucaguuuucugaauggacacagggaguugggaguaugugugugugugugugugugugugugugugugugugcgcgcgcgcgcgcgcgugugugugugcuucaccuugauugaguggcauuggcucacaugacccaggagauucccagacucuguuaguagugucuaggaacuuguguuccagcugaggagugucccagguguuaacgagacugaggccuauugcuggaguucagauacugcagcuccucuuguuuuucugcacuguguuugccagcccugcccccaucugauggaccaggcaguccuuuaucuggagggaaaagucugaugccagcagagguccuggggcgcugcucucccagguccuggucagacucagcuccauagcucuuggaggcuuucccuggauucccugaguacaguguuaaaaggccuaaccacacagccaccugcccuaagugacauuguguuuuuaggugucaccgucuuagcccuuuguuuuccuuacuagaguaucuuucccgcaccccuagguuuguauucugguucuacuggcuuuucucagugggacaccaagguagaaagggaguaagaaugguuuuccagugaguugaaugugcacacguuuaugagaggccuuugggugagcuuucugcucauuccuugguuugucuugggucccacugggcaggugucuagcacugagagggagaguguagacaagggagccacggagguacuggaggcagcaauuccucauccagcucagggacuccugacagccaaggggacagcaagaggacccagagcagggaaaggggucggggagucacacaaccaaagguagacucagaccaguucagugcuccugguggccauagggaccagaaagcagcuuaggaaaucuauccauuggcccuuuuagagucucugugugaacccaacucuacugaacuuaaacaccuuccaaacaguggcaggggccacaguggcagacaggguagaguaccccaggcaguuucucagccucguccguuguguggagggaauacugaauucaguuaucucaccugacugcuuuccugcccucagaccuggacacugggccucagccccuggccguguggaauccaugggauccucgggacuccccagacaggcgugugugaguguguucugucaugcagccucagcccaggcuaacccagucaguguuuucaccacgucugaccuuucucucugcacuuaggauugguguccacuuguagauuucuuucaacacaguauaagaaugugauauauuguauauuggaaaguauuuaccuuauuuauauaccugaauguuccuauuaaacaaauaaacauauacuaaauucuagauugugcguguuuuuugaugggagaagcccuuuuaaaacgauuuuauguguauagauguuuuaccugcauguauguguguccuguugcguggacaagccagaagagggcaugagaucccccugaaguggaguuacagguggguguggggaauugaaccuggguccccggaagagcagccagugcuauuaaucacugagccaucuccauucccaagagguuaguuucuauguuuguuuu

SEQ ID NO: 1116 - RNA, 11860 nt, Mus musculus
cggaaagcggaagcggcgugcagcacgugggggcggugccggcggagacgcaggucccuccuggucgugccgggcuccuagcggcuggagcaaaaacggagguugaaauuuaccuggcuuccauggaggcaucagcugcggagcagccgagcucaccgcccccgccucucggggaccacugcauccaugacggugacuucguggugcugaagcgagaagauguguucaaagcagugcaaguccagcggagaaagugagucugguugcuggccuugggcagcgcgcaccaccacccggauaaucacucccuccugugccccauucuuggcucuuugaaucccgcuccccagcccuuauugcuaccacucaggucuuccuaucacugaggccuucccaccgggauccugccgcauccuuggcuuacggguacaguacucgccucuaccuuucauuccccaacuuucuauucuaccuucugcgccaaauucucuucccaagaauuccauucuugauacucccacucaggagggugcuuucccgaggauucuuggggggcgggggaagagccucacuagucuuacagaauuuauccaaccuuucacauucguaucucuuaugucugacucucuucccagcuccccacuuucuucauaaauccaacuuccucaguaagagaaaagggagauaagaaagaucucuuacacauaguauggcuugcagguaggcagucuuauucucuggaucccagugggaaaaaucugucuacuguaagaaaagagaacuuacuacaagguacauggccagcuuaagcccaguauacauacuggugcuugcugauggcccgcugaagcaaacacuuuccugccucccaaguggugggauuacagguuugcuucaccacacucagcuugcuucauguucugauacaaccauuugaauguccuuuuuauaauguguuuuguuagaugauccuuuuuguuaccaaggagacauacuguaucuuuaguucuaaaagguacucuuuuuguuaauuaguuuguuugaugggcuacacagagaaauccagucucaaaaaaaaaaaaaaaaaccaacaaaaaaacgaccuaguauuguuuuaagguguguguguguguguguguguguguguguguguuuuugugggcuugaguaugugaauuccugugcgcucaguggccaaaugcuuuguauuuccuggaguuggcguuacagccaauugggaaccacacaacuugggugcugggaaccaaagucagauccuguggaagagcaguaagugcucucgagugcugggucauuucuccagcucccuaaagagucagcuguaagcucuuuuuacuaucccuguucuuaggaagccacgauccuaauuuuuuguuuuauuuagaaaaugacccacugaacccagcugcaucccaagccggacucccuaucaccaaagagaucauggcucucugccacucuuaaucguucccaggaaacaggcagcuucauuauuuaucagaucgccucccacacuuuccggccugucaguuuggaugcuugccccccaggcccccaccacacacaccuuugcacauaagauaggcuggcagaggcguaaaguguuucauuaacaccaacaugauucaaggaugaggauaagagguacaaaauagauguuaguuacuggaaauccagcaaagaguaagaauuaggagucaggagcaccuccagaggacauguaguucaaguggcauuugaugaaugaggggagaugacucaaaggguagagcucuuaaccacauaagcaugaggugcuaugguacauaucuguaaucccagcguucuuacagcaggauggaggcacacacaggagacucuauagaaguuugagacugcuugccugacauauauaacagugaacaagagagaucuugccgggcuggagagauggcucggugguuaagagcauugauugcucuuccgaagguccugaguucaagucccagcaaccacaugguggcucacaaccauccguaaugagaucugacacccucuacuggugugucugaagacagcuacaguguacuuagauauaauaacaaaucuuuggacaagagcgagcagggcuggagugagcgggauugcagcaagcaaagguccuaaauucaauucccagcaaccacaugaugguucacagcuaucuguacagcuacagcuuacucauacacauuaaauaaauaaacaaauaauaaauaaauaagagagagacagagacagacauagacacaccuugucucauagaaagauggaaggcaggaaccaguaucugaguugaucuuuugacuuccauaugcaugcugugguacccaaacacuaacaugugcacaugcccacacaaaagaugaaaguaguuaaccguuuuuuaaggauaugauauacaaagauauggugggauagagaacugaaaaaggaaagaugaaaagagugaugcagggcacaagcagaguuuaccaggucaggacaggucucagaauucagaauucugugcgugugagcugggcucugaagcuuccuuagguacaaagcuuuucuuuacgucagccaugccauguauguagaaaguaucugcagaccuguaugaauccugcaacuuuaacuccucacacaaacauguauacaauugucauuguguguuauguuuuucugucgagucgauacacaucaguucaccucagaaauggaacccacaacagaccaaagaaaugacugcagcaauguccaguuuggugaaccaaugugugcacacacgagcacgugcacucgcgcgcacacacacaucacccagcagcaacuguuuacuccuuuuuaucuuguuagauaggagacccucaagaaucuucuaggcuuuuuuuucuccagacaugugacuguuugcuugcccccugagacuggugagugucaucuuuccuccuagaagaaguauuuaaaauuggagggaguguuguaauucagaggagcauccuacaacacuguagcuaaggccaaucuggccuggaacuuggcaucuuuccaccucugccuccugcauguugggagaaaugcauaccaccacaccagguaacugacucuugaccaguguguuucucugggccucagaugucugucccuggcgucugaggguugcugugagaaugaagggguacgcacugcuggcauccaguuguuacacagcaggugcuagcuugcuuucugggaaaggaaagggguucugucgugugcuugucuuugaaguugcucuaagagacugagaucuccgauaggaaggcuaaugccugacccuuggcaguacuucauuaguucuacauccauuuccaauguguagauugccaauaauguuuauucugacacaggcuuuuuggaauuuugcuuuucuaauagaguagccaauuagacagagaccagggaguuuuaaaacuuguugucaucucaagugauuauuuuguuggggauuuucuagugcaaguugcauggggcaucacaauacacacguauggccuggggaucuugucagucauuccuguuuugggaucugcagaaucugugaauguaagcauccugggugacaaugcaaagugcagugagacugugucccacaaaagccaugucguuuucuucuaaaagucaggguuuuccugccuucuuuauaaauguuucuguccccaaccugcuucucucuaguucauuuguccguuuguccucacagaaguaaugcuguuaaccguuuaucaugugaacucuuggaauaaacuaggauuagcacacuuuucauagcaggagugcaaaagaaaucgguugacugguugccuuuucuuccucagaaaaguaacuuuugaaaagcagugguucuaccuggauaacgccaucggccauaguuacggcucagcguuugacgugagcaguggaggcagccuucagcucaggaagaagcuggaggagcccgcgucagguacacggcagggaugagauggugcuggcaggcuuccauuuaaccugcacacuuccaggaaacguagcuaaaguaagggcuggcccugugaagcuaagccggacgugaggagcugaugggcugggcguggguagggacucgggacaagaagauugcagugcaggcacggagguggugugcucaccuaguacacucgaggcccggguccauaugcggcgcuccauaagcuggacaagccacugaagugcucacgagaugaugguggggaaucagaauucaaguuaauuagguagcaacuuugagggcagccggugcuauguaagaccuuaucucaaaaaggaucuuucaggaugcuagagaauuagcccaacgguaaaaguacuuguuguccucugagaagauccagguucaguucugaacacccacaugguggcucacaaccaucuguuacuucaguuccagggaucugaugcccuuucugagcucaggcaccaggcaugcaucugguacucauacaugcacacaggcaaaacacucaaacgcgugaaauuaaauauucaaaacaugguuuuucuuuuugagaaagggucuuuacauuagcccugagcuuccaguguauaccaugcaggccuugaacucacagagauccuacugaugggguuaaaggucugugaagucagggcaagcaggauggcccagugaguauagguacuuguuccuaagucugacaauccgaguucagugaucccugagacaugauggaugacagcuguguccucugaccuuacauacaccgugccgugugugugugugugugugugugugugugugugugugugugugugagccuuuacacuuacacaaauacauguaaaaauaaguaauuaaaauguaaucuuuaauaauaauuuuauaucaaaaauuaucauagagcaauuucuuuccuuagagaccaaagaagcaggcacugauaaucgaaauauaguugaugauggaaagucccagaaacuuacucaagaugauauaaaagcucugaaagacaagggcauuaaaggagagguaaaaacggauucuuucucuucguuuguauguaacaaauuugucuauaauaucgauuuugagguaaaaauggaaugucaguuaaaaaugugugugcaguugaauacauuuguauguugugucuuagugcaagaauaauagacugaguggcuguacucaaaguacuaguggaagagaaguuaucagcucggguuguuugauuuuggcugaucuuccucuauagucucccuuucuuggcaaucucucuaacuuuagcuugacuuaaaggaaguuuguggccuggauuucaugcccagcaccagggggacaaaagucuaaauggaguugugaugucuuuguuccgaaaccugaguagaguguagaaaugcagagcugaugcacgcggacuccgugaacgagggccuggagaugaggccuuuggcugagugcggggcuaagaaggugaagcuucaggcaaugugcuugcuccuuuucuuccaggaaauaguucagcagcuaauugaaaauaguacaacauuccgugacaagacagaauuugcccaagauaaauauauuaaaaagaagaagaaaaaguaagucacauuacuugaaaugguugaaaauaguacauauuuucuauucacuaaguaaucauuacuaaaaaugagauguuuuaaaucuuuuuaauucauauugcuauucugcucuuaauucccauagauaugaagccaucguuacuaucuugaagccaucuacccguauucuuucaauuauguauuaugcaagagaaccuggaaaaauuaaguacgcuuuguuuccuuucaaaguauaauugggggaaauaugucuuuaagcgagucaugauuuuaaguaaaaugaaaagcuugcucaccugcauaaagugcccuccuuccucauaaauuguaaguccuuuuacugucgccucaagugaacaauaaucuuaucaacauaauucuuagagaacaacuagaaaagcuguuauuaaaugucaggauuuacuuagcugaaagugagcgaaucuuccuuuuuuuuuagccacaugagauaugauacacuagcccagauguugacguugggaaauauccgugccggcaauaaaaugauugucauggaaacgugcucgggcuuggugcuaggugccaugauggaacgaaugggagguaagaugauguuuucagauucaguaaacuaccucgaugugaggagagaaguccaagaauuggaaguuagagaaccagaucgaguugcuuuaagaauaggggagugaucgcaguaggccucuauggcuccugucccagaaucuuucuguguggcccguuucuccccacugaggcuguguuggugcccugcgauguuggccuuuccugcuuugcugucuguggggaugauucuggaacugcaguuagcuaaugaguuuaguaaaacagcugguauuuacugugcugucaggaacugaggagcugagaggcagggagacuucucaggagacauucucuuuuuauuuugagacaggguuucucuguguagcccuggcuguccuggaacucacucuguagaccaggcuggccucgaacucagaaauccgccugccacugccucccaagugcugggauuaaaggugugcgccaccacgcccgucccgagaaauucucucuuggaauucacaagcugaccugucugauuucucugauucuguagaaaauaagagcuugcauccacccuaucuggggaugaacaaggaaaaagcaaauaggcccaagccaucugaccucuaaacaagaucacggggucucuggaaagauauucucucuguagggaccgggauaucagcgagcuuggggaccacccucucaccgugggcuuugguauucuccacccuguagacaugggagaagaaccgugugaggacuugggcuucagagucuagauucccccacuguacagagguuuguuuguuuguuugucucuucaggcuuuggcuccauuauucagcuguauccuggagauggacccguucgggcggcaacagcauguuuuggauuucccaaaucuuuccucaguggucuuuacgaguucccucucaacaaaguaaacagucuccucaaugggacauuuucugcugagaugcuguccucagagccuaaagacagcacuccaguugaagaaaguaacggugagcuugaggagaaagagauugcugaacaagcggaugaagacaacauuguggaugccgcagaaaacaacucaggagaacagagaccaauggagauuguuccuggggacccagagaauaaggagcccaaagaaaaaagaagcaaaagagauuauguaagcauguccagagucauuauucuugugauagcuucagagccucggugagcuuuaaguuguaagauuuggguugacuuugaaagguuagguccccaggugcuaacuaucagaaacacuuggggaaaugggugucuuuguacauggcugugugacuuagucuuugggcuggagcucugcgugacucuaguggcugcuucaacaguggggguugccauuugagaacaaguuccuuguguguccuuaccuuccauauagaccagccccuccuguugucuacugaacaccacugcuccucucuucuagaucagggcauuuuuguaaaucuggcucagugccaucaguacauugguuucuugcuguucuuaaagauucaggaaaagcaaaggagacaagaagagcagaggaaaagacaucuggaggcugcugcucugcugggagaaagaaaugcagauggguauguugauccaggaugcagggcacuucacggugcugccacggucugcucugacuguaacacacuuuccacugucugcccugauucuugugggaagugagauggagauuuucucuugguuguuuugggguuuugguggggggaagggguuguuuaaaaaagguuggauuugggcaggaaagaugguucagcauuuaugagcauucacugcucuuucaaaggaccagcguuaugcucucaacauccugcccagugacucauagcuaccuguaacuccaguuuccaggagauccaacaccauggucuccuuggaaaccugcacauaccuacaugcaggcauauacugucauaaauuuuaaagaauaguuaguucaucaaagcuuuuauuuuaaggcuaguaaaaaauaaguaccugcuugguugauugguugguugguugcuuuuaaagaaaguccaagucuggcagggagaggagucaaagaaaucucagccuucaguaaugacuaucagauaggacuguagggguugggggggccauuaaaauggcuauaacacuggcuaauacagagcuaaugaaagauucuaucagaggcuagagaggaaaccaagugguuaaaaaaaaaaagaaugcuuggugcuucuacagaggacuggugcuuacccagaucacggcucacaauugucuguaacucuaguuucaggggaccugacacucuuggccucugcaggcaggcacacacacacacacacacacacacacacacacacacacacacacacacacaaauaauacaucuuuaaagaaaaagcacacuugucaguuggggauauaauguuagauuuaauuccuuaugaccuaaaagaaaaaauauaagaauauccaauauauauuugucagguagcacaaacacuuauaacccuguuucuuagaaauaaauagcucgugauuucauucugcuuugaauuucuagaaugcuguguagugcccuguacuuauauggcucacauuggccuaguacuccuuguguaguuccagccaaccuggaacucaaggcaguccuccugucugggccugaguauuaggauuuuagcuauguacgaucaugccuaaaucacaugauuuaaaauguggucauuuuaaauacauuuaaaacccaugcuccucuuggagggcauacaauaauauucucuguuuuccuugcaguuugauuguggccagucguuuccaccccacgccccugcugcugucuuugcuggacuuuguagccccgucaaggccguuuguggucuacugucaguauaaagagguaaagcugagacaaaauggacagaauuccuacaucuaaauuucgaucuuuguauuguagcuugaaauauaucuaacaggacucuggcuuugcccuuagccuuuguuggaaugcuacacaaaacuucgggagaggggaggagucauuaaccugagguugucugaaaccuggcucagaaauuaccagguaagcguucucacugccaggcccaagaguuggucucugggauugcuggcuucuugcagcaaugcuguacguuguuuaaauagagucacgguuuuacaguggcagugguggaaaugucugccugucacuuagaaaaauauccuggcuaccuggcuuucuggccugcuuuucauaucagauacacauucuguaacucuaguccagagguauuuaaaaugcaaauaccuaguuaugcuacccucaagaccuugccaucuguagaggugguaacugaauaugaagugacccuguccugugcugccacguacauagacuaaagagcgagaggaaacaggaugagcuaggugagugcuugcaaaagaggagaccagccuacagcgauacuuggagaaauucucaggcaggcuggugagaagccaggaguaaagacugcuccacugucagaccuccuagucuacucuugugccugggcucaguuugauugcccucuguaugaucccugcagcagauccugaagucacagcagcuggaggggcuuugcugccugagugcuucacaaccaguuccuucaggaagggagacagagggggacacuuuuggguuaccuuguggcccacccugcugcuuggagucucuuccuaccacagaaguccaauguaacacugccuuuuuauguggcaaaggugacaagugagaagagcccuugcugagauuaacagauagcagggaaguagccagccaguguugcuucuccauacaccccaaacccuguuguuggcccugaagcuuccuaaaaucagaaggaagaccagugcauaggccagaguacuacagaaaccauucacacuccccucccacacaaacuagcauacagucuaagagaaacggagccuuguguguuuguuuaaaauaaauaaauccccuugauuuuacacuuccuucugaacguacuguccuaugaagaagcagucuucuuaaaacuuagucauuguaaaucaucaagugauuugucaucuaaauucugauuuuuauuauauuguugacauaguuuguaagaaugcagaaaugcauaagugucguuuuuucugucuugguuagguucugccagaucggagucaucccaaauuauugaugaguggcgguggaggguaccuucugucaggguucacuguugucucagacagccuucgggcagaccccagccucaaguccugcacaggcgcuuuagacccacacaaggcugaggagccagcagcuaaaaaacagaaaugcauggaaucugccucuuaacucuuaggagauuaauguuuguuccaaggcauucugcagcugguaauuacacuuuaagugucaucacuaaaauuuucuccuuguccuaagaguguguguacaccuguuccugggaagaaguaagccuuucguuugccucuguugcagaaggauuagucagggcugcaacucugauggacaguaauggauugguacagcaguccuguaucacagcaggcucgguacuuaaaggaucugcagauuccuugggaaugucaacaccuugaaaauguugauguguaagucuuuguuuauauuuuaagcaaagaugauaauacaaacuagccacaacauggugagcagugaaaggaaauuuccucucauccacucuuccuccuaagcaauauggaugugugugccugugagauuuacaguaccaaaacgucuacccuugcccugcaaugaaagaagcuuuuuuuuagauacuagauuuuguuauuuuaauagucaauggccugaggaagauccagguauuucuuuuccugccucuccuuuuuugguacauagaaaggguggugggugcuccuuugcggugaaagggucuccucaguucugggugaagugauuggaacuucuguguacuauuaaacaauuggguuuuucucucucuagacacagacacacagaaaccuguaucaguguugguauauaugcauacacauagauguaucuauaugucagcauggacagaauguacuaccuguggugggacagagaaggaauacacguuuauuugaacugugguaaagacuugugcaggacagagcagcucuugguguguugcuguuacucuugucaaguauguuucaagugccuucuggggauuucucacacuggucuguacaugucugcuggugugaggugggugucuuuaucugcucugaaagaaguauaaucaaauuccuuaaccaucuccauuguaaggaauaaaaaugucuagaguaauugaaggcucuuguucccuugagagucuuguccuguucacuaggacuugugcgguguucuugucaucauagaagccuggccagcguggagcaucuuggaagauaaaaaugcuuuccuaauaacuugugcuguucugauaaaggcugcugugauuaccaacuuugguuuuuauuccuuuuucucuaaacaauugcuuuuaaagaauaaaauuuuccuacucugagccauaagucauuaaug

SEQ ID NO: 1117 - RNA, 28059 nt, Mus musculus
cuagucgcguggcuuccuuaagcagaagcgcgucauagacgcgccaaaaaagaacuucaagcgagguccgaguuugccuucugggcuugugcucggccuuccccgcccugcgucuggcguucuggcgcgcagugacgcgggcaccgggcggcuccggagacggaguguccgcggagcccugcgugagaguguauacggcuuacggcucugucgcaggcuccggggcuccugaaagcaggacgcgaggaagacggggagucagggauugcguacgacuuuucucaggcugcuucccuauguagauguuggaaucgccaccguucucaguauguuauccuguuggaucgauguggaacguaguguugcgauggaaugucucauccugaggauccugaagacuugagcuuuuaucacagggcuaucacaagcaaccuugauuauuauuaguuugcauacuugcgaaucuuuuauuuauuaaaaccucuuaggguuagaacagguucuccuaaugaauuacagcacagcguaugaaucuaucaauaguuuguaucugugggauaggaauuuuuaaguggaguuacuuucuuuuggaacaguuuuaggacagccugccacagaaaguaauacagcgaagauugggcuauguuauuucccuaguaucguacuggugaggauuauuuucagccaauacugcccaauauuaguuccacacagaaaaccgguucaaguuaacuccuugauuucucucuuggugguuuguugaaaacugguauugaauaaaugucuaugguguaccuuaaucaugauggagauuaaaagaauuaacuauacaacacauaagguuuauacugcagcauggaacuuugcaagccuaagugcuggucuuaaacacaguacauuaaucccccccuuacuauguuaauacauuuuuuaggagugcucuugacuuguggaagacaugaguggugcuuauagaggcagagguuuuggacgaggaagauuccaaagcuggaaaagaggaagagguggugggaacuucucaggaagguggagagaaagagaaaacagaguugaccugaaugaagcuucaggaaagcacgcuucugguacgugcacgcagggaucgauauguuuucucucgggaaagagacaauucaagggccgguagaugccagaguagguaagggggacugcugccaagugaggacccucaggucccuggaaccuacaugguggaaggagaaaacugacuccauaagcugcccucugaccuccacauaugcacuauggcaugugugggccuacuagugugcacaggcaacauaauguaaaaagaaaaaaaaaauacaaggaauggaaauaaugauaaugccuauuaauaauaaugccuaguagauagcaggauaguuuaacucagacuucaggucugaagguuaauauuuauaauucuuauugaaauaucuaauuuggagucuauuaauagacuccuguaaaaggagaaacuaguuggagggaaaacuagccagugcuuugguuuuuacuaacaucguauucuacguuuucagcacaagccucacaaccguuacuucaacagucaacauuggaucaguuuaucccguauaagggcuggaagcuuuacuucucugaagguggaguuuaagaaccauaaguuauauauucaucuuuggauacuacaauucauguuaccguugugcacuggucuuccugcucuaugccgccuuucucucuuccaagcauuuguuugagcauuauugcuauaugauguaucaggaaaacaggaacuggugaauguuucaaaagauuucauacaaggaauuggauauguauaugguagacucaacacagcagucugauuccugugacugagggagaaccaaccaagaaaugccaagguuaucagaagugggagcucaaagggagaggcaggacaacggugacauauucauugcaucgcacccuuccaaagcugugcuguaucacuuugaaagacguccuacugugugaugagaacuuagacgaaugaagcugauugucccuaguaauugaggauagaucagauguuccuggaggcuagaacuauacuauccugugcagucgcagggaugccauggaacaaggggcuggagagauggcucagcaguuaaacaugcuuacuguucuucuagagagccugaccuugguucccaaaaggaaacucacucugaaacccuuuuugaccucuguagaugccuacaugcauggcaugugcucccgcucucucccucucccucucccucucucucucccucccucccucccuccucccucuccaccucccucucucccaagcaugugcacuugugugcgugcgcgagcgcacacacacacacacacacacacacacacacauaaaaguaaaucuuacaagaagaagaagaaaaaaagaaaaacaagaauaguuucuugcaaccuuccagaccucccaguguccucaauuggcugaacuaaugauugaauaggaauuugggcaaagaugacagucagacaucaggacauaguaauaggcuucuugccaaggauuagauggcacucgauguuuguaaagugugcagauguugguuuucuguuuucuuacgguauugacgucucucauaucucuuaugaagcaugguuuuguucuugccuuuauuuguagcuggggguuuucccucuccaguguacuguagugcuuguagucaaggauccugucuugugacagacuuuuaguguucauugugugaaugaauucguuuccccucccuauuaauuugauagguguguuucauaggagagccuuuguuccuuuaggauacaucagccacaccauuuucaucaucacccugguagcuagcucauaccacuguaaagugauuuuuagauuauuaaagauggaauucaaagaauacuuugcuuaaaauugacccagcugcauuucauuagacuuucugugacagagaaauguaaagauacuauacaacuuuguaaaaauauuaaaaaguagcauuauaauuuugagauuacaguuaagcuuuggucugucuccagauccuucggaaauaauuagcaaguggcaguuuggacuaguagaauuuacuuuacaaagauagugauugucuuaacucuguucauguauauggcuuugcauuucuuagacuugaauaagauauuugaaugauaaaccguuugaggagucuaagacucagaaagcuucucagauauuugggguuuuauauauauuuuagguuauuuagacauuaguuuuuuuuuuaaaucucaaauauucauaccagcauuuacgcaaaugcagucauaacauggaauaggcaaggaagaaaaauguuugggguuucuagggaucugucucagcaguauaaaaugcuuccaucugugccucuuggugcuaaugcugaacuuguuggaucaguuuacaguaauaacucucccuuuauugagaagauucaagcauuugagaaauuuuucacaaggcauaucgacuuauacgauaagguaagagcuuucuaccaacuuuggcaguucaccauuaugugacaacuaacuggacaauguuugaggagcuagugagcgugagcagugcagcuggggagguguuagaaauaccaacuucaaaaguuuguuaaguauguauauguaaauacauuuacaauauuacgacuauguaauaaaacuuagaacuauuacugucugacuauuacaugcuuucugaaguguauacuaaauggauacuuaugauaauugacucaaaaaagcaauuguuauguuuaaauuuuaaucuuuuauaggaugaaauagaaagaaaaggaagcauuuugguggauuuuaaagaacugacaaaagcugaugaaauaacuaacuugauacccgauauagaaaacgcacuaagagaugccccugagaaaacacuggcguguauggggcuggcaauacaucagguaaauuugggcaaaguuuuaaaaggagauaucauaguguuuguacuuucugaaaggcacuuagcauuugguaacagauguugguuagaguuuaaggauugcagucuuccccuaagaggugguaaguucaccuauguacaagucgcccgaauuaguuuaauuucauuaaagauacagauguuguauuuccuuuuugagaaaguaucugauuguaaauauaaaauaggcaugguuuuaggaacuuggagcaaaaggauuuaacucagguguaguuaggcauugggagaaaucacuuauuuccccacugagucccguauguaaacuggaaguaacaguagggucugugcuuguaucgguuguucuuaggaacagaagcgcccacauaagugcuucaagguaaagggcagcuggucccaggacgggcaucguggcugccuucaggggcugggcacaauggggaaggccagagggagauguaggcuuaugauaggucuuaaggggguacaaucuggacacagcagcgagucaggauauccaggugcagcaaacagaucaccacacacucauguguacugcuagaacccugcacuggcaaucuugcuucuugucuucagccucauccaaucacccauuguuucucuagucaggcagccacaccaucucuuuauucuaacaugcacaauuccuuucuaucuuuccugcucuggcuuaggcccuauggaauuuguuuaguggaacccagugugaaaugucucagagggauguuauuuuauguguaugaguguuuuguucauauguauguauaugucaugugugacuagugcucaaagaaguuagaaaagggcauugguuccucuagaacuggacuuauggauaguuugugagccaccaugcugggaacugaaccuugguccuuuccaagagcagcaaguguucuuaacugcugagcaucuccccagcuccgacuguguuuuuaaugcuaaguuuaugugggacaaaagucguaaguaaguagugaugaugaaguguucuggugcaggcauaagaaaaucucaagucaaauaaauaaucuacuauaaaauaaauagaaccaaauauuaguccuuuaaauaacuaucaggguaguauuuauuuacuuuucugagauguucauaaacuuuggguucuaugaggauuuugcuuaaagagacuauuuauuuuucaaucuuugacuaagguauuaacuaaggaccuugaaaggcaugccgccgaauuacaagcucaagagggauugucuaacgguggagagacaaugguaaauguaccacauauuuaugcaaggugagaaacaugaugcuauuuuuuucucaauaaccuuuugauuauaguaccaacaaguggguuucauuguggcauuuuuauauguauauaaauguuacuuuguuuuuauuuuccuggcaccccucccccaacucuucuuauuucccucucaguguuugggggacccccuuccucccuuccaacaguccccacaucugucuucauagcacagagauuccauuacccucucuuguuuuucucucccuugagacuugcuccccaacucucaugacuuucuauguucauguccucugucugugugucuauaaaucuauauuucauaugugugagcaagcaagcaguauguguauuuaugucucacauauuuugcuuaaugaaaugaucucuaacucuaccuauuuucuugcaaguaccauaauuuuauucuuguuuacaguuuaguaaaauuccauuauauaccuuaaccauuacagacaucuaggcuaguuucuucucuuggcuguugugaacaguaugcaguaaauacgaguguacaaguuucuggagugcuugcucagaauccuucaggaauacuugguagugcuauagcugcgucauuugauaauugggaucucuguauugauuaccaguucacauucccaucagcaguguauaaggacuccugacagauagucauucugauugagaugagaucucaaaacaguuuuaauuugcuuuucccugaugucuaaugacagcaaaauuuuuccaaauaucucuugaucauuuguaucucuuuccuugaacuauauucaguguauucucgcauuaguuagaguagugggaaggguuuaagaacaagaaccuuggguuacugagauagcucaguggaugagaggcacugccauugagccugauggccugggcucaaucuacagagcccauauaguggaaugagagagccaacuccccaaguuguccucugaccuccccaugcaugccguggugcacacacaaaacacuaaaugccaacagcaacaacaacaacuacuacuucaaacuucaggguuucauuuuccucuuccaaaauuuauagaagauauuugauaacagcacccacaaagcacagacagguggaucucugaguucaaaaauuagaaacccauagguagcuuuuuccuuuuuuuuuuaauuguauuuuuuuaaaaagaauuacuuauuuuauguauaugagcacacuguagcuguccucagacacacuggaagaggcaucagaucccauuacagauggaugugagccauuaugugguugcugggaguugaacucaggaccucuggaagagcagucauugcucuuaacugcugagccaucucuccagcgcuggaauauguuuuuuauuuucgguuuuugagacggaguuuuucuguguagucguggcuguccuggaacuugcucuguagaccaggcuggccucagccucagagaucugccugccucuuaccccaaguguugggaucaaaggcacgcaccgccacauuuccuuuucuuuaaagagaaaguucuccuacuuuuucuauauauauagacagcuauauaugggguuuagcaguuuucauaaaauuuaacuugugaaguuucugguauaaagagggauaaauucuguggcugugccuaagaggaacuugugaaaauauaacucuauauauuguaaguuuauggagagacacauucuuguuuuauuuuuagaguguacaacuaugagcccuugacacaccucaagaauauccgagcaacuugcuaugggaaauacaucucuauacgagggacugugguccgggucagcaacauaaagccucuuugcaccaacauggcuuuucagugcgcugcauguggagagauucagagcuuuccucugccagauggaaaauacacccuuccuacaaaggugauauguucuuuaaucgacugucuucuuuaauucuugucuucuuuaccgaggaggcacaucaguuuacagaaagauuugccagugcuuuugaacagaacuguugcagagcaaauggcuguacacauagagcucaaaaacacaagacuucauuauguuuugugguugccugguuuagaaggcuggaggaacccucaccuggguguuucuuccucugugucucuguggaguugccauuacaaaauggaucugcuagagugaggcgucccaucuuucuuaaggguugguuuuggcuuuucacacacauuauggcaguucagagcuuauagucuacucauggcuauugacaucugcugugcaaagagaucaguugguaggcagagcacuguccuuaagccaacuucauaaaucaugcaauuccauuucugucaugguugauuagagucagucacagauugccuggauuccaggagauaaagcuccugauagggaguuacacuauuguauauaugaugcaaugccuuaagcuuauaaaugcaucuugagacacacacacacacacacacaaagugacauaggaaaaguuggacacaacuugcuuauacaaugagaaguacuugucaggugacuguaccacacaaacaaugcaagggggguuaacguuuauugcugugaagagacaccacaaccacggcaacucuuauaaauugcgacuagcuuauaguuucagauguuuaguccauuaucauggugggcaauauggugguaugcaggcagacaugguguuagagaagcugcugagagauccaugccuuggucugcaggcagcagcaggaggccauagccacagugggcauagcuugagcauaggagaccucaaagcccaccuucacagugacacacuuccuccaacaaggccacaacuccuaauagugccacucucuauagccaagcauucaaacacaugaaucuauggaggcuguuccuauucauaccaccacagggggcuagaggagaguagaggguuagugaagauccuuagugaaaggcuuuucaaaaguugaggauuaggucaaagcguauggccugaaggagguggugcagucaaggagcccaaggacugggagacugccuggacagaggaagcuguaaggacaugauaaguacggagguaagucaggagcuuuggcuacucauagcagagugaauacagaggaugagaaggacaagcuagaaaaggaccaggaaugaugccugaagaugguagcaagaagugggugagauuauaacugaguuuucuuaacuugaucauggcuugccagaagcugaguguagaugacuucuguugcaguguccugugccugcgugccgagggaggucauuugcuccacugcgcagcucuccucucacaguuacacuggacuggcaguugaucaaguaaguacucagauguuaaguaaaagagaagcucucauucugcuagguaaucgaugauggcaaugauuacugaugagucugugcuuuaaaaugguuugaaauugauugguuacuggguucuagagaggaugcagugauaccucccauugcuacggagaagugguucauuuccuaucuaaacgaugugaugcacugcaccuuccaugauggacugggauaacacugacguuuuagagaaaggaucacuuagaagugggcuacuugaugacaugcucucauuuucuguugagcauguuacaccgauuauuauuggcuuguuuugcuuuauuuguuuuaagagucaggcauuauuucuguauuuuuaaagaagauuuauuuauguguaguaugucuacgugaguuaugcugugaguguaagcauccaugaagaucagaagaggggcauuuaagggcagaagaagagcuucaggcccccuggagcuguaguuacaggcaguucacgagugcugggaaacaaacuuggguccucugguagagcagugaguucucuuaacuauuuaggcaucucuccaucaucaucauuuuuuuuucaucuaguaauuuuagguuuucuugauuauaugucauauguccauaaccacccccccaccuuuuaaaagauuuauucauuuuauguauaugaugaguacacuguaguugugagcuuucaugugguugcugggaacugaacuuaggaccucugcuuacucugguuggccccacucauucauuauuauaaauaaguauacuguagcuguccucagacgcaccagaagagggcaucagaucucucucgggugguugugagccaccauguggaugcugggauuugaacucagaaccuucggaagagcaguuggugcucugccgcagacccucugagccccauugucugcguggaacgggucucuagucgcaggugggcaaagcgucggauggaaugacagacagauguacacaggagagguuguguagaaucugaauguaauuugucaaauugagcaucaaacuuuuuauacaaaagaacauagggaaguuaggugacacaucggcaagguacaaaugagguuaccggaugcuuaaugacucuuacaaaaaacagaggaauguaaacacaaagacuggcaggagcugggcaauaaaacaacugacacaaagucagcucuaucuaaggucagcuauagucuuagaagccaggugugaggucuuuacacuccuagggcaagggcuuucacacccaagucaugguucuaauuagggaguuccauucuagcuaaccaucucaugaauaaugcaauacucuaaaaccacagcccgaucuacuuccuaaaccauuguaaauuccuguauaugggagcgacuuggcuuuuauucuaagugauaguguaauaccagaggcaauucugaaugucacugaacaggcaacauucuuccugaauuccaagcccauggucagcucaaggacuuucuaggacguuggaacaccggugaaggcuuagcuaugucagaauucaaucuuaaaaggcacuuauaagauaauacuaaaagagaguacguggauccauacaccagacuaaugcuggaauaaaauaugaguauauggguugaagagaaugccagacuccaggaggugaguuuccgugaaacucucugccucgugagugacuucuagaccucucagccugucaagcugacucgaccggagugcguggcagugcucuuacccgcugagccaucucgccagcccauaaccauuuuuuuaaaauaaauaaauaaaagacuuaaagcccucgaguuggguguguguaauuuucccugcucuuagugagagguuugaugcuauucugaugcucauuccuuuuagggugcuggacacuuuugccccuaccuucuaaucucuuucuuugugcaguuauccccauggcucgccacacuuucuguccuggagcugucuuuagcuguccuguauacuguccacuauuuccucuuucgccuuccugucagauacauccccuggauucccacugccuucuguuugccuuacccuuucauguuugcacacuuucuaaaguaaaguggcuuuuuguuaugucauuuuuagaaaugugugcuuuguuguuacuguauugagauaguaauuuuguaaccauguguaaccuugcaccaacucuuccuuagccucuugggauucugcugaggaccuagguugccauuucucuaugcccuuucucaacagcugucucuuaaaaaugaugugguagcuuuuuccucuggguaagauauguuuguaucucaguaauuaaggaaauugcuugugaguuuugucugugcauucugaacuucauuugcuuuacccgccacuacguucgguuuugguguuuucagaaggagugaguccuauuuguuagcguuugaggggugcuaggugaaugaaugcacagauucauucugccauccugaauuggaaacugcuaacgugauuuuuuuuuuuuuaauguaccauugaacuccuuaaaaagcagccugccuuuaucuagaacaguauccuacacauccugaguugaugaaauaacuguacguaagauauauucuaacugaaagcuuuggacugccuuagaauccaggagcugaugucugaugcacagagagaagcuggucggaucccucggacgauagaaugugaacuuguucacgaucuuguagauaguugugucccaggagauacagugacuguuacuggaauugucaaagucuccaauucugaagaagguaugcuguaacuuucucaacagugaugugcuagcuuuugucuucguauaagauauuucugcaucuccaauaauucagggaauuccuuguucauuaugugugaugaaguaucugguggcucaggcuugaaauugcacucuuuaggaagcugagguacaaggauagucacaauuugagguuagucuugaggccuugucucuaaaagccucaacugagggaauaaauaaagucacugaguuaugaaucuuguuuaacacucuagucaauuguguggaaaaugaaaauaauauauuuaauauuugaauuuacagguucucgaaauaagaaugauaagugcauguuccuuuuguacauugaggcaaauucuguuagcaacagcaaggggccgaaagcacagacugcagaagaugguugcaagcaugggacacugauggaguucucccuuaaagaccucuaugccauccgagagauccaggcugaagagaaccugcucaagcucguugucaaguaaguccuaaguuaccugaggcuuuguuagggaugcaugucagcgugcccuuguuacuagucaaaaacucuagacagaaugguuggcaaaugauuccauaagccaaaucuagcuugcuauguuuuguuuuaggaccugugaagguuuuuauauuuauggaugguuuagaaaaaugaagaguacuucauaacacaaaauuauguggaauccauauauuuuaugccauuugguguccauuaguaaagcuuuauggaacauuaccaccuucaggcacguauaggaguucguagcuggcuuugcacuguugugacuguguagcagcaacaaaaccacccacuuggcaauggguguuuauacugaugucuuuucagggaaaagcgguaccuaguguaaaugaagaccaucucucacaagcuugucauaauauaguauuuuuuggcaauguucugacaguuuggggauaauuuugaaacagugaggaaaaucaugaggcugaauuuaccaugccuaggagcagugaaggaggaagacuuggaauguggucugugaagaaguuggucuugucauacucccuuuuccaagacguugggcuccagaauugaggcgucucucugcuugaaguaugucaguucgccaacugaggaaaguuuugaguuacuugaguucuuguccuuaaucucucaagacuuccccuccaaauaggcaucccgacuuacucugugacagcuagugcugugaucgggucagcaaauguaagcuacauaggaauuguugucugagcagaugcccaaggagcagacauguugaagcucagacaccucucugcuguccuuacuggucauaagugaaguugccucuuagcagcccuuugucccuggccaccaguuugccuuuuucccuucugucuucuuguuugugauuucaucauccaaaguagaguuuucuaggacccuucacuuuauuuaucagaagauugacaaaugaggcagguuauuguuuugaaaauuuuuggugaaacaucccucaaccugauugauuugcauguuguuagcagcugccacuacacuacaaguugagucuguauagucuacaaggcugagaugauuuacuuccugggccuuuaagaaaaaguucauugaucaacacuaggugagagaacagagaagacaguguuagaauuaccaauauauggcaaguuuagauuccuuuggaagcaaugauuugguuaaaugccauuuauuugggagaagagcuuagaaauagcaggaaggcaggaguaauacagagaagggaaaccagguugggaugcccugaugagcagguaguugccauuagcugccuauggggaccuagauuggaggaaaagcccagcacuucuguucugcccuugugucuacugaggaugcuucugcgcucaugggaaagucugugauagacuuucaggugauugguaggguguggguggccauuagacuagaacaugguaaagaugauuuccaaggggcaccaguuucuguuuacacuuauuaaaaaaggaggaagguucauaguuuacuccugguuccuuccccuuguuugucuuuugcuuacaaaauguauauauguaaauaccauguuugcgugugcaugcauuauguugacaaucaaguauguuucuuguguuucuguugguaaguaucuuauguuuugagccugucucagugaaccuggagcucagagguugacugggcagugagcaccaaggaugcuucugucuccaccuuccagugcuaggacuacaguucaucccucuaccugccuuuucaugugggcgcugcuuucacagcucguacucugcuggcugaaccaucucuccaguccuuggagauuucuuucuuuucucuucuuuuuuuuuuuaauauuuuuuauuauauauuuuccucaauuacauuuccaaugcuaucccaaaagucccccauacccuccccaccacuucccuacccacccauucccauuuuuuuuggcccuggcguuccccuguacuggggcauauaaaguuugcguguccaaugggccagugauggccgacuuuccagugauggccgacuaggccaucuuuugauacauaugcagcuagagucaagagcuccaggguacugguuaguucauaauguuguuccaccuauaggguugcagaucccuuuagcuccuuggguucuuucucuaguuccuccauugggggcccugucauccauccaauagcugacugugagcauccacuucuguguuugcuaggccccggcauagucucacaagagacagcuacaucuggguccuuucgauaaaaucuugcuaguguaugcaauggugucagcguuuggaagcugauuaugggauggauccccggauauggcagucucuacaugguccauccuuucaucucagcuccaaacuuugucucuguaacuccuuccauggguguuuuguucccaauucuaaggaggggcauaguguccacacuucagucuucauucuucuugaguuucauguguuuagcaaauuguaucuuauaucuuggguauccuagauuuugggcuaauauccacuuaucagugaguacauauugucugaauuccuuugugaauguguuaccucacucaggaugaugcccuccagguccauccauuugucuaggaauuucauaaauucauucuuuuuaauagcugaguaguacuccauuguguaaauguaccacauuuucuguauccauuccucuguugaggggcaucuggguucuuuccagcuucuggcuauuauaaauaaggcugcuaugaacauaguggagcauguguucuucuuaccuuuucucuucuuuuuaaaaaaauauuauuuauuucauguaugugaguacacugucacugcuuucagacacaccagaagagggcaucagaucccauuacagauggaugugagccaccaugugcuuucugggaauugaacucaggacuucuggaagagcagucagugcucuuaaccgcugaacaaucucuccagcccauagauuuauuucuugauauucacauucuuaaucugacucuucugaauugaacugaaaaggaaugaaauuuuaaaccaccuuugaguacuacuguuugugcugagcucauacguuaguguucucccuucagugacuuugcuauacaggucucaaaugucuguucagacaaaacaaauaccugggagggcagcagaccucaugauaguguaguuuaagugcucuguccggucagcugugcauugaguuacuuuaagaugguuucaggcauucccuuggagcauagauuuuaaagcauucuucuuuuuauagacuaaauaagacuugcaaagguuuacuauaagaauaaaauuuauggggcugaggagauuaaauuuugcuuccccuuugauauuaaauaaaggagauuaagcaaauuguaaaguagcucuuguaauggaccuauacaauucaagugagaauuuaaaggcuguauucuguuuuucagcucacucuguccugucauuuuuggucaugaaguaaguauauuacuucaguuuaauuaaaaaguacauuguugucaauuuuaauacuuuaaaguagugagauucucuuaccagucauuaauauuuuaauaugaaucaucauucucuauaacagcaguuuucaaccugcggguugcaauucauaacaguagcaaaauuacaaugaugaaguacuguacacugaagucauuuuuugguggagucaccauaacaugaggaacuggacuaaaggauggcauuagguagcauuaggaagguugagaaccacugaucuguaaguuuauguggaaggcaaauaauauccaugaaacugucggcaguuacuggaauggacaccuuucaaagcgacuggacacuaaguaaacaccaauaggugcuuggugcuucucacucuggaguggauuaugguuuuacauaguuguuccuagcaauugcuaagauccuguugacuuaaauacuuccagucuuuguuuuguuuuguuuuguuuuacuuauuuauuauauguaaguacacuguaguucagacacuccagaagagggcaucagagggaugguugugagccaccaugugguugcugggauuugaacucaggaccuucggaagccaucucucagcccucagucuuugcuuuuaaucauuuguguuauagcagguuguuucuagacaaacguuugguuuuuuuuuguuguuguuuuuuguuuuuuaggccagcuuuugcuuuguugccccagaaagccuugaacccauaacuuuccugugucuguaucucgagugcugggauugcagacuugcuuagcuuugcuucucagcuucauuguaaagcaguaaaauucagucacguuagaaaguauccuggcugguggugcagcuuagggcugagcaccugacuaauuaggcacuaagccuugggcuccaucagcacugcaaaggggacaaucccuagacaaaccagugcuguagacaugcaagagugcccugugccauacacaugcaggagugccuugugcuguagacaucaggagugccucucgcuagucaucuuuacguuucuuucucuguucucuccuuccacucgagcucgucaaagcaggucugacguuagcacucuuuggcgguagccagaaguacgcagaugacaaaaacagaauucccauucgaggagacccacauguccugauuguuggagauccaggcuuggggaagagucagaugcuacagguagaaaaucaguuauuugguauuuugccuuuugcuuauauuauuggcaggugacauuucucaaagugugacauguuuggguuguagaagaacuaguuugacuaaggguauagagauuugugugaguaauacacaguguaucuggccuuacuuucacuucaagcuagccuccugccacacagacuauauaggcaucuuggucucugaaggucuuaacuaugauaaaaugcuauuuuccugacaccaucauuauuauaccugguaaugcuagucuauugugcugugacuacaucagugaccagacagugaagggaauaaagcugggucaugcauucucuccauguuaaguacaugagcuucuuacucuccagaggauucugguaaaggcaaggggaggagccgucugaauacaucgccacuguuucucugaauccaaagcaaagcagcuucuuuggucaaucaguuuuuagccaccaaagaagguucugucugucccagccagagccugcugcuguuuccuucuuagguucauaauggcccuagaaggugcuguuuguuagacugcuguaguuuucucagagugauaccuaguaggcuugaugcaguguccuucuuaaagaugcccuucaccccccccccccuuaccaaggacuaucuggcccuuuggugaguugcagucaauccugcgacugauaaaucuucauccagcaguugaacacucugguugugucuugcaguuauguuuaaaacucuuugaacaugguauaggcagccugaagcuaguacuuguauauauguaguucccccaaggugguccugauguguagacaggaucguugugauccucccguugcauccacaucccguccuuccuuuguaugugucaucuuuauuccccuuggcugaauaguaaaccaaucauuuuaauucuuuuaaaacauugcauccuuguuugggucucuuugucuagaagagccugcuuuaaccuguucugagcccuuggaacagccuauauaggaaaccaccccaguaucagcauugucaggauucucaaaacagacuagcagagggcugaguguauggcucaguggauagaggcuugccuggcacacacagaaugacuacuguggugguaacuccugcaaaaccagaacuucaaggucauccucagcgccacauagugagacccugucucagggaguaaaaguggcucagcaauuaagaccauuggcucuccuagaagacccaaguuugguuccuaguacccaugucaggugguucagaaucacuuuaaucccaccuccaggagauccgcugcccucuucuggcuuuuaugggcaucaguacauuugugauacacacacauaaauauacaucaaacccuaaaaggacuuagcaaagaaagugggauguaaguuuagggauugagcuguugacuauaauggucagugguuuuguuuuuguuuuuguuuuuguuuuuacugguauauguguguguguguguguguauguguguguuacuguauggagacagucguggugucagguuucuuccucugugacucuaucuuauuuugugagauggggccucuuccuaaacuucggagcuuguuguuucggguaaacugucuagccagcaaguccuugggaucugccuguuuccacuccagaagugcugggauuaugaauuuaugaacguucaacugcuaugcccagcuuugaaaaggggacuggggguccaaacucagguucucaugcugcguggcaaagacuuuaucugcugagccgucuuuuuccacccucugaaugauuuuuaaaccuuuguuuuaaauaggcagcaugcaacguggcgccacgugguguguauguuuguggaaauaccaccaccagcucuggucucacugugacucuuucaaaggacaguuccucuggagauuuugcuuuggaagcuggugcccuuguacuuggugaccaaggugagagaguaaagggacuaaugaugcuggggcuugauaccuuuucuucuugaaacaguugccgugcugugcagguuagauugcuucaagagacaucugcagccucuaccaccgaagugcuggaauuagaggcaugggccaccuccucuugaucaagcucuucauuucaaugaauugacuuuuaguuugagaguuauuccuacaguacugucucaaccagugaauugauaaugaguaucaaacaauaauugaaaauacaguacuaucauuuuauuuuuauuauacagcuaaaacugguguuauuuucagaaucuuauaaaaauaugucaaaauuaaauaauucgauaaaauaugaauaguuucuacagcuccaacuuuauaacccuauuacauuugugaccauuuuuggaguuuugugaguucuguauggaguugguuuggauuauccagugaacucucguuccuccugccuagugguauauguacagugagugcuuguugacagcauuacugugacuuagcucaaaauaguucuaguuaccuugaaacaacaaagaagguggaugcugucuuucguucuagaaagauugccccaugaguuuagagcugugacuuuaauaguuccucuguauuuaacuucaucuuagccuucuucaguugcagaguccguucuccuucccuuggccaccuuucuuuucauagcaaguaucaccacauuuucaauaggcugccucccuccugugggccacauagaauguaagcuucacaagggcaagaauuuggugcuuuucugcaugccuagaacauagcacugguguacaaauaauaaccagcaaauaucuacugaagcaaacauucaucugguguucaucagaagcuccggugugccugcuaagaugucaggaaaaggcaauagugcaugcagauaaggaugcuuaacuguaaaacugccagacuucauucauuagaaguggagauaguuagagguuagcuauacagacagcuaaugggauuuaagaugugaaaugcuaaguuagugucauguguauauauuuuaauaaacuugcauauauuuaaacaaacauuauauggcuagacagcgcuguuagauaaaaagggauuuugcaaguauaacagaagaauacaaaggaaagaucaacagacugaguucuagaaacagacagggucuugcuagaaguuuuauaaagacugugagggaaaagcaaaauauaaagcuuuuaaaaauaguauuuccaggagcuagagagauggcucaguaguuaagaguacuggcugcucuuccaaaggaccuggguucaauucccagcauccacauggcaggccacaacugucugcaacucuaguuccaggagauccaacacugccagacauacaugcaggcaaaacaccaaugcauacaaaguaaaauaaauaauuaauuuaaaaaauaguauuuuccuuuagaaucugaugaaaugaccagaaaaaguuuaagcguuaaauuuugugacuuaauauuuguauucagacaggcaaaagaguugaggauuguuauaguugucugaaguuugugcuuuauaaccguggguuaggugcuggagagauggcugggcucuuagaugacucagguucaauucccagcaccaacauggcaaguuaaacuguccucuaacuacaggcccaggaggucugagacucucauccuggccucaguacccaaacacaucuccauagauauacauucagguaaaacacucauacacacaaaauaaaaauaaaucuuaaaaaaaaaaguguagcagaaguuuccugucugagcaaaacugaaauccaagcaaaaaaugaaaauuauccaugaaauguuuaaugagaacaugaauuucacgaaauaaaaugaguuagggcuacuagauaaaacauuggugaucaccuggucguggugcuguaagccuuuaauguuccaggacagccagggcuacacagagaaaucuauuuugaaaaguacaaacaaaauugaucaauacacaaaacugacccugccagaugagaggauagguauagaggaaaggcuuacuguaacuccaaugacuacagagaagagagcacgauugcagagguaacacaguaaacacaacgcaguggguaacugguuccaggaaguaggaaccuagaagaagcacugggauugacuugaagagugugagagagccccaacucuaaggugcuuuagguucaagccccagcccugaaaaaauagaucuauagaucuugaaauguagacaagcgaaugagcaguuauuucuccuaugagcuuagcuggcaaggauuugguggccguagaguacaggugaguuuagccggagaccccuaacugugugaggaaguggaagaaagcacacaagguguggugaggagccccagggacuugugcuucaggagugacaucccugguacucagcccucgguacacaucaccgguggugcuguggguuaaguguccccgccugggccaucaguaccuccuguuaugcuugagucuucuauguaugcucuugugcccaagucaugcugcccacggccugccuaagacucagcucaaggagcaccuuuucugugagccuuuuaguccccuauuuuagcuauauucuguuucagagagcuaccacauaauucugcacagccuucucuucucuuucuucucuucucuccucuuccucucuucucccuuccccuccccuucuccucccccuuuuccucuuccuuuccucuuuuuucccuccaggacaggguuucuuuguguagugcuggcuauccuggaacucucucuguaguccaggcuggccucaaacucagagguccaucugccuuuucuacuacccagugguuugggagguacauuucuuagauguuuguaucuuaccuaacugguuaagucuugauccauuuuaagacuugcauaucuucauguauggggcugcacauugugugcuacccacggaggguggagaauaaguaguggcaggcacaugguuuuguaaugagacagaugcaucauuugcuguaaaacauagcgguccucauugacauuugacaauuguaaauucuagaaucaaauggaaauagucauuguacagcaacuucugccuuacagauuuggaagcugaccagagaaagguguuuuugucuauuuuucuacugugcuuguaggcaucuguggaauagaugaauuugauaaaauggggaaccaacaucaagcccuguuagaagccauggaacagcagaguauuagccuugcgaaggcugggguaguuugcagccucccugcaagaacuuccauuauugcugcugcaaauccagucggaggacacuacaauaaagccagaacgguuucugagaauuuaaaguaagugucuuccaauguguaugcugugagucaguaaggaaagaauaauugacuguaucaauaaguaacucacagaagucagaggucuccaggaauguacagaaacguacuuauuaaauccugaagacagugagcuugcccugauagccuacauggaacuggccaagcuuucaggugcaggugucaguguuacgggaguggggagaagcuacacaugcucaguguguuggaaccgccuuguacuaguguguacauucucuucuguucauuccagccacuuagcuuaggaaguccugacuguaguuaacaaaagccauagacgugcuuuugaauguguauucauuguuuaucaccauaaaaucggaaauuguuucaaaccucaguaaggcucauuccagauacugcuucuuuccugcuuccuaggauggggagugcccuacuguccagauucgauuuggucuuuaucuuguuagauacgccaaaugaacagcaugaccacuuacuuucugaacaugugaucgcgauaagagcugggaagcagaaagcgguuagcagugccacagucacucgugugcucagucaagacucaaauacuucuguacuugaagugguuucugagaaaccauuaucagaaagacuaaagguauacauguuucuuaaauauuuaguuucauucuacuuaaugugugugaugggggcuguaaguaugucucagugguauauguguuuaucacauacagggcuugcucuggauuuaaacaucuaucagcaucuauccccacccaauagaauucaucuuccuccuuguaccuugacauuuaccgcauacuuuggaaucaucugaggcagcacuucucaaccugugggucgugaccccuuugggagucacauaucagauauccugcauuuccgagauuuacauuacaguucacaacaguagcaaaauuacaguuaugaaguaacaacaaaauaaguuuauggggaaggggucaccacagcaugaggaacuguguuaaagggucacggcacuggggaggcugagacccgcugagcuaacuaaggugacuggaacgguagccacacugcgugguuuauuugggggagcuuuagaacuuuuuuauuuaccuaaacaagcuagaaauuuucagccauuuuuuucauccuucucuagguggcuccuggagaacagacagauccgauuccacaucagcuguugaggaaguacauuggcuaugcacggcaguauguccacccaagguuaucuacggacgcugcucaggcccuucaggauuucuaccuggagcuccgcaagcagagccagcgcgugggcagcucacccaucaccacucggcagcuggagucuuugauccgucugacagagguucgccuuguuugcacucaggacuuuuguggcuagaggaagcgaagacugaggacacaaaccuauagcucaggccuaagucagucaggaugcugacuguguauaaggccuggaaagugaaaagagagaaugauaggauguaguucaggggccucgagugcccguucacugugugcaaggcccuagguucagucuccagcacugagagagguugaggguguguguguguguguguguguguguguguguguguguguguguguguguguggcguguuuguguguggcguguguacaugcguguguguguguguguguggcguguguguguauggcgugucuguuacauuaugaucucuccuuuucucuguuuucuucacuaucauccuucuacaucaaaagugggugaauuaaagauuuuuuuugaagauuuagucacuuuuguaacaucaaagcuacagauaucuuucuaggcaaaggaccaguuauaccaagcaacuuuuauauuuuuaaaugacacuguagauuucuaaagugucugagacguggugagguuaccuauaaucccaggcuuccaguuugagcauauagggauguggagucugccgcgugucuucacugaugaugugacaggucaguagguguaggcagccuuucugagagcagcacugugugucaaugcacgaugcuccgaggacuacugcagugaaaguuagcugcgucggaugguaagguucuuuugauccuaaaauaugguugacuccucuguuauuuuaguucagcuaaacugauuuccugauaguaaaaggcaacauuuucauaaccaaaucuccugaaaugagcacucagaaaaauauuaguagguaaaaguacauucuggcuguauuuuaagcuauuuguacacuuuucuaauuuuuuaauuuuuuuuuuauucuuugagaacugccugcaugcauacaauguauuuuaaugcuagucaauaccuagccuuccuuauacaaugaaugauuaagcuuugauacaagcaucugcacaaauggugaaaauauuugucuuuuaagacaguuguuuucuuucacaggcacgggcaagguuagaauugagagaggaagcaacuagagaagaugcugaagauauaauugaaauuaugaagcauagguaagacugacacuggugcuuuuaugugaggagaggcggugcauccaucacacgugcagucaucagaggacaacuucuggaagccgguccucugcaugggucccagggauugaacugaugucaguccuggccgacaccuuuaccugcucaggcauuuugcugccccuuacuuaauuuuuguaggaaucuguucuuucucuuucuccuuuucuuucucaccucucuucccaauccucucuccuuccucccuuucugggggaaaaaaaagugcuuuuucacuuuggggaaguauggcagauauuuuucaaaucuuuuuuuuuuccaaauggaaacaagguagcauggauuaaaaucgcaggugucagucauuacuaguguaacauuuggaagucauccauccuuaugugccaaaguugucuucaugccaaaguugucuucaucuguaaaucggaauaauuauaauuccccaggcauaggauugcugggaggaugccugugguaaauacaaucaccaucugucaguaacucaaagcauuuccagcaauaaaggaacauuaauuuauugcuuaauucagguggcuuaagccugaagguguucggaauguguacuggaucaggaaauggguagaccccauccgcugucauguguuccggccuuacuuuaugcacauuucugucuguagaguuucucaucuauuaaaggaacagaucgugacuaucaaggucaucccuaaggacuccuuauggacagggcuaagaucuguucuguuugccacccugcacguccuagugggugaccaauacauauuugauaauuccugaguaaacacuuuguuaaacugccugugggauuuuaugucccauuguacagaugggaaucagcaauagagcuggauuacagggcagguaaucccaucuguaaaggguguugcagacuccagccaaaacucacugucaaugccuacuucucuuucuugguuauucuguaaaaauagagaacagagaagugggguuagugucugacugucaccacugcaagucugcacgagcugagugcuucucaagaguguuaauuuuuagaucucuuuaugggucuggguguuuugccugcacagaggacaauggaaucccauggaguuagaggugcuugcgugcugucaugugggugcucuuaaaccccaguccucugcaagagcagacugugagcuaaaccauggagccauuucuccagcucccccuagacuuuuaaacauuuuuuucuuugcagaugcugugguaaaaaauaauagcacgccuuuaccuaggaaaacuuaaaauauuguguucacaaauuuuaguucuauaaaucagaaaugauguuuuuugguauuuauaauacugcuuuucaacucuacauuuuuacauuucauauuuacaaauuuguuucgguguuuugaaauaggaucccucccuccauaucccuaacuggcccuguacuugucaauguguuucaggcugucuuuaaacucaagggaguucuuaugcuuuagcuccugaguacugggacuacaggcauuuauuacuacuccuggcaaaaguuuuuggaugugguuuuguucuucuaaaaaaaaaaaucacuaauuguguucaaaauacuuuuuugucaaucuauauauauccuaaugaauuucaaaguggcuaagucucacagcacucccagacuucuauuaugaauuggaaacacagcccaaaaauuucuguagccccgccauaugagauaauccuuucuucucuaucuuuaagcaugcuaggaacuuacucagaugaauucggaaaccuggacuuugagcgaucccagcauggcucugggaugagcaacaggucaacagcaaaaagauuuauuucugcucucaacagcauugcugaaagaacuuauaacaacauauuucaauaucaucaacuucgucagauugcuaaagaacuaaacauucagguaugaugaccuaaauacugagguucuuauuaauagaacaaaacaacuuguuuuguuuuauuuuuuuucuagcuguuuucuccguguacaauccuggcuguccugaaacuuuagaccaggcuggccaugaacucagagaucugucucugucucugcuugccucugucugucucugccugccugcuggccucucugccucugacuccuaagugcuaagacuaaaggcaagcauauccaugccugggaacaaaaucacucuuuagcuuuaagauucuuuguuaccucuucucaaagguuuuggcauuuccaaugagggacuuuuuuuuaggaacacuugggcucugucuggagcgcccuguggcuacucauugugauggcucugguuucucuuuggaugagucccugcugcuccuacuuuggaguucuagagaaaaccaguguaauugcacuuuaaauguggcaaguaguucagauguaagaucaugcaauuucaaaagcuagucuaagcugggcuuuuaauuaagacaaaguauucuuuauuuaguggaguacuauaugaagcauagacuguuuuuguuuguuugccuaggaagcucgcuggguauaugucuguguagagauggaugugaaagucauauuuggcugauuacugaaugugcugacucuuaauguuugcuuuuagguugccgauuuugaaaacuucauuggaucacugaaugaccaagguuaucucuugaagaaaggcccaaagauuuaccaacuucaaacuaugugaaagacuuuaccacaucagggcuuccugugguucaaaauaguucagaaucaucguaauuacaaaacugaaaauaaaaguucugaaaaaugacacaacuccuauaacagaauaaaggccuauccauaauuuauccagaagaguaagaagaguaaauuguuuccauuauuuuaucuaaauagcauaagcauaugcuuuuaacucaucauauuuuuaguagugcuuuuuaguuuuguauaucagaugucuagcaggcauucagcuaaugcaaaaacagauuaguauguguucaggugaacuuuuacuuaaaacauuaaacuuuggcucuccuaaauuguucaggucacaaaaacucuucauucauuuuuaacuuuaugauuaugggcagugggucugacuuggcuucucauuugaaaguaguggaaauuuauugacuuaauuagaagucuuuucuggggcuagagagaugacucagugguuaagagcacugacugcucuuccauagguccugaguucaagucccagcaaccacauggugacucacaaccaucuguaaugggauccaaugcccucuucucgugucucugaagagaguaacagugcacucacauaaauaaaucuuaaaaaaaaaaag

SEQ ID NO: 1118 - RNA, 1786 nt, Mus musculus
uguucauaaugauaaauuucuuuaauugaggcucaaacaguaaauuuuuacaaucagaacaacacucugauuuauagccaccccccuuggcaugguuugcuuuccuugcugaacauuuuuagucucugaaucuacguuuuucuuuguguuugccuguucugauguuauuuuucuucacuagaaggugaagguguuccaagaaggugaggacuugacuucacucacuguugcucccauggugucuagagaucgaacagagucagcugagagggacauagaaggcaccugugacaaccccuacccucaccucucccaaaaaaaagcaacaaaggaagccauugaagagaauucuuuaaaauuaugcuaaggaugcugaagucaguucucuacaauggugggcugugggcagaggaggguggggaaggacucacuuuucuuuaaaggucuggccaccgggaguuugaacaugcuccaaggacuaugugaacaacacaauuggacucagguuuuuuuauuuguuuguucauuuguuuaaucuuuugggggguggggaaaggccacaaggguaggggagcagacuugggaggacugagaaguaaggguaaugggaacacaguaugugagaguuccagauaaucaauaagaauauguuuuucauaaguaaguccauaaagagaugaaugggugaaacgagcuccgaauauaugacaguguuagcauuuacuuucaucgguuuugauuucccaucagugauacaaagauaaggugggagugguggcuauaaaacagugcuuuguagcaauaagcaauaauauuuuuggagcucugacaccguacuggagagaucauguggacaaucuuuuggcuaagaacuuugguaaugauacaaaaacccuuuagcauauaaucuuugauauaaucuagguguguggauucaucauguggaaguccuuaagcacauacacuaaaauuuagcacagaacuacauugaaggaaaauaaaaauuauccaaaauaguagagucaaugaauuaaauaaauuuggauauccaacaaugcaaagcuugacaaucacauuaagcaacauguuagacaagcaagauugauguucuauaauaagaaaaaaauauuuuuauuacuuacccuucuauccugugggucuagggagaaggagcauacuuuucugacuguggaugaaagugagggaggcuuuugugaggcauauaggcuucauuaugucaugaaaaguguaccagaagcagcuguucuuugaaaacaaucugaauuuuguaaugugcaguccaguuccacauaaucaaacaucagccuuggaacaguuaaagguucuccuuccuguuguugcucaggguguugguucacagaacuaaaucuuaacagagagggguggcagauuagacauguugaaaggcuagaaagguagagaacauggaaaggacaaucuaaacaaagggagaggcagugaggugccccucagugauuuccagaagcaacucugucagcagcagagccuuuccagcaacaagucucaggcugccagaaaucugcacagguaguguugcuuguggaugcagaccuugugagugcugggagauuuguaacuuaaauaaguguaaguucaaaucaugaauuuacuccuuggugaccagguaaccccggaugagcugcuuauguuucuuaagcuugaaucuccucauuugcauaaugaugcuuucuuggaguaugaggguucaugacagcuaggcacugugccugaggcauaaaacauu

SEQ ID NO: 1119 - RNA, 685 nt, Mus musculus
gagagaacuugcuuuccucuggcggcagccaucaggugagccaagaugggugcauacaaauaaauccaggagcuauagaggaagaagcaguccgaugugaugcgcuuucuucugaggguccgcugcuggcaauaccgccagcucucugcgcugcacagggcucccgggcccacccggccugauaaagcuggaagacugggguacaaggcuaagcaaggcuaugucauuuacaggauucaugcccgccaugguugucguaaacgcccaguuccuaaggaugcaacuuaaagcaagccuguccaccaugguguuaaccagcugaaauuugccugaagccuucagucuguugcugaggagagagcugggcaccauugugggguuuugagaguccugaauuccuacuggguuggugaagauuccacauauaaauauuuugagguuauccucauugaucuguuccauaaaacuaucagaagaaguccugacacccaguggaucaccaaaccaguccacaaacacagagagaugcgugggcugacaucugcuggccuaaagagcuguggccuuggaaagggccacaaguuccaccacacuauuggugggccgugcagccuggagaaagcgcaauacucuccagcuccaccguuacugcuaauacacgugauauuuguaaaauucauauccc

SEQ ID NO: 1120 - RNA, 697 nt, Mus musculus
cacagaggggaccguacagaagccgaaaggccuucuacugugcuaguggaggcccgggcugcccgccuagucuccgcccgcccgccguccccgccccgccacccgccgcccgcucaccuucgugauggaagcugcgcacgguguuggcgcggcuggcugcccucuccagccgguggucuggggcgggcgcuccuggcuggccugagugccugcgguacagaucuagcauauaggggggcaccacgacguccuugcugggggugggucucugcuucaggccaaacaugcugagcagccucaacucaaauucgcugaggacgucuuccgaaggccgggacaagggucggcuggaugccgcggcgaacuucuugcggcccagcucuggaaugaggccggccgcgccgcccaggaggaccuggggaagcagcaacacuagaagacagcgggucccggccaccauggucgaccugcggacagggccgacgugagucacccacguuccccgcccaguccuccgcccgcccccgcggccucggcucccauagagcucgcuggccuucuccaggaugcccuccuggcaugucauauucgcgggcuacagccuggaugaucaagaggauggaggacccccaagucccagccggacuucuuacuuggggcuuggucuuaacucccaauuaaaaagagcauugaccgu

SEQ ID NO: 1121 - RNA, 2225 nt, Mus musculus
gacuguguuaagaaauuuuuauuguuuccuuuggacaauuuuugugugaugaaagcacauaaaauuacaaguggaagaaacaucaugccacaaaauugcauagaaugauuacaaaaaugugaauuaugcauuuuaaauaauuucagauagaacccaaauauguacauuuuaagagcaucaaauacuuugcccucucccucuuucuccucuuaaaaggcgggaaucacaauguucaauccauuccgaacaguauuaacacagugcacaagggcaacauuaaauucaaaggaaugcaagcaauggcccuuucuuuuggaacuuaauuaaugacuucuuaucuauuacaggaguauuaauuaauguguggugguacugaaauguuaaaaaacagagcacaugucaugucauuagaacuuugaacacugauuuacacggcccaaccacauuauucucaguaguuuaaaggugucagggauacagccuauuuuaaugcaugacucuacucucuacucuaggaaaauccacaguacagaauuucacacauucaacgaagaacaaggcaaguacauaaaggcacaaaacugcacaucauauagaccccuuuucuuuaccuuugucuauuuucaaguaauauuaauauuaucgauggauaguaucaugguaguaguuucgaugaugcaagaugcacagugauacacacuaccccacaacugcaaaaagugucacuguacagauauaaaaaaugugauuacaguaaaugaccagauacaaaacauuguaaaaugacuagaaucaccaagauaaugaaguccaacuaccaaaacaggauuugaaagucaagguuauucaaccucggucacuauauggacuaugaugaaauccaauguccugccauaaccaccaguguguuugguuucgaauccuguuauccguucacucuucuccaauuuccaacagucugugacuguguuuguaaaauucagcauuccauuuggaccgucucacuuccuucugaguaauuccuuuccuuuccuucaaagugcaaaaguuaaaugguucacaagagaucucucuucaguggaagguaagcuuuaguaaguuaauuaacacucuugguccuucagauaaaauacaaucaucucuaaaggggaugugauuucccccuuaugucucgucucaguaagugugugugugugugugugugugugugugugugugugugugugugugaucaaacacuuucaugguguuugaagcaagccuucauuuugauuaaaacuuaauuaugguccuaguuauugcuuaaaguuaaauaaaaucauuuccagaaaaauauuaaauucuuaaaacacaaaauuucaggacacaacuguuauuugccuugcaaaauuauaaacagacagguucccuuuaaaguaaaacaaagccaugggcauuguuacugcugggcuuuaauguucuuugucccacucucuaaaaccauaguuuuucuauauaauauuauuucuuaagaccuuuuaacaaugauuuuauuagcuuuaacaugauauaauuugucucuuauucuccuuagaagaaaauaagaauuaaacaaaacauaacuaagugaaguaaauauacaaacuaaaauauaaccagagcuuuauuacugucagaauaaaacugaaauuacucaguuaaaauuuauugaagauaguaguaauacauuugcacucuauuuccuaugcauuuuugcauauccugaccauuaaaacaagcucaaagucugacacuuaaaauccaauuuuugauccuucaaauuuuuuuaguaaauucauuuccuaaauucuaagacuaccucaaguugcaucaaugacuucauaaacugauucuuagcauucccauauaauuuaauuauccauauaacauauauuugacccauuucuucucuguccauguaucccugaacuugcuuuuaaaucuuauggaagagauuugggucacugccaauuaauaaacacacauuuacacucaugcguauguauguguguacacuuacauggcugggugcauacguguacuauauacauggagauaauguguaucauuuauacaugugcauuuagauaaauauucuaucuucuuuucuacaguaaaaauaaaugaaccacaaaaaauaucugacaauaaaauagcccacuggauccuguucaggcuggcugauaucuugauucaacagaucagau

SEQ ID NO: 1122 - RNA, 3159 nt, Mus musculus
agaugaacggguguuuugcagggcuguguuucaucucagcgaucaacugguugaccuauaugugaggugaguggaaauccccugcugcacagagugaggcucaauuuuguuuuuaggaagaacaaaauauaucauuuaaaacauaggaaauguuaaguauuuccuagguuuacuguuugacauuaaauauucuuagauuaauaauaaauacaacauuuuaaaugcagacuuugcaagccgagugugaugauccugcuuagaaucccagcauuugagaggcugagccagcaaauugacguaaguuccaggacgaagaaugagauucuggcuaaaaaugucagagucugaagaggugccucagugguuaaaauuguauacugcucucguagaggaccagagugugguacccagcacccagguuggauggguaauacauccaugugugcaaacacacagauaaauguaaacuuauaauuaagaagaaaauaaaaucuuuuuuaaauaaacagacaaaaaaauuacccuugcuguaaaauaucucaauaaaguuauguuaccucggguaauagcauaacaagguuaaaaaccuugauuuugaaaaauuaaucaucuuuaaggcaaaaacuaucagaacagccucagacuuccuccagucaugcgccuugcuggcaguaauguauacaaugauccuaagaaauaaaagaaaaugaaaacaagccuucuacacagagcugagcgauccuuucucuauacagcaaacaugcagacaucuugacauaaaaucuuuaaggaauauggaucuuauaaucccuuuuaaaagaaguuauucuggaagcagaugucaacaaaugaagauaugaauggagaaaaugcaauaaaugagccauugcugaaaccauuucacuguaagacuuagauuaauucaaaugccaaucaaauuugcaagaugaacgaauaacagaaauagcaccgggaauggagaccagcaggaaacggugcagguacaacacagcaaagccuuguucccaaccauccaugacuucaguuccgggaaaucccaugcuuucuuuagaccuuugagaccuccaggcaugcauacauagacacauacauacauacauacauacauacauacauacauacauacaggcagaacacucguacacccaaaaucaaucuaaaaagagauuaaaacucgguuguuuucugugaguguguguguguguguguguguguguguguguauaucuaugagagagaaagagggagguauugauagggaugucuuccucaauuucucuccacuuuauuuguuaaaauaggaucuuuuacugaaccuggagcuugguaauucaacuagcuggacagcagggccaggaaaucugcuguccccgucuccucagcacuggcacugcauguauaaaccagcacacugacacaccugggguuuuuuguuguuuuguuuuguuuuauugauuuuuuucuuugaauccugggauugaauuaaguccucauccuucuauaaaaagcacuuuacaaacugacccuucuuuccagcccugcauuaauuaauucauuaauaauagcacauccacacagugggaaaaguuggggaugcucugugucuuaguuaggguuuuacugcugugaacagacaccaugaccaaggcaagucuuauaaaaaccaacauuuaauuggggcuggcuugcagguucagagguucaguccauuaucaucaaggugggagcauggcaguauccaggcaggcauagugcaggaggagcugagaguucuaugucuucauccaaaggcugcuaguggaagacugacuuccaggcaacuagggugaggauuuuauacccacacccacagugacacacccauuccaacaaggucacaccuauuccaacaaggccacaccuucagauggugccacucccugguccaaggauauacaaaccaucacacucuguaugcaccuucaaaagagaacagauuaaaaagggguccauuaguugcuuuugcaucauugcgaccaaagucccucagagaacaacuuaaaguugugcaagaaucacuuugucucacgggcucagaagguucuaugaucacuugacuuugugcccuuggguagagcaugacugugacagaaauguauggaggacaaaaguucaccucauggaaaauagaaggacaggaaggacaagggaccagugaccaaguaaacugucaaaggcauccugugcucugcccccacuuccucuuccuguaagccucaccucgaaaaguuuucagcacaucccaaaacagugccaucaguuggggaccaagguuucagcacaggugccuggggguggggugggguggggcacacuucauauucaaaugauaacagaggagagaggaagaaagaaaagagcaucuaugugcauaugaguccagauuccuaggcaggcuaaauaagauagagguauauauuaauuuccuuguaguucaugaaugcuugguggggaacaguccuuugaaauuguaauuuugaccacaucuuacugacuguaaaauauagguugcuauuucuuuuacuuuugcagggcaagauuuuacacuccuuugaggugagacagaccaacagauaccuguaaaccaaugaggcaagugcuauaaaauaggaauguguuccaggcuguaaggaaacauaggaggcuuaauuccaccuagaaggguuagcgaaacuguauucugaauguccaggacgacuuaagggguauuuauaaaauggugucaaucaguacuacuuaaugagugacucaguauaauguguggaaugacuuguugguucugguuucagccacauaguagauuccgaggccagugggguuuuuguuguuuguuuguuuguuuguucagcaaauauucauuaagcccccacuuuguccuaaguuccuuucagcacccugggaauugcaagcagaugaacaucggucccugcccucaagaaagcaugcaaugauuuuguggcauggcagagagcaacggggauccuaaguguucaacucucuagagagagugcuuaucacaucagcuccaccugugaugggauauuacacauagauaauuaauaaaauaaaaagguuauauuuuuacuuuggccaacacuu

SEQ ID NO: 1123 - RNA, 199778 nt, Mus musculus
ucucagcuccuccugugccaugccugucuggauacugccaugcucccaccuugaugauaauggacugaaccucugaaccuguaagccagccccaauuaaauguuguuuuuuuuuuuuaauaagacuugccuuggucauggugucuguucacagcaguaaaacccuaacuaauacaguugggaacuucaggacagcccuuaagguuguggaaaagaacucuaaaaccaugagcuuaaaaauauguaauuucucaacuaugcaaaaauauaaggauauaauaugaauuaugaggggcuuuaugaauuuaaauuaacagcaauucuuuagaauuuuuucuagugagagcugagcggucuagagaucucuguauagcucuucaagaaucuuuucuaucaggauuucugacuugguuggaagauccaauaauuuuuuuuauagcacuuuucugacuuuggucagaaaacccaugagcuauccagauagcuuuuacaauuuugauuagcagagagagcugucucaaccacauuuuagaauaucaagaaaaagcugucuagagcagagcagaacacacacacacacaucacacacuggugguggggggcagucuggaaagccaucucagaagaaccuaggcugcuagcuuggagcccugauuuugacuuugagccaaucuuuucacagcuccccaaaaccucuucucuugggaaccccucuccaagccaaggcugguccuuggcaguuguaguguugauuuuaaauagcuaucauacagagauuuccuaacauggccauaagaccaaacauguauuuugaguaaagaagacuuuuaauauauuugaucuaauuacccacuuuuuucuugccccaacuuuucuuuugauuaguaagauguuaauaguguuggacucacuuagauugguaguuugacugcucuauguccggugaggcccgcagaagucccaggagagucacuaacuucauucuuuucugcacugccuuuccucucuucuucuguagcuaucagggguuccugcucugucugcugacauacccgcuaaaguaguacuuagaugucaauguuuauuaguuuauauguauguauguuuuuccagcauggauaucuacaugccugccugguaccuguggagaccagaaaaagugucacaucccuggaaguagaguuacagacagcuguaagcugccauguggguguuagaaauugaaccuagguccuguggaacagcagccagugcucuuaacugcugagccaccuuucuuacuuuuaaucacaacaaugugccuaugauuauuuuuuucuugucauuuauuucugccggaaugaccuucucugaaauuauuuucaucaagaauucucaugccaugauuuaccauuagaauuugaauaguuuucuucaaguguuagagaaguguugucuucuacuuuccucccugccuuuugauucugagaagggucggucuuacugaguugccucggcagggcucaagugcugcuugagcaauggucuugccaggaccuccugaguaggugagguugcaagcuuagcuacauuuccaguauuucuuaguaaggauuguauacaacuuuagggaacacagaucauuuuauuaaaauauaccaauaaauucauucaauauuuaaaauaagagcagcaauguaucaucaaggaaggaucaagcuuuacaaaaagcuaguguacagaacuaacaaugguaauguccugccaguggaaagguacagggcacccuuucuuggaacaacuuggagaagcagcaucaaggcaauuuccauuuuccuaggugaccuauuauuuaguguucauaaaccuccaaacuuaaaugugugugaggacaccaaaaguggggugauggugaugaaaauaaaggcaucaagaauuuuuauuagucuauacauuucuauuuaacaaccauaaucuuccuuaaguauacaaguauacuuuuacaggucaucuguucaccuauggagaacaggccuuugggagagaacaguaugcucucuuagacaccucaacuaguuugcuucagaacauauauaugccauucucuuauguuaguuuuuaucuucaaugacauaugaaagaucuaaaaucaaauuggcugucucuacagccaccuguaagccacucagcuuggcagugaagcaguccacagucagguuacuggcugagcccaaagcugccuguggaaggcagguuuguggugcaaaaggaugauaaguacuucuuaagacagaccagcugagcucuuccuggcuguuguacaaaccacagccacaccgugacagcguaucugaccaguuaccaacagaggcagaaucugcuugacaggaccaaagguguccauacuucgugucaaugaggauuucaccaccaucauguuccaaagagccagcaacggacuccagagcacugcaaaaugcuucagcagcaacaugcagcuuugccugaguacacccaucaucucugacaauagcuucugccucgugaugaaccuaaagaagguggccagugaaaacauacauauuaauaugaaaauguguagaggaauuuuaauccagcaacauggcugcucugacaauggaucacauccaaagaccuucuuaaucucuaugaucuggcuggaauacagacaugcucugagucccuuaccuuucaucccuaacaaugaagguaaggcuaguuuguagaaggaagaagccauguuugaaagugacaaguaauugaggggcagacaaagugacgaaucagacagagauaugacaaaaugaauuagagauaggauaugcccaacucucauaacaacagcacagaaaagagaggcuauuaagagcagagagagagagagacagaaggagugcgguguguguguauggcaguuuuacagagacagguugaaaaagaacaggguagacacaggugaagacagaacaagucagagaaugagaaagagccagaagauuagaacagauugccaauguuagugcaaggccaagcagagcaauucagacagaagcugagagaagcuagauaaaucaguuaguuagcuuagaagauuagauugcuagaagcuuccaggccuaggccuagggauaauuacaacagagaaaaaaaugcucugggcuuaauccaagccaugcauuugcacagcuuggguauggcucucaucucaucccuucgucugaggaaagcaaagaaacauuuacaaaaaugcuucagaaaaauaggauacuugaucaaaaccuuguucauaaaguuagugagcuuuaucacucagcgucuggcaacagugcugcuuggccuguaugagucaaccugcuaggcuguaaacuuuaacauggcuggucagaggaaaagucuguauuucuggucaugugacagaaugaaggaauuaacucuuucaucagcuuauucuaaauggcugacccauggucacuccuuaaauauaaaaaggacaauuuuaugauuuaaaaacaaacaaugcacaccagaaaacugcuaaagacugaugaaguacuuaucauaucagcuaaacacuugagauauguuuaaaauuauauugcucuuuaguuuugagcauuagaacaucagaugcuggagaauuucagaauucccaguaacagaaugucagcuucaacaugccuuacauagacaaugcucaaagaacaugaucauuuguuauauuagaaucauaauaaccaacacaaucaauuuagcaucuuguauuuauaauuauuacuuucuugaagucaaccacauuaucugaguuuugaaaaguuaaguagcaaagguuccuagaguauuaugauuuggccauugucucacaaaacaaaaauuguugaaaauucaaauaacguacagaggcuguuuagcuuaccuugugucugacauaugcagccaaguguguuucuguacagccaccucccaauaaaacccacgguuccuugauuguuaacugcaagacgugcauugcuguuugacaugugagcuaaggaagaaacaaauuaaaguugggaucucacgcuaguacacaaagcacaccacacucucauagcaucuuagacugugaacucagagccaggcuuuugaauuuucauuucucucucugugugugguaagagaaagggcaggccaggacacaugcguagaggucaggggacaguuuccacuauguggguucuacaaagugaaccuaagucaucuagcuuggugguagguacccagauuuuuucuuaacuuaaaaaaguuagguuuaucauguguguauguaggucagugugcacacgugcuuugguauaaguguggagguaacuugugggagucaguucucuuccucccucaugugacuccugagaacuguauucaagucaucaggccugguauucagugcuuuuacccacucagauaucucaguaguguaaaggaacagauuuuaauuuacaaagaacaacaucuauuuuaucaaaguuuuaaugugacuaauucacauuuccaauaaugacuagagaaugaaggacacaauggucuucuuucaugaaauuagauuaauauuuuucuuuccaucuacuuugcucauaaacauauggccuaaaaauauccgcauuaacgagguuuggugguauuuccauaaaaauaagucuuaaguuguauaaauguuauacaauuguauaaauuguuuuagaaaugauagugaguacuaaguaauaaguaaaaaacagaaaucucugacuuacuaaggaugaaucuuuaagcauaugugaaucuuuaaacucaugaucaauuccuaugcugucaguucccuuauauaaaauguacagaaaacaauaaacucuacucagaagugggagauggauaaugacuaggaaauccacuuucugacugaauuacucauacgcauuaccuguacuacucaguccagccauguucaaccuguggcacacgagugacaugcuucccaggauggcuacgaauguagcacaccauguuuguagauggcaaugugguauugcuaugcccaaagacuggauacuguauacaauucaaauuaauuucucagaaaaacuuccuauuaagaacuuucagguuucuuauaaagcgcagaaaugacagaugguacacuauauuccaaguuuacuguagcagccguuaaauuagcuuacuugagccuuugcccugucucugcccuccuaugguccugggauuggugcucauauguaccaagcauauguuuuaccuuugagcuauauugccaggcccuccuucugucccuuuuggucucguuauuuauaucauuguggaaauuauagaaaaauaugaaaaaccaaaacaaacaacccagaccucacccugcagacccuuugcaugacugcuucaucccugcugaaggccuuggaauccaccuaccuucagcuccucccaggcggugucauuucugcugcagagaagcaaggugcagacaguggccucauuaggaagaagaugaaaaaaauguuuggagccaaaucuugcagagcacacaucuuucacacuuccauaaguaguagaaacuauuggguuuagagaaccaauaggcguugcuccuauauuuguaaaguauaaaaaauauaaacuguguaagcaaagaugagacccuuaaaacaauaucaacaaaccaacaaacauuaauuccuagcuaguauaagggacuccaccaagcuuauuaaaaauaugaaauauaggauaaaaaugcaucuucuuagaucucugaaauuuacauucuucuauuuaaauauuauuucuucuccuccuccucuucuuuuuggcauggcauuuugcuauguaguccugucuggccuggaauucaccauguagaccaagaugaacaugcaauuauccucuuguuucagccuuuugaaugcugaaauuacaaauguacauguggccaucuuugcuuguuugggcuauuuuuguuuauggauuuugucauaguuacuuuuccauugcuguaaaaaaauccuccaucaaaagcaaguuaagggggaaaggguuauucuggagcacagcuccugacagaagagacgcuacagaagcaggagcucaaagcagccauuccuggagucaggacagcaagacgcaugcgugcaugcuagugcucagcuuaccuucucugcuuuauacugucucagaacuccugccaggauuuaaugcuauucacaguggggucaggacuuuccaggucaacaaaauuaggcagauugguauuguuuauucauuuaauuguauguguauguauguguuuguguguguugcuaggaauuaaacccagccaugccaauguuaggcagaugcucugccacuaagcuacaugccuagucuuaccuaucugaacaucuguuaaaagcuauuuugaauguucaggaaaaggcacaugaaaaaaaaaugaacauauuuuuaggaaguccaggaucccccuguuuaaaaaaaaaaaagaaccacauuaaggaccucauuacuuuugaaaaagggucagaaaaguccuuuuuaaaagaagucauuuggcucucuuuaagucacuaacucccuuuugccuaugaguuuuucuuuuaauguaaauagguaugcaagugcaaaaauaaagaauauaacacuuaauucacuauacuguucuugauucuuacauagaucacaaauuaaaauauaaauaaaggugauuucaauauuugcaaaaccucuagagguaguuaaguuauauaaggaaucuacauggacuuccguaagaaauaacacuuaacauuugaauaucaaaacuauaacuuguagcaauucacuuuuuuggagugcagauuuguuuugccgagaguuaguccaggcuguccuugaacuuguuauguagaugaggaccgaggaucuugauaauccugucucuuccucacaagugcuggaauuagguaugugcuaucaugcccagauaccagaaaauuuuaggaauuggaauuuucauuuuguguucuagguaucugaguuaaguaacaauuuuggacuaguguagaaaaccagugccugcuucccauagcacuggugcuacuggaaaacaucccacaccuuaauuuacaaauccagaauagccaauguacugggugaaguaagcugcaaacaguuaaacuaaugcaaauuaguagauaauuuagaucauaaaaaaugaauuccaaguaacuauuugcauguucuuaguaacuuucauuuugguggucacuagguugacaauauccaauguuuggcauacaugguuuuuagugaacuuuaauucaguagguuguaacucacaaggcaggugugauagcuuguggucagaacuuuaugacuagccccaaaacacagguggaccuugcucagcaaaaggcaaccacugcaaucaaaaugaacguaacugauaauuugagcuugucagugcaguuauggguacauugauuugagaggugacucauaugagaaauucaacuuauuuuuguccuaaccauguaugugugcuuugccugcugaguuugugauuguuacucaccaacuaauuuuaaaggucugagggccaggccuauuagcauccgugucaguaaagagugcccuuugaucuuaagaacucagcuauagauauucuugguaaauguccagcauagauauauuucuuggaguuauaauaaaaguggagaaaaugaagcauuccagccagaaaaaccauguccugaauguuagaggauuuaaaagcuuuguaaauuuaagaccuuauacuuauguuagaccuuucaacugccuauacaauaucugaggguuagaucacaacagacuacaccugagguugggaauggccaccgccguucuaguuuuuaguaacugggcaaugggaucuuuucuagaaacaacagacaugcuuacagaugauauaaaugcuguaaaguugguggcuucuaaaaauguucaagguauuaacaguaacacaaacuaaaccucucugcucagaaagagugaugcauuaacuuuaaugggcaaaagccaggagagccuuuuaccugucacuuugcuuagagauuccaucagagucaccccaacucugucgauggccauaacguggcgcucacugaagaacuguuucaaagauggguggauuacuuuuuggcacaggacaaggucuacaugaucagugacuagucgccuuccuagauuaagcaacugcucuaaaacugcauucucaagggacacuugguaaugggccaccaccacuccuucuccagcauuagaaaaaucuccagauaaagauguacagaagagugccacccuaaggccacuugccuuuugaguggguaauaaccuccuuaauugaacuucugaugcuucaaugaguaguccagguaauacaguagaaucuguaacucuuuggcccuuuaagggaacaauuauacucuucccuaaaaccauucguucuucuguacuuucuggaauuguaaguaaaaaagcuuucaaaaucaaagcaccuaugugaucuguuuccuuucuggugagcauacaggcugguuugcuuguuaagauacuguguaccaagcugaggaagguauguguacuucugaagucaacugggauucgacaacuacaggcuucagacuugagauaacugguacagagacucaagagguauuuauuuaauuuaauagcaguugcgggugucaaaucuagucuuugaauauuuucaaucaaguugcagcacagaauggcugugaauaagccgcagucacugaagcaggacacgugauucugcacggaugacguuaggaucuuuaauacgggaugggugacugaaagguuucgaagcagggcugaggacugugagguuguguacacacaaccucccaauccauuguguagcugcuucagccucccugaagggccauagcaugaggcuaugacuccuuucaagacagaaaguguggaccugacuuucucacuugucaaugguucaguuuuacacaacgauggcuucuuagcuucuaaccgagacauccugcuucagguguaacuugugaaggcagcuuuaguuuguucauauggcuuucauuuuauugcacugucauguguuugaacauuaaagacuggucuccagguaugagucugcacaugcagcauuaccagcuacaaaaucaagugguuucagacaauaaccagcauagauuaauuuaaugacauuaauaauccaaagucuuuauuuugcuucauucuucaauauucuuuugucugccucuggccucagaccucacagacucuuuugcaacucucuguauaaaguauguuccaagauggacgccuaugaaagucaccccagccacaagaagccaguucuuucuaauccaacugggguuuuucauuucuucuuuuauuaucaaguucagauucaaaguugcuucuuucuauaagaaauuaaaaaaauuuagaauaauuccauaauacuuuauagguagcaaauuuaguaauuuuaauacucugcucaauuuuaagaaagagaauguuaacugucacaagccuacuggaagugagaaagggaacccaauggacuuaauacuccuuugcuucuagaagacaaauggcacauuagaaaacugaggcuuuuucacccuuacugacuaguguucacaguaguagaagguacucugcacacuacccuaagagaaagaaacaucaacccagcuacgaacccuuugaccuccaacagugaccugucugcacuauugcuggugcacuagugguacaaccaugugaguaagcaaacacuacgugauuggauuuuuagguccauuucaugaaacagaacccaugccugacacugccaaaguggucaauaaccugaaaauagauacuuaaccuagaggaaaccccaguuauucuguuaagagaucauggcaauaaaaugacuccuauuauagauuagaaucuuguucagccgucaucagagaagcuucuuccuguaguagauaaggacucagagucucacaagaggaaaaugugcagagaaugagagaccuugaaacacucaauccuaaaugggaaaucuucaucaaaccacaggaaccacguggaaggggagguauaaagaguauaaaagcuagaggugauggaugacucccaagaaaaccaucuuccagacauaguaguauggcacacacauaaacucacagcaacuguggcaguuugcccagcgccuguacagguccaaaacaaaacgguuuccagugcugaaaauuucuuuauuugguguaauuaaaaaaaaaaaaucauuguuuagcuuugaaacuacgcuugaauaggaauguauaaagauaaaauccugucuguacauaacaugacagcaagauagcuaugaugguuaauuuuaacuguuagcuugacacauucuagagucacugugaugggaaacucaaugggguaauuacucaauuagugagagaccugcaguguggguaguaccauucucuaaggaaaggauuuuagaaaaaaaauuaacauauauaaauacacacauacacacacacacacacacacacacacacacacacacacacauauauauauguauauauauauauauauauauauauauauauauauauagagagagagagagagagagagagagagagaaugaaagaaaauugggugcgucagugcucugugcucuugacuguggauaugagacuagcuacuuuaaguucuugucaccuuagauucugcacaauaaagaacuguagcuugaaauuguaagccaaaaaauaaaaaaauucccucccaccuuaaauuugucaggauauuuuguuaaaguaacaggacaagaaacuaaaucaguaguugcuaguauuccuacugcacaaacucauuaguauagucugcauuuaguugaaucaaucugcaaaacaacuauauuaguauacaaacuaugcuauaaagacucgguuaaagucagaguuaauuuuauaguuuuaaguacuagucuauuauuuuuagaguccuuaguuaacuaaugcucaccaaaauguugaucaaugcaaauaaauacagaagcccuaaagaauguccuagccaaccaagagaaaagggggucaugacucgucacaaucucugcaccacacaaugucaucacaucccaguggagaugcaugugugcagcagcaguccacguaagccuagggaguaaaguccaugcugggaggcaugaaauccugacaacuuaacaaggugaagauaguagaauuauuucaacgguuauuuuagauucagcaaaaucuuaacaauaguaguuauuuuuaauaaaaucuuaaaucgucuuccuacuuucuagagaaagggucccauguagcucaggcuggccucaaauauccuagguagucaaggguaacaauuaacuccugagccucuucucuucagacauaugaggauugcugcauguaccaucagauccucuaauguuuuuucuuuguuuguuuuuucgagacaggguuucucuguauagcccuggcuguccuggaacucccuuuguagaccaggcuggucuugaacccagaaaucugccugccugugccucccaagugcugggauuuaaaggcaugugccaacaccgcccggcccacucuaaucuauagaugacugaagcaucaacaaaauuuugcuuucuaaaucaagagaauguaaaguguuacuaaaaauaugauugcagacuacuuucuccuaaagagaauuagggcucuuuguaaaacugacucauuuuaggccugaggcaaaaacuacucaagcugagauuuccaccaaagacuacuugggucacgucaaaaauccaacauaagcaccgacuuaguaagaugcaagaagggacacugaacacugcagacauggugauggccauggaguacacacuguguaaccacacgcuuaaauugacagcagauacucaaacugccagagcacugaugcauuuggaaggcagacagcauguuccuuuaccuauucuguacaaaugcauucugggcuaagugacuaauugaggggcaaaauugaagcagaaaagaaaugguccagaauuugagcagcauaauuggguagcccaaugacaagauggauuggcccaucacaguaguugguaaauuaaggccauggaccacaguacuccauagccuauuuuuguaaggcgguguacuacaagggaaacaagcuccuucacuuauccuguuuauuaguucauacagagcucaacaggaacuuuauauuuaugggcagcaggaaguaaaauguuaacguaaauccuccugucuuauuguucucuccuauauccugggauuacaggugccggccacuauacccuguccucuaauaaaaaaaaguuaguguguaccacaaucaacacaauucucagaauggaaggcauuucuacagagaacuuaaaguuuaggauuaaguggaagaaauacuuccaauugccucaagucaauucaaaucaagucuugcugcuaaaggaguuugacaaauacauagcuguuuuuuguuacuuuguuuuuacucucccaacccaccucccaguuugacuccauaucaauggauaggagaaaaaggauagaaagagggagggaaggagaaagagagaaaaagacagagauagagaaucuaauuccuuuccuuuuguuucuucuuugagcaugaauacuaacaaacugcauacaaccccccucacccacaaagaaccaucaaccccaccuccuggggcccuagcauuucuaugcucucugaaguuuccagaauuccaaauaucacacacuugcagaaacuaucugcagcugaagaaaccaugccucugcuagcucagcaggcaaaucauagcugcugagggacagucagaagcagacccauaucuccacaccugaaauccaaaggaaagcacuuucuuauacuauuucuguguuuuuuaaagacacagaaaugccacaauugucacuaugcaaaaguuuugcuuuuuaaaacuuuucaaauuuugggauuaugaaugaaggauuagagacuugaauuauauaaucacauccucuugauuucagugauuuuuauucauaaauuauuuugaacugcaaauaugccuaucuuugucuuaaaaaaaagggcuauuuggauguaccuuaacaaaaaaaauaacaguuuauuuauuuucaguuuagucuuuuucuuccugggaaauaauacacuguugaccagauuuaauggaacuuaccugaaaacugcaagauggcuacuucuccuagguuuggcucuuugguggacuugcaagucccagacuauccagcucagugguaucguccuuaggaacuuggaagacagggcugcuuuugauucugugccaccccaaauguaugaacccaauuaaugguaccauaaccaucagaacuuuguacucucuccagagauucugaaagcucauagucuguugacaucagcacaccuaagaaaagauuaaaagggaaaauuaaaucaacuccaaaacauaaauggucucaaaucaugccaacaaacacaaacaauauuguauuucaauaaaauuucacuuauagcuuggagagauggcucaguggccuugcuuuucuugacgaggaccuggguuuggaacccaacaaccacaaaaacaguuuacaaccaucuguaacuccaauuccaggggauacaacacucaggucuccgcuggcaucaggaacauauucagugugcagacauauaguaaagauaacuacuaauacacaaauuuaaaaaauaaguugacuauaaagauauuuuucaagcuggguggugguagugcacaguuuuaauaucagcacuuaggaggcagaggcagaugaaucugaguucgaggccagccuagucuacacagugaguucuaggacagccagggauauacagagaaacccugucuagaaaaaauggaaacaaaacaaagaaaaaaggauauuauucaaaaguuuagaaggagcuucugcuugggagcacugaccuagaauuuccacaaugguaugaagaugaacgccucccaguguguggggacauuugucacagugguaaaugagccuagugcaucacauuucauguucugagccugccuuggauugcagagguugaccauggucucaugcuaccugcccuaaaucagagcacaagugucuacaccaucaauucugcccuaaaucagagcacaagugucuacaccauccauucugcccuaaaucagagcacaagugucuacaccauccauucugcccuaaaucagagcacaaguaucuuauaguuacaccauccauucugcucagauuagcuccauucacccuagcucguuuuuacuacggaaggaacacugccugaacgaaguucuacaccuccaccuuguucuagucuuuugggcaaccauccauaugggccaccaagggacaacaaugagcuacauacaucagaccacaaguaucuuuaaagucuauuucuuuucuaugauggcaacucuucucuuuucacuucugcauuaggagauuuuaucucuucaauucuccaguaagacuuuagucagguuuuaugugauuguuacauucccaagcugaaagaaaugacaguaaaauggagagagaaaaggcaauuacauguccuagaaaauccuaaacacuugggucucgauaucagauuucucuguucuguaacagugccaguuaaaacaauuguuuaguuauuuucuacuaacauuugaauacaggguucuuugacuuuuuaaaaaagagauucuuauucugucuaugagguuuccugggcgccaucugcuggcauucugggcagugugaaguuuccuucggcuuaaaauauaugaaaaacaaaacacucaugaagagaauaccagcgagguucuuaaaauuaauugaccuggcucuugugcuugggaugucugauauuaacuauuacuuugucuuuaaugaaaauguugauguuggauaguuguaaauuccaaucauugacuugaauaguucuuuuaaaaauacuguccuuauaaaaacaguuguuauuuucaauuuaagcaacaguccaaguuuggucuuuaguguagacaccaggcacaacugaaaaaauggcuagaagagaagauucuuaaaguuuuccucuuaaagaaacaaccuuugaagaaauagcuaugucuaacuggacuuaaucaucaugcagcauauagugccguacaaguacagauuuaaaggaaaggaauccauacugugugcacgccuaaccuguccagcauggcaaagagaagaaugguuugcccuccccccacacuuuguagauaucuccccuaaaauggcacaaauuuuguuagacuuuucuagucguguaaauacacauacaccaaauuaaaacuaaacuucuacucccagugagccaaugguuugcaguugaauucuacaguuuccacucuacaaucuuacugcuuuucucacucaccacucaaggacagcuugaucaacaucuaaguuggggaaaucuauuugaugucaguaaagguaauuaaaaccaaacaauacugaaaaccuuauaugagcaugucacuaacuauaaggucuaaaaugcaacugauggaugccugagaaguaccaaccuucuggcagucugugauucauuagaaaggacacagugauuuagagcugucucagaugucucccauuccauuccacugauuuuuaaaauuaucaucuaauauuauuauaucugaguuauaauuauccugauugucaucuggccuuggcacuaguguggggaaagagaauggaaauuaugcagacuguucuggauuaaguguccaguuguuuggcccucagugugacagcaggguuuuuaucugucucuaaauucaaagggccaauuucuacccuucauccuuuuugagauuuucauuuuuuucuaccuuuguaugggauacugaucccucuauuucuuguccagucuguaaaaauguacuuguucuagaucucauuuuaaucuucccuacugccuagauuaaguaagcgguacuucuguuaccuauggucuagucucauuugcugucaguuccaacccuauuggucccucuucuaugucaaccuacuacucuuaaaggucaucuuccucugcacgcuugugaccauuuuucuccacuauaaagaaacaaagguuguaaucucaggccugggaacuacaagagagucacugagaagauagcauuauuccaggucauccauccuucagcaaaagagcaaauacuuagaugacauaaaacugucucacaacuaauuaaaacaacaaaaaccaaacugaucugagucaugaacaacaacaaacuuucuuuccuuccaaacugcuguuauaccuguauuuuauuggggggggggggucagacaaaaagaaagagaaagcagggcuggagaaauagaucacucaguagcuaaaaucuuuugcagaggacccacauccggugacucaaaaccaucugcaacucuaauuccaggggaucugacagaccuuuaggucuuuaagggcaccugcaacucagugcacauauccaacaaggagacacacaucuauacauaauugaaaacaauacaagauuaaaaauauacuaagcuauccaacucagaaaucuggauauaauguauucuacauuuccccucacucuucaagacuguccacauccugacaucucagaugaucuuccuaagaugcagugacgacacuuaggaccucuaaaugacuuucuuguuuuguggucucauuaucaguagcacuagucacuggggaacuuaguagaaauguaaauucucaggcugaacaaccacagaagccaaacuccaggguagugucgaggaacauuuaauacgauucucaggaaguccuaaagcugaguuuacaggcgacuguuuuagugaccucgauugucacugaaaaccuuuauacuccuaacaggguuacaguuuaaucuguuauuacagcauacaaaggccauccagauuuaguuuuucccaacgaguuuucagaaaaucgaguaaaccaggucaauauggcugagucauaaagcaauaacuuaaagggaugaacuguagauuccuaucgccuggacuucaaaucuccccucaauccucuuuacaccuguacugucucagcuaagucacuggcaagaguacuaaugaguuccacaucaagaaccugcugugcaauacacgcuccugccgcagccuggacucagugauagauagguaaggacugguacucagugauagauagguaaggacugguacugugcuuugaucaccggaaaagggaggauguguuuuuccuuugccuuaaaaaaaaaaauguuguugagauuccaugaggcagggucacauguaaccugugcuggccuccaauucauuaugcuagacaagaaaaugaaaauaaaauauucagcugggcgugguggcgcacgccuuuaaucccagcacuugggaggcagaggcaggcagauuucugaguuugaggccagccuggucuacagagugaguuccaggacagccagagcuacacagagaaacccucucucuaaaaaacaaagaaacaaaaaaauuaaauuaaauaauaaaauaaaauuucagauucucaagaaacagguuuugugguuuugugugugugugugugugugugugaaaguguggaagccagguaagcaaugaaggaaauaagaaaacuuuuacagcacagaaaagcugcaaagacagaauggauggcacuuauguuugucugaggacaguuaauaaagaguuggcaagugaucagaugugugaacuucuggauaccuaaucuacauauacagagguguuaggcaauaccagaaauuuugagcaaacaugacaaucaacuuuaacuucuauuacaaauuaguuaucuucagaaaauuaauuagaaaccaguaaauaacaauaacgaaaaaccuccagaccaccucacauccaaacuauacauaguugcuuauuugggguaaucucuccauggcagguugugcauguuugauaucaacagacacuaaccagacucuguguccacugaggugccugggucauguucagagaauaaggggaaaaagcaagaaaugaugagagauauguaaaucucagaaacuggcuaacaacccgagaguaaaacuccagaaugacaacugucuuuuugcuugccuugaguaguuuaggcuguucauuucccccaacgugucaacuuauugcuuucucaagaugccagcaacuguaaauaacgugcauuuuaaagguauuuccaguuccuguggcauuaugggucugucauuucaguuacaauucuugugcaugugaguuugaggaagcucuauucaaacucuaccugauauuggucacuccuccucacccacacugauccaucaucagauagucacauccugaagcuacuuuguuuuuauuguuguuguuuuguuuaguuuguuuguuuuccgagacaggguuucucuguguagcucugacuguccuggaacucacuguguagaccaggcuggccuccaacucagaaauccgccugccucugccucccaagugcugggauuaaaggcgugcaccaccaccgccccgcucugaagcuacuuugaaagcuguccuugggccaauccgguagccaggugccucuguauccccgcccccaaauacccuugucccaaccacucgcgaccuuuccgugcggggacgcggugaggccgcaggcuggcuucuccaccagcggccuggccccucucaccugcccaccagcagcugcaccucuaggucaggccaccuucaccaccagaaaccagaaaucgcgcuugcacagcaaccaaccacgcagcggagcgccaccaccuuugcccugcgcggcaagaaggcgcaugcgcaacucuaugcucacgcgcaccaccccuccuucccccgccccucuuccgggguuugcgugaagcucccgcaaaggaaagcugcggccgucaccggaaaucuuacgggcagacguguauucugucugugcgcgcuaccaaaauugaaaggucacaucacaucacaucacagcaccaagaagguggcagagcgugcggcucucugcucucucgaaagguauuuguagaacgaaugaagcuguuaccaguccuagguggcguuuccucuguucugaccaaucacaaggcgccuugcccugucacucaguugucaauucccaccucucucaggacgcccuaagcuguagaaacuggcuccgcccugccgguccgagugacgucagagagcgaacaugcgcagacagagccugucgccaugcaggaaacuuccgcccagucuaggagcgggguuggcagaagucgggagucuucaauucagugccggauccgguugguuaauuuccuuggcuuugccuuucuuuuuuuuuucuucagagauaagucuuuuauucuuuugaaccacccgaagcauuaugaaauuauguuuaaacauauuuuauuucgcuuuucucuggcaccgugaaaggcaccuuuauuuuucaacguaucuuuuaaucuuccucauuaaaaauauuuucuacucuugcccuauaguuuugugauacgaaaaacacggcuuuuguuguuguuguccaucaguacauaucguugacguacagugauacauuaucugccaauuguauuuguggcuuuuccaaccucuuaaaaaaaaaaaaaaaauccgcuuuggccgccauuuuuauuuuggucuccauaaagcguugauaucaucgacagaagccauuuuucguuugggcaguucuuuccggcuaucccauuaccuuagccagggcuucgggcgccaucguaggugcuggcaguggcuuccaaccgaaugaagucgauaaugccaucuuguguuugggcgcugguugcauucucuaacgugcgaggggacgcugggaaacgggaaguaagccaaagcugcugaagcuuggucugccgccuuuuuagucugaguuuucccguucagguacuauacuaguccaccagugaccccggacaguaacaaagcauuacagcccgaacccaccucccgccaccaucguagguaagagcgugugauacuucguucggauaacccagcucuucccucaguuggaccgaacuguuuggccaucuuauaccaauacguauuuuuguuuuggauuuugggacuuaacacaauuuuucucuuagguauuccuucucuuuccauuagaauuguuaaacaccacuguucaggaagacugagauuuaaagggacaauaacguugagggaauuuccguagaauaacaaagcaaaauggauggaacagcaaauuugaucauuaauuguauggcuuucugcaucuauagaggugaauauagcucccagaggacuuuaaaaugugaucagcuguguuuguauauucuucccauucauucauucauucauugaauuuguugaauacuuagcuaguuuugugcuauaaaauauagaaguaaacuucaaaacaaaacaaaacgaaaccuccuuuucauccacuugcuuugauauauccaaagcugggaccaggaacauaauguucuaauguuuuuuuuuuuagcacugcuggacaagcaacuucauguucucacuucucguauuucuuggauacuguauauagccauaauuguaaggcuaauaguccagguagcauggccuuguugcucaguguaaucaucgaccagccaucccagcaucuucugggagcauguuucuuggaaugaguagaagcugcacuugggcacaguauaauagugacuuggaaacuuuggacuguggcuuaccuuagcuuuuuguagcaccaggcuuucuucugugucuucuuguaugagaaaagaaaaucaguaguucucaaccuuggcugcccaugacagucaccugggaagcuucuaaaccagacuucagaccaguugcagauagaaauggagacuauguggaauauagaugacacuaagguauuugagacaugguuuucaugcuguuaggcguaagauugguuuucaccuucccucuuggcuuuacuuaaaauaccauggagacagggaggaguauuagguuggguggguguugaaccaaugucccagugacugguuaccuugucaaccagcuucccaguaauuguuacuuugccauauaugucuuuuccuuagucuaagugggaaagaagaaugaacaccauuuguuuuacugagucucacaugaauguuuccauuguggauauucauguuuuaugaguauguaggaaaacauuauuacacugaaauauugcuuguuugcaauuuuuacagugcuacuaaggguagugauguaguguggauggguaaaaaaaucaguucugaaacgucuucccugacuguacauccuacuuccuucaccccagcuccaucucugagaucuaaaagacaguuacccacccuugugcuugaguuuccuaacuuguaagguaggacuccugugagaguuagcuaaguuaauacaagcaaugugcuuccuaaguaccuggcaugggcuggagagcuggcccagagucaagagcugugugcuguucuagacaaccugaguuuaguucccagcaccuaugucaggcaguucacgauugccuguaacuccagcuucuugggaacucagaggugucugaugucugcgggugccuacacucacaugugcaaaggugcacacagucacacccccaugcacauaaauuaaaaaaauucuuuuaagaaguaccuggcauauacuagcagcuaugaaaauauuaccuguagcuguauauuuuauuauauuauaauuacaaguuuggauuauuaagauuuuauuuauacauucccaugacugaaauucuuuggcuuuccacuuugugcaucaauuugaaaaacaagguggucuaaauacauuacccaaggccaggaagaugauuuuuaaauacauuuuuuaaaucaaaagaucuucuuuuaaacauagccuuauugagaugaaguuguaguacaaauaacagcauuucuuuaaaauguaccaggugauguguuuuacauauauaaacacuggugaaucaucaucacagucaaauaaugaacauaccuaucacgcuccaaaguuugaucauguuccuugguaauuccucuagcuacuuuuuucuaggcagcugcugaccuaucaguauaaacaagcauuuucuagauucuuauuucaauuggaaucucguacuaugguuuuuaauuugagagggaguaugaguaauuauuuugagaaccaucuuuguuauauugauagcucauuucuuucuuucuuuuuuuuuuucuuccuaguuaguuuuuuuuuuuuuuuucuuuuguggugcugcaaauugaagucagggcuuagugcuuguuaggcaagugcuuuaucacagagcuacagccacagacucuucagccuguuugaaucgcuaacugcucucaguguguggcuauacagucauuguuacaacucacuaacugauaaccauugagauuuuuguuuucagugugcucauuuuugcauaacuauguucuucuccagauuauuucaauagaaaaaaguuauuaaaaaaguuauuuagugcugucuauauacuaugaaaacagaagaauauagugguaaaauauuuuguguugggauuaccuuucucuuauauaguuuaugccuuaauuuuuuaugaaaaaaauaugccauuuuagaaaugcaaaauguguggcuggagauguagcucagugguagaguucuugccuaauaugcaugugguccugggaccaaccugcaacucuguauuuaaaaaaaacaagaaaauucaggucucaggauugaacauuucacuggcuaggcaagcgcucuaucacugagcuauuauucuagcuacccccggcccccgacauuuuaguuuugaaauagagucuuacuaaguugcccaggauaacuuauaauuucugucagucucuggaguaacugggaucacaggcuugaccaccugauuacuuauuuuuauucacuuuuuaaauuguguguacacauauguaucuaugugugguuaugugugagugcaggugccuguagagcucagggcaggguguaggaucuccuggagauggaguuacagaugguugugagcugcugagguagguagggacuuacucauguauguccaaugcaagaacaacaaggucucuuacugcugagacauuucucuaggccuaggauuauuaucucuugauuauuaucucuuagauauauuacuauaugucuaaucauuuaaucugccuuaaaucuuuaaaguuuacuaugacuauguuacuuuuaaggcuucuggacaguaauccauguacauuagagauuuaugagguaucacaguaaagauuuacaaagguacacuagagacaucacagagcucccagaauaccacuuauauuugaagguuuagcguuucuguuauagaaaaauggcccaccaguuucuuuuaauaguacugacauuuaaaauaaaccaaagcuggcuuaauuugauuuauguuacuauggaggcaauauaaaauacugcuuuuaaagcaucuuagauauaaaaguuaauuuaugucacuuugauuuauucucuagaagauauuaauguuuuguaauuagaaauauuuuaaauuggcauggcauaaaaaaagguuuagcuuccugaguuuugacucauguguggaguuacauaaccaccacugaaaucaugcuauggaccaugucuguuaccagccucugucucccacccaacaguucccacccaauuucuucagcuaccccccauaucccucuguccuuccacccuuaccaaccagugaaccaaugguauauucucuaauugauaccauuuuugcacaaaaaaggacucgauuuuaagaaguguauguuaaugauuaucagaaugccuuuuguuuguuuuuuccuaugaaggugauugggaaauaguaaucaugagaaugaacuuuagguuauaaaguugcaugaugucugcuuguacauuaauggcucuguuuaugacuaaucuuccacagagaaucuggcacagagccaguuauugacauacaugcucucagagcugcuauuucaugggaagaacuagagacacagaguugaacaggcucgggcauaugaaaaggcagcauuuagaaggaugugcuuugcuagagucugaagacaggauuggagugcaugagggcaucugugugugugcuucugauaauggaucagugauacauagauguggacuaucaguuaagcaucccaugcaggcuuugcugggcugaagaugcagcaggaaggggagcccuaaaucuugagucauaugauuaacaugaccaucaagugacagaaaaguagaauccauacuugggauugauccuguuacaguauuucaacaucucgucaacauuuaauaagaaaggaaagaaaaaaaguuagaauuuuguuguuugaaugauguuuuccuuguugaugcuuguuuugguuuguucuuuauaagcauucuaggcauucaaggcuggcuccuaagucauaggaacagccaauucuuuuuacgaugagguuuccuuuuaaccuuuaucuauguugucacugguaagaggguuuuuuguuuuuguuuuguucaucugucacucauugaccuuauauuaaguuuguuacuggguaugaguuuaacaacaaaacuguguuugguugaacagugaugguuucuuaacguuuuaaacuauagcuguaacagcagaaauucuaggccccugcgguuuuuuguucuacuccaauagcuagagagcuuuuuaagaugauagaagcacaguaauuugcuaguugaaauuuggaauggagagguuggaagccuagaguuaacauuuggccucuuaaacugggaugacugcuuuggaaagcuugucacacaggccagaaauacugaaagaaagacaaaugaggauuuugcauugcccuagauuuuucccacagaauaaucuaaaaggucacugacuuucuuuauuugaguuuaucucuguucuguauuuaaaugacagggaaaucaugugguagugucuaaucaccuucuauuccuuccccaaauuaauuuuucuaagaagcuuagauuguuugccucccugucaguacacacaugcaagcacaugaguuuuaguggcacugcacauuauucaaguaucuucuuugugaaggaaugcuuguuuucaguuuagagaagugggcucaggaaugcagaauauaggaugguuguauuuguaagauuuaugaugugcuggaauuccuccaugggcuuauguaaagaguauggugucuguguacuuggaacauccaucuuuugggagauuguccuggcuuucauaaaacuagucaagaaaauaaagaugccagugccuuuuggcguuaauagauagcacuguggcaaagguuuuuugacauuagagcuugaaacccuaagcacugggcuugcugcuuuugcagaaaaguuguuuccaaguuuacaaccuaauucugagguuaauaucuuuucuauucaaaugaguguuagaacaucaguauuuuaaaaacagaacaauggaaaaacaaaucaaaacuacacugaaguagacagaauuucaaccagaugucugaucuguuguccauuuaauuuuuuaauuuauaucuauuuauacuuuuuggugguuucaguguuuuagagcuaaggauuaaacccagaggcuuucccauguaaggcaaacccugagccgcauucccauccucuuuguaccuugcucccaacauaaagcacuaggaucuacaucugaaucagagcucucucagccgucacucuaugggauguuauguauuuaauucaguauuuauuauacugcuugucugcaaaaaucuguucagaguacuuuggcuuccuuuagaaagauuuaauguagacugugggauuggggacaauaacgcuucccuggauaaauauaaaauauauuaauagcauauagcaacugacuguuaggacaguaagaguugacuaagcaaacuucacuuguauacuuguguucaguuauuaaaaaggaucugaaaagacuuugucuuaggaagcuuacaguuagguaaaggagagaccacaagguccaggguuacauggccucuagugagcugaguaugaggguagaaguguagcuguggccaagggagaaacaauucaauugaaacagacccaaagcacucuaaggaacagguggguccacuguuggauguugggcuaucgauaggaugguacuuuaagagagagcguuccauccuucaguauguguaggaagaaguagaaguuccuauagcuccgucaucaaagacauuugcuauggaauacuuggccagauucucuuccuugaaaggauuuguauucuggcauuauuuauuccuugaacuaccauucaauuuaggaugguagaggccuagaaauagaagagaccuugggggucaccuugcuaauugagagguuauuuuccaccauccuguggaucaggaauacuuuacauguggggccugcacuuugauucaguagguagaggugcugaagcauaggccugccacucucuguaucccacaaguuggcaggaaaugggagauuccugacaguuguccuauggccuccaggugcagccauguugcacaugugugcaugugcacacacacacacgagagagagagagagagagagagagagagagagagagagacagagagagagagagagagagagagagagagacagcagagacagacagcagagacagacagagucugggacugagaaaaccucucucacccccuguacuggcuaguuuugugucaacuugacacagcuggaguuaucacagagaaaggagcuucaguugaggaaaugccuccaugagauccaacuguaaggcauuuucucaauuagugcucaagggggaaagguccccugugggugggaccaucucagggcugguagucuugguucuauaagaaagcaggcugagcaagccaggugaggcaagccaguaaagaacaucccuccauggccucugcaucagcuccagcucccugaccugaccugcuugaguuccaguccugacuuccuuuggugaugaacagcagcauggaaguguaagccgaauaaacccuuuccuccccaacuugcuucuuggucaugauguuugugcaggaauagaaacacugacuaagacacccccauacagagaaucuuucccggaacacuuuucagcuuguggucuguuugccuuuaugaucucccugaaaguuuucagucacuuauuggguggaagucaggcauacaguguaaaguugggcauccucaugggaagagaaaagucauguagaguuacaaaaauaacuacacauacuucauccuuggucaagcuugcugacagaaauggauccauucuccauauagcugaucuauuagacgauuucuaaguaucucucuaaugggggucuuuuaagaguuuagcuguguuauucaaacaugaauuaauguauuuuagagaacugauuuucuauuuaucaggcccaaauaauagaauuuuaaagauguaaaguuuuuggaauaaucaguaugaauguccaccuccuuguaagcuuuuuuuuucauguacauucauguuuaaauauuugaacaugcuuaagaugaagauaagcauagucauucagaugggggggcaugaagcugguuauaguugcuuaugcuucuugaaauguuaguacucuugagggugaagcacaaguaucaagaguuaaaagauauccucagcuacguagcgaauuugaugcuacccaaggcuauauggugaauuuguggguaucuuugacuacauagcaagauucccaacugggaaaaaaaugaaaaaagaagaaaaagggacacuaauaauuaaaugaguuagaagguaguuagaagauauuuugucuacuuaacaguuagaaugaauuuagccagauggugguggugcaugccuuuaagcuaaguacuugagaggcagaggcuggaggaacucugaguucgaggagagccaggacuacacagagaaaccugaucgcuaaaagcuaaaaagaaaaaagcaaaacaaaaaauuagaaucaaauuuuaucagauaaaaaaaaucaucuaaucuaaaaauagaguaugauugaguagguaguaauuaugaacacucauuggagaccacauguuuguaacccauuguugugugugugugguaaaugugcauggggcugggggcuuuaugcagagaacagaggaggccuuucugcuuuauucccugaccuguagacccuccaugguuuuaguuacauuaaaaacaagcuuccugcuucaaccuuucucuguccucacagcagugguguaauagguuaacaccauuccuagcuucugucugucugucugucuucccaugggaccuggugauuugaacccauguuuauguggcaagcauuuuuaccuacggagccaucuacccaacacuaaaauauauuguugaaacaauuucaccuguuucuguuggcuuuaugaaauauagcuacuagaaaauucuaaguugcauuuggugcugacauugcauuucuuuuguauuccaguguucuacaauuauugugcacaaaauuucaaaagacagcuagucccccauugggcuuauggauagugcuuuucccacuucacuccaucauauuaacucucuaccuuguucuucagguuggugcagacuuuuaacucuuaaggagcuggucgacauuaguaaauaacuugccauuguauuucuguuuuaucgugacuguuauuauugauccucggcuuugguuuuggaauauuucaugaacauuaaagauaguaauuuuugcucacuuugaguuuuagucucuaaacagcauguauauccauucauaugagcacacguguggucagcauauauuguuuaggucaagacucaguguuuacuaucaugacuauaaauguuagcuagccauaacugugcuguguguucaguacucuuugccuuuuggacauagaucuuguuucuacuagaauuaguaauugcuucuuacucagaugcuuagauuuccauaugcuugcccuaagucagucucauguucuuuaccaagaacauugucugaaauucaguucuaugccuguggaucugacaggaugugcuguucuuggagcccugagaucugccuaucuuuuguagcugcuccccuuuguauguucagcacccauaccaggcucuccuuucaguauuuuuagcuucccucagccuguuggaaguuggaaagaaauacucagaacauugaaaguguuucucccgugcuuuagagcuuccagggcugguuugugcaauuuagaucaaauucugguaccuaauugagccuguguguucuagaucuuagucccaacuuguuuucuuuccacucaaaauuucuuuauggauuauaccagaaauguuuuuauuuccaucuuauuuuuuuguguuagauguccuauauuguucauuuaguucugucuuauauuuucauuguuuucauuuuuuuugcugaaguuucugagaaauuuacucaacuugauugcccagccuuucuaguaauguuuuuuucauuuuaccuaucacagcuuuggacuuuuuuuccccugaaaguucucucauuuagaagguuuuuguuuggguuucuuucaugcuaggaucugggugugugacuucugguuuauacuugagcuggaacauuaaaaugcugacuagcauguccaugggucucaugccagugaaccucguuuuagucccaucugucuaaguugcuagguugcuuuugggggaaacucagauguccauuguguguggguuuguuuuuuuuuuuuuuuuuuuauuucuuuuuauuuuuguuuuguuuuguuuuuuugacuccauguuuucaucaacucaguucccuaaauguggauuuuucauuuugggucaucuagguaggauaggaagcaugugacuuagaaagucucagcuugacaagagccugauaaagcugucucccgagaggcucuccuagugucucacaaauacagaaguggaugcucacagccaaucauuggacugagcacaagguccccaauggaggagcuagagaaaggacccaaggagcugaaggggucugcagcccuauaggaggaacaacaguguggaccaaccaguauccccagagcucccugggacuaaaccaccaaucaaagaaaacacauggugggacucauggcuccagcuacauauguagcaaaggauggccuagucagucaucaaugggaggagaggcccuugguccugugaaggcuuuaugcccuaguauaggggaaugccagggccaggaagcaggaguaggugaauuggggagcagggggaggggguagaugauaggggauuuuuggaggggaaacuaggaaaggggauaacauuugaaauguaaauaaagaaaauagcuaguaaaaauagacagaauuauuaaaaaaaaaagaaagaaaaagaaagucucagcuuguaagcauccccuauuuucucucugugugucuuuaguagaguuaccuacaugcuuguaauuuucuaaacuagagaucauuugauuugauaaaagggauuauuuuuccuuuuaaugacaaaaaauauaccacaauacacacaucaguugauacuugguuuaucucuauguuuugguuauuuugaaugauguugcugugaaacuccuuuguguuuuuuguuacaaauaaugcuuuuauuugucucugguaugucaucagaccuacaaaaaaaaaaaaaaagcauuguuaaauauuuuauguucccacugggagugcaugagaauuccagcuuacaucuuguaaacacauaguguuguuucuguuucaauuuuagccaucugugaggauauaaagugaguggcauuuuaguauaauuuuaauuuguauuucuuuaauagcuaauggugguaggugcugguucacauguguuuauugacaauuuaaaaaucuucuuugaagaaauguuuaaguccuuugcccauuuuaaaacuaugauauuugguuauguuuuguuuuguuuuauaaggguucuuuguauauuuuggaugugaauuccuuaucaguuguaugauacacauauauauucucucauucuaugagcuugugcuggcucuguuuaaggagauggcucaguuggucaaguacuugauguacaaacauaaagacuuggaucuuagauaccaucguaaaaacagugguaacaaugucuguaaucccagugcaggauagcuggaagagcagagcucauuggccuaugcuaguuaagucaguuaacuccaggucaaggagaguucaaaagauaagguagagagagacuggugaagacucccuuaagacuuccauacuuguguauacacauguacauacccagaggagugcagauuaccccccccccccacacacacacacacacugcacacacaaaucaacaguaaaaagucaaaauuaaaagggaaaugacuaaauagauggcugugaaaugugaaagaaaguucuaauuacagcagcagccuccucaagguuguuuaugaacugugacugcuucuguguguguggaagagaggaaagcagagcacagaaggagguaggugagagagagaaaaggaagagagagaauucucugcauucaagaacaaguuauuugugaagaaaacaguuugauuucuuccuauucugaugcuuuuuauuuucuuuucuggucuaauaacucucugauacaguuuucaauacaaguugcaagagaagacauugucuucacucaucuuagugugaggguggaguugcucaugucuaauucuagcuaugggguuuucucuuucaaaguauuuuaucaguuguuacuauuauuugguuguguguguguguguguaugugugggggggggguggagggagaggcaggggagagacuauaaugucaugugcauaccacagcauguguuuaaaagucagaggaucaacuuuuuucuucucuuuuuuauucuuuacuccuacauuauaucccaacuucaguuuccucucaauauguuccucccaguccuucccucuccaccuuccuucucccuaccucuucaauuucccuuccaaacaaacaaaugaaaaaacccaaaccaacaccaacaccaacaccaacaccaaccaaccuaaaacaaaauagcaggacucccaggauaucaacugaacauggcauaagucacacuaagacuaggcacaaacccucacgucaaggcuaaaugagacaaucaguaagaggaaaagggucccauguguaggcaaaagaguuagagauuuaucuuagucccacuguuaggagucccacaagaacaccaagcuacccaaccauaacguacaugcagaggaccuagcucacauagagagauccugugagcuugccucuuuagucucugugagcugccaugagcccggcuuaguugauucuucugguguccuugaccucucuggcuccuacaauccuucuuuccccucuucucugggguuccccuggcucugccuaguguuuggcugugaguuucugcaucagcucccaucaguugugaauaauacuucucugaugacaauugggcuaugaguauagcagaauaucauuaggaauuauuuccuugacuuuuuuuuuuuuuuaaaccaguuguuuuagauucauuacuggguuucugggcuguucugucuccaguaccuggcccuccaggcagugacaggcguggguucccuuuccuggcauaggccagaggacaacuuuuaagaguugguacuuucuucuuucuaugcauucugugagucaaauucuauuauuauaugaucugugcuacugaucacuuuuuaaauguuaagcuaccuuuuucauuccugagguaaaugugacucaguuguagaauuugguagaguacuguagggaagugagcugagcuugagcgcuugcuucuggucagcuucaagauuaccacauuagaucacuguauaacauuuuggguaagggcaauuagaauuaaaauuuuaucuuacacuucuuacugauauaugucaaaucuuccguaaaacaucccuccaaagugauauuuugauauagcuaacuauaguauuuguuuuucuucucugcagguucuguaccucacuugggaaucaguaaaccauggcaucuaagaaauuugccguuaaaguaaguaauauuuaguaguugccuuuaagaggucacucacuuuuucuugcacaaauuuugauguuuuuaaguugaucucuacucuuuaaauuuacaauuauggaaguuuuaaguagauaacaccaaaauuuuaagaagagauggaugagaaaacuaguaauucuaacaauuauaaaaagucuuuguugaaaaucuuuuauuuaggauacuuuuugguuauaacucuguucccaaugcuaauagcaaucacacugaauguccaugacuuuugaggauaacagaacaggucaaagucaaagaaguaggcaaugcuguuggaucugaguacaucugagagaaugcucccaauugucugcugccuccucagccuuuauuguuagcuaaacacagaguagaggcaucugaggaaggccucagugaggaguugccuggauuagauuggccauauggauauauagccauaucuaagagagagguguuguuuuguucauuaauugaugcagggaggccggagcccacuaugggcaguucucucuuccuagacaggugauccugucuauguggugguccugggcuaagaaagugauauaagcaugaacaugugagugaacuuugagaaagcuaaugggcaggccaacaaugcaguuccuccauucuuucuacuucaagcuccucccucaaguucaggcccugacuucccucaaagaugggcugugauuuuuacuuguaaacuaacucccccauccuccugccucucaaguugccuuuguccaauauguuaucacagcaacagaaagaagacuagaacagcugaugucuuucauuuuucucuuauaaauacuucucuauccauuagaugaagagcugagaccuuagguauugagugauaaaggauucuauguggggaagaucaguggaagacugauaaauacuuaaugugagcucuuggagauaguuucauauacauuugcuguucucuuaguucuguagugguguuaccuuacauaacaaguaaaaacagcaggguagacuggugagauggcucaucagguaaagggacuuggcauaaagucugacugauccucaguuguacuccugagccccacaugguggaaggagagaaccaaguccugcagguucccuuuuugcuugcacacacacaaguauauguaauaauuaaaauaaaaaacaacaacaaaaugguaaauuccaguauuuaacuaaccagauugggcuggagagguggcucacagguuaagagcacuggaugcucuuccagagauucucaguucaauuccaagcacccauaugguggcucacaaccaucuguaauguaaucuggugcccucuucuggccuguaggcauacaugccaucagaacacuguaauaaauaaauaaaucuuuaaaaaauaauuaacuagauuaugaacuaauauaauauuauuauguuaucuuagcuaaauuggugcuuguuuacuaauguauuuauacauuucauuguuuacaguuacuucuggauacauaugcucuugaguauuucauaagggugucuaaguggagaacauucacuauuugucuauaaaaauguaucaugauuuuccucuagacuagagucuagaaagauauuaaguuguauuuuagaaugcuaguuugaacauaaucuuaaagaguagcaagauucugucucaaaagauaaaaguaaaauugucugaugaucuaugacauuaauuccagcacugaggaggcagagguagguagauaucuguuaauucaaagccagccuggucuacauagugaaacccgggagagagcagagagaagggaggggcggggagaugauucaugacuuaaaauaauaaccuaaaaaacuacugucaugauucuuuccugguuuuguauagguggucucuccuuucgauguuagcugggucuggugcuauugcaucguaugauacuguacuuccuugcuguuucuuccuccccucccugcucccaggggucuagaugaauggaaccauuguuuucacuucacuuuuggguagagaagcgcaguuuuaguuacauuuuucaccaaugucaguuaccauuucucaaaggaaugaaguagaaagcucuuuugaauggcuccugcucuggaaaacuuaaaccuuuggucauagacaaacugagcuuaaaaguauuaucuacacauuggaauuuuccccaauucuagauucacugcaagugacuccauuucuaaguccccacuuccugucagugccucugggacauuaugaguccagcuuucuagcuuccccagugcaucuuggcucuagauagucugacagccuaggcuugacccucauuaaguccugguuguagauaaugcuauggggguuuguuuuuacucuucuuuccagauaaccaccaguuucuaaucuauauucuuucuuuuauuuacuuggguauaucuucucuuccuuuccuaaguucuuaaggcagaaaccuaagccuucgccaucaaacuuuuucuuuuguguauacuuuaaagccauaugguucugucaaagcauuucauacuuaauuguauccuucacaguggaugcaauuaaggugggcauuuagucaaagaaguccuaaauuuccuuaugauuuaugauuuuugucuauuggcuauuguaaucucuguuguuuucuguuugggaauuucuauugauccuauuuaauuugcuguuuagggaaguucuguuuugauaaaauacugcucuguaagcauuugaaaagugugauaucuauaaauauauauauauauacauauauauauauauauauauuauauaaaaucagguauaguaauauauaauaugugcauguagaacaagucagauuugacaguuuuguuauaucaguuuauuauguauuugcuaauauuuuuguccauguguucaaucaguugaaagauacauuaaaguaucccacugugauuuaauauuuauauauuucucuguguaauuuuauugaauuuucuuuguuuaguuugaaauuauguucuuagauacagaaaacauuauaguuaagauaucauuuauugaauuuauuuugagauaucuuuuuaucucuauacuucuuaaauuauagucuguuuuucugacauucguguaaccuacguuugggaucaguuaaucacacauagacuccuaugggagucugaaagccugucagucagccaagcccagccauauguucagugcuuccaauaccacuucauuguuuuaauuaugaaugaaaaauagcaucuguacaaauuuaagggaaacuuagaauauaagaaauaaagacuaaagugaauggaugaacccagaaagcucgagagacuuuugagaaggaugaaaauuguagaguuugauauuauuuucauagcaaaaggaaagcuguuauaauuaugaaacaagaucaugauguuaugaacaagagacauuuuugagaauaggaaagaguacuuauaaaacacgauagaacacaaauucucugaucugccuaucaaggaauauugcccagaaaccaaaacacaagguuguucuaaaaaugugggaagaaaaaaaaaaaaacaagaaaacuugaauuugguguugaugugaaaaguugacguucuagaaaaaagacaaauauuagaaaagaacaccaugaaaaaaaaccaguguaauaaaauuuaccagcaaggacacaauguuccuuugaaggguugagugagaagccaacaaaaucaaugaaaagguauugugcuuauaagcacaacacagagacuugugugugaggggaggaggaggaggaggaggaguaagagggaggggaagcaaagggagggaggggcagauggaaaggagaaagagaacaacacagagggagcagauaaagaaccuggauagccugcucaacagcaagagcaaggaggagacaacaccaacacccacagugcucaugggugagccuagacggcucucacuguccagccuuuaagcacauauuauaauggaauagagacauuuucagagcugcuagcucaggucaggaaaauuuucuucuuguguacccuauuguaggacgugguucuccagcaugggaguaaaaacaguuuagacaugagauccuggaccuagaaaguuaagacacugagggucuaagcaaaucucaagcuguugacugugcaucauuuucagagucuagucauuuugauuaguacaggaaggaggguuccuugcaagauaacaaacacugaaggagauuacccccuccccucacccccacucuguuagagaacuugggaauaauuuagucauaggaguuuaggaaacuaacaaaagagaaaugauuuaacucuucacucuuaaguauagagagaauuguguaaaguagggaaguaaauguagucugaggcucagcauugagcaaagcuuaaguuucaugauacugugaauuccagauuucagaaggcuggggaacagcaugggaagaugguuguaagcauuaaguccucauuuuccauagaugauauauauaaaguggaaauagaaaguauaguucaaacauagaagcaugaugguuaguagcugugaaauagugaaguuuucagucaguugccuuugguaaguggcaguuggggucuuugugucuuguuuuguuuucccaguuuaggguuucucuguauacucuuggcucuccuagaacuugcucuguagaccaggcugaccucgaacucagaguuccaccuaccuaucuuugaauacaaggauuaaaggugagcacuaucguaccuggcuucuagacuuauuuuucuuauggcauuuuaaucagugucugcauaguauacagaaacucagugaauaaagaaaaauguuaacgaacuaaauuuauccagaguuuucauaaggauauaucuacuuuugaccaccuugguugaaaaauaauuggagcuugaauagaucauguuuucaauagguaccaaauagugugcccauuuuguguguguguuuguguauguguucgggugguuuacuuguacaacuuuccuaaacauggauuuaacuuuuuuuuuaauuagauauuuucuuuauauacauuucaaaugcuaucccgaauuaacuuuuuaacaagcaacuuuuccuuuuuaaagugaaaacuauuuuccugucuuuccucaucugaguguuuuucccccuacuucccucugucuuucuuugucucucucucucucucucucucucucucucucucucucucuuucucucucucucugcagccaugucuaaagaggagaguccuugaaacagcagcuuucaugaucucuggaugucuacaucccuguaguuuacagcaaggaggucuguccuacacugcagugacucuuccuaguuagaagaaaugguagcagcagggacacgucucuccaagcaucuguaguuaucauaguugaaaucauucguugucccauccccguauuuaaaauacuucuaauuguauaaacuuuuagaaucaaacaaaagucagguuuagacagauguuagcaaacuaaagcauguaugacagccauuuguuuuagaaaaaauaaaguuuuauuuguacacaggcacuucuauuugucaucaguugucucugguugcuuaagcuuuagugggcugguuuaaguaguuauaauaaaggcagagcucacugccuacaaaguagacauaacauugcuuuaauuuuauaauauguguguaaauauuucuugaaacacaucucacuuucuacuagccaaauaucaaauacucaguaggugccgguagcuaguaacaguuguauuggaucacacacacacacacacacacacacacacacacaaacacacacacaccacaccacaccacacaacacacacacauacauuucagugcuuaaaauccaaagucucaugcaugccagaugagcuguagacuugaguuacuccuggcccuggcagaauaggucuaaauggcuguaaauguucuuaccugcuuaaagcaugucacaguaagcauucaauggaauuaacccaagguuaguuaaugaagguuucauugaacgcuuacuacaagcaucaggcaagcccaaagcaaauaguaacagauaugaacacucaaguauuaaucauagauauuuguccauuaaaacacaaaguguucgagaaaagaaacagaacaauaaauuauugcuuaaaauguccaaucauguaucugauaucugccucaggaaaaguucagggucccauuccuggcuuuaagaagaguaaaauguugccaggcuucauucccaguaauuacauuuuaagauuuaacauguuuaacuugggcuccagaagagcaguacagugaaagcccccaagcucauugucugucucuagaucauuuccucugcuuccugcaucuguuuucuuggauuaguucgguauuacagcaaagucuacgauucuuuuggccacgaagacugcuuucccacuuccccucccaaccacuuacuguuucgugggugggaaaauuuuuguugugagaguugauuaauuagaagggauuccuggcuucccuagcaauggcagccugggaagauuacagagccuggcuuagugacaggcaggccaaucuguauuuaaggaaaacuuggaccagccaaauuucccuggaauguggaucuggcuuugucuucuacagggaaugugcagugacccuuugccccuucccaccacuguagaaggcugacagcaucuccuuuugcugguccauacuguccacuuuuucuuuggggucuguggggaaguacugguguaaaaagccugaguuguuuucuaaaguugaaauauaauagguguaaauguuuauuaaugcauaaaaaggaaaugaguuuacuauauuuuaaauuuuucuuuauaucuuuauuauuuaugcuuuuucuuucuccugguagcaauuuuaguuuuauacugagaucuacauuucagcuaacauuucaucagucuuugcauuuguagaacaccagaaaaaguuaaauaugcucaaauauugaugugauuuccuuguuauaguaaaagcgaaugggaagagcaaugcauugcauuucuagagaaagagacagcugaauagagauuggcugucaggcuuuugucuugcuagcuucccucugugaaucacuuacagccuguguccuagguuuuugguguaccuaaaggggaaugcgccacugacugugucaccauugcuuauuugaaaguugaugcauugaucugguaugaagcauugaaaacaagauugcagcagguauuuccauauagggugaguucuacuuacugaccuucuggauguuaagaaagauugaagugaagcgcuccaaaagaacaauuaaaggcacuucaaguaauccugguauuuauaagaaauacagcugagaggagagcgaccuguaucccugagaacacuuuuccaauauuugucuuugccuaacuuugaaagccuaagaaggauaaguguauuccuucuccugagucuuaaacucaccacuuucccaaccucuucagcuguuucuuuugagagcucuguucuuuugaaggcuuugggcuguagugccguggcuggcaaugugcuccgagugugcagacugcuguugcugcauugccagauugggaaaugugugcagcuaggugugugcugcuuacuugauggaacuggaacaaaacugcuagcagcuuucugacauuacccagcucaaacuaucauggcuguggagguuugggguaccuucuuacaccauaggagaguugcuguggguauugauggcuuugcagcaagaggauguauuuguuuugaaauaaagcuucuuuuaccaaguguucucugucaguucucaggccucccugucacagucuguuuccuuggaauaaaaccuguuuuuguuuccuuuuuuuauaacugaaaaauguuucauguuuucuucuacuugccagacugcuccagguuugccugaugaaugagucuuguuuucuuugauauagaaaccaaauauuccuaugcuaauuauacuuacuuuauguucagugcccaguaggugcaucuuauugucacacauugcacacauuguccuagaacacccccgagaaggacuucuccucuguuucuuuuaugucacgggaccugaauacucuaggauauuaccgaggugaccaguaccacuccuucuguguuuuuuccucauaacuucuuuuucuggacagguaauguguaaucuucaauuugugguauauccuuuacuuaaaaguucugucuuucucuauuucugccauagguguuccuagugacuuuuaaaauaauucuuuuacaagcagcuucuguuuauuuguaauuguuuaugcaugcuguauguguguguacuugauuguacacauguucacauauguguagccagaggccaaccuggggugucauuccuuagcauccaccuguaccuuuugagacagggugucuuaguggccuggaacucagcaaacagguuugacuggcuggucugcagguccuagggauccacuggucucugccuccacaguggggagauuaaagauguucucaauuuuucuuugugaguucucuggaucaaaguuagauucucaugcuugcauuuuacccucugagcuacuuccacagcacaccaacaguuagccaauuaauucuucuuaaacagauaacagaaugacaacauguagaguucacuucuaugucauucaacauuaaacuguaacacuauuuucuuauaaugauuuuguuuuuccugaugcacaugcaaaguauguguuuuauuuuaucuucuaguguuaaaacaaucuuuacuagaaagguagacucaggauccuucaccaacuguauggauucucucuaaaggcuguagagggcaucauuguucuauguuuccuaagguaacuucucuagauacugugauccaagaaagcaggccgacugaauugcuguuaaaauggauggcucagucucagauuaucacggaaccuuaaauucuggucugcuugcccauugguuguguauauagguacuccagagucuguuauacacacguguauuucucuugcuuccaucccaacauacuuacuaggauacaccacacuggacacuacagugaaaacaaucacaacuaccagaacuauccagaguggccuugagaaauuauucugagacuggcagaggcuaucugcugggugcuuuguucuagggucaagaaucuagaacugcugugcuaggaggaagaauccccuugucuuuggaaagccuugugggcccaggccuauccuaacaguaaacguuagaaggggccgagggggacugacacauguuguccugguuagugcucuuccuccucucuucuucucauuguucuagucaaugccaguuuggggauauuugguuaaggaaguuaggggugagguggguauuguguaucccuguaguucacaguuccugagaauucuguggcacugucuuaagugugcagccauguccucauuacccauacagucuaaauaugcauagugcuuacuuacucucuuagauauuucuccuggaguaccuuacagaacauagccauuaaguaauacaggaaauuaggcuucugcaugugucauucugucacaugugaguagcaugugacaguacuuugaucuuaagacuucuuugucauuuggcugcuauuuguuauuuauauaguuauuugacaacccuuuguacucacacaugugcauauaccuacaugcgauauuugugugacauuagaaaagaaugcucuacugugugcuucacaaaaguaugacaucaugaagauucugguaaagcagauagcaggucaagcaccccaguuuucauuacuugaaaaaucuauuaucuguuuuauuuuuuuauuuuuuaauuuuuuaauuauguauuuucuucauuuacauuuccaaugcuaucccaaaagucccccauacccuccucccccacucccacuucuuggcccugacguuucccuguacuggggcauauaaaguuugcaagacccaugggccucucuuuccaaugauggccaacuaggcaaucuucugauacauaugcagcuagagacaccagcuggggcggggggggggguuacugguuaguucauauuguuguucuguuauguacuaguauuggcaucuuguucaugaugucauuucuauaaauuuuuugucauuugugccugcuucuguagguuauuuuauagcaugucuugaaauuaauuuauuucuguguguguaugcacaugcaugugcacuaguuggagaucagaggggacagccuugggguuugguccuuaucuuccacuuugugacuguguuucuaguuccccccugcaugugccagacuagcuagacugaauuucagcaguucuuuugugucucucucugucucucugucucucugucucucucugucucucugucucucucugucucucucugucucucugucucucucucucucucugugucuccugucuugcuuugaaagagcugugguuauagacccacacuacuguaccucaccuuacauggguccuaggaaucugaacucagguccucauuauuggauggcaaucacauuauccacugagccaccucccagucacuucuugaaauuuagaucauuagguuuuugaggaaagaauacuagaaugugaaacuaacauuagauuuuacccaggauuccugaguucaucuugugguuucacuuauaaaaugacacgaaaucauguuaauucuuggagcagcccccucuuuaucuacagauagaaauaacaggauuaucugucucacuggguuuuuucauaucaaauuaauaaugaaagguauaaugcuacgaaaguguuuggaaaaauaacauucuaugugugccauggagcccucaguaauuguuuuacagugauguucugugcaguagagagacuuggccuucaguucuuauuuguucuugcucucguaacuuuuuggagugaggacuagucuaauucuuuucauaugugagguuucaguuaccaagucuuuauuugucuuugcuugcagaguccuggugaggcauuugagacagaggcaagccugaucaucuuccucucuccucagggaguuuguagugagaaauugugucaaacuuuaaaagcaauacagugaaacagaagugcugguacacucugcauagccuugucaugaccaaguugaauaucaugaucaacguuucugaucuguuucugaaugggcugcuguggccugucagucuguucaguguccugucaguuuccagccugggcugcuuacagugccaugcagcugugauuagcagucagcagaguuagauuuuacuucucaguacugauugcugguuagggacaagggacgguaaccuccauuaccuucuguuaccuacuaagaaaaauuacacagugagaggaaagacacagcuggauggugucgccuggagucacucacuuggaugcauacacuuaauaacugggauacagaacccaagaccacacccgguucuuuccaggauagcuuucugcuuucaaaugacaucuuaucauuuagaggacuggcuuuaguuugcuuacaugugacagugacauccacaaggacacaugcaaaguguaagcugcuggacuuggugaucauuuucuauaaccggcacauuggucgaucuacuguguugugucacauccaggagagggaugagacccugcugcuugguaggagagucugugucuguauucaaagaugagggaaggacucauauuauuagcuguauuuauguauaucuaucuaucuaucuaucuaucuaucuaucuaucuaucuaucuaucugcauuucuguaauacuaaaauuuuuauuuguagaauuccuuuuuuaucacauugugaaaauaauuucggcugacaccagucauguccuuauuacuaauguuguguuuuauaaaaagauaaagagagagggaauauguaugguggagguguaauaagguguuggggaaggggucccucugugggcccaugcugaaccauccuuucccugugagggaucaaccauaggaugguauaguauagaauagaauuuauucagggcugggcaaggggaggugagagaaaggcagaggggggagggggaggggagggaugguggaguauaggccagccaugagcacauggagagagggaggagaacggggagagaggggguaaggagcaggaggaagagcaagagagaggauguggcaagcaaucccuuuuauagugagucaggcacaccuggcuguugccagguaacuguggggcagagccuagacuaaaugucaacaacuaaccuguacuuuggaaaguuaaauuguuuugagcuuuuguacccauuuauuaaaauacuaggguuaggacuggaaaggucacucacugguuacaagcguauacuacccuugcagagaaccuaaguucaguuuggaguaccuauauuggguggcccauaaccaccuggaacucuagcuccagaugauccagugcccucuucugaauuuuagaggcaccaauacuuacuuguaagcuagcucugcaucucuaucccucucccuuccccuccucuaacuaagaagaaaaagaaaucccuaaauauuaggauggguuaaguagguguagccauaacucacuucuuauagaauuguucaucuuagcauagaguucuaauucuguuccuuucuguuucuuguuacuugauauaguuuuuuguucucccagauugaaguuuuuggcauuguuguuuaauauaaagauguuuggguauuuaaugcuguuuuacaagaaucagaauauuuauuuuuaagauaaguaauugaagucaagcagguuuuccuguuuugaugacauaaauuaucccuaggauggugugacuaaaaaauagacaaaauuaagugcagguuugaaaauguauuuuggugugugaucauuugaauuaugugguauuucagguaacuguugaguacaagaaagaaaagguuacgugggcuguccaguguucaguuggaguaccugggcauugauagugagugguaagccuguggaccaggcccccugggaaagacugggggccugugcuucugcccugaugcuacaugguuagaaccugagugaggaaucuuaacagagaaauugaguuggaguugaugaagcgcuaguguucuaaguguguuucuggaccagaaguaucagcuccuacucuaauugugguauuucuguuaucuguuaugagggcuaaaaaugaugcauauaauguguuuagcacagugcuagguaaccaucauacuaaauacuacugggcauugccaguaauagucaccacuguaauauuaaucauugugauucauauuuuucugccaggguguuucaugaaguaacuuauuuugaaauuccuuucaaagauaccugaguucugauuauuaggaaaaucuuauagcuggucuguugaucuuuauuguguaucuggugaaggaaagguguaagcaggguuugcagguguuucuuagaacgguccaagauugugaagguacuguucucagucugcugugguagacgauuguuaaccacagugauggaguuguacacaaguguuugcuggagucaccagcgccauuugaugagucucuccagaccccuguuucuucagcucaaagcacaguuguucuuuuccauguagaaucuccuuuuuguuuuuuuaugguuaaauaaggaucaugguuauccaccaaaggaaggccagcagggcccuagacacuaggcccaggcugcugugccugagccagccccagcuuuuccaccucugcuggcugccuucuuugcuuccucuuuaagcccagcucucaaagugaaaagcaguuuagucuguguuuagaagcugcugauucagagcagugggugcuuucugagaugacacugcugcugugcccuugcccagacuugcuuuggcuucuuguuggcaccugucuucaggccuggaugccuuuaccuuugcuuuccuccaggaagcuguggguuuagguauguccacugugggaaggggugugcuccacaggggugcggccccuuaccugcaugccuuucacugucuuuggacaagaguggaguggcucacuugaagccaacuauucagaugcagagcugucccacugggaguagguacaucuuccuauggaagugcugccuucuuugaaggccuuuagccaggucccugucccgccuaggcucagacaccaguggggaggggugagggaugggggcacuggguuccuguacagguuaccucaggaaaaauggcaaugcaagcacauacuccucauguugcuuuucaaggaugagacgagaaucucugcagaguaggucaagaaacucaagagcugcccggagaauguaugcagaggcaauaaaaagugcauuggccugguguaauuuuaguuaaggcucuucugaaggaagucgcaaaucuucacaaacuuaaauggaacugggaaaagguacuuuaugauuugggagugugagugacucagagugaauugacaaaguauuguugagcuuguaaggucugggaacagcuuuuuggcugccagugacuccacuccaaggcagcuccccugugggccuguccuggaggguuguagucucuguauuucucugcuggucucggucuucuccugccuccucagugcacuuuguaggacacagugacccaucccccagugacauauccugcaagggugcugugcaacugccaacuuuuggaagcuaguugaacagguguagagauuggcuucaucaacugugcuucaggggcacuguccuucauacuuaugagucaccauugcccacccucaugcauggcaguuguccaaaaacaaggcuuagauuccuccagagguuagauaguaccagccucuaguuuagagaccugaaaaguuugcuuuuuuuuuuugcuaucuccauacacuuacauucuugcagaucauacuaaguguuuguggagaggccucaaugacguuuaacaguuaguuguaauaaaucuuaucugugagaaguucucuggguuccuaggguugaggccagucaugauugcuuuccaugcaguuuacagcugguuuuauuauuggugugaaaguucagccguguuaguguuauucauaacccucaguguguauguauuguggugauuaaacauaauauugcagaagaauaucaaagaacaugucauucuaguaaaauuucuggauuucuacucuguaggugacauuaugggucaggacagucuucaguagugugaaucuugucuuacaucuuaaauuuugaagcacugacuguacuccagagagucauuagucauccaugagucugcaucuuuguuucugacucagcacucugcagacuuccugcagcauaggaaacaacugaccgugugcuguagccuuagcaguguuaauggucacuggugagcacugcuagcucccagcugcucagcauuuccaaaagggaugaaaugcuuacuguuuucaaggcuggcccagggcaucaggugcugggacagcaguucugaugcugcuugcauggcuuucacuucccacaacgacugacucuccaucugccgugacacugcguuccucagccucugcccccuccuuggguuggugacuagaauguuuauuuuuaggaaaaguuaaaauuauccauagaaggguguguucuguaaaauuuacauuaaucagccuugcacagcaggaaucaugggaagaguauguaugugaagauuuuuaacaaaaaccuuuuauggaaaauuucacaaaacagaagaaugcgaugaacauuaauauacccgucauccauuuuaacauuguggggaguuuuaaauuaaguuuuagucaaucugaauacugaucuuaaaaagugcuacauaacacuaacacccauguguuuaaucugcauuuuccagcuuuuaagacuauuagcacuuuuccuuauaaugccaaaaugucuuaucuccuuccuucaguuuaaauucuaagacauguacuacucgucuuaagagcugggauuauauuggauuucagaaaacagacaaaaccuaucugcacauauauaccuguguguauguacaugucugugcauauaaguguguguguauggagagagagacagauagagacagagagagacagaaacagagagacacagagagaagcaccaacacucacagccacaggaacaagcacauggucagauagacucacugaugggacaagaucuugcuccugaggccuugcuccugugacuuacuugcuccagugaaguccuaucucuuaaaguuuccuaugucucuuaaguugcacugguaguuaaggauugaccuauuaauacauaaaccuauaggggguauuuccuguucacaccaaacaaugucagacauaguacauugcaauuaguauuuauuaagcaagcuuugacauuaaacaaugauacuaucuagaaaugaaccaguuuuaaaauuauuuacacugcucuucaucuucauuggcauuuuauuucaccaauuuaaaauguaaauucaagagucuuuuuuuuuuuuuugagacacagucagaagcuagccuugaacucuugauccuucugacuucaccucuccaauauugggauuacaggugcauaauguuuucuuauuacaaauuuugauuuauaagcuuuuauuuucaauuuuuauuagauauuuucuucauuuacauuacaaaugcuauccugaaagucuccuauacccucccccugcccuguuccccuacccacccacucccacuuauuggcccuggcguucccauguacuggggcguauaaaguuugcaagaccaaggggccucucuucccaaugaugaccgacuaggccaucuucugcuacauaugcagcuagagacacgagcucuggggguacuggcuaguucauauuguugcuccaccuauaggguugcagacuucgucagcuccuuggguacuuucuuuagguccuccuuugggagcccuguguuccauccaauagaugacugugagcauccacuucuguauuugccaggcacuggcauagccucaaaagagacagauauaucaggguccuuucaucaaaaucuuacuggcauaugcaauagugucuggauauggugacugauuaugggauggauccccggguggggcagucucuggaugguccauccuuuccuaucaguuccaaacuuugucucuguaacuccuuccauggcuauuuuguucccuauucuaaugaggaauauccacccauuggucuucccucuucuugauuuucuuguguuuugcaaauuauaucucggauguucuauguuucugggcuaauauccacuuaucuaaugacuucuuuugugauuagguuaccucacuaaggaugauauccucuagauacauccauuuguccaagaauuucauaaauucauuguuuuuaauagcugaguaguacuccauuguguaaauguaccacccuuucuguauccauuccucuguagagggacaucugaauucuuuccagcuuuuggcuauuauaaauaaggcugcuaugaacauaguggaguauguguccuuauugucaguuggaacaucuucuggauauaugcccuggagagguauugcugaaucuucugguaguacuauguccaauuuucugaggaacugccagacugauuuccagagugguuguacaagcuugcaaucccaccagcaauggaggaguguuccucuuucuccacauccucaccagcaucugcugucaccugaauuuuugaucuuagccauucugacuggugugagguggaaucucaggguuuugguuugcauuucccugaugauuaaggauguugaacauuuuuucaggugcuucucagcccuuugguauuccucaguugagaauucuuuguuuagcucugugccccauuuuuuaauggaguuauuugauuuucuggaguccaccuucuugaucucuuuguauauuuuggauauuaguccucuaucagauuuaggauggguaaaaauccuuucccaaucuguugguggccuuuuugucuuauugacaguaucuuuugccuuacagaagcuuugcaauuuuaugaggucccauuugucgauucuucaucucacagcaugagccauugcuguucuguuuaggacuuuuuccucugugcccaugucuuugaggcuuuucaccaauuuuuccucuauaaauuucaguuucucugguuuuauguggaguucuuugauccacuucgacuugagcuuuguacaaggagauaagaauggaucaauucgcauucuucuacaugauaaccaccaguugugccagcaccauuuguugaaaaugcugucuuuuuuccacuggaugguuuuagcucccuugucaaagaugaagugaccauagguguguggguucauuucugggucuucaauucuauuccauugaucuuccuguuugucgcuguaccacuaccaugcaguuuuuauuaccuuuguuuuguagguugcuuuguaguacagcuugaggucaggcauggugauucccccagagauucuuuuauuguugagaauaguuuuugcuaucguagguuuuuuguuacuccagaugaauuugcauauugcccuaucuaacucagugaagaauugaauuuugauggggauugcauugaaucaguagauugcuuuuggcaggauagccauuuugacuuuuuuaauccugccaauccaugagcaugggagaucuuuccaucuucugagaucuucaauuucuuucuucagagacuugaaauuuuuaucagacaaauuuuucacuuccauagagucacaucaagauauuuucuauuauuugugacuauugugaaggguguugucucccuaauuucuuucucacacuguuuauccuuuguguagagaacggccacugacuuguuugaguuaauuuuauauccagcuacugcauugaagcuguuuaucagguuuaggaguucucugguggaauuuuuagggucacuuauauauacuaucauaucaucugcaaaaagugauauuuugacuucuuccuuuccaauuuguauccccuucaucuccuuuuguuguugauuuugcucuggcuaggacuacaaguacuauguugaauagguagagagaaagugggcagccuugucuagucccugauuuuaguaggauugcuuccagcuucucaccauuuacuuugaugcuggcuacugguuugcuguauauugcuuuuauuauguuuagguaugggccuugaauuccugaucuuuccaagacuuuuaucaugaagggguguuggauuuugucaaaugcuuucucagcaucuaaugagaugaucauguguuuuuugucuuugaguuuguuuauauaguagauuacauugauggauuucugcauauuaaaccaucccugcaucccuggaaugaauccuauuugaucaugauggaugauuguuuuguuguguucuuggauucgguuuacaaguuuuuuauugaguauuuuugcaucgcuauucauaagggaaauuggucugaaguucucuuucuuuguuggaucuuuguuugguuuagguaucagaguaauuguggcuucauagaauuaauuguguagaguaccuucuguuucuauuuuguggaauaguuugaggagaguuggaauuaggccuucuuugaaggucugauagaacucugaacuaaccccaucugguccugggcuuuuucugguugggagacuauugaugacugcuucuauuucuuuggaggaaauggggcuguuuagaucgauaaucugauccugauuuaacuuugguaccugguaucugucuagaaauuuguccauuucauccagguuuuccaguuuuguugaguauagccuuuuguaguaggaucuggugauguuuuggauuuccucagguucuguuguuauguuuuuuuuuuauuucugauuaucuuaauuaggauacugucccugugcccucuagauagucuggcuaaggguuuaucuaucuuguugauuuucucaaugaaccagcuccugguuugguugauucuuugaauaguucuuuuuguuuccacuugguugauuucaccccugaguuugauuauuuccugcugucuacuccucuugggugaauuugcuuccuuuaguucuagagcuucuaagugugcugucaggcugcuaguauaugcucucucuaguuucuuuuuggaggcacucagggcuaugaguuuuccucuuaggacugccuucauugucucccauaaguuuggauauguuguggcuucauuuucauuaaacucuaaaaagucuuuaauuucuuucuuuauuucuuccuugaccaagguauuauugaguagaguguuguucaguuuccacgugaauguuggcuuucuauuauuuaugcuguuauugaagaucagucuuaguccauggugaucugauaggauguaugggcuaauuucaauauuuugagaccuguuuugugaccgauuauauggucaauuuuggaggagcugcuaugagguucugagaagaagguuuuauccuuuuguuuuaggauaaaauguucuguagauaucuguuaaauccauuuguuucauaacuucuauuaguguccaugugucucuguuuaguuucuguuuccaggaucugucuguuggugagagugggguguugaagucucccacugucguugugugaggugcaaugugugcuuugagcuuuacuaaaguuucuuuaaugaaaguggcugcccuuacauuugaagcauagauauuuagaauugagaguucaucuugguaaauuuuaccuuugauaaguaugaagugccccuccuugucuuuuuugauaacuuugaguuggaagucacuuuuauucgauauuagaauggcuacuccagcuuguuucuuuggaccauuugcuuggaaaauuguuuuccagccuuucacuuugauguagugucugucuuuaucccucagguggguuuccuguaagcagcaaaauguuggguccuguuuguguagccauucuguuagucuaugucuuuuucuuggggaauugaguccauugauguuaagagaaaucaaagaaaaguaauuguugcuuccugucauuuuuguuguuaaaguugggaaucuguucuugugacuguauucuuuuuguuuuguuaaaggauuacuuucuugcuuuuucuaggguguaguuuccaucuuuguguuuguguuuucccuuauuauccuuugaagggcuggauugguggaaagauauugugugaauuugguuuugugauggaauacuuugguuucuccaucuaugguaauugagaguuuugcuggguauaguauccuggacuggcauuuguguucucuuaguguucguauaacaucuguccaggaucuucugacuuacauagucucuggugagaagucuggacuaauucuaauaggccugccuuuauauguuacuugaccuuuuuuucccuuacugcuuuuaauauucuguguuuauuuagugcauuuguuguucugauuauugugugucgggaggaauuucuuuucggguccagucuauuuggagucuguaggcuucuuguauguucaugggcaucucuuucuuuagguaugggaaguuuucuucuauaauuuuguuggagauauuugcuggcccuuuaaguugaaaaucuucauucucaucacuccuauuauccguagguuuggucuucucauuguguccuggauuuccuggauguuuugaguuaggauuuuuuugcauuuugcauuuucuuugauuguuguguccauguucccuauggaaucuucugcaccugacauucucucuuccaucucuuguauucuguugcugaugcucauaucuaugguuccugauuucuuuccuaggauuucuaucuccagaguugucucccuuuggguuuucuuaauuguuucuacuuccauuuuuagaucuuggaugguuuuguucaauuccauccccuguuugguuguguuuuccugugacucuuuaagggauuuuuguguuuguucuaccuguuuagcaguguuuuccuguaguucuuuuaaggacuucuaccuauuuagcaguguucuccuguaauuccuugagggauuuuugugcuuccucuuuaaggccuucuaccuguuuagcaguguucucguguauuucuuuaagugaguuauuaauuuccuucuuaaauccucuaccagcaucaugagauacaauuuuaaauccgaaucuugcuuuuucgguauguugggauauccaggacucacugaggugggagugcuggguucugaugauggugagaggucuugguuucuguuaguaagauccuuaaguuugccuuuuugcccucugguaaucucuggaguuaguuguuauagcugucucuggcuggagcuuguuccuccugugauucuguuagccucugucagcacuccugggaguccaacucucuccugagucucaguggucagaguacucucugcaggccaccucuccucugucagggaaagugugcagaugucuggaguucagaucugcugccugucugaagaugaaggcccaaaacagggccugucccagaagcuauguugcuucugcaguccaccugcucuccugugcagacuggucucugagggaccugggauacaagaucgauuuauaagcuuuugugaaagcagagaagacagccaacacuuaaccaagcauuuacuaaacucgaggcuuucaugucaccugauugcacucucacaaccacacuguauuguuggccauugucuacagaggugcuaggcagagacugagucacugcucaugucagagguagagaguaagagucaguuuucaagcuggucucugauguaaagccauggacuuuuuaaugcagauugauaccacuaccuguagucuguggaaaggacugauugagaaucaaccucaucuaguaauaaugcucauuuauaauuaaaacaauuaauaaugauacuacugucaccaacuuacacauuauuuuagaaaguaggaguaggagggcagguguaauucagagagggaaccuggcucccuggcuccugguucuuuucuuuucuuuucuuuucuuuucuuuucuuuucuuuucuuuacuucucuucucuucucuucucuucucuucucuucucuucucuucucuucucuucucuucucuucucuucucuucucuuuucuuuucuuuucuuuucuuuucuuuucuuuucguuccugcccuuuagaaaagcccuuuagggaaauagaugcacugaggacugagguggucaaaggucaguucugggccucagcauccuuuguagacaagggcauuccuguuccuuuauuguguucccuugggggcugggcauaugucuucuacaugcccauuucccuuuuguguugugcuuuugauggaagcaggaugaaagcugugccaggaaccuuaaucuugguuuucuguguuucuuucauacauccugccugucucaggauaguggaagugaaugcucauauucuucccuuuguauuugaugcugauuugauuuuucuuaaagcuguaguuugagcguugggcauuugguuaaucuuuucuaaaguggcagaggauggaccugcagggaaaguucaguugaggugagaugauuaucugcugucaugucugaauccuacucuccccacuugugguggaacuccaguucagaaugugcuucuuguuggggguggcaggaccaggcuaggcuggacacccaccccuccccauaguuaacucugcuucccacauaacaauuucccacaguucagagaagagaaaugauuugcaagagagguggcuaucaccauugggagugauagaagugcuuuacaguuagaugauggagagggcccuacagcuguauauauuuacuaaaacucacaaaacaggaauuuggugauaugcaaaguguugugguacagaaguucagaccaagagucuugcccugcaguccaugugccauucuagcaccaggcaggcugguguaggaagauaacuuggaguucaugccagccugugcugcaucgcuggauuuacucuuagaacaaaacuaccagaacccaaaccaauagacacaauucucagaaaagcaggaagaaacucagacucauguaugcugaacacauacucuuauuguagcccagcccuuauguauuauuggaaacggucuaaucccuaggacccaccuagccaagaaucuguagcauccuccugccucugcuuucccggugcugggaucacaaucauaaguacagcagcaugcuuagcuuacagcugaaguuucagagaagucauauuuguucagggagcuuuugugugagaguuuucaggaugcugguuauuuacuaggucaucuccucaucuuauugcuuauuuagucauuuauugucaugaauccauaacacaugggagagaaggccauaauuuuauaaguuaaguguguguucucuucagguuuaacaguaaaauaucaagaaggguuuuuaguuuuauugggugguauuuagaugcaaauagccuggguguugcaaacguggaaaguuagguuuuuauuuguucccggcuauaaaagaaacuagaagcaaaagggaaaauaaauucuucucucuaaaaauucugccucggugaugaggcucagacauaguaucccagguaugacaugauggcauuugugauuuuuuuuuuuuucuucuccaagacaggguuucucuguuuagcccuggcuauccuggaacucacucuguagaccaggcgggccucgaacucagaaauccgccugccucugccucccgaguacugggauuaaaggcaugugccaccaugcccggcuuauuugugaaacuuuuaacucagugauagggcagaggacacacuaccuaagauaugacaccauggcuuuugugauagucagauuguccuggccuucccagaccugagaaggaguuucugaucuuuuucuugagaaaguuuuaagauuuguguuccagaagaacccucccuucuacucagaggcaauagacucccuaacucugaaggcagggugucauagagauaucugaacacacauagaguuauuuugccucccuuuaccagugagugauauauguguauauacauauuuauauguauguaauguauggguuuguauguuuggguguguguaccguauaaauuuguacauguucguguguguguaugugugugugugugugugugugugugugagagagagagagagagagagagagggggggagagagagagagagagagagagagagagagagagagagagagaagcuagaggucaguaucucauauucuccuaaguugcucuucacauuuauugcuccuucacauuuauugcuuacuuguuuacuuauuuauuugagauagggucucaccacuacauagcuuuaguuagccuagaacuuaguauuuaaguuggauugcccucaaacucaauuuguaaucuggcuuguccucaacuucagaaguccacuugccucucccuugaguacuaagacuaaauaccugcagcacuuggccugccaucuucagcuuacuuuuacuucuuacuuuuugcgaccgguucucuucauguuuguauagcaagcauuuuccugccugagcucucucucagcccuagauuguuuuguuuuguucagagaccagauguccuauaauaacuauguacaccaggcuggccucagacuuguagagauccaccugccucugcuuccugagugcugggacugagggauugcaccaccauaccuagcuuccuacucuagaucuuauuuauugaguuuucucagucaugcuuuuccaauacucuucacuucuacaucaacccuagcacaaaaacgauacagaugucccaaugcuaugugcacuuuauagucaauacaguuuccugugucacagcuuuauacauuuuacuguuuucagcuugcucuuccuaugaaagccucagccauaaacuuaggaggagugagaaauuuuuacuuuucuacaaugagauagcccuuauuuacucauucuaacgggaaaauugagucugguuuuaguuuauaaaauguuauuaaaggaauuuaaggacaacuuuccuuuuuuuuagcugggaauuucacucaguuauuuaagugcucuuuauugaagauucugggcuuuucugaucaguaguggcauaugaaugaguguguggugggcugcccauagcuuuuccuagagacguccuuggacuugccacuuuaugagacaucauaggacauaccgacauuaugguauugccuuguggauuuuauuuuaaaaauauaccuagcauuuuaucugauuuccuaagugaaugaaugaauguguaagauguuguccuccugaagaaaugucuccugugcuuaggauuuuguuaugguguggauacaguuugcccucccccuacccccaaacucaugcuguggaguggaccugauugcaucuguguagcagguuucuaaguggauugcuggcuuucaagagagguuuugcucuggugagguuagaagaacagguuguuuuagggagucucuuucugaauuuuggacauuuggcacacaccuggcaauagauuuguuuucagccaugugucugugcugcaugaagcccuugacagaauaugagcaggcauucacacuguguuuuggacuucccagccuccagaacuaugaaccaauauaaaacccucuucuauaaauuucccaggcccagauaauucuguuuuagugacagaaaaccaggagacuuagaaaccauauuuguguggaaaagauagcuacaaaacauggguuccuauauucaacuguguccguaaugucugaagaagagagugguaguggcuuggauuguuuaggggucccaggagauguaccugcaucccucagagcagaacacacucacugacaagugcacagacagcaugacagagauggagauggcuuccaagggaaccuugaugaggcaggguugacugaagccaaggggaaaguggacauuuguguuggguauaggaguaguuacagaggcucauaaaccuaaccaagaaaucagguuguguuauuaagccuuguggaaaucacuggguacuugaaucaugaagccauugguuggcauacaacuuuuaacccuaucagaggucaugggaucacuauaaguuugaggccagccuagucuacaaaguuaaagguauuaggaugguaauauuucuguuuuuugcaucucuugaaugcaagaugcauucaauauuugguuguuuaauuguuuuauauucugauaccuuaagcaagguaaucaucaacacuccccaauuuuuuccuuacuagguaaagauauuuuguuuuuuuuucuucuccuccucccuuucccuccccucccuuuguuucuucuuuuuaaaaugagacaccgucuuuaaauagcccaacuugaucaauagcuccauauguuucuuaggcugauguuacaauuaagaucuuuuagccucggccuuauucagccaugucagcuccaggauaggguuuguagcauuggcuugaaaauaggaacgacacuuuauuuaaaguauuuaugcacaaauucacugaagguaugcaauguucaugagaguucagggguaaagaaguaccaugcaggguagcuaaacugguagaaaggcaggggugaaauguugcauauguuaggaagaaaaacuacugcuuucugcucugagccuugaacugaagcaaaguugcuguaugccaggugcuuuccucuacuucuuagucccugcaacaucccagaauguauguugaccccucuucagaugcagaagaggcuuaggaagcugacauguguggguaugaaucuuccguccuggguuuuaugaauucgguaguagaagaaguauugacaggaaggcuuucuguugguaugaaagagcucaguguuguuuuaaucuccccugagguagaugauuacguagccagagcaccucauugguccuaguuagcaaaauguuaaggcaauuugaaugcucuuauauacuacuuaagucaaguuggguacauucaacuuucaacucuagcauuucuuugaaggcuugaaaagcuaucccuuuuaaaggauuguagucugaaagaacauuuucuuaauaggacaaaguaauguaugaauuuuugcuuuccgaacuggcuuuacaaaaagauugugugcacauucaugugugcucacugguaugaguaucuguguacauuugugcauguaggccagaaguugauagacuaucuccuucaaucacuguucaucuuacaugucgagacagggucugccauugaacagaauagaauccuuuuagacuagcuggcuauggagcccuagggaucuccugccuuugcaccugcaucugcaucugccacugcuucugccucugcccuguucugauuucauguucacuguccaaacccugcuuuauucuuuuccuuagaagacaaacuuuuuuuuuaauauuagaaaagaauccagaagguuuguguuuaaauguucaucuucuuuaaguuuucuuuuuguuaguuguagacauguauauagugaauuuugaucauuuucaucucccuucaccuguucucaugcccucccucccuggccucugaaaggcagguuucuuccuguauuagucaggguucucuagagucacagaacuuauggauagucucuagauaauaaaggaauuuauugaugacuuacagucggcagcccaauucccaacaauuguucagucgcagcugugaauggaaguccaaggaucuagcaguuacucagucucacacagcaagcaggcaaaggagcaagagcuagacucccuucuuccaauguccuuauauugucuccaacagaagguguagcccagauuaaagguguguuccaccacacccuuaaucccagaugaaaaauuguagcccagauuaaagguguguuccuuaaacucggagauuuaaucuucuggaauccauagccacuauggcucaagaucuccauaccaagauccagauagggaucuccaagccuccagauaagggucacuggugagccuuccaauucuggauuguaguucauuccaaauagagucaaguugacaaccaggaauagccacuacacuucccaacaugccaucaugccauguuucuaauuugauggcuuuuuuuuuuuuuaaugaugacuuacugagauuaauuagaguugcuuguaugagcaugaguugggggguuauuuccuagagcuccggcagcuuaucaguggcuacacucugggagaaaaugacaccaccuggcuuagcaaccauuaacugccuuuagacccucaaagaggaguggagucucauaagccuucucccauacaugugcaugaaaguugauggucccagucuuuuauagauauucacagcugcaaugaguuuacagcagccaugcuguguccagaagaugcucuuuugcauccuaugguuccuacguucuuuccaguccuuccuugauauuccuucauggagaacgagucuagugcauuagcucuugaaagguuaaaacaaaaacaacaaaaucagaaucuagucuaauccgccucacuuugcauuucuuacuuaaaaaaauuguacuaacuuguuagaucuucugcaguuaaacauaauucccaauuuuccaaggccagcuguagaucaggauucuaaaggccuuaauggaaaaggguggguaauguguuugucaagaggccacuuagcgaaaucaguuccauguaauuuuuaauacuguuccuuggacagaguuuuuaugagucaguauuacagaugucauuaauuuauaauggaaaauagugagacaauaugacaauuaucuucagacucaagaauacuugagcagcagggggagugaugauugaauaguuccaacagaggccauuucagaaugcuccaaagcuaaaguucugguaucacaguugagcuguggccuccaugccucugagaauggucuaugugccagcuaagucugucagcaauccaggaccuaagguuucuucuccccaguggaaaccuccucacauuugcuuuuuuggagaggcugugcuacaugugagggaggccaugggcacaaugcaagugucguuuguucuuccacagucagauugcaccauacacaguucucugaacacuggggauuuuagagauucaagcaaaccuguuucaggugcauuguagacauuauuaugaggaaggagaauaaaauguguugauggguaauagcuucuguguacagguugguugacauuuauuguuuuaagguuugagcuuuuguguggaagucaaaucugaauuuaaguaaagcugcuuacuuaccuguacagccugccuaaaguaagccuuagaguagagaaauccuguaguagaaagggccacugccugaguugggaggacuggguuuugccuagguccugaguagaauucauuuuuaagaguugauuuuuuugugugucuuccaaaaacauauguugacauucuuugaugugguuuuacauuaccauuauuaucaccauaauggucuugcagauacccaaagacaauuuuguuuagucaguucucuccaucaccuuuaaauagguucuaggaauugaacuccugucaccagguuugcguggcaagcacuuuuacccacugagccaucucaauggcccuguauauugacuaacacugaguauuucaaaugugaccuucugugguaaugauguuaugacuaacucucucaacaggauggggaguauguaagccacuagaaacccggaagaaggaaaggaauagauuuuccuucacaguccucacagaaaccauccaugccaacacauugauuucagaugcauggcuuuggaacauguacaaauuuguuggcuuaagucacccuguuguuaguauagguaugguggccucagaaaaguacagauuugauuacgauuacccacagccacaaaacuuugaacaaagcuucugaacuugaacuucugcuuucuaauguguaacgucaaguuuuagaguagauaaugucagaaccuuccuguucugauguugaugauuaaacuucaaaaagugcauucaguuuucaguaaaguaauuauaguuguauuucucaauguagcuaaagcauauaaacaugcuguuuucaguuccuacuuuuguucuuuucauuuaagagucauugaugauacuucccuuaagcaauaagauugggcaaugcugucccuuccaaguugacacuaaacaaugacagcaugucuagucucuauaugaggauacauaguuugcucuauccucacauagacacauagagagcauuaacacuuaaaacuguauaccuguuuacuaaugguuuggggcuaccauauuuuaggcaucauuuugugaccuuuccuucauuagacccuaugaacauuuuccugcagucaucuauaggccuacuuuagaguuuccaaagcaacaacuugguuauuugguagaagccucacuuuggcaaacagcuccacaaauagcauguuuacacuguugaauauucuucaacacuagacuuccccugaguuggacagcucaaauggaaaggccuucuucuuuggcuugucgcuguuacaagugggucagugaugaaagaugaagacuuuguagagugugcugguuuagagguauacgggagggcauaacuaccuuccucugucccaguaguaccccguaggaaacuauauuucugaaauaauguacccuagacuugagcuuuuauuuuuuccuguugcuucuaaauuauauuagauaauuuaaaaauauauguuaaacaaaaggaaagugaauuaauauaaaauuaugucuuucuaaaaaauuguguaucugauugaaagcacaaaaauaucuuaagauuuauuuuauuuaaauuauggguguauguguauguguguguguguacacgagugggagugcuagugugugcgcauaugcacuugagugcugauacccacugaggccagaggcauuggaucccaccagagcuggaauuucagguggcucugagucaucccaaaaugggugcugggaauugaacuuugguucucugcaagggcucuuagucccugacucauuucuucagcuucacaaaacaaaucuuuuuuggaaaaaaaaaaaguaugaaaagguucaguuugcucuuuugccagggcugucccuaauuuucccagaacccauucacaccuuguugcucugcuauggugccucuguccauagccugccaucuuacagagaccaaggcccuuagguuaggcucaaguauagaaugucacagagcaaggggucagcuauugguggauguucagaugggccuuggugguuccuguuuucuuuguggucuauagaaaaguuguuaauguaaagacauacucacuguguacaacuacguugaaauugaaugaagcucauuaguuuuuuuaagauuacuaugcugccuuccugaaaauuguucuaguacuugugguuuaaauauuuucucugauuuaaguuuucugcuuaguucuacccacucaugcaucuuuuauaggccaaacuguucucuuuguuaauagcuaauucuaaggagacucugaugagucacuuguaugucugugugguggugaacacuuuggaaaagcaaccccacugugaaaagucuucagauaaaaucucuaccaugcaaaccuacaaaauauauuuugaagagagauuuuuuuuuuaaccauuugaaauuguagaaaauuuuuguauuaaaacuuucuuuguaugcacaugaaaaguuguugaugguacuuauaaucuuauaauuuauguuguucuugaauaaaugcugauuuaauuauuaaaucauccacuucugggucugauugugccucuugcugucuauagguucugaguuuccauuccagcuucuacagagcaauuguuaugagaguuacucuauucauuuagacccauauguuuucuuguaaaguuuuuucuuaugauuuuuuauuaguuacauuucuguugaugugguaaaauaacaugaauaaaguaauuuauggaagacagauuauuuuggcuuauguuucuagagagauacgaguucaucauggaagggagaccaggcaaccaucuguagguaggguggcaggaacaggagcugagagcaagugccuugaagcacaagcagaaagcacagagagcaaacuagaaguagcacaggcucacaguuugagaacauacccagugaugcacuucuucuagcaaggcugcacagcauaaaccuccccacagugccacaaauggggaaccaagcuuucaaauggcaagacuuugugggucuucaaaccauuacaacugugaagagaggauuagaaauaaacacagccuccucagagguucuagguuaagagucacaauuucauaggcucuuugaacauuacauccaggauucaccaguuugaacuuuuccaaaucuagcagacuuuauucuggugacuaguuguuuugguauuuaauucuuuguaccuuuuccagaaaacuugaauuaaaaauggaacuaaaaaccuacccugcccauacaaguguuaguuguuagaaguaggaaagacuuagugaaccuguaguuugaaauuauaggucagauaguugcuucuguauuaucguggauuuuucauucuuguuuguucaucuugcuuggugucuuucccuccuuuucccagcagcaugacuuaugguuuaugcugugaccugaauccugggauuccauugcuucuuauguguuuucugcuacaacguugaugguuuaaacacuccuuacacacucacaucuagccgcuccuguuugaaaguauacagaaagauaagcacuucugccacacuggauuuaguuagcuccgcuugguaaaaagcucacuguuacacagcuugguacuuaguccucccucccucccucccucccucccucccucccucccucccucccucccucccuguguuaccuuacucaggaugaugcccuccagguccauccauuuggcuaggaauuuuauaaauucauuguuuuuaauagcugaguaguacuccauuguguaaauguaccacauuuucuguauccauuccucuguugaggggcauuuggguucuuuccagcuucuggcuauuauaaauaagauuucuugaacagucuccaucugcugcaaaagaagcuucauucaugaugaugagaucuacauuuauauguguuuagaagaauaaguauauauaauacaguuagaaugguuuaggaaacucagugguuaccaaacuguggguuaccacuccuuuggcguugagugacccuuuucacaggguucaacuaagaccaucggaaaauaggauauuuaugucauaauucagcaaaauuacagugaugaaguagcaaugaaaauaauuuuauggcuggggaucaccacaagaugaagaacuguauuaaaaggucucagcauuaggaagguugaggaaacacuguuuuaaguaguuaugcucuacugucuucccugaagucuuuuauaucucaguugaacucauucacccccuuccuuccuuccuuccuuccuuccuuaacuccagaagcgauuucuuugauuaaauauacuaucuuuccuuaguauagauacuaagauauauauaauaauaauuauauauaucuuaguauauauauuagggaagcuuuaauauguauauuauauauauauauauauacacacacauauguguguguauuuacaauguaaauucuuaugcauaguugauuaauaaauacucaggaagucaucacacaugcuagugguugauacauuaucaguauuauuggguuaaaaguuguaaacaaugaauucucaccugaggaauaccgaauggccgagaagcaccugagaaaauguucagcauccuuaaucaucagggaaaugcaaaucaaaacaacccugagauucuaccucacaccaguuagaauggcuaagaucaaaaauucaggugacagcagaugcuggcgaggauguggagaaagaggaacacuccuccauuguuggugggauugcaagcuuguacaaccacucuggaaaucagucuggcgguuccucagaaaauuggacauaguacuaccggaggaucccgcaauaccucuccugggcauauauccagaagauguuccaacugguaagaaggacacaugcuccacuauguucauagcagccuuauuuauaauagccagaagcuggaaagaacccagaugccccucaacagaggaauggauacaaaaaaugugguacauuuacacaauggagcacuacucagcuauuaaaaagaaugaauuuaugaaauuccuaggcaaauggauggaccuggagggcaucauccugagugagguaacccaaucacaaagggacucacacaauauguacucacugguaaguggauauuagcccagaaacuuagaauacccaagauauaagauacaauuugcuaaaugcaugaaacucaagaagaacuaagaccaaaguguggacacuuugccccuucuuagaauugggaacaaaacacccauggaaggaguuacagagacaaaauuuggagcugugacgaaaggauggaccaucuagugauugccauauccagggauccgucccauaaucagcuuccaaaugcugacaccauugcauacucuagcaagauuuugcugaaaggacccagauauagcugucucuugugagacuaugccggggccuagcaaacacagaaguggaugaucacagugagcuauuggauggaucacagggcccccaauggaggagcuagagaaaguacccaaggagcuaaagggaacugcaacccuauagguggaacaacaauaugaacuaaccaguaccccggagcucuugucucuagcugcauauguauuaaaagauggucuagucggccaucaccugaaagagaggcccauuggacuugcaaacuuuauaugccccaguacaggggaacgccagggccaaaaagggggaauggguggguaggggagugggggguggguaugggggacuuuugggauagcguuggaaauguaaaugaggaagauaccuauuaaaauuuuuuuaaaaaguuguaaacauauuuauauucuccuguauaugucucuucagccuauaacuuuggcuuuuauauuucuucauuccauguauguuucaugcauuuucuauaacaaauguguccauaagcaguacuuggaauuguuuugcacauuuucaaacuuacuacaauugguguauguugugcauaaugcuaugcaguugcuuuucccacugauuguuagguuaugauggaagaagucagcauauggaugcauuuaacugugugauaggccuacugcauaguuuccccucuuguaacuguaggcuguuuaucuuugcuaaagaauauuuaaguuguuccuuauuuugucagcccuuugcuguggacauuuacaucuguacacagucaucuugguauuacugaacugcaaaggaccagucagucuggccacgcuagacacuguacuucauuuuacauuguaauaauugccuuauuucucuguguacuucagaauuuuuauugucauaauguuuugccauuauaaguuuucugcaggauaaaugaaauuauacaguuuauuuuuauuguuucucuugauagacaguuuguguccugugcugauuuuuuucuucugcagcuugucucuuuguucuuuuuuguuauugagacuaagucucacacuuuccuauauugucuaggcuggccuggauguuaccauuucccacuucagcuuucucagugccagcuucucugacuucucuuuaucuuuugguagaaacauuguuccccaaggugguuguguccuuuaccugagucauaauaccaaccagugacuuagcuuuguuuucugucuaugauaugcuugugaagagcuuuuaaauucugguuuaucauucuuucauuguuagggccuuuuauguuuaacugaaaaaauaucugucuagccaaaauccuggacgugucuuauauugaaaacauguuugcuccuugcucucuuuaugauuugcucucaaguuugugacgcucuuccuguuuccugaguucugggaucacagacuugggccaugauguucaucuuuaaaauuuuuuguuaguuuugucauccaaaugagaguuuuugaagauuuauuuauuuuauguaugagugcacuauaacugucuucagacacaccagaagagggcaucagaucuuauuacagaugguugugagccaccaugugguugcugggaauugaacucaggaccucuggaagagcagucagugcucuuaaccacugagucuucucuccaguccugcaaaugauaucuuuaauguucaucuagucaguucuccuugucugcaaguucuguacggauuuagcaaacuacagaaaaaauuguuuggaaaaaauuuucuguuuuacagauauucucuucuugaucucauuucuugaacaaugcagaaaacuagcccaugcauauugugucuaugauauaaguauuaugugcaaaacaauccauuuuguacaaggaccuggucauguguggggcuuaauaugcuaagggagguccuggaacccauucccauaggucaggagaacagcuguuuaguaugugacaccacauugguaucuacuuuuauuuaaugccacguggagagcugguuuuccuggagagaaguaguugucuccaaauaauguauucuuucccacugauaugcagcacuuuucugucauauauuauuauuccaguagacauagauauaucugacuugggcauuauuuuccaagaauuguuuccauuguuucacauuauuuguacuggaaggggucacuguguggguaugagcauauaaacaggugcccacugaauucuaaaggugucagagucucuggaguuggggauacagaugguugugagccauuacuguagguacugggaauggaacuugaaucuucugcaaguacucacucuuaaccccugagccaugucaacagcucuuuucccuuucuuucucucuggcucucucucuaucucuuuugauguuuucuugguugguuuuuuuuuuuuuuuuuuuuuuuuuuuuuuuuggagucagagucucacucuauagauuuggcugaccuggaacucauuguguagacacucuugaacucagaacucacagugaacuccuugcuucuguuccccaaguucugagauuaaagauaugagccaccaggccugaugacuuacacauuauuuuugucuuucaucucuucauaugcuaucauaaacuguuuugguugcuuuuucauucaauucuucuucuuuuuuuuuuucuugaaagagggugucucuguguagcucuggcuguccuggaauucacucuguagaccaggcuggccucagaaaucugccugccucugccuccuuuucauucaauucuuauguauccauuuuagacuuauuucuuuuguuuuguuuuuaagaccaagacacuuaguagcccaggcugucuuugaacucagugauccuaucaucuagccuccagagugcugagauuauagcuauuugccaucauaccugguccuauuuucuaugucuuuuauggccuauuauuuuuauaaauguucugauuuuguuaguaguccuuguauuccuggaaaugaacauugcggugauauuucagcauuagaauuuagaauuauugaaacuauuuuuauaaaugagcuuuauuguugguguuucuauuccuuuuuauggacuuucuuuguuacuggucucauuaaaaaagaugaaucaccccuuuaaaguucuugaaaauggcuugugacugaauaaagcuuuccuguaaaaccacuuaggcugguagagaaugagaauagaggauaugauuuuucaauuucuuccaaaauacuguuuuauauuuuaauauuucucuuguaucuuuguuaauaauuaaucuuuucuucaaaaccaacaguuuuauucauauuaauuguauugacauuggaugagcccuaguuuccuaugauuagccauuuaagguuuguuuuuuuguuuguuugguuuuuguuuuuuaucaaaaagcuuuauucuauguaguaguauuuauuuggaaugaaaauuuuccuuuauuauuaaacauuucugcuuuugucuucuuucccucuuaacuuucuccuuuuccucauuuaucugucuaccuugauuuuauuguaugucuauuguauguugcguuaacuuauuuuucuauuuuauauuacuggaaauacacauaguagaggguaggaagagcaauaaauuagaaaauaguaauaaaauacaaaguuucaguuagcuggaauccauuuucgacacaaauuguaugaaaguuauuaaaaaauacauuucaaacuugaugcgaaugaauuucagauaucuugccauaaguccuggcaugugaccauguccauggagugcuggucagcuugauucauucauuccccuuucacauagaucaaaaugucacauuguaccccauaaauauguucaauuauuuguuaauuuaaaacaaauacaugugacugaaaaauuaaaucucauuaauuaguauaauagauuuuaguauguaauacaucuauaaauauucugugauuauauuauuagucccuuuuugaauuauuuagggucauauuguaauuuucuuaaauauauauuaagaacauuuuuguggcuggaauauuccuugguagauugcuggccuaccauuagcaagccucgagauugaucccuagugcugcaagaaauggaagaagguuagccuuuuagacugccuuccaggccgaagcuugcaucagcaucuuucccaucuccaaccucuuggcccagucugcagauuucagacaugauagccucuaaguuguucucuugcucucuuuacauaaccauacccacaacccugcugcuuucauuucuguaaagaaccuuaauaacaggaggcuauaaugccuuucccaguugucagcuuagggauaggauauccucuaaccaguguaggauggucccuauuaacauuacagaggaaauuacuccaguuuacaugugagcuucacucuuucucuuuuaaccgcuaagauauaucuuuucaacaaugaugcuaguaaauaauuaaggagcugaggccauugucauccaugaguuacauuuguccucacugaaguaacuccugauaagucacauuuacuagagcacuugacaccuggggccaccaaugaagcacuuauauuguaacaguaaccuaccuucaguggggcugggaacacuaaaauguuucugcaccuuggaaauauaacaaugagcuuuuuuuuuuuuuuuuccucagcacaggaggcuguuacuagauguggagaaguuccagcagucacugggccucuacacggcuucugggguuuuccuggccucaaagauggcagccgugauuggccguuguguuaguuguccuuguucuauuccaccaggaaagaguaugcaguacacacccagcagggcuuagguagccggaaauguggcagcuccuuacccccaaagugaguuuuaaaguucacuuauuuacacuguucucauagcaacaggaaaacucuucugaccuauagccacagaaaacucuguaaaagaaacuguaggaggaaaaaauaauaaugccaggaaaaaaaguuaauaaaguaccauucuugcacuuauucggucagcugagaggaacagugugugcauuuggcaaccaaaagggaaaggccaucucaucucuagcacgaaccugccuacauuacaugacugauuucuuuauuuuguuuaggcacaguauauuaugagggaucuucaaauggaaagccauuaaacaugagacccagcaaugcucacuauccuaaggcauuugggacuuugaggaaugauaagugcaaacagcccagaauucagaaacucucccaaguacaaaccucuagacucugggaaugugggcaugucuugaguuacacggaugcagauaauuuuucuuucugugaggucucuugucacuucuaucuugucuggacaggguguaacuccuguguaaauucuauuucuagccugaagaaucacuaaauugucagccaaagccagugcugcuuggaaaaugggaaagauacagaagaugggaccugcuucuucuuuggccuggcugugaacuuggggccccucuguuuggugauuucugagaggauguccaaguucuguguugagccacugggccaaguugaagugaagccgcuccucauucacauguuuguccuuaaggucugugcucaguaacuguuuuguagauuuucuacugugugacucugagcuuagaguuacugaguguugugcuuggcauauaucuguaguuuuguaaggaaccuguaggcugaagaccauguaagcccuuccuauucucuguuuuccucguuucucugccuaaucauauguauugcuacacaaguauacauacaaccaagcucuauuaaauuauuuuuucuucaaaacugaauuaaaguaaguaagacauccccucccccgcccacuugacccaugucugcuucugaguuuagggugguagugucuugauucccguuuugguuguggaacuucauagccaaguuuguugcaugcugccccacuuuguacucaugguuaugauauugaaacuuugggaccacacacagauagcaaagucucuggccacuuacgcauguaaacagucuggcuuuuuauaaaguggaaaaauauuucuugugcacuauuuuaacaugaucagcauguugaaacuuggugugcaacugugucaacauuuccuuggcucugaagagcaaaccuggagagagaccucgugguaacauauaaaaugcaaagcugcuuuguuuacuacugggauuuagguugcaauuacagucugaaguagacuuccaaauguggcauacaaaauaaaugaaaugcauuuuccuagcauuguaauuauacuagguaaauaguuuucccuuuacagguuccuauuacaagcugauauucuugcagagaaucaggaggagauaaggaguuaagugcuuggagcuccuucuuggcccuuccucagccccagccauacagggccuuugauguauuucuggcacagagauguguuggauuuguuacuacccgcugagcacgugguuuaaagggcaguuuccucuucuugcuuguucccacucucaggucaucuggaggaaaacaaguaguaaacaggcagucagcgaccgaccggagcaagaggacacuggcaggccugggaaguggaucuguuccuuaucaaauguuuagugagacacugcugagaucuguaggucagggagcaaaacauacauuucuucccuuaauggggcuuacauuggagugaggaaauaggccaugagcuguaaccacaacagaugcucagaggacaggguauguugguagguggcaaguuguagcuagcaagaaaaguaaaacagguaaacuguaucaaggaguggcagaggggaaguugauugacuuuugauuuaguuuuuagcuacccaacuuucuuucagccugauuaacaaauagcagcucuuuauaaucaggaaacacugugauacuuugacuguccauaguuuacuagcucccucaccccacagggaggagaggagaggaaaucucaggggaaguuaaguagggcaguccaggaagaugucacugagaagaccagaauagguuagagagagcgaguuaggugcacacuaucuccuugguucuaguaaugagucaaguuagcaggaguggagacaagguaagguaaacaggggacucucguagaugaauaagucagugacuggaugucagagagucucaugauggggucauuaauuugaacugacacccagaagcugccaggagcuuauaugaagaaucugguguuccaagcagagaaacaguaaggucaaagggaguaaaugauacggaagaaggaggaucuugguagguggagcuguggucuagggcaugggguuuugcugugagggaaaucauguuuagagugaugcucucuucuacuugguuuucuuacagacuucagaggagaaaagaaugcaggauaaacugaacauacaugcaggugcuuccuuugggccagauguuggucggccugcuugugggaugcauggaacaaaaaguagacaugauugcagaauuugaagggagggccucauggacagaugauugagugacaugacaggggagacagcgucuguuaguuuauuuuuuuuucagauauuuugaaaacacaauaacaaaaucugaagaguaccaugccaauacuuuuauaccaaccauacagguuaugaauaguaauaaggauuuugggauauuugccaccaguuuuuaaaacuugcuucuuuuaaaaaugucuauguauuauuacucugagaauguguguguguaugugugcaugugagugcaaguguguaugugccaggccacagugaaggccagaggacaacugugagaagcugguucucccuuccaccgugagacucacauugaaaacagguucucaggcaugugaaggaagugcugagccauuuuuccaaugcuaaaauucuguuuucucuauguauacauauaagaaacagaaauguauacuccucuguaagccaugagcacacauguaucuacauaaacacuaaagauauguaaaggauuuauuuauuuuauguauauggguguuuuaucugaaugcaugucuccauaccagaagaugauaugggaucccauuggacugcaguuauggacaguguugagaauugaaccuagggccuuuggaagaacagccagugcccucaaccacugagccaucuguucagccccaacauuaaauguuuauaaucaccauuuuuuauugcuuuccugggguuagaagcagccaugcugugggccugccauacaaguuuuuaaaaguguuaggugaauucuuccaaugauugaacaaguauuuuccugaaagauguucauuugagcauuguuuauaauaaugaaauauuggagauggcugguuaaaagucauugaacuaaugaauaaauuucuacaugacuauauaauagagucaaauuaaauagauuuuuauuugaaucaaguagaacaaaaauuuaugcacauaauuauuuauaaugaaauuauugaccaagacacuaucuguuuucacucuaguuuuauaauaguaagucaagcagacaggagugaaaaguaagaaauauaacauaauuaaguaaauaucguuuccuuuucaaaagaguaaauauuguugcuacaagccugugagugcuugaaacaucaccuuugcccugauauaguuugucugucugucauccauuugaagucuuuggaagaaagaaagguggcagaaguaaggggagggaggagaagauuauaccgugucaugccaggccaggccaccgcagugacacuauguggaaagaaagaguagagacaguugcuguuuguccacucugcucuggaaaauaccagguucuagcagaugcaccucuuugaaucuuugcuaugugauaaacauaagaacuguuauugcuguuuuccugaguagaccacugugacucagcuagcacgcgguugauuggaauuuauaccuaaggcugauaggucaaagcccagaucuuuccucuaccuccugugcaaccuggaagcagcuuacaugcuuggugaagagcacuggccuccagaguauugcugcagauagcugcuuguugcuaggaugcauucuggaggugauaggagaugggcagaagaggcucauguagaacuggccuugggaaaucucuaggagaacauuguacccuuguguccaccuccugucucuuucuagaaauugcugauaaaagaccagggacagugucaggaggggucagugcuguguguugguggcaugagaaugggguggcaggguauguccaauugaggcaucacuguuccucugcuuuauuauguagcaucuuucucuucccauugaggcaacugauaaugcugaguggucucuauucccacaucugcuuucugaugggagucgggaacuuguccucucugugcugcaguaugaaacauccaccugaguuguuggcuccuucaucccuuuacuguccacccacacugaugcuuucacacuugcuuucuugcagcaaguccuggugugauugucugauucugggcucauccuggcuggauuuguagaugggaugaggacuggaugucugagaaaagaaugaaucuuccuuacccccccccccccccccacuuuacucuuuucucaaccugucugaaguuucuagcacacaaaaguuuucugguaaggugaucaggaugcauugagcuagcaguucucauuuuuacucuuuaugugagaagccuuggcuaagugacauuauuuugagccucaauuuccuuaucugcaaaagugagcauagaauuuaccccagacuaauuucuguaggagcuugugcaaugaacugaagcaaccaugucaauaacuaugugucauauauguacuggaaaguacaucucuucuucuauagguaaaagcuugaagugggauucaauauguaugugguaugugaaagucauuuuguauuaauuccagaggggacauggacuguauguauuaguaugguuaguuuuuauuguuaacagagucaccugggaaguaggugucucaguagaauugcuucaaucaaauuggcuugugauugucuugauggaagccugaugugggaggaccuagcuacuguauguaccaugagcccaaggcaaguaagccugggcuuguauaaaaaggaaagcuaagcagugagccaggaaauaaaccaguaagcagccauccgucuaucaugguuucugcuacagguuugugccuugaguugcugcccugacuucccucaaugauggguugcaacguggaaguguaagcugaaacaagcccuuucuuuucuguuguucuuuuccuuaugauguuuaucacggcaacaaaaaaacaaacuagagcaauauacauuuacccauuuauugcacucacaaccucaguggccuuuuugugucccagcugauugccacauguuuucucuuccugcuacgagagaggagagagagagagagagagagagagagagagagagagagagagagacucuugauuuauauuuagacugaacuaaugauccucauucccuuaaaacacagugagccaugaggaauacauauuguggucauauuuaucuuuuaggcuagauugcuauagcuugggcuucauccccauuaugcagugagauaucuuccugacugccaguaucagaguggagccugcuugucagagcuugccuaugcuccccugaagauaaggcaggcuauagugagagggaguuggcuguagccucagguaccuggcaaauuauuaaugggccagcaugaauggacccagcuugaauugggcacaguguaccucugcaggauccuaugagccaaaaccacguggucuguuugaagcaaaaccucuggcuacuucccaggggcacccaucacagugcuguggaauccugcucuuguccuucuguuuaccuuacugacaaaaguuuguucucuuuacugguuugaguugcuagugauucuucaaaacuuaaaauauuugcaauacauuguucucauaaucugccaacaucuauuuaaucuguuuugucuuacuucccugugauacaauuuucuuaauuagaaucucagaggggaaaauaaaauaaaaacagaacacugggacaugucucagauucuuucacggucccuucugcauccuuccagcuacagggucaugaugccucuggggauauugcugggauaaacaugcauccaagguguugaacucugccuuaguagagcaucugcucaucugauguuuugauuuggauuuuaagugcuucucagaaaccuauguugaaagcuugguccucaauguagcguugcuuagagguuccuccuccuaacuaggaaucuguuuaucgauugacaguuuaaggguuuauacaguagagagucuuaggaagccaggcacucucugugcuuacugggcaccaggaggugaguagauuugcuccgccauaggcuuccugauguucugccuuagcaaacagagucaagugccuguggaaugaacccacuggaaucaugagccaaaacaaauguuuuccccucuuauuugauuuaccuuggauaucugucucagcagugggaggcugacucacacaccugauaacugggcggcaggaagauaagauuuuuauccugauauaucugucucccugaaaccuaccugagcuguugugugguguuggucuuauuuuuuugaaaagaaccucacucuguagcucaggcuggccuuaaagucuuggcaguccuccugccucagccuuccuaguguggggaccauggacugucuccauaucuggcucauuaagcuauuuuaaauuugucagacugucuccaccugccccuucaaagccacagugucagugauuacuacaaguggcagcuggacacuuguccuucucucaaugcuuaucuccucacugcugggaaggaguuaauuccagggcuuucaguuggacaggugaaagucugcugggauguaggcagccuggagaggcagcaagcagucacugugcugugcuggcucaugcuccuuguguguccccuuugcugcugcuaaauugaugcaaaagcaaauugaugcaauugucuuuuccaccccgaccuuuucuucugccauuuauauaguugaguucuggcuacuccacacccguguucuagacaucacacccagaucugcauuccuguuugaauccuuuuucauuugauaggauccugaaacugugguacccuuggggaaguuaugcuuuggucaauuuuaguuucauuuuagguaugaaauugccacaagugaaaaaucauguucaucgugagaaguaauuuggugcccagaacccucuccgccgccccuccgcccccccccccccccccggcuguuuccuuucuucuuguugaagaaugaugaccugagacucuaaguggaagauagucucuagauuacuugagcaaacuucuucagggguagcaaauguuuucaaauaaggcuguuuuaguuuugcagcccauaaagucuuugauauauuagaaggauuuugaggcuagucugggcuuuauagaaagauccugccucucaaaauaaaacaacaacaaaaauccaugggggggggcacacaaaauaaaaaugagaauaucuuucaauucuacaauuauuccaugaaaccaagcauggcuguauucuaauaaaauuuuauuuuauuuacaaaaacaggcaagaacaggguuauaacccuggaucauagcuuguacuuagugggguuguuauugauaaugaaaauuccacaagaggucacuaaguaugacaguauucauuguuuuuuaucuugcuuauuuaauaauugcaccuuuuuuaauccaagauuguguugcucggcagaugaauguauugucacuguacaauuaccauauuuggaaguucuuaaugacacaaagaugagcuagauucucuagcuuacuauaacaguuuggguuuuguaucaccagaucuuucaauaguuaauguauaagagaacccaacaguagaagaaauucaaggcgggggggagaauagagaccuccuagaauguccaucauucaugguuuugguagugccugcccuggacacuaauauauauauauauauauauauauauauauauaguucauauauaugguuuaaaugcccuuuguaccagggcuuuauaugguuaauauaucaggaaauguaccuaggaucacacagcugacgauuagacuuggcugcaguccuggacuccagacccuaccuccaagaacuuacuauaaaguaguugaauuuaacaaaugaaucacaugcaacuagaagacagggcugaacuggcugaacuggcagaggugauuacuacucugccuucuuccuuauucgccauggacauaaacaucacagagggugggugcucaauggaaccuuucagcaggagcaaaggauuagcaaagccugaagaucuuucgguugaguugagcuucagaauucaagaggaauauaccaagaguguguaugacccacagauguaagggaucauaaggacugaggagagguguaggcucuggugagcucagagcuuugcuggcuaggcuccaggaugaggaagacaguagagcaccaggucaucuucucccugcuuaucaguccuuagcaguggaaugaagaagucuguauucaacauacaucugucuggcuacuccagugcacguuuucccgggauaccugcgccuucuaaugaggcugguggagggaguaguccacacaaauucagcacccuuguuagucucucauccuuuaauccagugauuuaagagaacaccaacuugucucuaauuuccauugggaguugccuucauuagauaaaccugugccaaaaggaaaucuuuaaaaguaauuuccauugcccugauuauuugugggugguauuuuuuuguaugguuuccaaagcacugacccuaagcacagugggacagucauguggagcucuugccaacuccucacucagggaaaaggacagagaaaggugccuguagcuuugguuacaaccuccuggaaacagaaccaguggguaguuuuccagccccagcgacucaauguauauccuuuaagguacacucuaguggguauauuuuuucccagauucugaacauugccccaggacaacugucugaguucauuuuggcaccaggacaaaugagaggauguuuccuguuugccugacucuugccccaacuucuuucucuguucuguuaagcucuuggcuaaauucuuuccucuuguauuccacauuuuaacugauguuagggcacugagugcaaaaaucugcaaacaguuagcuuucauguuugaacauuccagucagaacagacugauguuaaaguucucggagcacggcaagaucccccucugcauaaugcauuaaacauuuaauaacucuacuaauaaucccaaacacuuuuaaugggccacaugggagccuuaaugugguuuaaaaaaaaaaaaaaagcauguuucuucaugucaaguucacuugcaucaaauugagagaacuucuuggaagcagcuuugaggagcuggagguuuauaaacugggaaacagguagcagauccuuaagcuaguuccuguguagaaugagaccgugaaaauauggggaccgucgaccuagcacugugcauggcuuuguaguuuuaaaacugucauaaguugaggagaggcaucacagggcucggguguaucugcugcgugucagccuaagcgcuucugaguagggcuggcagcuaaacuacucuuggaacacaggucucuggcuucaggaccuugcucuuugauugggaaugugaacuguuugaauuugcuccauuuuugaaguuguauagaaaauacaacacucaguauugaaagcagaaaaaucgaaggacaacguguuucggguuaaauuaaauucacauuuauuuccagguugaauguuuuacaguuauucucccaugaaacaggugugcacuugaaaugaugcaguugcucucugaaacucagaaagaaguaguuaaagcaaggaugaguccauuagugcaauagccagcuuuacuuuguuuggccuauuucaaguaggauuggcuccuugcuccaaacauaagccagucaaaacacuugcaguuauaaugugaauacacuaaggacucaggaaacugauauuuuucaagcauuugcaaggaaaugaugucuucugaauaaaauucaugacauaaaccuaguccaucagcucauuagccugaguccugugccuuggugguaacuuuuuaaaauuuaaauacuuuuuuuaguugaaaacuuaaaaaauugcaugugucaccaugaauauggugugacccccccacaugaggaggucaguuuugguguaaggcuuagggcuacagaaaucgccacacauuggcagcauccuggguugagcacugugccuuuuaagaguguguuuguuuacaaaugucaguuccugguuacuuuguaauaaacaggucuguuccuugcuggcauucuccaucaaaagaguuuucagcaaagagcaguucaccccauuuaaggacagcagugauccaagugucuaacgauagugaguauccuaaaaagaaaagcaaaaaagccuugcuuuuuaagaaggaauuuacugguauuaggaaaaaaaaaaaaaaucacaaacuggcuuugguuaucuccacuggcuuucauucaucuuuccuuuuagcagaaugaaaaauguguggauaguuacaacuuuguacuaaaguggcccauaauuuggucuguguuuuacaucccagaggauugcaaaguccaaauauggcuuugauacucagagcacccccccuuucuuucucuccagccuuuacagugguuaagguacuucugugcaggucaggaugaucauguaggcagcggcuaacccgaaagcuccauguguuugucugucugucuagaucauuuauagugggcaagcuuuugccucugaggaagcuuuagaauuuaugaaauuauuuuagucagucuucucucucaauuucauaccauuaucuuugggucuuuguccuucuaucuaccacaccgggggguuugaagcaaugcuugugaaucacagcacggccaagaagcagacugccgugguaccuguguuguagcauggauugagauuucguuccuguaaauucagagauacacaaggaaagaccggaaccagggauaggcaaaguccagagccucaugcaagcuuuaggaugagcaaguuauucuaaucgagaugauguguaagauuuccuguguauuuucaauguaaaugcaccuuuuauugaaaggaaggaagauaugauugcucuguggaagugggcauauucuguugguuagaacuuccuucccuggagguggcggauggacagaccuaugaggacuuugggcucacugugagcuucuugaugguaggcuuuguguuaaccauggugucacuccacuugucacugagagauugggacagggccaguuucauggagaugugaggacuagauuucuguaauaguaaggaagccuuugauuccugccugcugacugaagcugcuaccucugaggaugcugacaaguuagcagacuggugcucaagacagggcuuuaucagcauauaaucgguggaaucuuaagcaagucucuccacuuuccaaguuaguaccaauuucaggcuuuauaagagaagggguucuggcuguaggaaauuuacauuuuuaaaguaaaauuguauuguucccaaaaagcaaaccauaguaguuugaacaaagaccccauaggcucauauauucgaaugcuugguccccaggcagugaaauuguuugaaaagacuacaaggauuaggaggucuggccuguuugaagcagggugucaccgagggugggcuucgagguuucauaagccugugccagauucagucucuuuuucuuugccuaugcaucaggauguugcucucaguuaaaguauagagcuuguuuucccaagugcuguagccugggaggggccagggcuagcucuccagcuuuccugcccugccuucagagccaauuuuuccaaccaaggcagggggaggggcauggggaaagggccucaccuguacccaugccaccucauggcagaccauuggcagcucuccucaaccucaggguuggcucacccacacccccuugaccagggcugcccaggugaggugcugggccccuacagaauguuguagcaggcgagggacagggccagcucaccuguuuucauaacccuggggccagcucucccaacugcacccaugacaccucguggcagaagaguggcggggccagcucuccugugcucucauucucaggacucaccugcucacuugugcccuaauucagggaucacuggcuuuccugugcucccacuaccaaagggaacucugcugugcuguccaggccugcuacagggccuccucuccuaagugcugcugccgaugagggacagggccagcucugcugcucuuucccagcugccagaaucagcucaaccacauucaugcuuucccauaaugcugucaccaaugagagguggggcagcucuccagagcucuccagagcauaugcaucuauggccaccaaagcagguaccaaauuggguugaacaaaaggacugccaucugcucugcuccugacucacauaagaacaccaccaccaccauggggucccuuugcccauaagcuuuuuaaggcuccacauaugagugagauuuuggucuuucucuuugcuuucuggaugacaugcauuaaagaaccagcauuuguagugucaaugaccugguuuauuagcuuauugcuuugucacuucuucauugguucucauaugugauaaauugcugauuaagcaaggugggugugugcuccuaugguguuuggcaacaacuucauaguuuuaaugcuaguuuaacucugugguccauuuuaaguugaucaugugauuugaggaaugggucugacuuccuuuuugugcauguaguuaucccgcugucccauaccaucuuaugaacaugcccuuucugauuuuuaauuaucuuucccuucagguuucugaagaguacuauaaacuuagaaggaaaaaagagagagagaaaaaacaguaauugcuucuuuuuuuuccucucugucauuuauuucccuucuuaaaaguggucuuuuucuccguuagcuauuucuucuggguuuuguuuucuuuuuacaugcuuauuugacaauuucuucaauauuaauuagaguuaaguauauuuaguuuugaaacaucuuauauaaaguguuacuggcuuuucauuacuaugaauguuuuauaauaaaaaauguuauuacugagccaagcagagacuuugauugcauuucccucuuguuaauuucugcccccagcagaucgucuuucuguucagauuuccccuuugucguucuguaucucucuguaggcaucccuccuggguuccucuaccuuucccuuuaggcugcuugcucucuguuggugcuaacuuagagaagaagcuccucugccugcacuagccuccccucuuccucgcgcuauagcaaagcuuccaucagggauccuuugcaucauauauccuggaggaggcuaaugccuacacuagugaaauaccuuaucuaggaucuugcuuucuuuuccucuucauggcuuaugaacacaaauuuaagugcuaaguggagaacagcucacuuaucagaauggcaguguuacguaucaagaucacaguuccaggaagcaaaggacugaaugguacuauaucugcaaauaugaccgcugaaccgcaaaggauguccucaccauucaugccucauuuggaggcugccuuucuuuuagauacaguuuuuaaaauugauagaaauuuuuauauuuucauaugucauagccaaggggaggagguauguaaagugugcacauaggaauugcauuuggcagccgaaagaaugaacugugugaggagagaagcuuugugguguguguguguguguguguguguguguguguguguguaugagaaggugaaacgcuucuucuauuccuaugugauaaggugauugauugcuucaagaauuaugugagccugguaaggccugaaaugcaucaucacagacuaguaagauggcaguuuucaugcuguucauucaguacuauguaacuuaugcugugacaaaugcauagcaugaggcaacuuaagggaggaaggauuuaguuugacuccuguuugaggguacagucugcauagcagugaaggugugguggcaagagugguucucugguguggaggaguaggauggcgcugguccuauuuuguccacaggaugcaggagggagagagaaaguuuggcacucuguucagcuucucaucuguucacuucuuauucugucuagaacacucgcccaugaggcuaggucuucuuguaauuaagccuaucuggaaacccccucacgacgugcucguuggugucuucuaggugauuucaaguucaguggaguuggcaaugaagauuaaccaucagaaauucaucucuugucaaucugaacccaacauaccacuuauaaaucauaacaucucccccuggccuucauauccaucucauaaugcaaaauggauaaacaccccaggagucuuuguucaaaacacccaagccccaucugagacuagacaaacucuuuaacugugagccuuuauaaaguaaauuuuguauuuguuauauacagugucacaaaguaauuauuccuguuccaaaaacuaggaaugggagaacaguaaggagagacuaguaguguguguguguguguaugcauguaauaacaauucauggaaaaaaaaggcuauacauuuuaaaagugagcaaggaggaguauaugggagaguuuagagggggaaaagagggaaauguaauuauuauaaucucaaaauaauacaaaaauauauuaauuaaaaaaguaaggugaaagaaggacugugaaugaaauccugacaucagcaucucacaucugcagguuaacauucccacagacacgcauguauaaggcacacacacaugcacacagaaacacauacacucauacauacaaacacacacucacauauacucucauacauauacauacacucauauauacaaacaugcuuagacacacaugaacacacaugcaaacacaagcauucucucucucucacacacacauacacacacacacacacacacacacacacacacacacacacagagggacuuuaguuacugggaagaacagugaggaugcuauguucagaaaauggcaaguggcugucaccuguacucuuugaggaaaugaucaaacuaaggacagugaccugacacagcucuuuuacuguaguuuuuaguucugcauauuauagaaaacugucuuuuucagauuucuuaugugcucuaccagacuuucugcuuacuuaagcuagugcuguaacacuuaacacaugggggagagcucaaaagauguuuucugaauaucacccauauaugcaccuagcccauacacacacacacacacacacacacacacacacacacacacacguagauaugcacuacuuuaccuauuggacauaagcaauuuuacagcuauaaaugcuauuuguaaaaccaguugguacaguguguuuuuauagggauaagacaggaggauuaaguuaugaaaucuaguuccuauggguauuauuauuaaaugaaauuuauuuuuucaauaaaaacauaaaauucuauguauuuauaauguauuauaguaucauauuucaauucauguacauguuguauaauauuuaaaucaaguuauacuuaaguagaacauacuuugaucauauucuccaauuuacuugauuaucuguucuccccaauuucuuuauauuuaccuguauuuauuguccacuuguccuucuuuugaaauauguuaguucaguuuguccacccaucucuugauuauuauuuguucuuuuagugaugacuuuuuauuuguuuauguauucugauauucuuuuuaggaugaauagcuaguaaauuuuuucccauuauguagguuuucucuuuacuagguuaauuaucuucucuccuguguagaaacucuugaauuuaauucaguucuacucaccaguucucauuguuauuuccugagcugguggggucuugcucagaaaguuauugccuuuuuuaaaaguauuuuugaaguguucugcaauuuuuuuuuuuuggauucugguauuaugcuaauaccuuugauaaaauuuuaauugauuuuuuucacagcauaaaggauaguuuuucuuuuuucuuuucacgugauauccaguuuucuauuuauaucuguuaaaaaugcagucuuuucucuaaucagugauuaugacuuuagaugugugaacuuauuucuguaaacuucauucucuguaauugguuuguguaucuuuucugugggccaggaagugugugcuguuuuguuacauuagcucugcaguauuuauuuuaagucaguacucacagcgguguaccuuuugcucaggacugacugacugugucuuuugugauuccauaguaaguuucagacugcugagucaguugcugugaggaguguccuuuggauuuuugacagggagcccacucagucugugcagcacuuagguaauauggucauguucacaaugaacauguagaaguuuuguuugcuuuuuaagagucuuucccaaguuacuucucugauugacaguuuucuuuguagagaucuuucacuugcuugcauuggguugcucuucaguauuuuuuuccagacccuuuaauuuguuuguuuguuuauuuauuuauuacauauaccgcauucucacugcauguaugccugcauaccagaagaggguaccagaugucauuauagaugguuaugagccacaaugugguuccuggaaauugaacucaggccucuggaagagcagagucucccugccaucucugagccaucucuccagcucuuuucugggcucuuauaaauggaguugucuuuuucuucuuuuuuacucaguugguuuacuauuggucucauugccauuucucucgccucaguauugugcuaccuaugugcuucuagccugcugguuuauuuguguaauggcaugauccuccugugccuguuuucuucuaagcuuuuaucaugaagaaaugcuuuguuuugucaaauucuuuugcuucaucuauugacauggugugcaauuuugcauuuguagauuuacauguggagccaucucugaaaagaaacaaacuuaauuaugguguaugaucuucauacaguguucaauuugacuuggagauguuuuguuuaugauuuauauaucuguguuuaucagagcucuuauauuaauaaaaacuuaaucaaguuuuggugauguuaucuucauagaaugaguuuggaagcauuuuuucaaauuuuguguuaugagauaguuuaagcaccaagggcauuaguucuuuaauaaagaaccaugaggaauuuauuguaucuguggucuugaguuuucugugucagaagccuuuaauacugcaauaauaccauuaguugcuauagauuucuuuggauuucuuuuucuuuugguucaauuuugggagaucuuaugugucuagaaguuuacauguuucuucuagcuuuuauaauuaaguuuuuaaaaaguuaacccuuaauggcucucuggauuuuuuuuuuuuuuuuuuuuuuuuuuuugguuuuuugagacaggguuucucuguguagcccugucuguccuggaacucacucuguuuuuaugucauguuauuuuacuuuccugccuuuaguuuguaccuuaaugucuucuuuugugaccugaauauccaggcuuugauuuuguucauaucacaaaagucuugcaucuuauguuagagagagagaaagagagagagagagagagagagagagagagagagagagagaguguuuauuauuguguaaauuuauuucuuggcccaagcccucagaauuucuguccuccuuuagcuauugauaauaauugaguuuuucaaguuaacuuacugaacuuuuuaagauuuuuggguuuccucccaacaucucuuuguugaacuuguuguucauauuuugcauugcuuuccuuaauucauuucauugcauuucuuuauuuccuuggcauccccugaucuuaagaaaaaaagaaucucucgguuaaauucugcauccaguauaucaugaguuucagcugaguauuuggggccuuucaguagagaacugagagacucuggaggaguugcacugccuuguuuuuucguauaucuuguauauuuauauugagauuuuuagaucaauuuuaaugacuuauuuuuucaguuucacgugagucuugugacauguccuaggauagauagcugauuauguugaauauauuuccagguggcuuugauguaguuuuagugaagcucauuucuuaccucucucaggggauuaguauuuugucaaauuuguacuguuguagccuaggaaugcccuguuucccuguaggucugacaggaguggcacaugucuaguaacaggcagauguguuuuauauaugaacgucaggagguaugcccuuuguaauuacugcuccagccuugacagcagcacccagucugagcagucugggaacaaccuaugcugugaccucuccuagguguugcacacagaguugcuuucuuucugcuguuucuacagggaaacauuaggccuucaggccccaccuagccaugccuucuuagagcuuuguugacaguuugugguuuuuaucuuuuguucuuugaguaaugugguuacauguaacccaaggaagguagcucagaaaagcaucaacauacaaaguggcaaccuugauuccauggcuuccuagaaaggaccaaacaaauaagaauaaggacagcaacaaauagcagugaaccagacccaaagcuaaaguggaaaaccacacaccaaguauaaaagccuuauaggaggauuuguggcagaaauaauuuuuaaaggauguuuaaaaaugaggcuaacaaaugaaagaagaaauggaaaaguaaaagcaaaagaaaaguuaggauauuaaaaaugcagaagaaagauucgagccccgggcuaccuugccagcggagucgccugacacccgcaagggccaacacaggauuccccacggaauccuaagaccucuggugaguggaacacagcgccggccccaauccaaucgcacggaaccugagacugcuguacauagggaagcagacuacccgggccugaccuggggcacaagccccuuccgcuccacucgagccccgggcuaccuugccagcggagucgccugacacccucaagggcccacacaggauuccacaugggauccuaagaccucuagugaguggaacacaacuucugccaggaguccgguucgaacaccagauaucuggguaccuucccuccaagaagagagcuuuccugcagagaauacucuucccacugaaacuaaggagagugcuacccucccaggucugcuuauagaggcuaacagagucaccugaagaacaagcucuuaacagagacaacuauaacagcuagcuucagagauuaccagauggcaaaaggcaaacguaggaaucccacuaacagaaaucaagaccacucaccaucaucagaacgcagcacucccaccccaccuaguccugggcaccccaacacaaccgaaaaucuagacccagauuuaaaaacauuucucaugaugaugauagaggacaucaagaaggacuuucauaagucacuuaaagaauuacaggagagcacugcuaaagaguuacaggcccuuaaagaaaagcaggaaaacacagccaaacagguagaaguccuuaaagaaaaacaggaaaacacauccaaacagguaauggaaaugaacaaaaccauacuagaacuaaaaagggaaguagacacaguaaagaaaacccaaagcaaggcaaugcuggagauagaaacccuaggaaagagaucuggaaccauagaugcgagcaucagcaacagaauacaagaaauggaagagagaaucucaggugcagaagauuccauagagaacaucgacacaacagugaaagaaaauacaaaaugcaaaaggauccuaacucaaaacauccaggaaauccaggacacaaugagaagaccaaaccuacggauaauaggaauugaugagaaugaagauuuucaacuuaaagggccagcuaauaucuucaacaaaauaauagaagaaaacuuuccaaacauaaagaaagagaugcccaugaucauacaagaagccuacagaacuccaaauagacuggaccagaaaagaaauuccucccgacacauaauaaucagaacaacaaaugcacuaaauaaagauagaauuuuaaaagcaguaagggagaaaggucaaguaacauauaaaggaaggccuaucagaauuacaccagacuuuucaccagagacuaugaaagccagaagagccuggacagauguuauacagacacuaagagaacacaaaugccggcccagguacuauacccggccaaacucucaauuaccauagauggagaaaccaaaguauuccacgacaaaaccaaauucacacaauaucuuuccacgaauccagcccuucaaaggauaauaacagaaaagaagcaauacaaggacggaaaucaugcccuagaacaaccaagaaaguaaucccucaacaaaccaaaaagaagacagccacaagaacagaaugccaacucuaacaacaaaaauaaaaggaagcaacaauuacuuuuccuuaauaucucuuaauaucaauggacucaauuccccaauaaaaagacauagacuaacagacuggcuacacaaacaggacccaacauucugcugcuuacaggaaacccaucucagggaaaaagacagacacuaccucagagugaaaggcuggaaaacaauuuuccaagcaaauggucugaagaaacaagcuggaguagccauucuaauaucggauaaaaucgacuuccaacccaaaguuaucaaaaaagacaaggagggacacuucauacucaucaaagcuaaaauccuccaagaggaacucucaauucugaauaucuacgcaccaaaugcaagggcagccacauucauuaaagaaacuuuaaugaagcucaaagcacacauugcaccucacacaauaauagugggagacuucaacacaccacuuucaucaauggacagaucauggaaacagaaacuaaacagggacacagugaaacuaacagaaguuaugaaacaaauggaccugauagauaucuauagaacauuuuauccuaaaacaaaaggauauaccuucuuuucagcaccucacaggaccuucuccaaaauugaccauauaauuggucacagaacaggccucaacagauacaaaaauauugaaauugucccauguauccuaucagaccaccauggccuaagacugaucuucaauaacaacauaaauaauggaaagccaacauucauguggaaacugaacaacacucuucucaaugauaccuuggucaaggaaggaauaaagaaagaaauuaaagacguuuuagaguuuaaugaaaaugaagccacaacguacccaaaccuuugggacacaaugaaagcauuucuaagagggaaacucauagcucugagugccuccaagaagaaacgggagagagcacauaauagcagcuugacaacacaucuaaaagcucuagaaaagaaggaagcaaauucacccaagaggaguagaaggcaggaaauaaucaaacucaggggugaaaucaaccaaguggaaacaagaagaacuauucaaagaauuaaccaaaggaggaguugguucuuugagaaaaucaacaagauagauaaacccuuagcuagacucacuaaagggcacagggacaaaaucuuaauuaacaaaaucagaaaugaaaagggagacauaacaacagguccugaagaaauccaaaacaccaucagauccuucuacaaaaggcuauacucaacaaaacuggaaaaccuggacgaaauggacaaauuucuggacagauaccagguaccaaaguugaaucaggaucaaguugaccaucuaaacagucccauaucaccuaaagaaauagaagcaguuauuaauagucucccagccaaaaaaagcccaggaccagacggguuuagugcagaguucuaucagaccuucaaagaagaucuaauuccaguucugcacaaacuauuucacaagauagaaguagaagguacucuacccaacucauuuuaugaagccacuauuacucugauaccuaaaccacagaaagacccaacaaagauagagaacuucagaccaauuucucuuaugaauaucgaugcaaaaauccucaauaaaauucucgcuaaccuuaauccaagaacacauuaaagcaaucauccauccugaccaaguagguuuuauuccagggaugcagggaugguuuaauauacgaaaauccaucaauguaauccauuauauaaacaaacucaaagacaaaaaccacaugaucaucucguuagaugcagaaaaagcauuugacaagauucaacacccauucaugauaaaaguuuucuaaagaucaggaauucaaggcccauaccuaaacaugauaaaagcaaucuacagcaaaccaguagccaacauaaaaguaaauugagagaagcuggaagcaauuccacuaaaaucagggacuagacaaggcugcccacuuucucccuaccuuuucaacauaguacuugaaguauuagccagagcaauucgacaacaaaaggagaucaaggggauacaaauuggaaaagaggaagucaaaauaucacuuuuugcagaugauaugauaguauauauaagugacccuaaaaauucuaccagagaacuccuaaaccugauauacagcuucggugaaguagcuggauauaaaauaaacucaaacaagucaauggccuuucucuauacaaagaauaaacaugcugagaaagaaauuagggaaacaacacccuucuuaauagucacaaauaauauaaaauaucuuggcgugacucuaacuaaggaggugaaagaucuguaugauaaaaacuucaaaucucuaaagaaagaaauuaaagaagaucucagaagauggaaagaucucccaugcucauggauuggcaggaucaacauuguaaaaauggcuaucuugccaaaagcaaucuacagauucaaugcaauccccaucaaaauuccaacucaauucuucaacgaauuagaaggagcaauuugcaaauucaucuggaauaacaaaaaaccuaggauagcaaaaagucuucucaaggauaaaagaaccucugguggaaucaccaugccugaccuaaagcuuuacuacagagcaauugugauaaaaacugcaugguacugguauagagacagacaaguagaccaauggaauagaauugaagacccagaaaugaacccacacagcuauggucacuugaucuuugacaaaggugcuaaaaccauccaguggaagaaagacagcauuuucaacaauuggugcuggcacaacugguuguuaucauguagaagaaugcgaaucgauccauacuuaucuccuuguacuaaggucaaaucuaaguggaucaaggaacuucacauaaaaccagagacacugaaacuuauagaggagaaaguggggaaaagccuugaagauaugggcacagggaaaaauuccugaacagaacagcaauggcuugugcuguaagaucgagaauugacaaaugggaccuaaugaaacuccaaaguuucugcaaggcaaaagacaccgucaauaagacaaaaagaccaccaacagguugggaaaggaucuuuaccuauccuaaaucagauaagggacuaauauccaacauauauaaagaacucaagaagguggacuucagaaaaucgaauaaccccauuaaaaaauggggcucagaacugaacaaagaauucucaccugaggaauaccgaauggcagagaagcaccugaaaaaauguucaacauccuuaaucaucagggaaaugcaaaucaaaacaacccugagauuccaccucacaccagucagaauggcuaagaucaaaaauucaggugacagcagaugcuggcguggauguggagaaagaggaacacuccuccauuguuggugggagugcaggcuuguacaaccacucuggaaaucagccuggcaguuccucagaaaauuggacauaguaccaccggaggauccagcaauaccucuccugggcauauauccagaagaugccccaacugguaagaaggacacaugcuccacuauguucauagcagccuuauuuauaauagccagaagcuggaaagaacccagaugccccucaacagaggaauggauacagaaaaugugguacaucuacacaauggaguacuacucagcuauuaaaaagaaugaauuuaugaaauuccuaggcaaauggauggaccuggagggcaucauccugagugagguaacacauucacaagggaacucacacaauauguacucacugauaaguggauggauauuagccccaaaccuaggauacccaagauauaagauacaauuugcuaaacacaugaaacuaaagaagaaugaagauugaaguguggacacuaugacccuccuuagaauugggaacaaaacacccauggaaggaguuacagagaaaaaguuuggagcugagaugaaaggauggaccauguagagacugccauauccagggauccaccccauaaucagcauccaaacgcugacaccauugcauacacuagcaagauuuuauugaaaggacccagauguagcugucucuugugagacuaugccggggccuagcaaacacagaaguggaugcucacagucagcuaauggauggaucacagggcucccaauggaggagcuagagaaauuacccaaggagcuaaagggaacugcaacccuauaaguggaacaacauuaugaacuaaccaguaccucggagcucuugacucuagcugcauauguaucaaaagauggccuauucggccaucacuggaacgagaggcccauuggacacgcaaacuuuauaugccccaguacaggggaaugccagugccaaaaagggggaguggguggguaggggaguggggguggguggguaugggggacuuuugguauagcauuggaaauguaaaugagcuaaauaccuaauaaaaaauggaaaaaaauucagaagaaaaaagugugagaaagcuggaaauugaaggugcagcaacgaguuuacuacacugcuuuggcuccugggguggggggugucacacucccaggcaccugcccagaagcucuuuggauuaucaaaugaaagacacgcgcucaugaguacacacacacacacacacacacacacacacacacacacacucggaggccaguuaauuuuaaaaugccuuggcuagcucaaagacugggcaguucuaauccuccccauggguagcccccauuuuucuccuguaauccuggcuuaacaccuucuaauucuguuuuuuaucuuuuuugcccuggcuccuccugggugauuuccuagucuuugcugcccaagaggcuucugggcagccuuucugggcaccacauuccuucucacuuacauuucggaugauuuuuuuuucuguagcuccaagccugauccgucucccuccaaaugauggcgauucuccucuccuuccucccaguaccuagccugagcaaaucuaaagauccugccucagucuaccugcccaguccaccuggcugcuggcucuguauugguaaaucuaaaacuaacuggggacaaggaccuucaguauuuggacaagcagauuccugauuuugggggcaaagcauuagaaccaauucccaacagaagguauaauuuaaaggaaaaaacuugauuauauaauggaaggauuuaaguagagaggagagauaaauagcauaacaaaaaacaaaagagaauacugaagaaauuuuauauuguaaaugaauauauguauauuuacuuauauacagagagagggaagggaagggagggagggaaggagagaggaucugccaguguaaaaacaauaggaggaagagagggagggaugagagaagagaaagagugugaaaagggaaaaacggauuggucauaaugaucuugcagguggaauggccacaguugauccugugcuuuccaccucccauacugcagcuuccacugugguuucucaagcccagucucugcacgaaugcacucccuggucagucuacugcaaacuccuuagcuggcugauggagucagcugccacccaaaagcaaagggggccuuacaccauuuuugucucagacccaaauucuacugugcauauuuuccaaugacauugcuucucuggcuuuugacuagugucacaugaagccacaaggcagcugauggccaaauaaccugguaguaccacuauggauucugagcuacagggaaauguagcaaauuaauuaagguccucuaagcaaaaagcacagguacuguccucucagaauucuuuccaagauggugccaaugcaguuccauugaaaaccagcacuuuuccaaaugugagcguacuguggucagacugccuuucuguuccucauguuucuauauaauuuccccacuauuuuucuauuuuuuuuuuccucucuucucuguugcaccaacaagcugccaugggcccagugcuaacacaccguuucucugcuugucuucugguaacucucuccaagucucugucuaaagcuaaacuucagugcccucuaccucugcucccaccuggcuccgaagcuguuuuccacucccaauucuaaaaggcugagaagcuagaaaguacuuguugcuucuaauuccucacuugguuuccucuauaacuguuuucuuauuuguuuguuuuuauauaguucugagauugacuaaaauguucccuccuucccuccauaugcugaugcagucagagccuguugauuuacuuccaagacacaauuauauacacaggcuauuucuaugguacauuuccuguuuguuucuaaacugaaaccauaaaugucauggaaaacagggacagugacagcuuauuuauguccuccccaagucuaguacagugcacugcaccaaaugcagugaguuauuaaugaaugaaggaauugauugaaugaauggcuggcuauaagugaaaggauaguugcguggauggaugagugagugauauauugcaggagacaauguauuuugacugccuguuaggcuaugucuuaugagauaaacucaugguaaguuuuagaaucaugaacagaauaaaacaucuuuuuaaaaguuaguuauauaaucaaagucaaauuaucacuuugcugcaacuaaguucuuauugaauauauuagauacuaagucuuugcuugagggcaggaaauaguagauaaagagcuauguuugaaaaguuggucaauaaguaaagguagguauuugggaagguuucugccucuugccugacaugguccugggaggguuggucugaaugguauaaugcagaguguacaggucaggcuuguggguccucauacucagcaaagccaugaagaugguuugggagaguguugagagagcagaagaccugucggugguagcaggccuaagagucucaggcauaggauugugggagggaagagagcugcaggcaucaugggguugugucuguuugcaaucuaugacauaguuacaggggacagcucacauaacuccaagacaggaggacccucugcauuaauucucacagcugcuccucuuugggaaucauccuggaucuuuucagacucuauuguugcugcucagugugggggugugcaugcuagagaagugaccauacagacacacacucuugaccacgagcugccuuaguuccauguugcugagaccauacuuguucuauuaguuaugacuaggcuuccagugcagucagaaccuagagcucccaagggcccacucagugcugaugagaaaauagucauaagcaagagguuuaauuggaaauucagugugcuccauacauaaaaugccuuugauguuuaaaauaauuaauauuuuugugaauugcuuucaaguuuuauuugaucaguguggugcauggugguacuaagaacaggaguauuagguagccaagugauguauguguagagaacugcacagagucuagcagaacugggcuucuuccauuuacuugauacuuuauuuguaucucaguuuacagaucugcacagugggguuaaugacaguguuugcccacaucagacgcugagucuguccaaagcucugauuacuugucuugucucauugcuuauuucuuagauauuucuccuugucauuucuuuauuugagcuggcuugaccucuuguugccaggaugacauaauaaccucuuaaccuuucagaguuaguuauaucaaaugccacuuucaacccaucucuccuuccuuuagaagguuguguucuuuccugcaagaugccuuucuucuucuuuuuuuuuuuuuuuugaugccuuucuucuaaauugauuauuuuguuuauuccucacacaaccucccaagaaaggaguauauggagagguagaaaccauccauugcuucccucucaccuacugcuuguuuagucuguuucaagcucacuugccccauguacagucuuuugugauuuaguguggauaugcacuuugaugcccaugaauuuuuuuucuccucuccuuagucuggaaaugacucuuagucaccuuucuaucugcauaaagacaggucuuuaaaccaugucuucuggcaauaagauauguggucucugcuuuuaaucaguuuggguuuaacaaaguauuaagagucagcuuuucucaaguggauguauaggaauuguggggauugcauuauacauuguuugaugguuuuuugagugagaguauaauucauuaagaaauaagguuaguaguauuuccacaaggagcuacuuucaguauaacaggaugcuucagaagcaggcagcugacaagugcugacucugaaaugggcaguacacuggggaugggggugggguugcucuuagaugccagcucucuuuccagggcuacuguaacaagucaccacaaauggacagaaaaccagauagagccauucacucacaguucugaaagccaacagccugcaguaaguugccagcuggaccaggcuuugucggcucuaggggagaauuccuuuuuggccuguuccaacuuugcugguugccaguuuuguugucuugugaacacaucuguuugcuccaucuuuaucccaccuuuccaucugugugucugucucuucagugucuuuucuaagggcacucgugauugaauuuagggcccauauugauaauccagggugcugucuucaaaacuuguaauuuggucaucacacagcaauugauauuuugcugguucauucauucacuuaacagguaaucaugucauaaaacaggcccuuuugcuagacuucuguauauaugccaauaaguuguaaauucuguuucucauaaagucauugugcccagaagggacaguuuucucauuagaggcccaauauccauguucaugaauaacuacagaauaaggaagcaaaacuauaaagagaaauucugacaguaauaguaggcauggaaaguuuacaggaggucuaggcagauaucuuauuucaugauuuacccacugaaguauuugaacugacucuuuaugugugggguggacuuacgauacaaauagcaacuggcuaacuugaaauuaccucugucagaucaucucaguguacucaauaaauccccagguuaucuuguaaaaccuuuguaucuccauguaccuuaguaaguuguuuaucacuaggaaagugaaaaggguuugcaugugauuucuuuaccaaaaaaaaacaacaacaacaaaaaaaaacacuuacaguuaccaauuauuauaaucacucuuaucauuugcauuguugcauuguucugcuuuuucauuugagaaaguggggggggggguagagggaacagcuggugccucuguaauuauacauaaccaaccccaaaccugccuuuucugcauacucuugggagcagaaaagaaaugccauccucuguuaugcauaauccauuaaaacuauauacccacauacacaugcacacauacauauguauggaauagaccauguaauuauacaagugauuggucucuuggguauugaacacguauuaagaguagacuuuuuaauuuuauuuuauauuuuuaaauuguguguaugugugugucuacgugugugugucugccugcgucuacucauguguuucaaggggauauguacuacaguguguggcaaaagacaauuuguagaauuuauucuccuaccuuuacagaaauucugggauuggaacucauaccauuagauuuguaugacaaguucuuuacucgcugagacaucuagcuagccaugauguuaaauuuuuauuuucauuuuuugaaauuaauaaaaaauaguuuacauagaaaauaauuuuaaaaagcuacuuaagauuuugccugggauggugggugaguaccuaaauccuaguaccucagaggcaggaggaucauaacucccaggcauagaaauguuuuuuccaacuuuuuacuauugguuaugacuugaaguuauaugagaacaagugagcacacuggaauagaagaaaaggggaggagcuucaugauaaaccugauccuuuguaggaauaucacacuggauggggaagccuaacaauccauuuuugagaugacaguuuuaagauggagauugaaucauucaagaaaaauuuguaccuuccccaguuacucuuuuaucugauacuuuugaguaauaacaaaucaacaaaucaacguuuauagauagaaacuaaagugcucuugaggaauaaguucauugucuuuauaauacucuuggaaaauucuuaucuuuucucccauuaucuagucucccuuucuuguccucucucuccuccgcaaguggugagucggcauucugccagacuagcccuuugcaugucugcuuaugggucugguuuuggccuuucuggccagucuugaguuuguagaagagaauuccauuguacuccaugagaaggcuuacagcuggcugcgcagaggagcaggccagcauuccuccugcuucuuauguuuccuaggccuaacagugugacuggucagcuuagguaauuuugggauuugggauuuuuccugcaaagcaugaauauaaauaucuugaacacccucacacuacacuaaaugaagcccaugugagacuguagagaacacccagagcuuuccuuuauucucgugacuuaauguggcaaauuuauuauuucauuuugaccugugccuggaaagaaauguuuugauacauucaugguuuguuuagagggaauucugacucuauuuguuuucaggauuuugguuuuuguaauaaauuucgaugguguccagcaguguaagcacauuccaagauugcuucugcuuugacaccauugaaggugcagucuuaagaguauugcuuaugaaagggaaauucccuguuuaacuaguaggagguguuuucuuuuuauccuuuaauuuuacuuuccgaucuuuaacuguauucuagaagagauaaaaaaucuauguucagagugaucauggcacagucucucacuuuuucuuuauaauccuaagaaaaggaagaauaccaaaaucauggaaaauucacuggcucuucccguaauugcuaucaauaaaauguucuuuucauucgagucccccuggauguaaacuagcacaagccaaaauuagcaauaaucuccaugccaagagaauuucaugaguucgggaagcccuuugagucucugcccuuagucuggcaauuguuucauuucugugcuaauaacagaauccaaggccauguucauucuccagaggucccaaccacagacuaggaguugaauacugaacagcauagugaagguguggguaaucuuauucuaucuguagugauguuggcuacgcaggcagcccugucaaaagccuggucaucaguaguaguuuugggacccuagacugugaacugaggauacuaccuuuguagcacaucaaguaauaaugugagcgacucguauuugcaaagacuaaaugaaugguguagaguuuuacaacugaaugaauaaagucucuuuggaagcaugaauagcauaaaaaggcuauuccccaaagugucacuuccccaaaguaaacuaaggcaaucgcagcagcacaacuucagagauugaagcacaauuacacacuggcuuguacuuucaucuuauugguuaaucuuuguuuuuggcaugagucuguguguuuacacaauucaaugacucugagcuuuuuaucuuguaaaguguguugacacauucauucggaaagucaguagacgugguacuguggcagcuuuguggucuuuagguuuugauuucccucugaaauuaccaccaugcuauuaaacuuugaugaaguuaagagcaucagaugauagaagaaaaugcuuacuagugguuuuucauguuuggaguuugggaagcgugcuguuuucaugaaggcgucugagagugcacauggugagaagcuccuuggccacauguaaauugagaaauacauuucaacaucaguuuugaugaaacuaggaaugugagccugccauggagaaacaacugacucccucaucccuuacagcaugagcguaaagaugugguagacagucagcauuuuccugucuuucuuaaaaauaguguggguuauaaaaagaaaauaacuaacuuuguauggagacaaaauuuuuuugaaguaguuuuuguucauugaguugauguccagguggaaaauaaagaccaauuaauugcuaauacuuuucaaaggaagcaaugcuacagcucagcucugcuuaaaagugugagugucagccugagaaguaguucucacacaugcccuggaauugugguuguaaugucuucauuccauuacucccucuuuugaaagcaaggucucauuauguugagcaggcuggcuuuaaagucccaggcucaaaguguuacucucaacuucuugaguagcugguccuacagaugugcaccaucacucuccacuggaguccuuaucuuuacaggaauacuuaggauuauuccaggucuaaauuguaguauaucucccuugguggacugcccauggaugguauaccagggaguaagaugagggaggacugagugagucacuagacagaacccgaguagcugacuagcuuguagugggaucagaugcucucuauuugacugcuauguccuguuauagcaguaguucucaaccuguggguuguggccccaacagaagucauauaucuaauauaaugcaaauuaaauagcaacauaauucauaacaguagcaaaauuacaguuaugaaguagcaacaaaauaauuuuauaguugggggucaccgcaacaugaggaauuguauuaaagggucguggcauuagaaagguugagaagcacuggguuacagggucggguccucaguccugccuccugccuguccuucuuugacagagcagauucucuugaaaagaugaggcuuaguccgaugcaguuuccuguguguuugagaaggugguguauucuugcuuucacugggcagaguuuaagacaucccacagaguccuguuaugcaugauacuucuucugcaguccuguuugauuuuugcuuccuugaucugacaugauauaaagugagguagucauaacuacucuucuguuucucauuuuacccuuagaagugguaucuuauucaauaaauguuagaucuucuuucccguuugccaggaaugauugucaucaugagaacacaauuuuaaagaccucaaaggccuugggcucaugaagauagcauuucagucagcauauaacaguggacaaagauagggccauuucagauacagcuugaaugcugcugaaucugugagucugaaauuugaaacguuucauuguugacauuauaguuuaggaaacuuggauuugggguuucagaacgagugacauucagcugguaaaaucuguguaaauaucccaaaauuagaccaacucugaacucugcaguggagccuuggaguuggaaagcaacaagucuguguucugagaccuggggacaggguucugcacugagaccuggggacaggguucugcacugagaccuggggacaggguucugcagcaggagaagcugcagacagagcuggagaagcggacgcgcugcugcagaggagcggccuuuguuucugugcuuccgugccgggccauucguuccucagagcucugccgucacagaggccuacuguuugcuuuauucuuguugcuguaagugacauuauauccugaacauuguugucuuugcacuugcuggcaaaauuugcccuuuuagaucuggacuauucagacauuucuauaauugacugacauguggacccuguaaguuugugacuuaucuuagugaaaagaggagcuuaaaugguccccucuggugugggaaaucauuagagcauuuaucccugcuuaauuuauuuaauagaaauaauaauaacaacaacaacaaugccuaaucagggcugggguuuucucucauauuagagcauuugguuagaaugcauucaaucuccagggcuuuguaugucacuaaggguagacauugguguuucaaaagcacccccacaccaagcacucugugucucuuugugucugcugcuuguggcucagaagguaaagcucucagcuauugcuccggugcugugccugucugcuuucuggcaugauaauaauggacuaacccucuggaaguauaagcaagcccccaauuaaaugcucucuuuuauaucuguaucccgccaugauaauaauggacuaacccucugauacuguaagcaaaccuccaauuaaaugccuucuuuuucaagaguuccucuucacagcaaugaagcaguaaguaagacacacauacacaaacacuugcaaacauacaugcauacacacauacacacaccagauacacaugccugcauacaagacacaaacauauacacauauaaauacgcacaaauaaaugcauacacauacauacaaagagacacauacugucauguacacacacagaaacacacaugcaaaugugcauagauaugcagagacacagauacaaacucaugcacacaaugcacccccacauauacagacaugguaaaauauuugugauaucuauaaaaagugugaaagauuaauauuuuaagaaacuuaguaccuacauauaacauuacucuguaacccaaaaguauauauaauuauauaugcuaauugauuaugaagaaguugauauuagcaccuuuauauaauaguuauaugggagggcccucaguuuagaaaagugaguggagggagggaggggaaucucuucuccagguggaugaugcuacccccucaguuaugaccugauguagccucaugggaaaagguauucuucuugugacuuacuugguaaaaaugacucuuguuuaguguccaccuuacaccaaugagaagacucuagcuacccauccaaccauacagcaguuggagaguuuaaaauauuaaaccaguguuuaauguuucaagaagaauucuggaaaugagaaucaugaugcugccagccagguaaagggagcuucacuugaguaugcagucauggguuuugaugaagaagacacaaaggaaaacugcagaaauccuugguggaggccaggugggaagugguguucaucagaaccaagguucuaucuucugccucauuguuugccuucugccguugggcugguauaugcucaauaaaaagcaagugaauaaguagcuagugaccaccagagauggagcacugcagaauacaggaaugucaaguuccaugaggcuggagcaucuggcagacgguaugccucacagcaagccaugcagcuuaucgcaagagccgaggcaagauuucagagagaagaggcuggcuaauaauaauuccgagaguggguccuaaagugcagcugacuuggacaaauugggauguaugguuagcuucucauagaguuagucuuuucucugagaacaacugaaagaaagcucucaaaguucuucuaguggaguagaggcuggggacaaaguugaacccaguuugaucccccuaggaacagacugaaggugaauugauggagggaacacaagagagugcugcagaggaccaagcaaaacaaagugguggcuuggauuguaggaggaacuggguaccugggacuccaggauggggguugucugugacuucuggagaagggagugucaagucuuagaagcagaaaggucaugcuaccauugaccuagaacuggagagggagcagguuguuguggggauugaaaagugaagguauggacauuaaaguuugcauccuuaccuuaugaacaucauuaucuuaugaaaagggaaagagugaauagccugcccauucuucauguucuuuauccucugccuucugccccucuaucuacccauucacuauugacuuaggccaaaaauguaaacggaaaacaaucucuuucuuuccuuacagguaagugugucuuacaaaguaggugcugagugaaccugcuuagcagagcaaaugguuuguccaggagagaggggauuagagaugccuuuagagagcuugaagaccuugggcuacaaacagccugcuugggaauaugaaauugggaacacuagugaagaagaaaaagaagcuaggauggggccuggaaacuccccauaggagccugaaacgcuagaguccuucagggaauguccuuugcauuuagaauuguagcugauuugcaaacaucucaugucauauaauagcuucucuccagggucuucaccucaccuuuuuaaaagcguggagcauggacuuaguauuaacauguagaaagcggguugccuguggauagcacuuuugucccaugagguagacacacacugaaauagcucaguccucuagucaucuguuuucuuguucaagagaagaguuuauguccuugcaugcauaacccagcaacucccugagguguuuaugaggccugugugcuguggcaggcgcuaccuuccgggcagguaacuuuacucuaugagacuugccaguauugguggccaccauugcccucuucugguaaggggcuaaugcugcaaaugcacugaguuuuuacaaggaagaaaauugaaccucagcauucacuuugaucaacugugcucugccaccuggcauuaagcccuaauaaugaaaugaauguuugccuucaguaguguaauauauacuccagccauauaauugugugagucuaaccuuauuuacaguuuuggcuugugggcacuaccuuggauauuccuaccauuuuccacaucuguccacuuucuuguugaugaaauauuucuucugcuuuuuucacugcuuaugaaagccugucuugucuggcuucuucauuagcuaauacaugugaguuugcauuguugauaguggcagcaauuacaaugaauauggaucuaaucaauuuuaguaucuaauaucucugaagcaguagggcagagaauguuauaggccugggcuaaacaauguucauuagggauaucuuaguauuucuuggugacauaccuaugugcuuuauaauuccgaggcaacuuuaugucacaugguaaaaguugagcuacacugaaguaacugccuccauuggaaggagcagagagaauaugguauuucaguguucuuuguggaguagcuacucaaagaacaggcccugcaguuucuuuucugauuagucuuuggcagcuucccuuuucuucuccaguagaguagauauguucuccgugaaugaauggacauuguacagaggaaccauagugaauauuuauaagggaaaugguguuuuauggggcauuuaaguacuucuuuaauaaaauccuuuaauguaauccuucuuaaaauguagaguuuuaguuaucucauuaaauagcuacuugacacuuaaaccugaagacuaguacagauaaaagcuagguaccaugcuuauuccuuuuauuagaauauaaagacaugauguuuaucuuuucagcuagaucgauuugaugucaacaguuaagauaauuagguuuguuuuuuuuuuucccuaggaauuuaauagcaaaaggaaauacaucuuuuugggagauuaauuaugaugcauggaagaauccuuggguaauaauaauaauaaucuuggguaaucugcacugucaggcuucaucaguagguaccaauguaugaucaacaaagccugaugcuuccuuaaacugaggaguugaggaugggacaaaacuguccuguuuaggggcaguguagaaugaaucagaaagcacgcaccgaaagaaauauagcugcuuccccccaccaccaaagaaaaauauuuagccuuucugccaguuaaauuagaaacaggcacuauagaacuugauuuucaggacacuaauucucuaccagccaugcuaaggcagaggcagugagggaagcauagacgcaggauuaaaggaguagaauguuaucuagaaagagcagggguggcacugcgcacggaauagaccauggaggacccuccaaagaaaccauaaccugcaccuuaacuucuuuuuuuuuuuuuaagauuuauuuuauuaauauauguaaguacacuguagcugucuucagacacuccagaagagggagucagaucuuguugcggaugguugugagccaccaugugguugcugggauuugaacucaggaccuucggaagagcagucgggugcucuuaccacugagccaucucaccagcccugcaccuuaacuucuauaggucucaggucagaguucaucacucauugccuacccuguuugaaagacacacaaauuuaucauuucccccuugucuccagguguucuauucagugaaccuucagagaagcccaagcagcauuagaguccaugugacaaugccaggacaacauucucgguguugguuucuaaaacacgaaggaggaaagaagggagggaaggagaggaggagggagggagaaaaggagggaaggaaggcaggcagacaaaagcagccagugaaacauauccagcaaggacugguggggucaugcagaugauccuaauguuuguccagggacaggaaccacuugucauaggucacugauugucacaguguggcccccagguccaucaagguuacuuggaauuuuguuagaaguucaaauucucaguuuccccucccccuccagggcaagccuuagcaaucuucugugaaucuuacacacugaagcuugaggaacgcuauuuuuggccauggagaugucaaucaggucccgagaaucucgagcaucuuacagcagauuuuauaaccauuauuccuaagucagugguagagucuucagaguucaguggccucaggagacucuucccuuaccgagaggaggaugccugggagauguaaguuuccacugagaaccuuuauaagguuuaauugcuaauguguaggaggcagcugauacugaguugucccucccacucaguucagcuaagcuuucaaccucucucucaauauucuuaauuaaugaucuacagcuucugaagccauuucaucagggucucaugucuuggcauguuuccucugugagcaucccuugaagaggguguuauucccagcagucaauuagaaaaggaaaguggagguggcucucaacagauccugugaccacuuaacuaucucccuuuauuccucuuuguaguucucuaaaauuaggccagaggaagaaaaauucauuucugaccaacagcccugaccuuguuugucuaacacagacuugucccauuuggauuucaguuuccugccuuaggcaggaauugauugaaaauucccuuugaacucuugaucccuuuguggaaaguuguuucucuaucugggagaaguugaacacagagagggaacucagcccggaacuuuaaaggucauucccaccaacaccaaggagguuagacagggacuguggucauuguaagagucauuguugaauucuguguucuuguuugauaaaguagggcccaagugaaagaugaugagagcuuaaucgucuuaauccucuauuucuaaguaaucuuuuuuauugcuuaucuuuguuuauaaggaaaauaccuuuaaaacuuuuauuggaucuaacacguucuuugguaaauuucauagaaauuucccagguuagucccucucauucccucacagacaguguugaggaggguucuggaguucccugugggaugggaauccccuuguaucacugggcacuuccuauuauggguuccugaugcuguuugcucuuuguggcuucagucucucccuaaaauaauguaaccagguuuuuuugagcaaggagucacuuugggaauguaacuccacuguccacuggcuuuccaauaaccauauccauguuuugaaauuaaugaguaauuccuaauuaaccaauuuccuuuguccucacuucacccgugacucaagauagaauagguaaagaacaucccauuauaauacaaagcuacuggacuggacuggacuguccauuuuuuuaaucucauugguugagaaugaugucaauuguuaaauccucuauauuuauaacaauguaaaugauguaguuacuauuuguuaacacuucacuuucucuaaugucaucuugacaggaguaggcguuauugcuccccguuuaacagauaaggggauugagguucagccaggcuugggaacauacauacauacaacaggugcuuucagaguuaaaauuucccuucgaagauagauacauacauucucugguucuugaggucauuaaguccccaucuuuaggaacacacuuuagaaacguaaaagccaguaaguaaccccagacacacuccuggaugcuuuaaguagcugauauaaaugcagcaaagcagucaauccucuccugugugguuuuaaucacuuuucacagauaaaaacuuguguucuacaguggcaguguggugauucauuuagucauccgcuguuagggguuuguugucuguagaguuugaucuucuggguugggcagugagauuacuuccuuuggcagaucacuuccugucuguaaaucccuuguaaucuacaacucuuccuugcaugaugaauauagcuuucuccucagaucuguucugcuucgccuucuucucuauccuuaaggccaggcagaucuaaaaaggaauaucccuuuaccuuuaaaagccuuguauuauauuuuauucuguuuucuugguuuggaacuuauuuuucuuuuccuauacaguccuugugaugcaauuuuaaguauugcugcuaccuuguggucacuuuuacuugacuauaugauagauucugucaguuugaaaugcauaaaauuaagcacuaaauacauaaagccaggcccauccuaccauuuauucugacuauuaaugcuaaaguagccuauuagaaaauuaauguccuugauggccacagaauuauacuaccacuaguaaccugaguuaacuuagaaugcuacugugcugaaccuccuagauuuuuauauauuguccuuugcauauaaaaaggucuaucuuuauaaaaacacuaacuaguuagauuggccuuaccccuccaaguaauauggauacuauuuacagaucccccacaccacaagaucuaauuuuugcuacuugggauauucaauuaucuuuuaacauccuucacauauuuuaugaguuaaguucaauguauugauaucuuccaccauauugacaaagguagaacaaaaaccuuuagaaaagaaaagaagaaaagaggagaagaaaagagaauagaaaagaaaagagaagaacaauccuggaacccaggaacaaguguucaagucgccugcaggauguguggauauaucuaucuacuggcccuguggcuuugguuguuaaaugacuacaaauucagcccauuguuccauugcccugggauuuuuguuuguuuuaauucaauaagacccuuugcacauucuuagguucauuuugucaguauauguugagcuccuauccucagccagacccuuuaaaauauagaauguuagggcuugcuagcagauuugauguggaauaugagaaaaagggauacauuaaaaaaaaaaagucccaaguuucuggccuggacaauuagguaaaaguugccauuugccaagccagcucaacuaaacccagugggaguggauuccagaauaaaauacggacaguaucguuuuaagucuguuuaauuguuuguucaauaucucagugaaaaugagaaacauggcuucucaauugggugcauguaucuggaguugugugacauucaagccaauaauaauaauaauaauaauaauaauaauaauaauaauagugauauugauaauaauaauaaugccuucagucagcuugugaacugcccaauauuugaaacuugagaugugaguguauaugaugcuaagauauucccaaggaaugggcugucaagucuucccuaauuacagggccacugugacggaagcaagcuagaaaagaacacugagaaagagcagcuaguggugaaggcaggggaggacagggcgagggaaccauuuuguuaggugacacuuagagguaaaguaacagaaugaccaagaccauugcgcuugucagugagggccacuggucguuaguaauagacuguucuaguuaguggcauacuguggaggacagaggaaagugcagcuccugacuagcgucucugugugcuuucaccccacuuucuaccacguauggcagucuaggaauccuucaaggaagaaagggaaguuugauuuuaauaagagguuuucaucuugauccccccucauaaucugcuaagaauuaagagaugaaagccauugcucugucccuuuggaaacacgccuugccaagccaccugucaguucuuaguucagugcuaccagcaguccccagcacucuccagugcccacccgugaccccacccugugccuaaaacagucucuaugagccuggggacccacgcucauuaaauaacacaagcacuguuacagaaucuuacugcagggaguuucucuucuuucauuccauuucuggucuuucuuuaccaguccuugcugcuugccagccaugauccaaccuuuuugauuuccaucaccaucucuaucauccuacuucagaggaagauauaccaugguuguuugguuucauguuaguaaaaaaaaaaccuggaaguaaaccagaagugaauuuuuaagaucuuaaaaaaggcauuauuucaucugugguuuucauccuuggcucuauaucacaguugacugccagagaggucuuuuuuuuuuuuuuaaagacaauaauucauacuaacuaaaggaucuauuuuuuucauaaucauaacaaaauuguggugucuaaaggaguuuuggaauuguauauucuagugagccccaccuucuguugcauuauguggugagacugucagauauuccugucucaggcugaaaauacugugagcaguccucuggcagucauagagaucuauaucagacuuucuuaaacuagagcggccaugagaaucaccgguaggcuuguaaccacagggucuuacacucauccugaacacuugggugagauuccuucuuacaacucaaaccagcuacagaaaaugcugggacuuugagaaacagggaucaagacuagaggcuguugugaucaauacccuucagauuauacacacagagagcgucuccccagagaagaauagccaaaaggaagaguauggcaaggacaagaugggcaugccacuugccucuuuggagcuucuucagcucuggugacccugagcccugcagaaauaugaaccucucaugugcacaguguguggggagucuuuauccuaaggcuaugucucaguuuguagccacacaauuagauucuuuuuuuccccucuguacagguuguguguagccuggcgugugcacacacacacacacagagaaaguaauauuuguacagaguuacuaccacagaaaauaauugaaugacaacuugauuggguuaagugcaagauacaauuuggcaaauucuuuguuaaaguagaagaaaaggacauuguugugggaguauucuuuagauaauuuuguauuuagcccaagaaauggaauuccucuaagucacugaaaauccccaaauuccugguuaaagauuacuuggucccacccaaggagguaggaaaguuaugccaccacccuuucaccuucauucuuaccguucacaaaucucccucugaggcuaccuucaguuacaacuaccucucagucuagguauuggucaccaggggaauauuuagaggguuuuucuuugacucauaauaauauuuuauaaauuccuucagcucaaguuaaccugauuuuuaguguauugucaggaacauaagagauuguuuucuaauacauauguacauacacacacacaugcauauacacauacacucacaauauacaaauucauccauccaucaguccacccauacauacauauauacauacacacacacauacccucccacacucauauacagagauacacacagacaauauauauauauaaauauguauauguguauguguguguguguguauauauauauauauacacacacacacacugacauacacauuuuuagaaagagaggugggugggggagaaagacagagagagacacagagauuuuaugauagaaauuuacagguacuguuuucuaaacaccauuucagggagcauaagucaucauugguccugaucauguuguagaccagccuuuauguugcuaacucuggaugguaccugcucuguucugcuccuuuggagacugaugagucuacaauacuuuauugugaauuaucuuuucuuucauguucucuguagcagaaauauguaagagcagcauuuauauuuuuuacuuugccauuuggcaugauuacaagccgucugccugcucuucccagaagcaccguguugucagaguaaagccacaaaagaauucuaagcauuuauuagauuuugguagagauagguaaauacuuggcacuacauaugugcaaaagguuuuuaauugauaauuuagagucuaauuagaauguccuggaauuugcaagagauaccaccuuuggaggggcguaaagggaguggggcugacauauggagccaucguguuucucauugcuacaugugcauuggaccugccauaggucaggcaacugaggggaaaggacugcagaucacauuugaaaauggcuagggaacacaccuaaaacaaugaaggagcguguggaagccuguuccuaacuuggcucugucuacagugacagauagaguuucuaguuuuauacugagguccuagugguguguauuaaagugucccuuuacuaacacuaguuucaguggccacugcuuuauuuccaacaucauggugcaucucuucccaagccuugucugugagcugcccugucauuuauucuagccaaaagacaaaaggcuuucucuucucuaaauaaaccagaaaguuugcuagaagacaccaagcagccucuuacucguuuauccuuauagaagccgccaucaagcccacuuguucuuucccucagcuuuucccucccauuucuuuaucauuuucucuuuaucucuagacuagagauaaaucuuagugaggaaucuacuguaaacuccuucaccccgaccuguaguuagaauccuacaacggacaaaagggaaaaaguagcucuccugucccagccccuuuuggacucauauaggccacgccugucucucucugucuguucuaacuagaaaaacuugaacuccgagaguaaaucaucccugacuuuccccaguaacucuccucugauggaucugguucauggagccuagucuuguccuuggaucuuguucuaccaacugauuugaagaugagaaaauagcccguuggcuucaacuaaauguguauugccuauuucuguaugugauguagcuuuacuuguaagcugugaaccugauucuguagccuuauucuguggaaaggcuguaagagaaggggagguggucccuccuaaagcagcaagcagguuagucagcuuuccuagugaugcuuuuacucauuuagcaaacaccuuucuuugccaccuaugugucauacacaguacugggaguugacaacuccaagggaacccggaaggcggaaggccgaaggcaggacuuaaugcaggcaggcccuugagugagacagcuguggcuacagucacaugcuugcugccugugguuaguccugccuggggauguccugaagugccacagagaagaguauuugccuggaucucucccuuggccaguucuagcuccauugccuguaguuuauugggugauuuuuagccauguaguggguguuuuacauccuguagauuuuuguaauguguuuguaugggccacgguggaaugauagacaggacaagcugcuauauuuuaugugucuuuguggugacauuuauuuacagaagggugagcauuauguauacaaguagaaccaaauauauagauaugcaugaaggugggaucuagaguggaagucucuuugaaggagucuuccuguuucacauccaggaaaacugaugccuaauggaccccuuucccucaggaugcccuucccuugugucuucuuugugcaguuggauuugaauacaucugccugacccugguuuccacugccugccaugaaccucucuucugccuuagagagcuuuccagcuugccugccccuugcucccucugccuuucuggguuccucuguaacccgaggcuuccugccccgaucuaucuuauccugugcugacauugacccauaggucugcauuaugagacuuaagcauauagaacuauuuggggccacuuucucugagugcugugguugguuuugcuccacggcuugcuguuuccuaggacucaccaagggccuuuucucugcugccucugaucuuuggaugaacacugugguagaugaguaccaugagguuaugguacgugcugcaguacccuguuucugugccccucuguuggugugggacucagccaauauggaaacccuucuauaucugugcuuuguguugauuuucacaaugauucaugcaaacauuuucacuuuuauguuauauuuuuguaaagucagcauacaaggucucuuugaagacuccaagagagcacaacguagagcuaaccuucugaaggugaacuaaccaacaugugcaucugccauugacuuagggucagguagucccaggauccuugcauuuuaaaucuuggaaaaaaaaaaaaaacccuucaccacugcugaugacagcuguuaucgcuauacaguaaggagagaggaagguauuaguucauucacugggaugaauagccauggccuuguuucuagaaaggcuuuugagucauuaccuugcugaugugccuaaaacguaggacaguuuguucugucauauuuucuuucuuucugccacuaaauaugaagcauguuuaugggcugcuagagugcuaaucacaggggauuagagucgacccuggucuggacacauuucugcuggagcucacguucuagcagggaagucuccuccacagaccauuuaaugcagaagucuguaagcacguuaagaaugugugugauccagaggaggaagauaaacguuucagaagaacucagggcccacugugcuuggaggaugguuacucagcaggaaacagaguagugaggucuggugaaaggcucagauuggcuagaguaggcauacucuguugguggcauuacagguucaugugagacacuacuaggaaagggucugacaaccuaagugggggugggcaaagcagcagaaaaggaguggauggaugucuaagaacacauuaaaaaacacaacuuacaagaugaagcaaccuauuccagaagguuagggaaaaggcauuguugagguaucucccagggcuuuggauugccauuucuagauggaggggugaaaggaaaagaauaaguuggccuguguauauacaaccaaaugcaugggcuauguuaugaaacauaaugaagcgaggggcuaucuguggcaggacugagaauuuaagcuaugcuccagaccugggggaggggagaggagugagggccugggaaagggguagaggcagacaagugcacauguagacagcagacagauagcagauccgugauggcagagagagagagagagagagcagagaaggaccaagcggggacucagaggacaugcaggaagagcuggggugguggguggguucuuuugcuggcuucacacaccuggugcaccugguggcagcaggugaugagguacguaauugcuaggucccuggggcaggccggggaauuuaccuguaggcuaacauuccucugaguuacaguacuaauguuauaaaauauaauguggcaagacauaucaucuuuguaggccccagccaagguauacccugagaaauuacgucaugcaacagauaugguguaaaggggguuuguuuacuggggaggguagaggaguuagggccuggaaaggugguagaggcaggcaggugaacauguccauagacagcagggccaugagagcaggggucggggagggggcgguacaucugcagagaacagauagagaggaugcuaggaacagacugaaagagagcugcugaauggaggguggguccuuuugugugcagcacacacuugauguucaccuggcagugguagcaauucaugacuuaaaguaauugguaggucccugagggcaggccaguggaauccccugcacacuagcauuccucccuaacaaugugaagcuauuucucaaagcccuuggaaucccuuccugagugacccacucuggccuguggaagaagugaugcuccccagguuuccugaucugaagagagcugcagaguguuucuucugagaguagaaagaagcuccuaauuaaggcuaaggaggaagggaagcugugccuccucugugcucagaggccuaguuuguuccccucuguuuacucaggggagaaagaagcagagcuuugagagcagagaacuuuaggagacacaaugguucugauuagugcagauuauccaagcuccugcuagagagaaacaaggccuggugguugcccagagagaaccacugccugccaagcauagaaucuuccagaaaucuagcaaaguccucuccuacauugccaguguaagauuugauaccuuauuuauucaaagaaagaaaaaaucuaauuaauguauaaucaaucagggugugaaaaaacgccagauugaaccuuguguuucguuggacuuagacgggaaaguuagagcuugauuuugaccaaguucucauaaaggaagguaggccacuuuuuauuaugacuggaggaucuaaaauacagugguaguagcagugcuuauggccauuagaaaucacagcucuuugucuguuaugguuguugcaaagugauuuuaaagaauaguauuaauuuaauauuaaggcuaauauuaaagauauguagauaccagaacccauauccuaaagugccuccuaggccucucuucuaggcuuuagguucucugcuauggcuucucgcucagcuccacucuucccuugucaucacucauauucaacccagaaaucugcucaucccagaucuccuucuggggaagaugagcccaguuguuacuguaauuccagcacaaacaauaaugauggaugaguugaggaagacagaggccucagguucugguucucagguuucuucauuccaauacaguauagaacagaagccgcuuaacauccuauugaagaacaccaugcacaagaaaacauaucugaaaauaucacagcacucuucccuuucuucaguuagcuguuguuacugggcccaucagauaugagucagccccugcaaaccaugcaugcauuauuacaguaucaccaacuggaguugcuuuuuaagauuuugauaaauauacuucaguggaaucaguuuucuuuuguaucuccuauauucauuuuauguauuuaaaaugcauucuugguacauuuuauaagauucucaguuggcuaaagaaagacucagggcacacaaaauguuaauauccaccagcuaagaucuuguaguuguggcauaugaccuccaccugguggcagcagcauccuuaaagguuagaucuauaaucaacaauugagaacauaaucugaguguagccauccauacacuugaaugugguuuucaaacauuguuuugcuacagcccacaaaacaucagccuuucaucauaauucauacagagauuuacauugcaccaaacaguucucaaucuuaguaucugacauacugauacuuuuuauggcuuucuaauauucucuuggauuucuuuaauuaaaaaacaauucugguugggcaauagaaucacacaccuuuaaucucagcucuugguaggaagagacaggggaacgaguaucuuugaguuugaggucagccuggucuacagaguuaguucuagaacagccaaggcuacacauaaaaacccuuucuugaaaaacccaaaauaauaaugauaauaauaauaauaauaauaauaauaauuuugaugcaucaaacuaaauugcaaucagacagccacaauacacuauccuuauaagagguuauauaauuugcacacaguuucagauauuauacuuacauuuuaaaauuauuuauuagugaucaguaauucauacaagguaagaagagccacuuuuauauguacaaccaaggucccuuuuuagaacacugcaucuuccugucauuugucuucuucuuaugccaugcagacacugcccugccacuuucaccacacauggcucuugcuguugugaacugucagagccauacaguagguguucaucaaacuggccucauuaacucauccugguuuugagaugagucuguggguugugucaacauuuugauuaaugcgauuccauugugugaguagaauacuaguuuauucuccuguugaugguccuugagucugucuucaguuuggucuagugggaacagagcucagauaagcuuauaagauggccuccuuggccuagucaguaaguacauggcuugcuauagaaagcuggcaaaccuuuugccaaaguggaugaacccaguugcauuugcaacaguguaugaguuugggcugcuccauucuuuccugccauuugguauggugucagucuuuguacuuugaauccauucuguggcuguggcuguggcaguuaauuaggaaaugaguuucccuggcaucagucaaauucaauacuuuuucaagugcagucacccauuuuucauauuugugguacauauuucagcuuagauuaaaaaauucugugacucuguggaaguuguuuacauauuuggaugucaguccugcaugucagacauguguauuuauaaaugucuuuuauccagucuguggcaaacuuaucauuucacugauaguaccgcugaugagcagaaauuucuuugauuguuuauguccacuuuaaucgacaauuuuuucuucaauguuuuaaauuuccgggaucauauguauaaaaucuuuuccugccccagugauaagaguaauaauguuuugguuauuaugcuuaagucuauaauuuaucucaaacuaaauguuauaauuguuaauaagguagauaccaguuaaguuucuuuuuucuuuuuuuuccuguguuuguggcugauguucuagcaccauuuuuugaaucuacuuuggccauguuuucacaaaaguuuauaaaggaaaguuuaaaggcuuccuuaguuagagauguauaaaagugacuuugcuacaggucuguagaaugaauugucaggggcucuuugacaucauccucaaccuaugaucuugguugccuguuuuuuucuuucuaauguauuguuuacuguuaucuugggaaucucagaagugacuucugaugugugaacauuuauaaagcuacagccucugugugcuguguguguguguguguguguguguaugcaugcacgcacuccucugcaugcacuccugugagcuucccugcaugguccccugaaugaauuccugcaugaggccagagguucagcaucaggugaaccauucuugaaccuggagcuugccauuucuguuugacugacugcucaguaagccucuggaaucagcacugagaccugagguacuaaugagcguggggacucacacuuccacagagggcccuugacccucucagucaugucuccagccuaguuacagcuuuucaugagacccauguggcugcugaccaguacggagacauuagcuacaugggcuuaacaaauugacauaaaaugaaauuaaaaugccaacuuuaagucaugauagccauauuuugaggaccuaguuggcuauucuauuguauuauagacauacaguauuuucaucuuuucucuuaaaguaagaaaggaggcuuugaaaauucauagcauauuuaagggagacuuuccucaguuucaguaacuggcauccaacuuggacccccuuaucucucugguucuuucuuguuuuccugaguauuuauuccuaucccaugcucuuucgugcagcuaguucuuauauuuuaaaaaaaggcaauaacuuauauagauucuuuaccauggaggagaaaggcucuucacagaauuguucuuuucuggaggcuaccugguacuguccucuucuacuucucucgauguuuggcagacuuccagcuaccauggagcugucuggucauccucuuucaagguguggucuagaaauaguuauuuugucauuuccauccuaauuaagccugcauuucuucuuaacaucuccacuauaauuauggacuugugaacacuaggagccaugcugagauuccgccccaaggguggguuuguuguccuucuuguguauguacaguuugugacauccucuggaguucucuguugggcaugaccugcauagacacauucuaccauugauaaauauucaccucuucucuuucagugugggaacuucgcaguccugguggaucuucauguauugccacaagguucaaacagagacuccaguugguuuucugaacagaagaaagagguauaagaaacacuuuuaucuuuaaauaauguuuuuuguaauaccagauagaagaaaugucagcuagucagcuauucugagcuuucuauuuccuuaguguuuuuuuuuuuuuuuuaaagggugauuguuaggcguucacugaaaggcaggaguaugucuggagagaagcaugcaugugugcccacucaugcucuucugacagagccauguuucaugugcugacugugugugugcacaugugcaccuuacacucucuauguccucaucccaggcucuauuauuuaaacccaaaauucgaauucccuccacuuggaggaaaauuauucucaauaauaaaaagggaagaagaggaagucagacuaguccaagugagcagggauuuugaucugaagagaugagaagaauggcagcaccuguaacagguguggaguucacaggaggcuaaucgccacaucuguauuaauccucacuuugaucuuugccucuuuucauugucaugagccuugacaagugaagaggaauuccagucuuccuccuuucauguugacuauccaguaaagcagagaguuaguauggaugugcaguugacuuggaacaacauagauuuggaauauguuggucuguuaacacaugaaauuuuaggaaaauuugaaggaaaaacccguuagaugagcuucauagccuagaaauauuuaagaaaaauagaauuaguuuacuguuuacucccaaaauguacuacaguucuuuaaggcauucuguaagccucuguuggcuuaaguugagggucugccuaaaacacuaggugaguggcuaaugccacaugaacaguuugucuaaguaaaaaaguaucucuuauuguucguaauuauuuguucaaccguccaaaccuaacauagaaaaugugucacgacuuuauuuuuuccauuaguaauucuuucuaguuaguaguuggcuauuauagaacgaaagaggugucuuguucucaaaagcugaguuaaguuccuagcacccauucagacagcccacaacuaccaauaacuccugcucuaggggcuucaagcccucuuuuguccauggucaugacccacacaugucacaaacacacacacacacacacacacacacacacacacacacacauacacacacacacacacacacacacacacacacacaccacacacacacacacacaucaaagucaaaaccuuaaaaaguuaaguuacugaggagucaacaguuauucuaggguuucuaacuaucuuucuaccucuugacuuuaagaauucauucuaugauauuugaccuuccugggagcuucaguuuccucuuaaaaugagaguuugaccagauaaggcuuuagucuccuaugauuucaauacuucugugagcuccuauaguguagaaacauuauuucuuuccuucuauagagaucagggacagauagugaggcauacccuguucaaaaguuucaaaacagacuagcuauauugcucugugaguauaaaggugcauacugcccaacaguauguguauccccaggauacacaagguagaacgaaagaacuaacuccugcaagauguuaguucugaccugcacguauacacuacagcuuguaugugcccacacaacuacacuaauauacaccagaaauaaaugaguagauauaauuuuaaaacuuucaaaauaugcugguccuuuuuuccuucauaguauuuaucugcugccaugacucuucgagaagugaauaauagucaguuguacuaauauugaaugauaacaagacuaauaacgguuggauggagaaugguauuugugaguucaguucacuaagacuaaucuauccacccacaaauuaguuuuaaaaauacauuuuccaucaaauagaaauaccaguaguacuuuguggucauuauuuugcaaggauacucagugacccaaugcugagaagaggaaacaagaacugguaugguuguuuuaucacuaaggaaguugauuaugggcuguccucuugaaaacucucuauuuagcaggucagaaucuuucuccaccauuuaccuucuucaaucucagauuuuagaucacuuacacaugucuauaugauucaaauuagugaguucacuauaacaaagugccuaauauuucacauaagggaccucaccccaguagcuucugauagcuucuaaaaucucuaauuccagacuccaacuuucccaugcucuuucacaguuugacuacuucagcuguagaccuuuaguguugguauuuaggcaguuuugaucaagaaguaguugauauggaaugcucuggauagaugcccugcaaagcaugaggugagauuucuugucaaggggccacaaggugcugugcucuuccaacuagugccuacucuagaacaguuaggcaugacuuagcagaggugcauggugggaccugcagagaggugcuuuggugguuacugcaagaggucugcuuauucuaauaaguugagcauuccucucaaaguaaagucaauauuucgcuaucucuguuuuaggcuguuucuucaaaauacaucgucauugacauuagagcuagucugaaauacuuuaugugcaugcuuuaaaaggagaguuaaagaaagguuacugcuuuacauuguucagucagugcuuuguugguuuuagccuuuagaucaccuuaugauugaaguuucauaaacaaccuuuuugauugcauucuuuguaugaaaagaggacuggguuaauauauuaaacauacguuuuauuugaguccaguucaagaagucuuugcacucaagaggcaaaccgaaauggucccaucuguaaacuugcagaaguuauuagcacaagccccauuagcccugagaggcagugucuaucucccagucauggaguuuuccugcguccucucgccgaccucucagauuucucuggcuguuuucuccuguacaacucuauuugcuucaccaugucuggcaccaucaguucuuagggacuuuucccacucugcccauugcugucuuuaauuccuaaaaccagcuucccagaaggaacgccuguacuauagugagacgcuucauguguauggccucuauuuuugucuuacuauuuuuaguccuagccuuauaggguauuuauggccaaauuuuagcaaucccuguugccuugugugucuuccacauauuuucuagcucagucauaguugaacccuccaugugaagcagaaauuauuuaauugcuagagcgacaguaugaggcaaggcugccuuuguguucugucaacagugccaaggcauucagcugcaaauggauaucuuuauaucccacaaagaaaugcaucuuuuaguuacaauaaaaaucaagagagagaagacugguauuuguauuuuauguagaaauuucuguguaugugucaaaccaaggguuuuuuauauacuauuuaagggguguuugcaggaaaggaacucacuauggcugcucuaaagagcagccaaaaaccugguuuauguuguaauuaugaagcauuuaaaagaccaaccugugaugucugagaaacaagugaaacagguuugaggugaccugaagaacucugagagugcuucagaguuguugggaauugaucuaggauuuauuacucauuuggugucaguuuuauauguauccuguauauauguacccugauauccuguaguaaauuacauuuucuugauaaugcaggaaucaccacauaaaacacugauaguuccaauguggacuuggacuucugaguuauuuuugguuguuguucuuuacaaauauuauaagccaaaugauaucucuagaaauuuauuaauaugguaugcugaaauuuaguucaagccuaguucugcuaccuaauaacauuaaucuacaucagagaccugagaagcuauuuuuaucauuaaugaaugaagaaucauacugugauuugaaaaagcaaaugggguuuaugccaccaccacaagagugguaaguucacguuacuggauucccccguuuucuauuuaacccaccacucugacucucuuguguuuguaauccuaaaaccagaaacuagugaauaaugguauucacuuaacacuaaaauauaaaaauuaaauuugaaacaaaauucucaguguuucuggcuuucuuuauacaaagaacacuguaucagcaaacaggacaacagugcagugagaccauggggccagcgggcuggcagcugugaccugucccaugccaccugcagugacaguaggaauauucuuacccuccuuucugccucugacuaccucccugagacugugcugccacccauguagagcuccaugggauuugucucuucucuccaucacagugugauagacugauacuuaugaaaacauucuugaagucacauccugcucuugaaguaagcuuuuaagucuuucauuugauauuguaaaacugagguagagagaaaaugauguaagccagcaucaggcuugaagccaucuuugauaguauguuuaauagugcagugaugaacaguguucauuucagcauaacugcuaggcuuaaaagcuagcugaaaagcauuugcuuucucaauauguauaauuuugcuucuccccauugcauuaaacuagaaaugucuaauguuuuaaauuuacuuuaggaaguuuguuugcuguuaaaagaaaccauugauuccagaguuaaggaguaugugggcauuuauaaacagcgcaagccaucaagugcagaauucacaagauccagucccuuguccuuaaaagguaggcaacaagcacugcaauuuuggacaaagaaaguaaaguuucagcuuuguagagauugcaauuauauuucacucugucauguccgcauagugauccauuuaaaacuaugcugugaugacgauacuuguguuugaggaacaaacauuugccagaaagcccuaaaggacuuuuaaugauaggcaaaauauauaaaaauagcaaauaaaacauucuuaaggaaacuguaacauuuuaaaggucucuuuugguuuuuugacaaauagucuuaaaugaauuuauauuaauacugacaucacuugauucgcuguccuuugcuuuuuagaauguuuucccauaugucauucucuuucaaauguucucagacaggagcacugauacuccuggagggcauuuggaaaugugugcagaguuuugcuugucaggaguggcauggggugggugcugccuguagugggcagaggccggggaugacaggacagccacagggcacagagcaaccaaagcaagguugacacauuccuucccuccucuugaccccaguacuuaccucaguaccugugauagagaugcagugacaugcugagugaccacaggggacagagcuggaauccagacccaguucuuaugaacuccacuccacuguuuuuucuguucucuuggucuucugcuuuguuucucuguuuuguuuugguugguuguuucuuacauaaaaucagcauuucauagcagucugugauacagucagugcaugcuauuuaucagacuguagugguagacugcugugagccccguuaugcuaacagaagauguuuaggaaaaauacuggauuacacacuccugaaaucgcucuaggucuagagugcuuaccuuguauagaugauaaauagagaaguaguuuuuguuaccugaacuggaaggcuugagagaauuucauuuccaaacaaagcaauauuacuauccagugguucuccaccuguggccaugacacccacagggguugcauaucagauauccuacauaucagauauuuacaguaugauucauaacaguagcaaaauuacaguuaucauguagcaagaaaauaaccguauggagaaacgguauuggagggucacagcauuagaaagguuguggaacacugauccaggagaugcuccaggggauuugccacucagggcugcuuuaaauuaugagagaagcacuccuuguaccgcaauuagaccuggacaagcucauauuuucaccagugcaacaggaaaagaauugagcaagauucuccgauucccgacucuagugcagcuguuacaauaggugcuuugaucaguacugauucucaaccaacccuucccuucccaaaccugcccuggcagcuaaaguguguuugaggcuacauacucaguacccagcuucucucagagacaagaaaacauccucauuuuuguggaggaaaagauuuauugauuaaacagacaaagggagcuuagucuauacacaguuuuguaaccguuucccccuccuaauuaauauauuacuaaaauaaaauuucccgugucacuguuugguaaaguuguuguuguacaguacagauaaaauuuacuauuuaacaacuauugaaguguuuacuuuggcagcagaaguaugcucccauuuuugugcaacuguugccauuaccaaucuccagaagucugucacuguccaguaggacuuuguaccuaggaauaauguguccucaugcucuagcugagcccuggguagcagagguccugcuuccugauuuucuugagcucacuacagucaguaucuuccaugagugagucauaugauauuugucaucuuauucucugguuuauuuucauuacaguuagguuuucagcauuccuagugaugcauuuaucagaauuucacuucuuuugaaaucuuauaguggaugacacauugucuguucauucauuuguugaugaucacuucuaugcucugacucguaugaacaauagugugugaacacugauauacaaauuaucuuuucaggacuuuggguuuuuaaauauacacuuagaaaugucuggaucacaggguaauucuuuugauuauguuuuugagguacuaauauauuauuugccgcaugacugcauuauuuuacauccucacucacuguacaaggggucuauuuucucuacaccuuugccgacccuuauuuucugauacuuugauaauugccaucaugacauauguggaacaaucucuaauuguggcuuuuuggcucuuguuuguuugucuugguuugguuugguuugguuugguacuauuuccuuggugaauagugaugcuggccaucuuuuuauguacucauuggcuauucauauaucuuuuuuuucuuuugagaaaugacuauaugccuaguccauuuuuaacugggcuuuugagggaaaguuuuuagagggcuuuauaaauuaugcauauuaacauuccuuauugacuauguaauugacaaauauuuucucaaauucugugguuugucuuuuuaaucucuugguggcuuaccuuggcauagauauacauacauacauacauacauacauacauacauguguguguguguguguguguguguguguguguguggccuuaaaugugcuaaagccaaaauaccacuuuuuucuuuuguugcuaguacuuagaugcuaugucuguggaaaucauugucaguccuguuuugugaaacguuuuuuaaaauuuuucuucuaaaaacagaaguucuauggaauuuaaacucauuuucauguggauguccacaguuuucuuaguauucuuugcuuaaacggcugauuuccacauugaauggguuugguaaucuuauuaauaagcauuugguauugaaaugaaguuuaauuucugagcuugccauucugcuguagccuuuagugucugccacuggugcugguucuagagccuccugauauguuauagcuuguacugagucuuucaagauugccuugacuuacuccugguccacauugcuauuuuugaugaguauaaauuaaguauucuauuaaacaucaguguucuuaauguauugguggaauuuggauugcaucugauacucuuaguucuaaagaaaagugcaguugacauucuaauaauguauauauuuguuauuucagggucugauuuaauauuguuuuggggacugauuagaguugggugugugugugugugugugugcauguacacaugggugcacacaagugggguuacauuaacucagcacauguucuauuaguggucuauaugaacuauaacuuuuucuuuucauuucuuuuuuauuauuuugaauagggucucccugaguuguucagaguccaggcuagccccaaucuugauauccucuugguauagucucccaaaugcuagaauuacagucauguaccacacccagccucuaagaccacuuuaaagauaaugauauauguguauauauguaugaauguguacguguaugugucuguacguguacaaacacauuugugcaggcucaagguugaagucacgaauuaucacuauccacuccaacuuauucauugccagguuuucucaguugagcccagcacuuguuuauauggcaagucuuacucuaaagauagccugucgcccccuuccaggcaugcagcuaugcccacuggcauuuacgugcguuggagggaucaaaaucccauugcucaugcuuuugcagcaaguccuuaaccccugagccaucugucuucuauuccccagcaaauggauuuucuguugucaccugcucuggacuuuaacuguaccaccacaaaccaggccguguuugccuuaugcagcaucugaugaccauuaauagaguggauacaguauuuagugcagugagaugauugugugaccagaggaaaccaggagauagauauauauguacacauauacaaacuuuuuugaaaguaaaauuuucaggguagccccauauuuugacucuuccccucauuucaauaacuucugugcauauuuguugagguuuauaccauggccauccccuuccccaguagccaugagguaguuuauauuucucccucacuuagagaacuguagcaggcaccucaugguaccuuucauauggccagugugccacauucuguccauucuauacuuaggccgucccuuaaaaaaaucacagguuugauuuugugcaacucuguagaaaaccauucaggauauucucaggaucacuaugaugaagaccccuggggaacugagcugccagucauacaguaccacuuuuccuuucucuuguuuaagugccauugacuugauuccuuucuccuagaguuccaucguucugaaagcuugacucaaaucagaaccuuuucuucccugcucuguguuaucaucagcucucuagucaauguacccagcacaaucucccuguuuguagauuacagguacccuaaacuuauccuccuaccauuugacaaacaucuaccucuccacagugugugagccucccauggaccaggucugcccuguauacucuuuguugucucucuaccaugcagggcagucuauggucuacaaaauacaguacauauguguuuaggugauugcuuuucucauaagguuaggguugcucuaaggaaccuggccuuccuuauuuccugcagaaccuacuucauuuuuaguagcgucuccauuguauggccaaugaagucccaacucauuuuuuuuuuuuuuaccaguucuuucauucccccuuuccucuaaauaccuguuauuuggaauuuauuacuuauauuaucuguaccauauuauaucuuagccaugcuauagucuacuuaacagccuucuuuccucccucagaggggggggggcugacucuggcaccccuagaaucaccuuuccagauuaccaugcugcagagaacugucuucugagugcuugcucuccucacauaguucccaagauaugagugcuacaguauggcucucucuuccacaggaucacugucccaguagauagguucaccacagucaguuccuucuuuacauuuccauggccacaucaggguaaagugccucagcauggcacgagauugagugugucguccuggguaagccgagucuacacacuuacaacuuuguucauugcucuaguaagaugaacauuauucacgcuuugauuguucuuuauaaaacuacauaugcuccuccaagacuauauaaaaguacuucacaaugucagugaagacuauaccaaauauacuagcuucaucccauguaagucaucugaaaagucaucuugguagucagcauacguuagugacaugaggaaguuuucaaaaagauaucacagucaacuccuaccaccuucaccucagcaucuuccucuagucaugcucagaguuggguguuagcagcaucuucaauuugugucagacuagcagcccaaaacucaaacaagagaauugugcucuucgauuuucauuuauguuuuauguguucacagacagcuacacauuuacaguuuggguucguauuggguuguccucccucacccaucccucccuugucccccucuuccuuccuucuuuccuccauucuucucucuuucuuuccugcugccacuccccucauaauuaauucuugacuuacugcuauagccuccagauuguucuucuaauucauccaugccucuguugccagaauugccuuuuaagacagaauugacaguccucagcuugagacccuauagcuuaauuuccuuuucaguuucuucuguacuugacauaagccagaguguaucuagcucuugguuaaagcuuaugggaucucuaagagggcgagcaguaacuauucugaagcacagccucugcuacagcauggggacagguugaguauacauaccaguuaccaugaaagucauguucaucugcaaagccaggacauaguaccagaaacugcugcccagccagagaggucagcacaugaccaagcccugugcuucagaaccaugucuugugucuguuuucugaccacagugagucaauggaggcaaaccauuuggccuuuacccugcgaguaucagaauaagagaggugucaaucuuuugguugaguagaugcaugguacagcuuacucacuuaaguguuccucuugauuuccuauuucccugaguuuccaagugguaacaacaagcugucagcccacuccuaacacagcugccgagcuacauagaauauucccucuccaauagauaaaguucgaaaccucagcuccacucuacuacgggguuucugagugaugguucuauacuuuuaacccucucuaguucauucauagcucauguuuauuaauuuacugacuaaauugugaaguggacuauaaccaccauauuuuaaauaaaacaaguaggaaacagcauaaacuucuaucucgguucuugcagaugaagcagcaaaaagggauguguagauugcaguuaccauucuggcuuugguaagcaagaaacauguaguuaguauuucuaucuuuuuccuuuggauuuguuuucuauuccuugugccuguagcugaucuggggucuucacuuugacucuugaggugcuugagcugccagcggcucugccuugacaggucaaucuuguuccuugcucuguccacuuugagaaugcucaguagugucagggggugguggcacacaccuuuaaucccagcacuugggaagcagacgcaggcugaucucugaguucaaguccagucuaguccacauauugaguuccaggaaugcuaggauugucaccccuccauuuaucccuugguuccagaaaccaguuauuuuguuuguuuguuuugcuuuugccagggaaauacauauuacuuggccggucggacuauacuuugcaucuuuuaacuuacaggcuuuuccaaguuccaucaggucuugacccucacuuugcauccugacugaauuuuuaguaaaucucaucuuugauuacuuaagaccauugaccuuuaucaacccauugucuuauuaugaccaagugacuuaugcaguuuuggucuuuaauagccucaguauuuuuagccaccuagucaucacaugacuuccuacuccagggcuuuggugguuugcagacaccaucuguucuaaucauuagucuuuccagcucuugaugcccugagguugucucucacagagacuuuacagcagugcuguucucaaacgagccagucauuauuuugcaaaggauucugguagaagagaggaaaucucugguagggguugccauucuuauucagaucuucauacauacacauaucucaccauucucuuagcauccuuuggcuaguugugcuuggcugggucuaccuaagugagccuuauagcugaauucugauagaggagccccagcucucucaucaauggucuuuuuuuuuucuuggacagcuacaagagugaccuucuggguauggagaugccaaacauuuucaccccagguugagauaaugugaaaucuggcuguuaagaauucuugaugagccagucgacuaguucagagacuuuggaaggucugugagacacugagcuuacagcaagucccucaggagaaagaaguaccccagugaccuagaccaacacaccugaagaguuccccugacuaaucaccaguuugucauuguacuguaacuaagcuauaguccccagauuacaaugcauucucaccucucagcuuuuauccaugcugcuuccacuucugugggaaaacucucacuauuuuaggacugggcccugguacagucagauacuggggaggaacacaaguguuggaaaaagcagaggaauuguugcuauucauuggucaccugcuucuugacuuuccuuuggucugcuuccaucacagcagagguggagguggucugugaguuacaagucaugaaguagccuuucauuuuccaaaaccacacccugcccuguauaagauuccaggguaggaaaaucaccuagcacagagggagagaaaaugcuuuccucuuacccauccccucuggcaguccuuuagcaucugccuuuuagugccuauuacugaguguuagccggucagacaccagcacgguugugucugaaaugggcauuucuagccacuuuuucuucccauugguggggauuaaaacuaggcuuucuacaacuacacaagugccccacugcuaagcuauaacuacagccugcagacaucaucccugacucuuuccccgaagcugagaacaggcuuggaguuguguaacuuguccaaaggucauguagcugugaaaugccaguagcuaugugauggacagcugucuaaugacaggcugucuuguguuuccuuuaaggagagucaugucugcuuguccuuucucuuaauaaaaauucccucuuguuauuaaggcauaguucuuuuuaaauuacccagguacaggaucaguguucugcuugaauuaauauaugcaucuuuguuuuaaacuuuauaucucccaucucucaucuugagacagaaaauagacacccaaauagcccaucuucuaauccaaaguaucuguugcaauaaauuggcuauauagauaacaguccauuuauguguguggagcaguaggauuuuuuuuuauugcuuauuacucuauucuauauaaccuuuucuuuuaguuaacaucuaagaaacccagcccuuuagaaaaugucauaagauaaauuaaauuucccugaguucugugguuucugucugaaggguuuuuuuccccuaugacuaugcuuuucaguugaauauuucucugaagucuuagcugaggucuccagccaaagugcacaugcgucugucugcucauccuuuuguggcauccagguguggugugugaauggccaaggcaggaguacaaggcuuccuccccaccuccuccuuuccagccuuuggggauggggcacaucgccaucguguuagaaaauccauggguguucacacaagaaaagaaaaaggcaagcauggccaaaacaagcaaguucuuccuauucuucccucugucugagaaauguucccucccuucccuuagugccugaugcaacacgagauccugccaaagaaagcuuucuccuugcucuucagacacaggcuuguugugagcucugcucccugaugucccugugagugaaaaauguguacauguagaauuuuguuuuguauuuauuuuccuagacuauuggaaacagagccauuuccuaauuaaaauaaauuuuggaagugaagcauguuuccccugagcccaguccuuccucagcccaaacccggcaucuucaggacagacugcaaaucagcugcagcacaccaccuauaugauccccugcagcugcugcaucucuuaauuuucacuauuuuucuaaaaaaaaaaaaaaagacuauauguccagugacugcuaaaucucaacaaacauagggccuugauagauacgcuauuucucaucauuccuuaugugagucagcuucuacggcagagcucugagugcacacccacaggaggaaugguacuauacucuagucacagacagaggguguauaggcaguuucugacucucaagguacagaagggaagaacugaaaaaaggaagaaauagucaguugugugguuuucugaauaguaagccagcacagcauaugcucaguuaccuguucuguuaaauauucauaguuuuuacacauuguuuuuguucacagccacuuaagaauugaaauggauuucccuagucugucauagaacuuaguuggaagcauauguuuucuuuuuacacauguguuuaaauagcuuugguuauuauuuauauuucuccccauaauguacucagucaaaacauuuucuaagcuuucauccacaugcaaaaaaaaaaaaaaaaccuuaaaaaggacaauaaugcaaacaagugccugcaagcccucucgugaauauacuguggcaucagcagagauuauuuuuccaagaaugggcaauuuguaaaacuuaaacuuuuagacauuuuguaaaagugcuaaagcagcaaugacaacucaagaugcuuugcuuucucaaaugugggggagauggugcucaccacuuacugcaauauauagaaagcaaacaaaacucugaagaguaauggucccacuugcuaaagucaccugauagggagggauauugcagaguuuugucaugcuuugucugcuacauuuuauacaaaaucaaauacaaaagugcucaaagagaauucugugaacaaaacagaauucuuuucaacacaugaagugcuuggucuucuauugaucuaccugagacaaugugggcugucaggguggacuuuauuagagugauccuacuggcuggggagucuucugcugccuucccgcccacagcccuuucucccugaacucacagccugagcucuauggaggcuucuugaaacaaaauugauguugcuuuugcuuaguuucaagcugaaguuccaauucuguuaugguguuuguaguaaugccgcguuguuuuucuacagcuuuuaauaugagucucauacuacuuugccugguuucuuaugaugaugcaaguuuguguuacuuuuucugaagcucuuaugaugauuugagugccguaccauuguaucugcuuaagaucacuuuuacaaauggaaauuuugcugcugaauugcuaugugucuugaaacuagaaaauucacagggauuaccaaauccuucacaagucauagaggauuuuuguuaucaaauacugguuuguaagaauguuuucagaggaguugugcaguuggcugagaggccugcccauuaucagcuccaugcagaacaaugauuuaucacuagauuuucuacagacaagucacuuggaggaaucagaagagcugauucgcacuccugucugcuacaauuggaaggaaaagcaauggaggagaaagcauccagcucauaaauuggaauagaaaugggaccaaaacuaaaaauuuuucuuuuagguaucugcuucauuauauuucugauuaugacagggcuauuuaggcaugcuggaaaucaaaacagugcuuuauacaugcugggcauguacucuaccgcugaccugcaugcucagccaugugacagcuaucauuaauuagaguggccaccauuucucaugcugacaacuagcugcagggucugugacucuucacuuuuuuaagcagaugagaacaacccuuaccauugaaagccaugauuuaacucagcaugucgggaacacaguacccuagcauguuggcuuuauguuaucuaguggucuaguugccacauagcuaauguguuuguauggauuggcgagaaggauggaaauagaaggggaaagugagauccuuccuagacagcguucuccuuggcacauaccagcuaaagccugggaagcucucgacccacgggucugacagauuauaaagagcauucuccccucucugccauaaugccguggucuuuucucauccgggcagcauauaauuuaauuuacuagacaggauauggggaaaccuucccacaaccuguauguuucuggauaguuuucgugucuacuucucuguagcaguagccuucuaaugucuaacaguauuuggauuguuuaccagcuugucuggucuuugucaccucuccucuccucuucuagggccaggacuuccaagguuuuaaagucuagccauugaguuucacauggccaauguuuauacucauaagaauacuggaaagaaauaacaaggauuagagagagagcucaguaagaaaggccugccagaggggccagguuggagccacacaauccagguaaauagaaucugagcauggaagcacuuaauaguaaucccaugaaagguacagacaggcagaucucuggagcucacugagcagucagacuagccuaccugguaaguucuaagccacugagagacccugucucaaaacgcaagauagauagaaccugaggaaugacacgagccguguccuuuuggccuacacacacacaaauacacacauuuauucacacaugugcaaacacucaugcauacacaaaggaaaggaaggagggagguuaagagagggagggagggagggagggagggagggagggagggagggagggagggagggaagagaaaggguagaaauguaagagaugaauguuaguaagccaauuuugcagguguaaagugggaguacagagcauugagaauaagauggacuuuggcuuuauuccugggacaagaauucuagcuaaaaagcuuaugaaauuuggugguaacuugcaugaugauuauaaacuaaaaagcuuccauucucagauucccuaguguaacccccugauuauucugauuacuuacaauaaaaguagagaaucuaaaauuaugacuugugguaacuaaguauuuucuguuaacuauuucacuuguuuauagccaacacaauuauaaaucaauuaugauagcuccuaaacauugccuggaguggugugcaagauccuucucuuagcaggcauuggacaugucucuaggugaauuuacacaaauaucugagugaggugucuacacgggugguugcugggcugcuccucaggaaccaagugaggacacacuugccaguuuuggaucccucagcuuuuucgcucacuuauaugugcucuucugccacugugcucucauuaccaagugccagcguuucacucaauuuccacugucuuaagcuauuuauuauaaacuguauaaccuagugggaacuuggucucaucuauuuugugaacuacuuuagaaaaguucugucuacauuguuacugaaaaauaacaaaaacaaaacuccucgacaaagucuccaauauaaaagaauggaugucuggggcuggucuggugcucaguuggcagagugcuuguccagcauacacaaagcccuccauucccccagggcuacauaugcaaggugugacagugccugucugacaucccuuccuagagguggagaccagaagaugaaugcaaggcuauccucagcugcauagggcguucagggccagccuacaguacaugagaccuugucuuaaagugguugggggcagggacaauagcuggaagagauguuaguuuuaagauuuaagcagagaucaauuaaauugcuguccuagggucauagauaauguaugucuaaguaaguauaugaauuauguuuccauguucaaugaguauguuuauauaugugugugugugcgcacaugcagauaucuaccauauaaguuacuacuacaaaaaauuaaaauuuuaagccuugaaaguagauauccaaaauauuauuuccuuacaaauauuugcaggaauuuugcuuaauugcaaccagaagucugaccuggaagucuagugucuugacccucuagcugcuugguuuccuauuugugguguuuugcucuccucgacugugagaaaaucucuuuuacaugguuuuaacccuguguauucuuagaaacacugaaguuuucuaaguagaaaauacucccuuggggaaaccaacauucucauuauuugcacgagugacuuguaaagguuucuuuuaaauagaaaacauuuuuuugaaauaguuagcaaaucuuuuuuuuuuaaugggaucuguuuggaaguaaaauagcuuuccuuugacauaaugugaacuuuggagagguuugugcauucugugaauuuaccuuucauuaguaaaauauauuuuaaucaaaauggaguauauuaauuaucuuauuauaaggaaacuuuuccauauacccaucacuuuugauuuuuuaaaucuuuuuucucuaaccuuuuagaaaagagaaaaguaggcuggccugccuuggguggcuccauaguauuuaguauuauaguggucgaagagaguggguaagcuggacacugcccaaggaagccuucugcauuuauaccucuaagguggaugccauauucauuaaugggaacauuguuuccguguagcacuaugauuaauugaucacauauccucauugcaaauagcuucaggguuuuuguuucuguuuuguuuguguguuugaggcagaguuucuuuguguaguacuggcaguccuggaacuccuuuguauagaccaagcuguccuugaacucagagaucugccuacuacugccuccagagugcugggacuaaaggcuugugccacagcaccucaguucuuucuuauuuucagucagaagagcuuuucuuuuucuugcucuguugcucucuuguucucucucucucucucucucucucucucucucucucucucucucucacacacacacacacacacacacacacacacucacacacacacucauauuguguguauggagguguuuguuccugugcucuugccaugucaugcacguggaggucagagaacaaguuuguaggguugauucucuuuuuccaccauuacaugaguucugggaauugagcucauagcucauagcagacuuacauuguugggccuuuacccaucuugcuugccuagaagaaaucauucuuagcuguuucggggguuaagaaaaaggaacacuagcacuuccccauccauuuagcugaagaacauuuucuucccuauccccccccccuuuuuuuauuguaguaucauauuuacauuucauuacuguguuaaggaucccugggugcauuugcaguuucauccauuucugcggaugcuucuucuaccccugucccuaugcaaccacuaguuuccuguacugaucuaggcauuucaugaauuagaauugcauaauuagcuucugucacuaagcacuggacuuucaaaauccauucauauuguauauaugcagucauaacuucauuucuucauguguguguuuauuuuggugcauuugugucuuuggagaccagaggucagccucugguggcauucuucuguuucucaagugccuuuccuccuuaguuuuguuuguuuuucaagaaugauauuaaguuucauuuauuguuuuaggagaauucaucuaaaaaaaaaaaacaaaaaacaaauguuguagcagaucacaugcuugcaaaucccaacagugagaagggcagagacagacagaucguuacagcucaguggccggucaguguagcuuacuggauaccagcgagagguccagucucaaggaaacaggguuaggucagugaaauggcguagcagguagaaacucuuguacaagccagauguucucaguugacucaccagaacccauggagaaaggaaagaauugauguucuguuuguuugggugguuuggucugguuugaauuuuuuuuuuuuuaaaucaguucugaaguuuaagcuuagcucuucaucccugcggagcaaggacuuuacugagcaagcccucuucccagccuacuucauugccuuuuaaucggcaguuaugguacuauccagugaauuuacauuuuauuuauacauuaauugauagacaauuugaauuucuguuuuaaaauuaauguuuugugcgcgcacacacacacacauacaucccaccucucucucuggugagcucaggucugaugauggagcacaggguuccuucaaugcuaucuaauacucugcugcucagccugggcuaugacacaaaaguguuauuaaauauauaugugaagguuuuugaguggauaugauuucauuucucaugggucuauaccuaggaaugagauuugccgucuauuuuucaucuccgugguuaauauauuaaagaagugcagacuguuccagguagcuacacuauucuguguuuguuccuguagugcacaaggagucauuccaucuuccucuguguucccaccagcacuuguuacugccacuuugauuaugcccauccuagcaugugugacauggcaucaucuuguaguaacaacugguacuaaguuaaacccauauccaccugcagaagcaugauguaagaucugcuacuucauaccacaugcaaaauuaacagaucauagacucgcuuauaggagguaaacgucuaggggaaaaaaaaaaacuuugugaucuaggauuauaugagacacuguuucuuagauaugaaguccagagccugauuaauuagauuguagucaaaguucaaaaucuugaggggagaaaaaaagcccaaaggagaaagagcuucauuucaucuauguaacaagagcacuuaaaaugaaaauggauaugcauagguauuuuucauaaagaaaauauuaaauagucaaucaauucucaaauaagggcaagcaucacuagccaucaggaaaugggacuauaaaccccuaugacacauaugggggucauaaggacauauuuuuacauauuaugugauucaaaauaagauuuacccaacacacacacucuacuaauaaaagucugcagccaaugggauggcucaugagauaaaggggcuuacugcuaagccuggcaacccgaguucaaguccuguacccuacacaguagacauagaaaacugacuccacaggagcuccuggcagccacucaccaggguuacaucacauacacaagcucucagaaauggagauggauggaaggagaaagagagagggagggagagggaggaagaaggggaggaaagaggagggggagagggaggggaggggagagguaucuauuuuaaccuggucauugcaaaugaaauguuaaauuguuguaagcagcuaauguuugaauuguuuugaaagugcuguuggucuugcugaagcuucuuuccugugguuguagaagaaaacuucucuaacuguguucaucccaguuauucuacuuuuggccaaucaguucagagauccuugcuaucaucagcaucuuccuguguggaagugucagguguggcaauugagucuccuggguaucaguauuggcaguugaagcugagugaguucugaaagaccaagcugaaugaagucucauucuuaucccacaguggccucuugauuggaggcuuagggaagguggcagcuuccuaaccuccucucagagcauauuuguuuauguuuccuuugggucauuguugucuacuggaaaacaguucacaacacaguaaaggauaccuauacauuccuuguuaaauacuguuuucaguccuaguaaauuaccaauagaagcaguuucaaucaugauuuauguucugagacuggagaaaaaaaggcugugugaacacaaauuauacucagcagaaaugcaucacaucuuuagaguucuugaauauuuucaucacacaauguuuauuuaaaacccucuucaaaaagucuuuccuuucauuuguuaaacuuaucaaaaauuucaguuauauacaaaauggaaucauauaaugaaccucauuucucuacugucuacauuacuuuuuucacauagucauugccauuucauaauucucuacuucucucuccucuuauugaaauuguuuuaauauaaaacuuggaaucagcuuauauacauaaauguuucaacagaaauagcucuaaaaacaaacaaaaaugaucagagugcuauuuuuuuaaaaaauaguuggguuggguauggugcugcaugccuauaaacccagcuccuggaagauggaggcaggaggaugcaacuuuagcugcaugcagagcuuaaugccaaccuauacuuugugaaaaccugcaaaugaaaucgcccugcuguuuaucauuuacuauuuuaucuaccuuaggaucugugagugucuccauuacuuugaguuggauuauucaaaucaaggugcaaauaagguugagccauuuauccuuagaguuggagaccucucuuugcuauaaaagaacacugcuaauaugcacuccucuuaagcuuucuuuuuuuuuuuuuuuuuuuuccauuuuuuauuagguauuuaacucauuuacauuuccaaugcuauaccaaaagucccccauauccacccacccccacuccccugcccacccacucccccuuuuuggcccugguauuccccuguacuggggcauauaaaguuugcaaguccaaugggccucucuuuccagugauggccgacuaggccaucuuuugauauauaugcagcuagagucaagaggguacugguuagcucauaauguuguuccaccuauaggguugcagaucccuuuagcuccuuggcuacuuucucuagcuccuccauugggagcccuaugauccauccauuagcugacugugagcauccacuucuguguuugcugggccccggcauagucucacaagagacagcuacaucugcguccuuucaauaaaaucuugcuaguguauauggggcucagaacugaacaaagaauucucaccugaggaauaccgaauggcagagaagcacuugaaaaaauguucaacauccuuaaucaucagggaaaugcaaaucaaaacaacccugagauuccaccucacaccagucagaauggcuaagaucaaaaauucaggugacagcagaugcuggcgaggauguggagaaagaggaacacuccuccauuguuggugggagugcaggcuuguacaaccacucuggaaaucagucuggcgguuccucagaaaacuggacauaguacuaccggaggauccagcaauaccucuccugggaauauauccagaagauaccccaacagguaagaaggacacaugcuccacuauguucauagcagccuuauuuauaauagccagaagcuggaaagaaccuagaugccccucaacagaggaauggauacagaaaaugugguacaucuacacaauggaguacuacucagcuauuaaaaagaaugaauuuaugaaauuccuagccaaauggauggaccuggagggcaucauccugagugagguaacacauucacaaagaaacucacacaauauguauucacugauaaguggauauuagccccaaaccuaggauacccaagauauaagauauaauuugcuaaacacaugaaacucaaggagaaugaagacugaaguguggacacuaugccccuccuuagauuugggaacaaaacacccauggaaggaguuacagagacggaguuuggagcugagaugaaaggauggaccauguagagacugccauagccagggauccaccccauaaucagcauccaaacccucuuaagcuuucuuuugacuccuguguuuauugaagaaagcaagucaagugcccuggaauuucuccaguuuggguuugguuggcugugucugugugguauaguuucuuuacagucugagucugagugaaaucucguaugaaccacuuugugccuuuuguauuaacuuuaaugucucauugugacacauuuuauaugaacucuuaagaacuuauagaagauaaaacugaaaacuagguggucuuucuuucuuuuuuaaggaagggaaaacaaaaaaggcaugagacccauccucagaaauccuuaagagguguggugguaacuaaucucauguguauuaaugacuccugaguugucaaggucauuugggacucggugcuuaagaacuuuucuuucuccuagugccucuuugcuguugcucugaaaucccugccaaaaccuguuuguuuguguuuaaggaacuaggguaaugcauguuuucacagacaaaauccuauaucuuuuucauuauccgauaauuuugugaugugccaccauugcuagaacaagacucucaguaauuaauugugacauccuauaauaauauuuagaacuucuaucuauauguaucugagauauggcugaauaucucauaugccaugugugccucaucaacuguggaaauucaaauuccacagauguaguuaggcaccauggacccuugacugaacugaggagacucuagaacaguaaacacuuaucugaauuucuuauuuauuuauuaauugaugagaaaguacaagaggugaucaacuuggaaaauauuuagucccaccaucuguucuuugaguacuaaaugcaucaggaccccuuacuucuuaagauggaauugaacaucuaaaugacagugacagaauuaagagacacauuuguaauagccagaugcugaauaacaaauauaggggagaagacagacuaucuaaacaucaggagaaggucagagagugaguggaccagaaccaggagaugaacccagaacugugacaggagagaaccauaggguguccugccucugugcgguggugaguccccuaaagcucuguguccuguucugccucuucuccacagaauuccugacacacauuguacuggcuaguuuuguaccaacuugucacagcuggaguuaucacagagaaaggagcuucaguugaagaaaugccuccaugagauccaacuguaaggcauuguuucaauuagugaucaagggggaaaggccccuugugggugggaccaucucuaggcugguaaucuugauucuauaagagagcaggcugagcaagccagaagaagcaagccaguaaagaacaucccuccauggccucugcaucagcucuuucuuucugaccugcuuguguuccaguccugacuuccuuuggugaugaacagcaguauggaaguguaagccgaauaaacccuuuccuccccaacuugcuucuuggucaugauguuugugcaggaauagaaacccugacuaagacacauauuuuugccuuucuggagccacucugguauucucuucuccccugaagcuacuucagaaauacuaccaaaugccucuugauugcuagcucagcauuuuguuuucuuuaaucuccuuucugagacuucugcccugcuuauucuugucucacuacuacuuguagucuccucuuuguuguccuugacuggugugugugugugugugugugugugugugugugaucuuuguagauguguccucccccugcaccggguaaaaugugcuaggcuguggaucuuucuuaccuuuuggacagguuguccucaguauauccccacaugacuucuucccugaaacccauuuuguuuugcauuggaaauagucacuuagagauacucauugguucuucucuaaaguuuuguucauugucuuaucagcucuccauaaaccccauguuucuugccagcuaccauuuaucuaagaugaauucacagaggugaaacacacaucaccaccauagcucugcacacuacgucaaucaccagacgucucugacucugucucugaaguaucccuuggcuguguuuccauuugucauuuuccuggacuacugaggaaacucacuuucuccucauuggcuuuguuaaaagcuuaagccaaaagucaaguuaauggaguucauuuaagcauagaacaauuccugaaugaggcagugcuccaaaucacaagugguucacagagcccucccuggcaaugggaguaaauggcuuuauaggaugaacaugcaaacaaauggaagaaaacuacucgauuagguaggcauuuucuuugaguauaacuuaauggaaauucuccaguuauauaacagauugguuacuuggauuccugaaauuggcauaaaaugcaacuaaaaauuaaucaguugcaauuaaugcaucuaagguaaauuuguugcuugcuugcuuguuuguuuacaaaaaaccugugcaagggcaucuuuguaaaacacugaauguuuuuauugaugugggggagggaggccauguagaucugggcaugaagauacauauacuuauaauccuaguguuugggauccugaggcaagagaauuucaaauucagggccagccugaacuguauaaaacuaugucuuaagcuaacacaaaguauuuauuuggcaauugagaaugucagauacaaggcugccagcaacaauauucagaggucuacaagaauuuccaaaccaaaaagaaagauaagggaauacaaaaccgcaggugaaaacaaaagacccaaaaagcuugucagugaauaccaaagaaguuuaauaacaccauagacuaguucucaacauagugcuggagagauaggucagcacccacaaggcagaccacagcugccuauagcuguaguuccaagggaucugauacccucaaaccgauacacaugaaagcaauuaaauaagugaaagaacaacuaguuuucaauuuugugaaaggacacuaaaguuauuuaaaaacaaucagcaguuuuaacauguuaaauuuguaauacauuuuaucagaaaugucuuaguuuucuugaaauugauuuuuguauggcucaggaucuuuuauaucaaguguccaaaaggauuuuuuauaacuugacaagcuaaaugaaagagcaaaaggccgugaaugacaaguaacauugauagagaagauaguaauauugaguaccaagagagggauuugcucuaccacauuaagacuugcuguaaauaaaguucagguaauuguaaaggaaugcagaaaagggacauauaugacugacugagauuaggggugauugugggccuucugucugauauuuaacuacugaucugugacauugacauuguguauaacaugaaguacauuaaaauaacacugcucugggaugugccaacaugccuguauucucagcacuuagcaggcugaggcaagauuagagaaagaugagccaaccuggccuaagaccuuaucucaaaacaaauaaacauuagucacugccuguugucuaaagagcauuauuaggcagguguaguugaacacauccacauugggaagugguggcaaaagcauuggaguucaaugcuagacuggauacuggcuuaaggaaaccacacauaggggcuguggauggcucagcagauaaagguacuugcaaccaagucugaaaacuugccuuugaaaccuaguacccacacaguggauggaaaggaaaacuacuguuuaaguuauugucugaucuccacauacauaccauggcauguaccccacccucuuuaguugaauaaacagauguaauauaaaauaaacacaucacaaacaagaaugugaagggggauagagaacuaacguugagauuuuucuuuuuuuuuuuuuuucuggugcauaaauuuaacuucuuuauaugagauuuuuuuuuuccauuuuuuauuagguauuuagcucauuuacauuuccaaugcuauaccaaaagucccccauacccacccacccccacucccuuacccacccacucccccuuuuuggcccuggcguuccccuguacuggggcauauaaaguuugcguguccaaugggccucucuuuccagugauggccgacuaggccaucuuuugauacauaugcagcuagagucaagagcuccgagguacugguuaguucauaauguuguuccaccuauaggguugcagaucccuuuagcuccuuggcuacuuucucuagcuccuccauugggagcccugugauccauccauuagcugacugugagcauccauaucuguguuugcuaggccacggcauagucucacuaaagacagcuauaucagaguccuaucagcacaaucuugcuaauguaugcaauggugucagcguuuggaugcugauuaugggguggaucccuggauauggcagucucuacaugguccauccuuucaucucagcuccaaacuuuuucucuguaacuccuuccauggguguuuuguucccaauucuaaggaggggcauaguguccacacuucagucuucauucuucgugaguuucauguguuuagcaaauuguaucuuauaucuuggguauccuagguuuugggcuaauauccacuuaucagugaguacauauugugugaguuccuuugugaauguguuaccucacucagguugaugcccuccagguccauccauuugccuaggaauuucauaaguucauucuuuuuaauagcugaguaguacuccauuguguagauguaccacauuuucuguauccauuccucuguugaggggcaucuggguucuuuccaacuucuggcuauuauaaauaaggcugcuaugaacauaguagagcauguguccuucuuaccaguuggggcaucuucuggauauaugcccaggagagguauugcuggaucauccgguaguacuauguccaauuuucugaggaaccgccaggcugauuuccagagugguuguacaagccugcaaucccaccaacaauggaggaauguuccucuuucuccacauccacgccagcaucugcugucaccugaauuuuugaucuuagccauucugacuggugugagguggaaucucaggguuguuuugauuugcauuucccugaugauuaaggauguugaacauuuuuucaggugcuucucugccauucgguauuccucaggugagaauucuuuguucaguucugagccccauuuuuuaaugggguuauuugauuuucugaaguccaccuucuugaguucuuuauauauguuggauauuaguccccuaucugauuuaggauagguaaagauccuuucccaaucuguugguggucuuuuugucuuauugacggugucuuuugccuugcaggaacuuuggaguuucauuaggucccauuugucaauucuugaucuuacagcacaagccauugcuguucuguucaggaauuuuuccccugugcccauaucuucaaggcuuuuccccacuuucuccucuauaaguuucagugucucugguuuuaugugaaguuccuugauccacuuagauuugaccuuaguacaaggagauaaguauggaucgauucgcauucuucuacaugauaacaaccaguugugccagcaccaauuguugaaaaugcugucuuucuuccacuggaugguuuuagcucccuugucgaagaucaagugaccauagguguguggguucauuucugggucuucaauucuauuccauuggucuacuugucugucacuauaccaguaccaugcaguuuuuaucacaauugcucuguaguaaagcuuuaggucaggcauggugauuccaccagagguucuuuuauccuugagaagacuuuuugcuauccuagguuuuuuguuauuccagaugaauuugcaaauugcuccuucuaauucguugaagaauugaguuggaauuuugauggggauugcauugaaucuguagauugcuuuuggcaagauagccauuuuuacaauguugauccugccaauccaugagcaugggagaucuuuccaucuucugagaucuucuuuaauuucuuucuuuagagauuugaaguuuuuaucauacagaucuuucaccuccuuaguuagagucaugccaagauauuuuauauuauuugugacuauuaagaaggguguuguuucccuaauuucuuucucagccuguuuauccuuuguauagagaaaggccauugacuuguuugaguuuauuuuauauccagcuacuucaccgaagcuguuuaucagguuuaggaguucucugguggaauuuuuagggucacuuauauauacuaucauaucaucugcaaaaagugauauuuugacuuccucuuuuccaauuuguguccccuugaucuccuuuuguugucgaauugcucuggcuaauacuucaaguacuauguugaaaagguagggagaaagugggcagccuugucuagucccugauuuuagugggauugcuuucagcuucucuccauuuacuuugauguuggcuacugguuuguguagauugcuuuuaucauguuuagguaugggccuugaauuccugaucuuuccaaaacuuuuaucaugaauggguguuggaucuucucaaaugcuuuuucugcaucuaacgagaugaucaugugguuuuugucuuugaguuuguuuauauaauggauuacauugauggauuuucguauauuaaaccaucccugcaucccuggaauaaaaccuacuuggucaggauggaugauugcuuuaauguguucuuggauucgguuagcgagaauuuuauugaggauuuuugcaucgauauucauaagagaaauuggucugaaguucucuaucuuuguugggucuuucugugguuuagguaucagaguaauaguggcuucauaaaaugaguuggguagaguaccuucuacuucuauuuugugaaauaguuugugcagaacuggaauuagaucuucuuugaaggucugauagaacucugcacuaaacccgucugguccugggcuuuuuuuggcugggagacuauuaauaacugcuucuauuucuuuaggugauaugggacuguuuagauggucaacuugauccugauucaacuuugguaccugguaucuguccagaaauuuguccauuucguccagguuuuccaguuuuguugaguauaaccuuuuguagaaggaucugaugguguuuuggauuucuucaggaccuguuguuaugucucccuuuucauuucugauuuuguuaauuaggauuuugucccugugcccuuuagugagucuagcuaaggguuuaucuaucuuguugauuuucucaaagaaccaacuccuccuuugguuaauucuuugaauaguucuucuuguuuccacuugguugauuucaccccugaguuugauuauuuccugccuucuacuccucuugggugaauuugcuuccuuuuuuucuagagcuuuucgauuuguugucaagcugcuaguaugugcucucucccguuucuucuuggaggcacucagagcuaugaguuucccucuuagaaaugcuuucauugugucccaaagguuuggguacguuguggcuucauuuuuauuaaacucuaaaaagucuuuaauuucuuucuuuauuccuuccuugaccaagguaucauugagaagaguguuguucaguuuccacgugaauguuggcuuuccauuauuuauguuguuauugaagaucagucuuaggccaugguggucugauaggauacaugggacaauuucaauauuuuuguaucuguugaggccuguuuugugaccaauuauaugaucaauuuuggagaaggucccgugaggugcugagaagaagguauauccuuuuguuuuaggauaaaauguucuguagauaucugucaggucuauuuguuucauaacuucuguuaguuuuacugugucccuguuuaguuucuguuuccacgaucuguccauugauaaaagugguguguugaagucucccacuauuauugugugaggugcaaugugugcuuugagcuuuacuaaagugucuuuaaugaauguggcugcccuugcauuuggagcguagauauucagaauugagaguuccucuuggaggauuuuaccuuugaugaguaugaagugucccuccuugucuuuuuugauaacuuuggguuggaaguugauuuuauccgauauuagaauggcuacuccagcuuguuucuucagaccauuugcuuggaaaauuguuuuccagccuuucacucugagguagugucugucuuuuucccugagauggguuucauguaagcagcagaauguuggguccuguuuguguagccagucuguuagucuaugucuuuuuauuggggaauugaguccauuaauauuaagagauauuaaggaaaaguaauuguugcuuccuuuuauuuuuguuguuagaguuggcauucuguucuuguggcugucuucuuuuugguuuguggagugauuacuuucuugcuuguucuagggcgugauuuccguccuuguauugcuucuuuucuguuauuauccuuugaagggcuggauucguggaaagauauugugugaauuugguuuugucauggaauacuuugguuucuccaucuaugguaauugagaguuuggccggguauaguagccugggccggcauuuguguucucuuagugucuguauaacaucuguccaggcucuucuggcuuucauagucucuggugaaaagucugguguaauucugauaggccuuccuuuauauguuacuugaccuuucucccuuacugcuuuuaauauucuaucuuuauuuagugcauuuguuguucugauuauuaugugucgggaggaauuucuuuucugguccagucuauuuggaguucuguaggcuucuuguaugaucaugggcaucucuuucuuuauguuugggaaguuuucuucuauuauuuuguugaagauauuaacuggcccuuuaaguugaaaaucuucauucucaucaauuccuauuauccguagguuuggucuucucauuguguccuagauuuccuggauguuuugauuuaggauccuuuugcauuuuguauuuucuuugacuguugugucaauguucucuauggaaucuucugcaccugagauucucucuuccauuucuuguauucuguugcugaugcucgcaucuaugguuccagaucucuuuccuaggguuucuaucuccagcauugccuugcuuuggguuuucuuuacugugucuacuucccuuuuuaguucuaguaugguuuuguucauuuccauuaccuguuuggauguguuuuccuguuuuucuuuaaggacuucuaccuguuuggcuguguuuuccugcuuuucuuuaagggccuguaacucuuuagcagugcucuccuguaauucuuuaagugacuuaugaaagucuuucuugauguccucuauccucaucaugagaaauguuuuuaaaucugggucuagauuuucaguugcguuggugugcccaggacuagguggggugggagugcuguguucugaugauggugaguggucuugauuucuguuaguaggauucuuacguuugccuuucgccaucugguaaucucugaagcuagcuguuauaguugucucuguuaagagcuuguucuucaggugacucuguuagccucuauaagcagaccugggaggguagcacucuccuuaguuucagugggcagaguauucucugcgggcaagcucuccucuugcagggaagguacccagauaucugguguucgaacuggacuccuggcagaaguuguguuccacucacuagaggucuuaggaucccguguggaauccugugugggccuuugcgggugucaggcgacucugcuggcaagguaccccggggcucaaguggagcggaaggggcuugugccccaggucaggccaggguagucugcuucccuauuuaccgcagucucagguucugugcgauuggauuggggcuggcgcuguguuccacucaccagaggucuuaggaucccguaggcaaucaugugugggcccuugcggguguagggcgacuccgcuggcaaaguaccucggggcucaaguggagcggaaggggcuugugccccaguuuaggccggggucgagauuuuucuuuacuuguguguuuaauuuuuuucucaggcaguaccucacuccauagcucagacuggucuugaauucacuagaugacauuccgcugcacaucugagauuacagguguaugcuaccaugaccaacaacauuaaguuuucauuuuaguacaguugaaaaaaaaauguugcaugguucuuucuuuuuaaagcaaaacaaaacaagugucaagcuuccuucuggcauugcggugugugcuuucauggauccacucuuccccuuccucccuuccuugcaaagcugcuguuccacuguacauauucuggucaggcgagcucuguuagcuccuaugucugucuuccuggaacccuuccccuucaugguccuuuuucuaugcucaucguagucaccccacauaaacacacaaauguaaaaaguagaagcuaggaugcauauaucuuuaaugucagggcuuuagaaaggauucaaaaagacaaaucacacauagauaugcaugcccugcacaugaauuaauuuaggcuagaauaaauaccuaaaucaaagcugaauacugccuaccugagcauuuggaacuggccagcuuuccuuaggcacugucaaagacccuggacaguagguuucccuagugugcagaauugauagagauagcaaacuggcagcagcgggcuaugcugcauaucagaacauuuuauuuggacuauacacuuuauuuuaaguuuaaauuucuuuccaucuuaaaauauaaauaguuuuuauauaaaaguuggguugacugguuuuucugauacuaaaguccuagguuucuaauggcagcugguggcuggaguugauuggccugugugagcuuuaaacaagagggugguucucuugggcuuucaaccauuuuucuuuucuuuuuuuuuuuuuuuuccauuuuuuauuagguauuuaacucauuuacauuuccaaugcuauaccaaaaguccccuauauccacccacccccacuccccugcccacccacucccccuuuuuggcccuaguauuccccuguacuggggcauauaaaguuugcaaguccaaugggccucucuuuccagugauggccgacuaggccaucuuuugauauauaugcagcuagagucaagagcuccgggguacugguuagcucauaauguuguuccaccuauaggguugcagaucccuuuagcuccuuggcuacuuucucuagcuccuccauugggagcccuaugauccauccauuagcugacugugagcauccacuucuguguuugcugggccccggcauagucucacaagagacagcuacaucugcguccuuucaauaaaaucuugcuaguguaugcaauggugucagcguuuggaugcugauuaugggguggaucccuggcuauggcagucucuacaugguccauccuuucaucucagcuccaaacuccgucucuguaacuccuuccauggguguuuuguucccaaaucuaaggaggggcauaguguccacacuucagucuucauucuccuugaguuucauguguuuagcaaauuauaucuuauaucuuggguauccuagguuuggggcuaauauccacuuaucagugaauacauauugugugaguuucuuugugaauguguuaccucacucaggaugaugcccuccagguccauccauuuggcuaggaauuucauaaauucauucuuuuuaauagcugaguaguacuccauuguguagauguaccacauuuucuguauccauuccucuguugaggggcaucuagguucuuuccagcuucuggcuauuauaaauaaggcugcuaugaacauaguggagcauguguccuucuuaccuguuggggcaucuucuggauauaugcccaggagagguauugcuggaucuuccgguaguacuauguccaguuuucugaggaaccgccagacugauuuccagagugguuguacaagccugcacucccaccaacaauggaggaguguuccucuuucuccacauccucgccagcaucugcugucaccugaaauuuugaucuuagccauucugacuggugugagguggaaucucaggguuguuuugauuugcauuucccugaugauuaaggauguugaacauuuuuucaagugcuucucugccauucgguauuccucaggugagaauucuuuguucaguucugagccccauuuuuuaaugggguuauuugauuuucugaaguccaccuucuugaguucuuuauauauguuggauauuaguccccuaucugauuuaggauagguaaagauccuuucccaaucuguugguggucuuuuugucuuauugacggugucuuuugccuugcagaaacuuuggaguuucauuaggucccauuugucgauucucgaucuuacagcacaagccauugcuguucuguucaggaauuuuuccccugugcccauaucuucaaggcuuuuccccacuuucuccucuauaaguuucagugucucugguuuuaugugaaguuccuugauccacuuagauuugaccuuaguacaaggagauaaguauggaucgauucgcauucuucuacacgauaacaaccaguugugccagcaccaauuguugaaaaugcugucuuucuuccacuggaugguuuuagcucccuuucaaccauuuuucuauugcucguuuugccauguaggcaugcaguucaucaccuggauucaguugauaaggacggaugguguugcauguagacagauacaacauccucuuaccuaauguuucagguugguuuuguuugcugguuuguuuuauguaucuugggaaaguggauaagaugucugucaggggucuauacuguacuaugauuucauaguccuguuggaauagaccagugguuggugagccuuuuucuuuauguguaguacuagaauaucaagaguuggaauaggcuuucugcaagacagggaagcccuacaggacaugcugcccagcuguggauaauguaaaagcuauuccugagagguauccucagacagcuagcaggucaaguaaacagcgauaucauucaaaagguuaacaaaagcucuguuucuuuuauuaauagcagagacuuuuuuuucuaaagacagugcaggguuuuguagaggcuauuuaguuuuugagucugcaguauuaaaucacucacuccauuggucauggccugacagauagugcugugagaaccagagcuuuagaugcuaguucugcaguucuugcaaguucucuuggcauaguuucauauuuuaauuuuauuauuuuacauguuuacauugcaucuuuauaaaaaaauagaaaaccuauauggaaaaaagaucugaaguaauaauuuuuuaguuugucuuaucauuuugacuaccuugaaaggcuuuacauucuauguugcugaugggccaacaagaucaggaagauuucagguggcaaaaugauuuuuaaacaggaaaucuugccucauuaguuuagaauuuuuuuauuacacuaaccugcuugcacuauuuauuuuggcaucagauagacauaaguguauugugguacacauuacagauuuuagagcuauaauaauuuaaagauaugaaauaauaucucaagggaaucuuuucagagucucuaaaugucuuggguauaaguaaauucucauccuaggaccaaauauuccacuucucaaccuaaguuguuucccaggugccaucuuagucuaggauccuguguguauauauucuuaagauuaagacagaacucuuugagucucaauucccauaaaaccccuguccccagcccuacccaucaccagcaacagugaagguaacauguaagcccuugacauacuucacaagacuucauggagccucucccauugguguuccugagaguuucuugcugcauuuuaauggacaguguccaacuuauaauuucuuuaccuuuuaugucuuagguguucucauaggaacauaugaaauuuucugaaugcauguguuuuagaaagugaugaguuguauacuuucuucucuaaaugaaauagcuguaaaacuucuguccaucuucuguguguuucugauguaguauaguacagaagacacugcuggugcuugcuaggcaguaguauuuuucuuccuguucucuuaguugcaaccaagucuucaaauggaaugugggcccuucuccugccuucacacugggaaccauccccuguaugugcugauacacaguccgcuccauagcagcacacaguaguguuucucaauacaaaugagaccacacuccuacuccuucagggagcuuacuuugccaaaauguuagguuucuacaauuguaccauggguuucugugacaucauugguagaaguacauauuuaagucaacugccuuccagucuuugaacugcaaguauaaguuugguuuguacccacagauuucuaugacagguaaagaaggcaaaaguuuuaaauuucuaguauucuaaaagaccauccagauuggaggaaaaaugcaacugaggcaacagagaacaaaccugcuaaaaaaugaguuguuuccaucccaguuuggagggaacucgguggucuguacauugggauguuggagaacauugaauuuaaaguagcuaucugagcaauaaugucaugcuccacucugguguugcaggguugucuuuguuaucugaaauuugugggacuagagauguuucauuuuuccagauuugugggguuuuuauguagacuuuauuguuugaguacaccucauuuaaaagucagaauucugcaauacuccaaaggaugaaacuuacugaucaucaugacaauggucaaaaguuuucagauugugaggcaguuugaauuuucaggcucaggauguucaaucuauaguaucuugauaauaaagcagacucuauauugcucggagcucauacuuacauguuaggaaaguaagucuucaugaugucuaacuuauuuugacauaguuuaaaagacauguuuaugaaauaugauagaagaugagucaugacucaucacucagacuagaugguggcguuugggggacuucguggcacucgcuuugcuuuucuggauauuugaaguuguuaugguuaccugaucaaaugaagaugccuguucaaaguuuaaaguuuaaaggauaugggcaugaacuugccuugugcuuugggagagggcuuugcuggaagagagccaugugguggguagguggagcccagaagaaaccuaugaaagagcgcgugcuugccaugcaaucccguccccucagcagggcacaugaagauauuucucccagccuccccauuccauggucuguguuugaggguggaacuucuguguuaugcacugcacuaccaacuugccuugccagcugcaggauucucaagucccuuuggcugugaguccacuggaaaacuaaugaggcugaguaguuuuacagcaauucaagaagcuauuuucucucagugacuuggcacuauaaauuauaauaaccaauguaaauaaccauuacuuuaaacugagugucuuagucacuguucuauugcuaugaagcccaugccaggcuaaggcucagucucacuuacucagccccuccccaaccuucucugccugccuaucaggauauagcucucaacuacuucucuggcaccaugccuuccugaguguuggcaugcuucccaccaugacuguaaucaccuaaaccuaugaaacaguaagcaagcccccaauuaaaugcuuucucuaauaagaguugccuugaucauaaagacucuucacggucacuaagacagaaguugguaccaaggagaggcauauugcugggacagguguguccgugcuguugguuggaagaauaugaaagacuuugggacauuggacuagaaaagcagacgaggcugaaggcaacuugaacugugguggcucagcucaagaaguuccauaggaccaggauauuauuagcaaguggccuagagaccaaccauucuugucaauucucucuagugccgagucuccauauuucuaucaaagauacaguggaacaguguaagacaaaguauucauaucuuuaaaaaguuuguguacuuuuuguuaacaacuuguagagcccaguaggaaguuugcaguaacuggucuacauuugagcuuucaauggagaguuggaggcuguuuguaaguggauagagagaagaccaucagagaagaacauuaaaccaacauguuuuaccuaggaagcaugggaugcaagaagugaaagagacugaaguuuuuaggggcugcuuaggagugagaaaaaagauguacauuuuaguaucauuuagcaguugucaccugagaaauagagauuaugucugggaauggauauagcuggggauuuaugauagagagagacuucuacuacaaaggcauccccccucccugguucuucaaaaaucuaaagacaguguuccuuaguagaagagggucacaauagcuagugagaaaacggacuaauccagugugauuuccuaguaccuagugaguuuaggucauaauugccagaugguuuucaaguagaacacguuuccugcuuguguaucuuguccucagucuccugacagguucuuuuuaaucuauguuuuacucuuuugcagcuucauucauguauacagugaauuuucaucauuucaacaacacaaccccccuuugaccuuccaucucccccaauuccuucuccagcugaaauccuucccaaguugcccuccuacuuuaaugucuucucuucauguauuacucacugagcuuguuagaauugcuugcauguacauagguuauuuacuggagcauggaccagucagcagugagauagugacagaagauagugacugcuguucccccaccauuaauuauuuguuauauuucaagaagugauggggccucaugaaucuuuugcauuucauaauaaaauguuaaugggcuuaaucuuguacagguagccauagcucuagugaguguuccuggguauaauggccaugucauauccagaagauaucuuucaaaacaugugaccuuccaucccuuccagucuuuccuuucccucuucuauaauuuccuaaacuuuggaagggauaguaucaaugacccauuuaaggccgagcacucuacccuauucuuggaaguucuacuaguuaugagucucuuuauuaaucauggccugcugcaacgagaaacuucucuaaccaaggcugagaccuaauuugauuuucugcauuuaggacuuaaguguaggaagcuggcaggggguccgacauggaggggaagaaauggacccaccuggauucuuugccauguuacuguuaucugcagagugguggagccuuggcuuaacccugaguaaguccaaagccucaguaggcagcugaacuuuguaaccucaguggcauugaggacaaugauaagaaugagguuguucugucucccuguuaucuauggaaaggaaugcaucccaaagcucaguauguuucagcuggcagugauuuucucuguucacacagcgagauucguuugccuuaagaacugacacaguaccauuuguauuuacauuucucuuuaaacaauaaaguuucauauaaccaauggaauuaaacaggugcaaaucuucuuucuaaaaacaacauguuaaaccuaccauuuuacuugaaggaucauuaggcugcauuuccuaagacuacugcuacuaauauuggccacuugaggagugauucuugugcauaguucuguuucaggggacagagguacacagggccagguucuguccuagugauuucacuaacaaacugcuuggaauaugcuuuguauuauuuuuccauaggaggaggcauuguauugaauuuuuauugcauagguuaguuuacugguuaggacuuuugguggaguuucuucaucagguaggugguaucuucuggauaacaaacuguggacucagagcaguggcuuucauggucagcuuucccguuagcuucuuucugaucauaaccuucuuuugcugacauuuugucaggaagaguuuauacuuacagaccaucaaaggccaguguguguucucuugcuucuuugguccuuuauaagacucauaaauaauuaugugaaaguucacuucuaaauuuugauguguucuugaguucuaaguugccacaaauuccucuccuauaacuauuccuccccuaacaguauggcaaauaaacaaaugugguggcuuccacuuucucagugaccuaaagaacaaaaugcuuguuuaaagcacucagaaauauuaacuuuguguguauuuuuaaaaacuuuguagaagcaagcaauguaacugaaauaaaaucugguuuuuacugugucuggaaaaauguauuugaucaucuuaaaucuagagauuauccuuuaguauaugucauugucauuucacaauaugcguggcugaaggagcugugcugucaaagccauuguguguuuagccaggguuucacaucugugcucuccuaguccugagccuguuugcaaggugcuaggaaggcuaggaaauacaaaagaggaaauguacuugguuguguuuuaacuaugcacauggguucagagcaaccuucgucauggaguuaaaaagagcaagggcuuuauuucccugugguugcucugaugauuccgucucugucuugaagacuuagcaccuuucuaaauuggcgcaguucuggaaaacccucaccccaucucucugugguaacuagaagcacagucacuugaccucaggaaaauucauugacccaggggaaacaggaggagagguacaaaggaaagaaggggaaagguaggcaaauacuuucuguggauugccugaaguucuguuagacccgaagagucaauggcaaugccuccaucuucacagauaagauuacuguuuggggcagaguuuaugugguagcuauagccugugcauuuuucagagaaacacaggguuuuguuuuguuuuguuuuggagacaggguuucucuguguaguagcucuggcuguccuggaacucacucuguagaccaggcuggccucgaacuuagaaauuugccugccucugccucccaaguacugggauuaaaggcgugugccaccucgccuggcuaacauucuacucuugauggaccuucacuucaguuugugaccauugugaagaaugcuacuauagaaauacacauauuuauguaauuucaacuuuagguauugaguacccuuucaaaauggcugugccuauuuguacaucuaucaacaggucugugcaucaguuuagauuuaguacgucacucaugugacaucauuaacuuucagacauguuagaccucauuuguuccguuuuacagaugaagugacugagccacuucacagauuugggacuuuuaaaagagccagugugauaacauugcucucuccacucauaugaagucucuguugguuuauuuauucuuuuauuuguuaauuauugaguagguacuguaugacaggcauugggcagggucccgcuauucagucaaauuuauaaucuaaugauaucacuuucauuuuacagguuauggcuuucagaucacagcuuauuuccucaagagagggauacaccuucacuguauccagaacucccagaauacugguaagguaucuaauuuuguacaucaggcauuuucacaaucaaguugucuaaaggagugacaaaaaaaaaaaaauuagagaacaaauauuccucuuugcuucuguagcuacaccauuuaguauuucaaagaguauaugacccccuuugcuccauucauugugcuuacugcccaugaaaacagagagcuggaccacaaugcacuuucgugguaucacagcauuuuccugacauuucagagugacucagugaacaggugagcaugagucauuuugucauggugaguguaccccagagccuuuggaaaggggcaaaugaauuccaagaaagcauuuuccuagcucagagccagcaaagcuuccauaaguauuuaaugaggcagcucccaacucuccccugcacaaguccugauacggaaagugauaccaugugcaaucaaccacagugaaguaaggagauaauguccagucugucugaauagaucagaaccguagaaaaaccuccuugauggaaguuuguucacagcaugugcaugcuuaucuguauuuucuuaacucuuaaauguugaucagauauauugccauauuuuuaaagaaaaacagaauauuuucuuuucuauauaugaggucugcuuucauggauguauauuugucacacaucugugcuuggugcccuuggagacuagaagacagugauggaugugcuagaacuagaauuacagauggccuugaaccaccaugaugggugcuaggaaucgaaccucgggccucuggaagagcaaccagugcucuuaaccacagagccaucucucuagccccuauauuagccacuuaauagggucuuauauuuguuuaccucaaaaagcuaaccuuuuaucuguuacaaugcaaucuagcuuuacauucugguggagauuggugguguuuacauuuuuauuuaaauauuaaaguaacacaaaucaauuauuacauaaucaaguaaagugauacaaaaggaacuuuuaaauugauuugacuaucaaaguauucauaaucuaucacucuuauuuuugagaagaaaaauagaaauauaaaauagauugaguucuguggcuuuauuuuucccccuccauaaaguaggacaggggcugcuuagcacuuaaucccaaucauuuauuucaacaacuaauacauaaauacuaauaaaauuaaauuuuauaauuuuguucuuagagcuuuuucaaaaaccaugagaggcccccauccauauggaacaucuguguggggucaaacuuuagauacacccaugacuucaccugcaaggagaccuuucucugagaggcuccgguugacugacaccagagcaacaaguuggcugaagucauggagagcauccauguuagguagugggaagaaaaugaggcaggugaugaagcuuuuacuuggaacaucuaaccuguuguuaggaggugugugguucaguacaguagucaccaaagaaacagcagaggcccagggcucaagggagaaccacuccaggaacauuaacucuuuuaggucuuuugguacacucugaacuagcagguagugagguguuaccgguguucauauuguguguuugcauaauuaacaccuuugugcuuaacuaacaguugaaccaaauggagcugcguuacuaucuuacucagucucucaugggcagaauauugaaaggguucacaauagauuuauaccucucuuuuaaaaacaugcucacaucugagaaugaaucuuucuguuuuagaacaaugauuguuuuuguagcaauguacguguaugauauaaaaaagauucaggcaguguggcaaguaucaagagaugaagaaucuuccccauuuaguggagauugguagucuuuguaucuguuacacaucacacuaaacauggucccacaguugaauggugccugguagguguacagauggacggagaaggcaggugaaagaagagugauauagauggcacugcuuaugcuguguucccaucacugacugaaggauccuuguucugugcuccauucuguggucccacuuggaagucaauggcuuugcugucagaaucugcagagguggauugcugugaccaaggucuaaugccaucucuccuguugcauacuuaaccauucuguuaauugacuacccaauuccuaagagaaacaguuguuuucguaucucaauucagcuuagaagcuugauagugcagaauuagccuuuuaguucuccccaagagcuaggaagacaauguauacaugaaugggucacaguuuuagauuuauaucucacauucuucugauuuuuucuuuaaaaauuuaauuuaagucugaaugcugacuaaaaaacacuaauauuucucccuacuaggacuccuaaacagaaaagggcaugcuaacacagaaaacaauaauagccuaucuggauguuccauguucagaccaguuugcaaccccuuggcucuuccuagaacucacucugcccaagugguggaaaucuuguagagagaagaagggaaaggagaucccacucacaugcaugugcuguauauauaacccuaacaaaaagucagcagugaugucuucuugcaugauguugaugcuuuuaguaacuugaucuucuuuguguuguacagaacuucguguauuuccugaaagauuugugguguguguuagucagcuugcauuuggucaugauauuugggcaaaccagaaugaaaaaucgguauguacgaaaaaagcucuguaaguaagagaaucugcuuaauauugagugaccaugguaauagugguaguggugguaguggauggugugagugcgugcgugcgugcgugcgugcguguguguguuccagggugucuuuuauuaucagcaguucaucuguuugaagagauaagagaugcuugccucccauuuugcaugcuaacguugaucaauuaaugaguugauuaauuaauguguuggguuuuuguuucuuuccccuccaaaaccuucaauauuuaguuugcuaggaaguaucuuuucaccuucaacuuuaaaugaggcagcaacauaccaggacaaccuugaugguguuugugauuauaaaugaagagaagugaaaaaucugugcuuccacuggaacuuuccguuggaggcagugacuucugacuuguauuccauggugaaucucugaugguuuuucugagaacuagugagucuccccaguguauuauuucuagcuaauagagcucauucgcucuugcucucuuuucucaugcuaggcuugaguucuagcagggccuuguucuguuucacaggaguucucuauugagacaaguaacuguagaaaaccuacgcaaaaauauaucuuacauuugugucuuuuaagcuuaacauguacucuuaacaguauccuuauuauuuguauauguaucuugcuucaaucacacuuuagucuauuuaacuugcucuuaaaaaaauuuaggucuacagcuugaaccuucaaugaacaggaaaaaaaaauauagaagacauuaacccagccauuaagugugacaugauuauuaugcuucuaaaauaauuuauagggauauuagauuaucccuguuguuuauuauuuuuuaacccauaugaaauuugaaauuuggcucacauaguuuaaaaucaguuucuuaucucaucuuaaguaaauacauaagaacaguguuuuggagccucugagacaauagagacccagaagaagucaagagcugaaaauucauacuugcauuuaguuccuuuguuuugagcagagaauccuuucaaaaaagccagugcaacccuuuuauuucuucuucauccaucaaacccacucuagauauguacauaaaauaagauuagugaagcaaaucuagccaaaagcauuaaacguuucuucuuugaaauauuuccaugaugcuguauuaucuuugaagauuaauaaauacuaaaauaauuuuguugggcuauauuuuaauaaauauuucuuaacugauuuuuuucagagcaagaaagaauugaucugugguuuaaaaaaaacaaugauuaacucuaccagaaugcuauuacuugcagaugggauaccggagaaaucagaucuuauagcugauguguaauguuaauacuuaauaucugaaauuguuaaagaggaauuaaagcaucugaauacaaaggaaacaguauccccuuaggggcucugguauuuguacagauguaaguuuucuguagcugcugugauauaaauccuguaagccagagaacuuccugauuauugagaacuuucauccugaaccagccuggauauuuuacauggggacuuugguuuccuuaucuuuaacauguucugaucuuuaguagguauacaaucaaaguugaccauauuaacuuauaagaaaaauacuauuuauaucacaugguucuuuuguugguuuugguggcucuuuuuugguuaugucuuucuuuccagucacauacacacuuucccagcaacaaaaacaagagccaguacuacccccauagcuccacugccacaaguguuccaacuucagcugagcacauccccuccucagguucuucagcccaccaccuucucaaguauguugucacuagaagcuaugaaaugcccaggcccuccugcaaaucccucaucaggccagucauacugucuucuugccauugauaucuguccucuucagaguucaccugucucagcuauuuagagaucaauaaacaaccucacccucucugaugccuccuggcagagaaagaacaaauuaauucucaugauguacuucaaacauccaaacgucucuuccccaagcauuugaauuucuuuucauuuuacauugauguuuacaaaaacgcagggcccaucucauucucuccugcuuaucauucuaaggaauuucugacuaggcaaggcuugggaacuuggcuccccauguaacuauauuggcaauaaacuagaguuauuuucuuauaauuguuuauauaacccgcuguuuugccauccacagaagugauggugguggggcgauuuuguaccugagagcaacuuggaccucucauugggacuguagccauuaaggaguucuccuuaaguuccccaugcucucuggaucaccuuugucuuaagugagaauuugauaggaaaucugagagcaucuauugaaaacugcuuugccaggggacucuuucagccuucagacuaggaaggcagcaguauuuagcaccccaguucuucaagauagcugcauugaagaacauauaccagaucacacagcacaaaggaagcagagaaauacccuuccucugcagagcagagugaaaguaguccuugcugucccuuuaccaccaugccagugaagucuguucccacuuugucaacucugucugccuaugugggcacagacaguugaggaaggcucuccuguugcaauagcccggcacccuguccaugugcuugggaugugggaacugagcuguguacuuugggaagcaagggcauuauuaugaaaugagucacuguauuuuucuuacuagaguuucucauaagaaaucuuaaaacucuuguagccucagauuugaccuccugcuggcuguggagccagagccuuucugaagguuuuaccuuuguuggcucuuuucacguuuuccuuagcagcauaaaauaucaagucagauuuuacuguacuuggagguacuccacaaaauuggcgugucuccucuccucccucccuccccccccucucucucccccucucucucuccucccccccccucucauaccacccccuucccaaacauaagucuccuguguagagacugcccuuuuucaguuguuuggagcacacugaaauuacuuacuagagucuuugauuucuuuauugaaguuauguaaauaacuguggaccucuguauauaucugggacauuucagggucauugcaaagcuacuguuugauuguguguugguuacaagccucuccuagucucuggagaccaugguucccauucaaucugaccauuacauugaacagaauguucugggugcuggcucuguaccagggucucuggugaguuucagugacacaaaaauaagaaaauacugcugcccucuagcugcuuauaguccgggagauugacaccacuauugauuguccuaguugccuaaaaucagucauagaguagaagcugugaauuuagagacuaaagcccagaauuuagauuuccacuccuuguuuuaaaacuuuaaugugucaaagccuaagauccaauuagaaauuagaaaaugacacauaguguuagugcugccuaaaagcagauucauacccuaagauuuuuggggauuuccaucuucuccugcaucugaguuguggcugagcuaugaaaauagugucaggcuugcgagugacacacacacgcauacauauacacacacgcauaugggcacuagggcaagguccacucuguaacacagacuauauagaaggauugcuaagaaguccuggaaaucaacaacauuuaaacauuaaguuuaauacaucuccuaagccagguuauuguuuacaacaaacaaacuaacuuucucauuugugaauauaauauugacauaaaaauuaguaucaagcaauaaacuacuguagguugaauuauauuuagcauaugucuuauucuccucagcugugcaugguccaaccucugcuggccuuaugagagggugucacauuaucucaaaaagcuuuucucacauggaauuucugucaagaaaaaaaaaggauaaaaauacacuaaauaagaauuuuaaugugauuuuuacaugaaguaguuuuauuuaauauaacaacaguccuguagaaucuagucauuuuauuuuaggggaaauaaacaacauuuuaagccuuauguuuuuuaaaauggaagaagcacaaauuaaaaaaaaaaaaaaacagaagaaauggacuacauaaaaauuugaguguauuaacuaacuucuaugcccugugaggggcuaaguaaucuaugacguuuccaaguuuuguaugaaguaucagacuauaggaagccauucuugucucuguuuaugcuuaugguucaucguaaauuacauggaacugucaagacauuuccauaacacuugggaauggacuugaguuuggaagaaaggcucuuuacuaguucccauuuucuuauaguucaaacuagcuuauuccuuagcagguaguuaucaaaauccuggaaguucauuacauccaaagaugaaauacaaauaugcacaaggaauuugaaaauuaccuuugacucccagcccaaaauaauuguuacuaaccuaaucuuuauuauuaguuuagccuuaauaacugaggucaaugaauauuuauuuuagcuagggcccuguuuauuauauuaguuuauuucugcuuuccuauugacauucuauugaugauauucuuucuacuuacuauauaaaauauucuuaucaaguagcagaggacugccugucuggccucaguaggagaagaugcauugaauccuuuagagacuugaggucuuagggagugugggagcauccuauccacaacagggaggggagaaggaacaggaugaggggcugagggagggggacgggaagaggggcaagggcuggauaaaagaaaagaacaacaggcaaacaaacaagaguaauucuuagugagcuuaucauuugucuuucaauuauaugucauugauaugaggcagaagucugugucuuuuccauaaugauucuuuuucuuuuuuuaaauuaaacuaauaaaauugauuuuaaaauauacaacucaguauugacuuuuuuguuguuguuguuuugguuuuugguuuuuuguuuuguuuuguuuuguuuuuucaagacaggguuucucuguguagcccuggcuguccuagaacucacucuguagaccaggcuggccucaaacucagagauccaccugccucugccucccaagugcugggauuaaaggugugcaccaccacgcccggccaguauugacauuuuuaagucaucaaaauaauuuauaauaguuaaaugccucuuaaauauacaugauaucuucugaagcuaaaaguaauaugcacucaaugaguuuuuuuaaaucuauuugaaacauuaaauaugauagaagaaaaaaaccucuaugaaguccucuaugaaaggaaauugugacaaguucuugauuaggcagaaacuguuccaucuccaagggaaaauacucaguauaacuguggcuucauagaacaaauuagguaauguuccuucuguuucuauuuuguggaauaguuugaagaguauugguauuagcucuucuuugaaggucugauagaauucuucacuagacccaucuaucugauccugucuuuuuuguuugcuuuggggggggggguuuaauggcugcuucuauuucuuuagggauuauaggauuguuuagaugguuuaucugauacuaauuuaacuuagauauuugguaucugucuagaaaauuguucauuucauccagauuuuccuguuuaguugaauauaggcuuuuguaguaggaucugauguuuuuuuuuuuuaaacauccucaguuucuguuguuauaucucccuuuuuacuucugauuauguuaauuuggauauugucucugugcccucugguuaguaaggcuaaggguuuaucuaucuuguugaaucuucucaaagaaccagcuccugucuuuguugauauauaguucuuuuuguuucuacgugguugauuucagcccugaguuugauuauuuccugcugucuacuccuuuuguguguauuugcuucuuuuuguucuagagcuuucauguguacugucaagcugcuaguguaugcucucuacaguuucuuuuuggagacccucagagcuuugacuuuuccucuuaguacugcuuucauucugucccauaaguuuggguauguugugccuucauuuucauaaaauucuaaaaagucuauaauuucuuuauuucuuccuugaccaaguuauuauugaguagggcauuguucagcuuccauguguaugugggcuuucuguuguuuuuguuguuacugaagaccagccuuaguauaugaugaucugauaggaagcauaggauuaucucaauauuuuuguaucuguugaggccuguuuugugaccaauuauauggucaauuuuggagaagguacuaugaggugcugagaagagguauauucuuuugauuuaggaugaaauguucuauagauaccuguuaaauccauuugguccauaauuaccugaguuucaaugugucuguuuaguuuguuuccaugauuuguucauugaugagaguaggguguugaagucucccacuguuauuguaugagguauaauauguucuuugagcuuuaguaaauuauguuuguguggcuaucuucuuuugggcuuguugaaagaaaaucacuuucuugcuuuuucuaguauauaguuucucuccuuguguuggaguuuuucaucuauuauccuuuguaggucuggauuuguggaaagauauuguguaaauuugguuuuacacaaauuuacacaacaucauggaauaucuugguuucuccaucuaugguaauugagaguuuugcuggguauagaagccugggcuggcauuuguguucucuuagggucuguaugacaucugccuaggaucuucuagcuuucacagucucuggugagaagucugguauaauugugauaggucugccuuuauauguuacuuuaccuuuuucccuuacugcuuuuaguauucuuucuuuguuuuguguauuugguauuuugacuauuaugugacaggaggaauuucuucucuaguccaaccuguuuggaguucugugggcuuuuuguauguuugugagcaucucuuucuuuagguuaaggaacuuuucuucuauaauuuuguugaagauauuuacuggcccuuuaaguuaggaaucuuuacucuuuucuuuaccuauuacucuuagguuuagucuucucauuguguccuggauuucuuggauguuuuggauuaggagcucuuugcauuuuguauuuucuuugacuauugugucaguguuuucuaugguaucuucuccaccugagacucucucuucuaucuuuuguauucuguuggugauacuugcaucuaugacuccugaucucuuuccuagguuuucuaucuaggguuuucucccuuugugauuuauuuauuguuucuauuuccauuuuuagauccuggaugguuuuguuccauucuaucaccuguuugguuuuuuuccuguaauucuuuaaggguuuuauuuuauuuauuuauuuauuuauuuauuuauuuauuuauuuauuuauuuauuuugguuucuucuuuuaccuguguucucuuguaguucuuuaaggcaguaauuuauguccuucuuaaaguccucuaucaucaucaugagauguguuuugaaaucagucuugcuuuuccuguguguugggguauccaguacuugcuguggugggaaaacuggguucugaugaugccaaguagccucguuuuuuguugcguauguucuuguccuugccucuagacaucuuguuaucucugcuguuagcgguuuugcugucucugauuuuggcuugugucuccuccaagccuggggucaguauucuugggagaccacuucucuccaggaggaauuuggguuuggagagcugugacacagggucagcuccaggguacagacggaaacuggaaggauucuaucccaggcuauuccuugcuucccguguccuaauggcucuaggagggucucucuugggccaggaauuugagcagaaguagucgucuuacuuguguucaccgacaugucugcacucccgggaggccagcuuucuugucaguguuugguauggagaaauguugcacagggucagcuuugggcacagacagaaacuggaaggauccugucccaggcugcuugguuucuguguucuaaguguucuaggugggucucucugagcagaagugcuggccucacaggcuuguccacacuccugggagaccagaucucuuccagccauauuuggguauggagcgcuguggcacaggaucaacucugggugcuuugacuuccauaaugauuuuuaccaugaaaaauauugauguauuuuuuauauaaguauuuuuauacaauuuauuauuuugagggguggggguccuuuuuauucuguauguugaccagaaucaugcuaauuauguuccuuagguuuaacggaaaucaacaauuucuuacuucaccaucuagaucucauagcaauccccucuagggaccaguuuucccuuuugccuccuauaaugaaauauucagugaugucacuaagacauugguguucuccuaugaaaauaaacugucaucugcacaggauagauccuuacuacagcauugugucaguagaaggaacacugaaacauccugucagaagacaagauuuaagcgcuaaguugaauggaucucuuaagucaggcuguuguuuaaugcuaaagcauucucacaguguucgguacugcagaggcugacugccaguuccuucuccaguuagcuggaguccagugucaggaucagcacauggucaacagauagacagggacagauugauggagugcagacugucagacugucuccuuuagagggacccuuucccgaagcaccccucccuaccucccuuaaaaggcuuuugaugaaaacucuggugauaaggaugaacaugguuuuuguugguucauuuuucuagacacugacacagaaaauuaggaaauauauuucucagcuuagaucauuuuuaaagauuaaauauuagauauucauauaauaaucugaggucuuauucuuucuuaacaaugaaagccucccaaauuuuaaacaguaguauugcaaaugagauauguuguauuucaucaccugaagguaaccugcccacuagugaauuaaaagacucuaaaauuaauaauuaacuaggguaauagaaaaugacauaucuggcccucuaauccuucuuuugcauaauguugcuucuauguucagagacaugaaauuuguccucagugaccaauuauacuacagauuaauuaggaaaagcauaguguggaauagaacagaagaaagaguauuggaguuaauaugaagaccuagccuugaccacuguauccucccaucacucacuagcagaccucagacacagcauuuggcuuuuggaaaccagccucugacuugauccacagagguaaaugugauaugcuauaauacaagcccugcuaagucuuccuaccagucaagugaaauaauaaauauuaauguggcuuauaaaugcugaagcacuuguguguacuaauuaucaccaucauuuccuuuucccucagaaaagaguucauauaaaugcugcacugcucgauuaaugaaugaucguaugucuucuucguggucuagaauugagaguaauacuugguaauuccaucugcacauaacauucucccaagaaguuagguccuuguuuuugugugcuucugcuuaucucagcuguauuuugcaacuacacaaacugcaaaaggcuaagugauaaguccccacguagucagcugguccuguggcacgcuacugaccaguugcagagacuacccagcuaagcaccuaggaauuacagcaacugucaguagacuccugcugugaugugacucuggaggguaaagccagucauuucucugaagucuuaggacuugggagauagcagacuuuucuaggccuaaauuucuaggagucuauguaccacagaacacccgcaaugacagcauaaaguccaaugugugaaugaggcuguguuuggaaaaugcauuaauaaaucgaugauuuagaauccacacucauuuucccaaggaaacaaugucaugauagggaugagguuuccagacaaguucaaaaaagcuguuccuaucaggagauacgagucuuggaaagaggggcccugauugucugugcucaaggaaaauagcaagagcuauuucuuccauaacccuaggcggagggccagcucuagaaagaaauuugaaaugagaugaccgugaugucucuuucugcccuuuugugcuuucucacuaauauccaggcuucuuuaggcugccuuuuagcuagcccuacuaccuguggguguggaacauaucauaucuaccacucuccucucccuuucuguccaaggucuuaagcucagccacaugagaagucacagcagccugcaucucgaaugaaggguucuagaggaggugcuuuucaacaaggggaccauggagacaggccaaguuucccuaagguguauuuuaauaguuaucuaaucaaauuuaagugaauuucauacaauucuaauaguggucaauaggucccugugucagcuacagacccaaaugaauguauucuuuaaaauaccgucuuuugucauacuugucugcaccagagagucaacagcagccucagguuggucaagauuuauuuuuagguucucaaggggaggugaguguaaacuggaaaaucccugugaagugcauacuuccuucacgauaacuuccuugauuuuucacagauacaaccuuuagagcuacauucuuugcagcaacucacagguauuucccuagauuuguauacaacagcuucuuggucccacuucaaagggaagaauuucuuuuucuuuguugagacaggaucucauguauccugggcaggccucaagcucacuguauagcagagggugaucuugaucucccagcccugcugcuuccuucuccucaggugcuggguuucucauguguacccccauacccagauuguguagugcuggggcacaaagcuagggcuucaugaguucuuaggaagcacaugccuaaaaugagcuacauauucagcccuacagaaagaaaauguuauuuuaaaggaaaacauucauaguauuugugucuaugggucuaguaccguccacaagccugguucucuguccccuuaagaucuacccuuugacugaaauggaagagggaaagaccuagaggagagacuucacagaaccuuugagguggagaaggacauggcugccuucuccacuuaacagcugcugaucccugucccuccuccuucgccuaaaguaacacaacacacaucuacuuacauuguccuuaggaaaauggcaucagucuuguggcagucgucagaugccaccuccuuuucuguuuuuguuuuucccuuugcuuccauuccuuugauguuauacugauauuauaccgacuauaucuuuccuuuuguuaugauccuguuccaucuauuucccccuuuuauuuuuuaacuuauuacuagauaagaaaguauuagaaaugaacuuuggagggugcuuccuccucacgcuagaauguaugugugacacagccacuccacacuguggucugagaugguguauucuugugugcgagccucaauucagcugcuucucucuaaccacuucagccuuccauacugugucacacuucagaacaucauuguaccugaaaaucaguggcacugcacaaaaguaauagauacguuaauguuuucagcuuuauacuuuaauauacuuuucccuaaauaaacagauaugauguauuaaacuuuaugcagcucuuauuguuuauagaaaaugucucugacagagugcagggaccugguuguacaauaacucauaaaguacaccaucuugagaagcaauucugugacucuugaaccuuuuccuuuuuaacagacaggcagggcaacugcaaauaucaaaaggguuggggggaugaacauuuuacugaugucccugacaacuccaaacuuuagguacagcuugaucagagacagaguauuccaaaaacucaguuucucaucacuuuuaguucugccagccuucuuuauggcucuauucucugccuguauaugaugguugauccuggcaucucuaggucuuuccuucccagggggaaaaugaacagaccucuacccaagacagcugcgccgacuaguuuuauaucaacuugacacaagcuggagucauuuuagaagaggaaaccucaaagagaaaaugcuaccagccaguuggcccguggaaaggcuguggugcauuuucuuaacugaugaucagugugguacagcccacguugcuccgggcagugccacaucuuggcuggugguccugaguggcaugagaaagcugggugaggaagccaugaggagcacaucaguaagcagcauuccccgcuggcuucuccagcuccugcucugacuucuaucacagaccauuggcagugauacagaaauuuaagaugaacuaaacccuuuccuccccaggcugcuguggucaggauguuuuagugaagcaacagaaacccugagacaacaaccauggcucuuuuuagaaaucagguaaaggaauugaagcucaacaaagacaaauacauuuuccaaaucucuuaccuagauggugacuagaagggacuguugcaaagaacuuuugauucagaguugccuaucuacugcuccaucccacaaugacagcaaaugauguguaggccacucugcagagaagaaaaaggcagcccuauuuauaggauguugcgaaaagaacuuugcggauucacuuuaugaauuucuuucgguauagaaagcaucuuuuccuuuucauaaacuguuugauauguggagucaucagggcuuauuuguuuguuauaagcaauaaugucaagaaaaauagugucaacacuuuuuaguuuccaaaguaugcuuucuacaccucuucauacucaaaagcaaaacugagagcaggccauugggguuguaaaacuggcccugggccaaggcagugcugagugugaguccuugggcuccaccaucagucagcuuugugcccccugccauucucuuggcagaugaacucuagacagaucaucuuagcagaucaugagaagugaggaucaguagcuuuuugacucugccucauauuauagcacuuggugaauuaccuccuuguaaauauaguugagcuauuauuuuaacuuggagugaacaaaacagaaugagaagacaccuucuaugagacacugaauucaauucucaagagauggugaucauggugauaaaaacauuacuauauuaaauacuccuuuggaagggaaaauuguacuguccucgugacaaauuuuaaaaucuuauaaacagcacuuugcugaucuagucuuuauacaggguuuagccaugccuaugagagauaccaagaaucccacucagcaaggaguaaacuauaugugaucaaugguuugaccugaccccugacgucucacccuaauuccaaccucaacuaauauugaagucccaauguuucuaaggaagagcuagagaaucagcuacagaacguucccagaaggggcugcauuugucaucuagucacuggcagugccacaucaugcucuuugcucauguugaguuaguccugaccaaccacaccuaaccccgggcagugguaacaauacuaaaaccugcuucacuagacuauagugggaguaacauuagcaugugccuccauuuuucugccuuuccuuagugagaaaugcucccaaagcauuguuuagagcugugcuggccaaugugguuuccauugauugcauucugcuguaagcauuugaaaggcaagucgaaaauuauacacucuguaugaagucuguauguaugucuggcugccauaaacccaguauauaaauauggcucaauauuuuuauauugauuacauguuauaauauuuuauaaagguuguuaaauaauacauauugaaauuuaaauucaccauuuuccuuuuacuucuucaauggacuauagaaaguaucagguuacuuguccagcucauaauucuguuuguacuagagacuucugagucuauuaucaucucgacuucccuccaccuaugguaggauuguaguugcuuaagucucagcuuuuacccugaacagcuacuuccuguccagguagcguucgcuuuugcuguggucuaagggccugcguccuucucuuagcagcacacccauugauguuucauuucucuucucuucuucccuuugaggacacuaugguucucuuuccuuaccagugguuccuuugucuccuuuacugcaucuucagcaucuuuucauauaccuuuuuuaaaaaauauuuuuauuagauauuuucuuuauuuacauuucuaauguaauccccuuuccuaguuuccccuccgaaaaucaccuaucuccuccccacucccccugcucacaaacccacccacucccauucccaguccuggcauuccccuauacuggggcaaagaaccuucauaggaccuagggccucuucucccauugaugaccaacuaggcaauccucugguacauaugcagcuagagccacaaguuccaccauguguuuuuuuugaugggugguuuaguuccaaggagcucugggggguacugguuaguucauauugauguuccuccuauggggcuucagacuccuucagcuccuuggguacuuucucuagcuccuucauuggugaccuugugcuccauccaauggaugaccgugagcauccacuucuguauuugccaggcacuggcagagccucccaggagacagcuauaucaggcuccugucagcaggcucuuguuggcaucugccauaguguuuggguuuggugguuguuuaugggaugaauccccacguggggcagugucuggauggccguuccuucugucucugcucugaacuuuguaccuuuucuauccaaacucacuccccuguagaucucuucugaguggcuuuggacaccaucugggaggauuuccucaguuugcauuggcagcuaaagaacagaacuguuuucuguggaauuguaagcugagauauccaagaacaaggaccauuggcuuuucuguguagggagaaucugaucucugcuuccaaauugguacuucacugcucuaucaucugaaagagguggggaacacgucgucaugugaugaaagacagaagggccaguaugaacuuccucuguugaucucucuaagggaaccuaaugucacucaugagaacaaaacuucacaacucaaaucaucucuuaacauugacauuggcaauagaugaauuuggcgggggugguggagcaggggacaaaccauguuguauguuuguuuauuucuccuguugacagaagcuccaugaaacaaggccuuuucuuuuugguguauagcuuuuuacuaagggcuccaggcucugucugccagaguucagugaucauuauugaucauucuacuaugacuauuggaucagucugcuagauucagcucaguuaccaguaccauguguuuuuaaagcacuuccuuaauucugcuggguauaagaaucauuggggaucuugccuaaaauauaccuucccugacccuagccccucgggacacaaaugcagucgauucuggguggaaucuguaccauuucuuaacaagcucccaaggugguuuugcuggauuacaccagcacacuuugcaaagucuuggcugucucauuggaccagguuaaguucauuucuucuagugcuuucuuucuugaauuuuguuucauguauaucagcagagugugaaucaccugggaaccuaaauauagaucucuuagccccaccucagaccuugugaaucagaacuuccacgaaaugaauccuaggauucuuuucaaaaaaggggcgggggaggggccugccuuguugccucuucugcuagaguccacgcuggucuugcacacucccugaggaggagguccuaacucaggagcaagcagggguuuucuuugccauuuuaaucuccuuuucucauuuaccccacaauguucaaaauugcuguucagugagucaggucagcaugggaugaaugcugagagguuccucacaguuuccaggugcucuguuagcuugaauauugaccaguaauucaaggacauuucaaaccuguguguaacaagcauggccuagcugucgaccuugcuuugguggggaugcccuccuucauccuuucaguucaggaacugaagguuccccagauccgagcagacaacauguccuuccuuguugcacuuucacacuuugccugcucagccuuccuguggaucuguguagugggacauacuugggcugccuucaaccuugaaguguauucacuggucuccggagagauaguaagaagccugaccccuuugccuaagaccuaccuggacugcauaaguuacugacagcaggguacuuucccagguuagacuuguggaugcaguagcuuguccugcuucuguuguuauacuugcucagauagaaaacuguaaaugcagaaccccaaauuguaacaaaaagaagugguaggaauugguuaagugguuaggaauagaguguaccaagaaaugauauucacagaauuuguccuuggcccagaugguugugaaguucccuccugguuagucuacucccuaaguaccugaccuauguaguaugccuucucugaacuugaaugaguuaaacacuugcuagccucuuugaauaugguagauuugucuguauuccuugcagaagucagcucauugcucaggcaaaaucuaaagaguagugguaucagcccuacaugcucuagcagcaguucagcuggacuagcgugcuccaucugcuugcagcuugucuauggauaagagucagauuucauuuuuauuccagauuagaaaugcaguaaucaggagaaaaucucuuugggaaauccuauucccagaugauggcugcugcuuuaggauagugagucaaggggacagcacuagagaccacaagcugugauuuaguaacaaagggaugugaacugacccuagaaauguauggacaagagaggucuaaugagucuugacaguucaaggacugaggcaggagaauaaucacuuuuuucccugcccacccagucuucauacaaauguaaauaugucuccuucaucaaagugccaaaugugguauggauuuauaagcuauagaccagccuugcugaguguauguauacucaggagugugucuauguuugugugugugugcucucucucucucucucucucucucucucucucucucucucucucucucucucucucugccuuccccuuucuuacuccaucuugccuccuuccuuuccccucuccuccccuuuucucccccacucucauuuuugaagucacagguuuuauacuucugaacuggacacccccccaaccccauccccugucacuuuuauuccaaagucaccccugaccccguuguuggagggcuuuaagacaagaauagacugcuguauuucuuaaagagguuuuugaaguucccagaggaaauacauguacuuuuuagacauaacuaagucagcggcugaauccacacagauugagauuugaagagccugucgcuaucgcuguaccacacuugauacaguggaugcagaaccuauuguuguuauuuaugacccugucugccuuccauugugggcuucuuccagccuuggggaauuuacaucauuccuaauagcaaaaggcuuucugguucccacagaguuguucaaagccugacucaugcuccuuauguuaauuguucagcucugaaaauacagcacuuacaggguguggcuaugaggggaaaucaacuguauuuacagggcaugcaggacauguuuagaaauguuucacacauaaaucuccaucgcuccgaaucucucagccuccccucuuuugccuccugccucugacuugacuugaaguauucuuuuuccaaaaauuaauauuaggaaacaacaaacuaaaaaaugaccuauuacaaugcaguauaauccaauaaaggcaguuauacuuuguucacugaccauuaaaaccaauuuagguuacaagugggcaugccuuugaaagguccuagcccaggucugaagccacagucauagcugagaguugauggacucuccuaaauuguauugugaaguccaauuagagcaaggcuuuugagauacacuggaauaauacaacugacugccauccuccagaaucccaggcacuaucacuugauccccuaaggaagcccacuucaaacaaagaccuaguaauagguaccaaacugugccucaugggucacaaccuuuuauagggauuugauguggaagaaugcuuaguauccuagacaauacgagcugauaacaccuuaucugaacuaucagcuucuaaccuaagggaagaaauuccaaaaacauuacauggcucagcucuggcaaagguuggcagacuuuuaaauuuuguaauuaccucuuuaugaaacuucaugguuauguuuuuuuaaaggcagauaaucuguguauaaacauagcugugacuacuauaaaaaggcagacacccuuaaguucuuuuguuguuguuguuguuguuuucauuuguuuguuuggaagauaaccaauauugaaaaccuccauuuuuuaaaaauuccaauauuaaaagguauagguugauacuguuuuaagguuaacagaggcuauauugguaaguaagggaaauguggagaaaaucucaggauugucaggaugcuggcauugucuucucgagguaugcugccacuggcccagagacucugcccuuuggaguucaggggccacagaguuaccagauauuguucuagauggcuugggauucgcaguuucacauuaugguuuuguaugguacauauuagugcaugaauggaguagacaagaauacaaaagcaguugugacccacaacagcaacuacccaaccgaaagcaucgaaacagccaagaacagcagucucuuuuauuuaguauuuacaaaguaaagcuguccaucugagccuuccuagugaaacuguuuucucugguguugagcuaauagacuccuguuugaaccuuuguuaucuuuuggauuagacaaaaaaagcccuccauggagugucugauuauuuuccugagugugcagagaguucaccgucuccugguacaaagcucaagaggaacgcucugaaggaaauguaaguccagcauguuuccugugucucguuuucugacugccugggaggacaguuguaucacuagaagagugaucacuuaaugacaguguguauggaacccagucagaagccccucuguguuggcucugcccacagccauuuauuaacgcauguccuucccaccuuccuguugcucuugcuuucuggauagugggaauagacuccuugcuucacagguguguugcaagaagugauuaauuccaagcucuuugaagaugaaaagcaccuacuggugguguguuucacacagcucuugaggcaacugcagacagaccuaaaaacuccauuccuuuuguaagaugcuucuucugacuauaauguaauuaugacagcccucaggccccuuacaacaacauauuuaugguuuuuuuccacaaagcuuagccaaaguaaauauuccagcuucaaugcuugaauuuaguggcugaagaaguuucaugcuauuuguaaauguauuguugucaacucuuugccaaaauuaagggcuuaagucucucaguuucuugugaaguuccugucuugcccuggaaguuuguuuuauaguuaaguaaaguuugucuuacuuauuauguauccuguggaagaaaaagguuagaugagagaagaagagagagagagacacagacagacugacaggcagacagacagacagacauagauacauacauguauaguuagagacauacagaugaacagacagaugauagauaaagaagauacauacacuguuuguuagaguuauacuuuguuuaauguuaacugucugaauuuuuuuccaggacugaccaagucugauuaacugaggcuuauucccauaugguuggugaauaagccagcaccugcugcauaauaccuuaaaguaucacaagggaauuuucagauuaguauuuacuuacaaauagaaauuguaugugugcauauuuuugcauaugcaugaguaugcacaaacauacuguguuuuggauguaucuaagcauuuucucccacaaaaagucaguauaucaaccccaggcauuauuugccuuuaauaucuaaagauggauaucuauuugcuuuaguuaaaaauuauucauugugauuccauugaugaaccaauaaugaaaauucagaacauaucauaguuuaguggaaaauguagauguuauuacuuaauacaaucaguauucaccauacacuuuggggauuuccuagauaugccaggguguugagaagccagcugguacaugccuuguucuuaggaguaacaaccagcgaguggggguuuggaggaucccaugccauugcaaaccucauauacucuacaaucuuuauugucuguuuuagugugagaagaacuaaaucaaaaggcacugaugugagcaaaccacagcccagcggggaccucgugggaagaucuagugacucaguaauuacugugguaccauggaggagggaugccucagccauucuccugucagaaucugugggucaagcacaagaugacauaagagcagccaagagccaccaggagcuuccuguucaaaagcuggaaaauguuucucagacucagccaggagacacucgcagccagcagcaacuucauccuggggagugguugaagacggggcuucuaagcaggagcccugcguauaacuaugagucagcaucaccagguccaaagcaaagucugagagcagccaagacacagcagaaacacaggaauuguggcucuguggaagacugugaccaccgcaggagaguuucucuuggaaaugaaggauuagucccggaggacgcggauagggaaaggagcacagcugucaggguuuuaccagccuuagaguugucagauccuggguugcuuuugaaacaagauuuggcaaaagccaaggcuaaggaagagcuacaugcuuuggaaaaucucuccuccagacaucuugugacaaacaacccggggcaggcacagcagagcgacucagcugcaauuacugaacaauuagcuacagaucagggcggccccagcaagaaaagaaagaaacuacaaaguuacaacagaggauguaguggcaagaaaaacugaggauacaguaccugggguauuggaaggaauuaggacaauuacuuuaaauaaauaaauuuaggagcuggaguuaagucucagcuuuuaagagcacuuagugcucuugcagaggaaccaaguuuagguuccaagcaccuagaaggugacuuacaaccaugaugaacuccagauccagaagacccaacacacucuuugaccuccaugggcaccaggcaugcgcaugguaugcauauauaccaggcaaaacacacauacauguaaaucuuuuuguaaaauuguuuauguuggaauuggccuucauggucaccuccuggaggcuguuuuccuaacaggcuuguuacuuuuucaucauuuuagaacugucuccagaaaauacuauauugacaaagagccauccacuggucaaggaguaaacuauguaucuaggaccccaaggagaaaucaguaaugguggccuucucaccccaucacuaugaagaccuccugauuggggggggggggggggcagagacagugccagguacuucuggccacaucuugggcugcaguccucugacuucucaaacugaguaccugacaguaagaauaagucagcagucucagcaugugauucugugaggaaugcagguauuugggucucagacauauggaaugaagaacugugauucugaaauggacuaaaguugaaaacagcucccuagaacuuacauccuacagccuaguuaccauggcuuccaucagcuggcgacacauguggaaauguacacccccgugcuuccuucagacuuagauuuggggugugagucacuuuguucccagguucauauacuauaggauggacagaaugccuaggucucucuuauaucuggaguuaccagaaauguaugcguaauucaucccagucugagaugaagacauggaagagguguguccuguguagcacaaguuugacccuguccuuguccacaccccccauauucugguugcaguuaagacagaccagaauccaaagcuagggcaguggccguuccaguucccaauuuggaaaauuucccagggcauuuaaaugaccucuucaguuguguagucaguccucaagaaagacaggaagccagagcuaucagccuggacgcuucaucugcucaccccaaccucaaaggaccagaaacugcuugcuggugucccucuccuuucccaccuagcuuuuuuuguuuucuugagagcugauuccaagauguugaguccucaauguaagcaugaguagucacccuuguacagagcuaagauauucugaccuggaauagacgggauuugaauuguuuaauggcuaaggucauauucuguacuuaauuguacuuauacgaagaauaugcuuucaagaaguguuuugcuuuucaaaucuguuccauuauauuauaggaaauagugauuauugugaccaauaauuuauaaaaaaaaaaaaguauguuacgguuguagauagauguggcuuuguagcagccuucaugcacaauggauuuuaacaggauuagcagagcucugggcuuccauacucugccauauguuuaaggaauuuugcccuuaaucauuuuccuucagcauguuugaaacaccucuccauguccuguuucuugaaugauuuuacaauuccuugaauauaugcauaaaggggcaaauuaauccccaauguuuuguuacuuaucaggugggacaugaaguauugucuacuguugggaaugguaugaguuuuuauauucuuaauuacuguaacaauuuagcauuugaaagucugagacagugucaggauugauagucaaaaccaaguucuucaucaaaaccaaguucuucaacccuuucauccuccaaauuaaauguauauuuaggucccugugauucugauucugagaggaagcguucacccaauccguggauaacugaacucaagacuccgcaguaccugcgaugcuaagccccuccauguacuaucaaaugacauuucaauagaugaaagcuagugagguccuuuuguauuuucuuucuuucucccuccucccccaauuuaaaaacauggaaaggcuggccugguggcacaugccuuuaauccuagcacuugggaggcagaggcagguagaucucugagccagacuggucuacauaauaaguuagugaacagacaaaacuacauagugagaccuugucucagaacaaccaaacagaucaguaugggaaucaucugugauuuuucuugcauacgugcuuuucuuugccacuggagguuaacucaccaagacaugcauaugacuugugcaguguaaagaagcacuuggugcuggaauaguauggaaauguauuuaauuuuuuaaaaaacaagacucaugagucuugaauacuuggugaaguugugcaugugcagugaucacuaagacaccaauaagaaagaaaaagacacaaaaagucucuguauuuugauguuugaagaauccaguucaucucuggauggaccuucucaaaguggaucuuaguggugaugauggggucucaguauaauuguuuuauguuugaugucauguuuugauuucagcugaaauuguaccucucauuggccuuugacuucagaaaaagccccgacuaggacggacacauagggaaggaagcaucuaugcccaagagaaugaccuaggaucagugucagccuucguaguuuuuuaagcuccuuggcaggucguacuguaauauuuccacaaaacaguagugaacggcccucugaauaauaagcaacuuuucaagagccaaaacacgcacugugcagcaugcugggacuagaauauggaaauuguuuuaauuucuucuuuucucuuaugaggaaaucacugcacuugguuugucaagacaagacaguucauuccccuguauugaaacagugaugaauugaaacauguuggagcaaguuuuuaaagaaaaucaaaauuaaacugguuuuucuuaaauagcuuaaagcguuccacaguacacaauaaaugaagcauuguaaaaugaacuuaaugcaaguaaucacuuaagagagaaguuuaagcagauagauauauauauacauacacauauacaucaucagucuugcaguuccaggcuauaauuaauucucagaaacuugcugaauucccucuaauuuuguuucuauauauacuuaccaagacagggagcaaaugugugucaauauguagcaugacaaagagaacuugggugaaguuuucuacuuguggagacccauuuggacugggcuugaaauaucucuggguaaaucucaucuguggcaguguccccacacuacaguaaggcuuccauaaccauucuaagcaaagacugcgcuuuuguuuauugaaguaaaaucaguaaaagugugcaguuggcuccccaaggcagcugaccggugcuaauaggugcuaauuugacagauucucagaaugaguuuccagauggaauuagacaguaccacaaucuccaggagagcccugguccuuucauucaaguaugcuuaauagacugaguguccacagaauaaaaacacuuuuguugugaaaauguaccuguuuuaugaauaaacauguggguuuugugaauuuaaguaa

SEQ ID NO: 1124 - RNA, 6788 nt, Mus musculus
aacaauaagcaaaauuaucuuucaauggcauaaucggagauacuggcuuaggucccgcaguuuguuuccaguuucuaaaacagaacgcacauguccaaccgugcuguuuguuucaccaucagccaacacuucaggaacaaaggcaccccacucuccuuguuuaagcuauacaaaaagaagcaggaaaauguuacaacgauuucucaggaaugcaaggccacccaggcccagaaacgauaaacuacuugugaucuaaguauaucgggaaaaaauuaaaaagguguggugggggucagaaaagagaacaaggcaucuaaaaggagcuuuugguaagugaacauuuuuaucagacgaaggagugaguuuuaaacacuggaacagcugugaguaacucugaagucucugugugucugcaaauaagaugguaugagcuuacuggguauuaaagggacccaguaagucacuacauuugacagugagcacuucacucauccuucuggcugaguagacacgaaucacauagcauauagcucaggaaugacagugagagcccagcaccuugggauucagacauggaagagacuuaacuuggaggauucagggaugucaaagaagcacuucuuuucaucuucauucauuuguaccuaacuugggaugcuguuaacucaaaaguuauuaucuucuauaucuuguagcuugauuuucuucaaagaagugcucuaacccagaauagaaagcuccuuagagcuuugcuaaagugacauagguugaggagugagguugacagggauugugaaaucagaucaauugcuuuuacaagaguucccucgccucuugguacguggaugcgggauugaugaugggaagaagucuacugugugauaaagugagcuacacauagggcaagugucuguacgugaaguuaacaggcagagaaaacuagaacggaauagacagaccuuccguuccgcuuuucccaguugauaauucuacuuuucagauuuuacagguuucuuagucuagagagacuguauuuucuuuuucuaaaaacaauuugauuuuuuuaaguaauuaacuuauguagagucaaccuucauaguauagagaaaacaaugcauugugaaugugcagagcugagauuucuaacucaacucugcucucuguagcauuccaccuugguuuccaaauaucaagacuaauaagacaagcaggguuuguaucuuuugaacuuuucuuguauaugugugugcaugcauaaacaugagugugucuguaaugcaugcauguaugugcaugcuuugccuguguauaggaggggcacaggcacauaaguugccaucuaucugagaguuuaagguuguuguuaggaaacuuucucaaucacucuauucauugaacuagcagcagucuagcaaacccaaagacagccaacaggacuaguuuugcuagccagcuuugccugugaguucucugucucgaucucccaaagcugcaacgacagcugggcugccaccccuauccagcauuugugggugaucuagggaaucugaacuccagucuucaaucuagcaaggcagacacucaaacuccugggcucuauccuagacagacaaaggguuuaaauauuuaugugucagaaagagcuauuguggagauuaagaucaaaauguuuagggagaauccaagaaccuauaguugauaacuauguuuuuaugguugcuucugugguauuaauugaaaaaaaaguuagcuuuugaacuuguuuuaauuauuuucuuuuuaauuuuaaguguauguguguuuugccugcuuuuauguuuguauaccacaugcaugccuggucccuauggaggccagaaaauguuucauaucuccugaaacuggaguugcagauccuuguuagccaccaugugaguacugggaguugaacuugcaucgucuagaaaaccaacaaguacuccugacuccugagccaucuccccaacaccaaaugguguuuguuguuguuguuguuguuuaaguugcccgucuucgguacaauuucauuguugugauaauauauuauguccaaaggcaacuuaggcaaaaaaggauuuacuucauccuauaacucucagaacuuacucugucacugaagaaaguaagggugggaauauggggagagcaucugaagcagaauauagggagugcugaugccucuugguuugcucccuguggcuuauucagcacgccuucuuauacaacccagaacuaacugcucgggaaugguauuguccauagugaacuggguucuccaaaucgaucauuaaucaggacaauaccccacagaguuuccuguaggcuaacuuaauuagguagcuucucaaucaagauuaccucuugacugauguaucuggguacaucuagguuuguauugaauugacaaaaacaaaucagcccauuguccaagcuaguaaagauuagauaggaccuaaaugaauaaucuugggacaagaagggaaagaugcuuccccuugauucuaucucuuaucuauuucaaagggggaugcaucuggucucccuccauccagauucacccauuugcucaggcagacuuuauggagcccuuacucuccuagcccuuacagccccuuccucuucacaauaccaaauaaagauauccagacauguauuucaccuugcaguaagggucaguggugagauaacacagugugcuaaauccccuuacaguuggggaugauuggcugcuaauguucugucaagaacaugguucaauggugggcagugacacaaaaggacaccaacggccugaaggaaaauccauguggcaagagauaggacucuagaaacuugagguuguuucaccuaguuauggcccuuuuguucgaauuugacaacaaucuccucuuagauagguacauguacuuucauuucaaggucuaaggaagcaagaaagcgaauucuaaauacaucuugagauaugauuuuagcucugaagcaagggugauauagaagucucaugacugggagcuacacagacuucuggaaaauauugaauugugaccaagcaaauguuaaaguagggagauaaauuuagcuagcacuguguguguguguguguguguguguguguguguguguuugugugugugcuugugcaugcaugagugcuuuacauugguuagcaguuaaaaggcagauuccagcauaucagagacucaaucugaguuuguaaacagagucuaauccaccuggaugcuaauaggagguaaaccaccaacuuugauauacaggagacccugucagaauguuuuacugggacugccauugggugcuuaagguaaauauuuucucuaauacaggcaaggauucagaagcaguauauuaugacuaauucccuugacuugccuugcugggauggaaaauucugaaugaagacauaaaagcaaugagauugagcuaaucucuuuuuaccuaugaauacucauucacaccugucaacaugggccaguuacccaggaggcaaccuuggggaaagugccauggaaggauuauaucugaguugguauucccuaaucaucaggccaaggcccacacuccuaguuccuacugagcaaagcauucucuacugccuaaaaccuguauucucccacaugccuuagcaacaggucaagauuuacuaaacagacugugaauucccagcagacuugauuuagggcuccaaugcaaaugcaucacauguuccuauauaguucugcagguugcaggugaaagggcagacgaaaaucuuuggaagaagacaccuucagagcccaucuggacaucagcauuuccucucuucugcaaaguuggucucugguucccuagggaggauuuaaggaagagaaggcaugagcuuuagagaguucauguuugguagggauguucaugcacagggaaaagaaaaauaaucccaaugaaaggaaaaagaaaucagguaaagcucugaagaaaagaauagaaacaauggaagauccccagcaacacaggacagaguggauucgaggugaaauucaagacaccugauggcaaccauuccucagacucaugcucuucacacuaaaauaaaacucuuuccauaccauagaauuacauaaauaaauuauaguuauuucauagaauaacugcuuccauuuuauuggcagcagaaauuauaaccgacaccugggagucuuuuuuuugacacuugggagucuuagugagcucuuugcuuauucauacugaugagucugggagaaaucaguuagaauauggucuuaauuuuggaagaauauuucuauugaacacuuuuauaaaaugaaaagugaaguuaagagugacauuuguuuccacucugcaguuauucuugcucuucauaccucugaauacgaacuaucagauacauacugucagauacagucuaauuuuugcuccagaaauaaagguugagcuucugugaaauaaaucaugacaaaaguauuuuagcuggcaccaaggaggguuaaguuaucaugguauacauuauuaaaagauuaggcgaaaagggaaaguaaauaaaggcuaaggagggaaaggggaaaggcagaggaagguggagccuuuuaacucuuaaagaucacagccuuuuguuauucuggaaccauuccuguaacuaugggucacacacaccuuuuuuaauucuucaucuaucaaggacauuuuuauguuuuaaaaggggguauaugaaucuuauauaaagcuuauaaccaaaaugagauaaagugacagaauuccagccaaaagccaaaccaccaacugcaagucuuuucaauugcaugagaaauaaaugucccauuguuuuuuaucuuuauuuuucgauagucagaaacuugagaagagcagccuaugucuaggagagcccugagaagucaggaggagaagguaaaggacuuagaggaggaauggguguggaguaauagaaggcaaagaugaguguacugugacauugaggccacugagcuggacuuuggauaccuacacuuaagaaagacaaaguaaagaguuggagcagcaaagggaccagcaauaggaaaauggaaaaugagggucuuaaggaugaauuucuacaucucaagucuucuugguacuaaccuucagucauagucaugugaucguguaggacucuguacuuuaaucuuaugaaugaugucuuuuagaucaucucacugaaguuuguuuucaacacauuguuuacguuucuuuggauucaaauaacuuauaacuggaaaucugaugauauggaagucaucugacucuucuuccugccaucuccaaagguaucacaccaucauauuuugaaaacaacaaucucugaagcuguguuauuguuaucugauauuucuaaaacuacuugacauuucuagauguuguaauugauuaaaaguuaaaacaaacggugauucuuugguuuuguacaucuugaaagcauuuguguuacagcuaaauacauacuauaucuuuaauauaugacacuauagugugaaugcacaagaaugguauuauuaucuuaguuuggguuucuacugcucugaugaaauaccaugaccaaaaaguaaguuggagagaaaaagguuuauuuggguuacacuuccauauuguuguugaacaucaaaggaagucaggagaggaauucaaacauagcagacaccugaaggcaggaguuguugcagaggccacgaggguagggggguuacuccuuacuggcuugccuuauaugucuugcccugccugcuguuauggaacccaggaccaccaacccagggauggcaccacccacaauggacuauaugcccucccuucaaucacuuuaggaaaauaccuuccaacuugaccuuauggagacguuucucaauugagauucccuccuuucagauaauucgagcuugugucaaguugacauaagaaaugcuagcacacuauaccauguuuuuuccaaacuacuuuuucugagaauuaugugcuaaugaaucguguccacauagcagacugucuguccuuuaauuauuagguugaaugaaacuaagaagugauuuccuuuuuauuucauuaccuuuuaggguauuuuuugguauaguuuuuuaauauguagucuauauuacccucaaaauuacaauccucuugcccaugacuauagaauuuuagauuuacagcuuugugccaccacacccaguucauucuuuucucuuuauauugagccuucuuuauccaaauuuuuacugagacuaucaugccuucuuggacuugucaacuaucauaucccauuaagauuggcaagaguuuuaucucaaugucugaacugcuuuuccccuggagcaauaauauauacacuacugguucucuuagucauagcugauguuguguaaaucuugcaagcauuuuaaacuauauaaauacuucuugucccgaaaauaaaaugaaagccaggaagcugucuuugcauacaaaauaauucaagacuaucugcuaaacucacauuucaggaucaggguuuuauauaggaccauugacaaccucuaaaauacucuauaaccaagagcuguuuccuuuagauacuaaaguccuauaaagucacuuauagccaugaaggaaguaagcaggcuguuguucucaaagaauaagaagaccuuaccgugugucuucaagauagaaauuuuaugagucccaagagauacaaacaacuccagaugugagaaacauugauuaaauccuuccugaagacuuggaaaugcccu

SEQ ID NO: 1125 - RNA, 50686 nt, Mus musculus
ugggagugcgcuccaugugaacucagacugggaucugagaagaguggugggaaacugugcggucgcccgucgggcucuccuugggauuugugaguagccccuauaguccggucccuuucuggccucauuguucucuucagagcugcuucucgagagagacagagaacgcagccgaguaacuugccccgaaaguuugugaggugggaagaugguucgggacgagcugaccuggagcucccaggccagaggguggguggacuugagggagaccgggaagcguuucaagugcuguccaguugcuuucgcuccucugaacaucccauguucgccgugggcuuccauuuccaacauucacacgcacugcaguugguugaggugguagcugugucguacagcuguuccagguguuguaguaucucucucucucucucucucucuauuagaauguaaaggguucugaaguaaagcaacacuguaauuccaguauugaggccgagagacagaagugauugcaguucaaggcuaggcuagccuguugugauggcguacagucugucgcaggagugaggggcguaaauacugucuuguuuggucagucagcuuuuauucauacagaaacuucugacuuuuuugcaaaguugaaaucuggagaaauccaaccaccagggacgcuuuacaaaggaacauuaggcauacaaacuucugugagcguuuuuguguguuuauagccuaucuaggccuuagucacuuugagaauaaaauguuauaaaaaagcgacauuugggacuggauagauugcucagugguuaagugcacuggcugcuggucuucaguggaccuagguuaaauuuccagcauccacuugauggcugacuauuguccagucaguaaaaccaguuccaggggcucagaagaccucuucaggcguccaugggcaggaggcacagaagugauaugcagacacacaugaauacuuaacacccauacacauggaaaaauuuauuaagaagaacgugacaauuguuaacuguaguuugagacuaauuugggucuugauagaaacuaggauuuauagaaauaacacuaagguaaaucugauuugauuuuuuuuuaaaugccccucauuaguuaagagacagcuuuguaaaaccaaaagcuuaugcaauuaugaaguaaacauuaacaaagagaaugaaacaagacuaugaaaacccaauuagaccagcugagauuucagaaucuuuuguuuuugucuuccugugucuguugcaucuguagaugauuacaucagcccacauacccaugcacgugugugcucauauguuuggaagggugcuuguauauggagccagaggugauggcuagugucuuccucaauugcucuccacuuuuuuuuuuuuuuuuaagcagaaccucucauuggaaccugaagcuccucaaguaagcuaaguuggaugauuagggagugaguccucuugucucugggauuacaggcauucaggguuuguuuguuuguuuguuuguuuguuuuauguguguguguucuggaguaucaaauccauguuguauuuguauuacaagcgcuucgcugauucagccuucuccccagcaucugucuuugguuucuugaaacaaucucacuagguaacccagacugaccaccaauucccuaugaaacuaucuaagaucuggccucauaauaagcaugauucugccuucagaaucuugguuuuacguguguggcucuaugcaccaagaauaaucuuuuaauugauggcaaguacaagcuagaacuauaaaaauucugagggcagucagcuacuaaacauugcccuccucaaaacccuagguuuauaaaaccuugguuuacaaguuuauuucaagugaucuguaagggaaggauuauauuuugcuaugccuuuauuuuuuauguuugacccagaauaguuuggguaggugaaauuaaauuuaaguugucuuaauguuguguauuuagagagagagugagaaugagaaugcauacauacacaaugaacaaaugugguuuuaaaaaauauuuuaauuauuaaccauucaucauuguaauauuuaucuauuuauuuauuuuuaguauuugguuucucuggauauuucuucauuaagacuuuaaaaaugucauccaaacaagaaauaauggaugaccagcgguucaggcggguuucaaaggaucccagauuuugggaaaugccagaaaaggaacgaaaagucaaaauugacaagagguuucgagccauguuccaugauaaaaaguuuaaauugaacuaugcuguugauaaaagaggucguccuaucagucacagcacuacagaagacuugaagcgcuucuaugaccuuucagacucugauucugaucucucugaugaagaaagcaaaauacucagucagaagaaagcgaagcagaaaaaaaaacagaccaaaaaagaagcaaagucaauugaaaagccgauugaagagaaaaaaaaagaaaccaagaaaacugaccaaaaggauucuauaaauaaacaugacuuaaauaauucugaaagaguucagaaaaugaaaaacucacagaaaccucagaagauagauucagaaauaagucccaagaaggauaaugaagaauuucuacaaaauaaaaaaaagaaaagggguaccacugaccuuaguguagaagcuuugcccaaaggaaagcuaaggaccaaagauuccaguaccucugaaauggugaaaucuucaacaaugaguucuucuaaggcaaagagagaaaagcaaucagguugguuggcaguacugauucucuuauauuacacuacuuuaagucaaguuuuuauuuuaaaauauaaaguuaugaaagaaaaguaugcaaugauuuucuccuguuuugauaccaaaagacaaacaugagaguugggugaacgauuuugguuuguggugagcaaugcugagagcugcuauauguuauuauauaggaagagauguguuuggagaaggaaaguagaguuggguacucauuaguucauucagcuacuaagugacaacugcuguaagggacagucaccucguuuaggguuauugcuagcuugucugaggccuuugugcaagguagaaaaacacauguccucugaacacacagacacagaauuuucucugggcuucauaauuuggugagaggauggcacuguugagugaagcagcacauugauuucucuugaguaagcacagcaucccagagcucaugacuugaagauuggaguuagauuugguuucagcuguucuuucccuuuugucgaugccuuuagguagauuacaacuugauaaacucugugacaacccugguccacuagaaauauuuagugauggguuuccuaguaguggcauuaaaacaucaaaauaaguagaugaaauaauuuuuuauaucaaguauauacaaauuucaucucuauguaauuaaugauaaacagauuuaugguuuugacuguuaacaaccauauuggaugacauagaucuaagguagaaaaagucaaaccucuacuauaaaauauuguuacaggaauuguuucauaaaugaaauugaaaaaguucagaaguagucacucaaauguaaucagagaaaaauuccuuuauugggauuagaagggggggauuaaguuugaggaccaaagaacuuuuugagcaaauuuaggauuggauauguuuugaaagaucaguaguuccaaucuguuagacagugaagucuugaagagguuuuuaguuuuaagccaaauaguaucugcaagguuuucccauaaauuccuccaugcauccuggugugcugauaaaugucuguuagcccaguacuuggaauaugagucacaagaaucaggaguucuaggucauucucuaaaucacauaguaaucucaaggccaauguggucuacaugagagacccuguuuucaauuaaagcaagcaagaugacucaacagauaaaggccccugcaucaugaguuugagucucaguauugauguauaugaggaaggagagagcuaacuaugaaauuguccugaccuucauacaugcacuauggcauguauaccuccuccccaccccccaugcacaaggacaucauacacagacaugcgaacaaaauuuuuuagaagcuuuuuucauauuuuuguaguaugcaggucaaagaacugggcauuggauuugcugggaaugaaguuacaaauguuguaaacuaccauguggguguugggaaucaaacccagguccucuacaagaguagcaaguaguuauaaccacugagccaucucaccugccuuccuuagacaaguuuuaaugcuuuaauauggcacauuaaaccauagauucauuaaugaauaauuucucuuuguuuaugagcccuucgauggcauuaaaucuuauaaauuccuucuuuugccuuucccuaguucaauguuuuauacauuguagguaauaaguauuugauuaaugaauaaauauuuuaaaaacaggauuuaaauaaaagcaaauuacauucuucaucuugaguuuuaaauuuuacuuuucauucuccaaacuuauaaucucuugaguaagcugaaauaguaacaccagcuuaaacauaguuuauaagcuguucacacaugcagagaugauugcuuuuagaaguaaaauaugagcucuuccagaguugugaaagaaaaauuaaaucauauuucagcaaaguaucuugguaggugguuaacaguuauauaagaguuagcagaaaauuuuucacuauuucuacuugaugaucucauucauauauaacuucuuuucuccauuguguaugaauaguuuuauaaauuuuaucucaagcccacacuuuacucaaccuauuucuuauaauaaauagucauauuguuauuucuuguuaaaugacucaaaggcacuuugcuuugugguucuauagaucaaacacagugcuuugccaugcuaggcaaacacucugccauuaaccuugaaagcacuuucaauucaaauauccagaacucguuuaagauaaagucucuucaucaaguuaguuauuuccaguauugcauaucuacuugucuaaccaacuagcuaagucaggaaggugggacucauugacgauucuaaaagcccuguuccccauaugagaugccccuuucacuguagcaucugagcuuuucacuuugcuacagcucuacagccaucagcucuauucuacauucacuucaugucuagaggacuguacuguccugcuguuuuuguuauuccugcccacacaacccuccaguuucuuguggugugauucagaugucauccuugaugugcuaaucuccuaguguccuccauuggaaauggagcaguggcagagcugauguccaucuuauuccuuguuaacuccuuggauguguuguuacuaaauuccuugcuggcugcaacccacacaugauugcugcuuuuuuguaauugacaaucucuucagaugcauuaccuacuguuuggaaccuacuuccugacugcuuccuucaucaguuuuuuuucacuuucauuacuuaauuccucuucauccuuuaguuagcugcuaaguuaccauacucuuggaaacuuaaugcuuuuagaguaguuucauuguggguauauugauuugauuacuuauuuuaauacuugucaccuggucauucaacuggaaaucaacugaaaauguucauaacccguuuguugccaauaauuauguauuaaacaccuagcacaaagcagacauuccacaaauaaauacuaaguguguuuauaaacccacuuacaugaucuuauauauuaugauuucacugaaauaacuugguauaacaugaauuuuacugaacguaucuuccuuuucucuguuuuguaaaaguuauauuuuuacuagaucuaaugucaauaguucggaucuaauuuaauucucugugucuccuuccucccacaauaugcuguagugguuccagucauaauggcaaaagacaaugaugguaaaaugccugacgaagaugcccuggaggaggauucagauagugcuagugagcuaggaagugaugaggaaucugaagaugaaaucauaagugaugguaaaaccucagcugaugaggaugaaagugaagaagaagacgaagaagaagaggaagauagugaggaggaagaagaggaggaggaggaggaugaaagugacagugguccugaucuugcaagggguaaaggaaauguagaaacuaguucugaagaugaagaugauuuggcagauuuguuucccgaagaaccugguuuugaacaugcuuggagagaguuagauaaagacgcuccucgggcugaugagguaacacuugcaauaagauuguuuacgaauagcauuacaauuagcuuuuaugggugcugggguugaugucauuaaauuaagcagaaaggaacuggagggcuaguucagugcugcaauucuuagcuagugugggugggcuaacguggggcaugguggcacacaccuagaguagcaucacugaggaagcaggaagguugcugcuguaaguuuuagggucgcccugacuuauugaguucuaaacugacuuggaguauaaaccugcucagugaagcccugucucagaaaagaaaacuaaacagaaagaaaacacuaaaaauauauuaagugagaaaagcuuuaucggugacuguuuguuguugauugaacccaggaccuccuaucugucagggaagaucucuaccagugagccacaucaccagacccugugguauccaugauuaagauuacaaugugaggacuggagauaaacucagugguacagcagccuagcauguguaagccucuaaguucaaucccagcacaagaaagauugggcaccuugaaauggagcugguguauauagauuagauuagaugugugcccaagcaguaaaauggaaaagaaguucuuccccuuucuuuucuuucugacuuuuuuuggguggggaguuaaaauucucauuacuuguuaaagauagcacaugaagucauggauuuugccgcagcacuuucacacgugcagccagggugcuuuguuccuuacuccuccucccuccauuagccuucuccauuccuccugcccugcucuugcuugucucaucguucaccccgcauaguucucccuucugcuuuuagaugacguauaugccuucauucucuucucccuugcucccuucagaucucucccuccagucucauggacccuuucuaguuucaugauguagauacauaaauguaaacuggagccgggcaugguggcacacgccuuuaaucccagcacuugggaggcagaggcaggcggauuucugaguuugaggccagccuggucuacaaagugaguuccgggacagccagggcuacacagagaaacccugucucgaaaaaccgaaaaaagaaaaaaagaaauguaaacuggacuuaacaggcuggagagaugguuuagucuauaaaguguuugcuaaaaaaaaaaaaaaaaaaaaaaaaaaaaaaaaauaaggaaaacauaaggaccugaauuucagucuuuuuuuauuuuuuuuauuuuuauuauaaucuuuaaggcucauuagccagccagucuaaccaaccagugagcuccagauuugaugaaagacccuguauguaaaaaauaauaauaauaacauggaaccagacauaguggcacaugcuucaaacccagcacuugggaggcagaggcaaacgaaucucuugaguucaaggccagccuggucuaauagcaaguuccaggacagcuagagcuacauauugagaaacccuguguuaaaaaaggggaggggaggugugguggcucacgccuuuaaucucagcacuugggaggcagaggcaggcgaauuucuggguucaaggccagccuggucuacagagugaguuccaggacauccaaggcuacacacagaaacccugucucaaaaaaccaaaaaaaaaaaaaaaaaaaaaaaaaaaaaagcaauaauaacauguagaguaauccaggaagaaacaucagugucaaccucugaauuauacauuaguucacauacacauauauaccaaaaauuaaaaaaauuuaaaacgcagcaaaaaagaaagcauuuaguaaauacuagucuucugagacuagcauauaucucauuuaacacaauuucuaauaucauccugcaaaggucauaauuuuauuuuuauuuuuuccuuuuuuaauuuauaugguguguguguguauguguguguguguguguguguguguguguguguguguguguaugcacacacacauaugacuccaagcauguauauaggucuuagguagacaucaggugucuuccucaauuguuuuucaccuuauuguuaagacagggucucuaacugaagucagaccucauugauugaacuaaacuggcuaaccagggagcccugucccugccugccgaacacugggauuauaggcauacucaacuuuuugcauuuuuguuugggugcugggaucugaacucaagucucuggcuuaugcagaaaacacugaacugagccagcauuccagcaaucugaguagguuuuuuguuuucaucucuguuuuuuaauguuuuuagugaacauauaauaauuauacauaauaccaggcucauuaugacauguucauacauguaugugauguauuuugcucacuuccaucuaccauuaucuuccucccacucccacuggucugcuuccucuugggcucuaggcccuaacaaggaagcuacagcugcuuugcuaaauggaugauuccaaauaguuaaaaucauuccuauaaauuagugcuauugucucacacacacgcgcgcgccuccaggucuuagagaacauucuaggagacagggugcaaggccuaggaguuuccagguagagccuuuaagaaccuuuaaauauaugaucauguuggugaaaaugaggaauuugacuucuuucuuuccugaauguaugucuuacaucggcgguucucaaccuuuccaaugcugcgacccucuaauacuguuccucguguugugauuccccaaccagaaaaugauuuucauugcuacuucauaacuguaauuuugcuucuguuaugaaucauaauggacauauuuuugaagaggaaggcuugccaaaggggucgagacccacagguuaaguacuuaagacacacaggcagaguuaaguacuuaagccuuaaguacuguugugaaucagaguagagaaacuagacaccauuaugucuuuccugacuuuagaggaaaugcuuuuaacuuuuccccauuuacuauaaauacauuugucauauauagacuuuauuauguugagaauuguuccuucuuuuccuaguuucuuuagggauuuuauuaugaauuuauguugaucuuugucagagaccuuuugagacagaaccuuucuacaaaagguuaaacuuggaauccuccugccucuucuuccucagagcugggauuucaggcauaugccacuaugcuuagcaagaauuucuacaugaguaauuuaaaaugcaugcaaauguuaaacuuguuuuugcuagguguuuauauuuauguucuuauugcacaguaaggaaaugcucugggguaaccuuuuucccuucuccacacugguagacuaucuuugcucuuacauaauucaagaauucaaaaagcccacuuuagagauagugcuuaucuguuguggauuuauauuguuugccucacgaagcucucuuugcauguuaaaucgguuaaaucacauagaugauuucagaacuggagaaagaagauaguucauuguuaaucuucgguuuuaagcauugaaaauuauguaaaucccugugcuuaggaagcagaaguggguggauaucugugaguuccagccagccuggucuacauagugaguuuuaggacaacccuagagcuauauagugagacccugucuuuaaacugaaaggaagggagggagggaaaaagaaagaaauaauaaagauucugugauaauuaauaauucuucaaauuucucagauuacacgucgacuagcaguuuguaacauggacugggauagauuaaaggcgaaagauuugcuggcucuguucaacucauuuaagcccaaaggaggaguuguauuuucugugaaggugagaauuaauuacauaaauuaaauuaaauguaaaguaaauauuucuagauguuuuaacuuaaaacuaacuuuguuucuaauuuuacugacuuaauuuuccuccuaaaaauauuuuauuaaucugaaaauugaugcaauuuuguaugaaacugauauguaacagguaauaaaaggguaaaaaaguuuuaaaaaaagcaauuuucuuuucaacuuuuuuaauuuuuugcuuuagauguguguauguguuugugugugugcccacguacucgcgcgcgcauaucucuguauggaaguaagaggagcccuuuaaaaguagauuauuuccuuccacaauggauucuagagaugaaauggagauuguuauugauagugcucuguuuuaguccccaucuuucuccuaaauuucuuauuuuaaaggaugcuuuauaucauguacuuagaaaugaguuuggcuuuccugcauugaguucgaaaugaauuguuuuauugagcugagucauaacucuuggugucuaaguuuugaugggucugaauauuauaugaaaaagaauguaugaguaauaucaguuuuguuuuuuguguucagauauauccuucagaguuuggaaaggagaggaugaaggaagagcaaguucaaggaccaguagaguuacuaaguauuccggaggaugccccugaaaaggacugguacugagucacucuagaauagaaaacuaacccuugcaaaguacuguccuucauucagaauccuacuacguuagaagaacugaaguuugcacuaacacuuacacuuaggacagcuugaucacauuuggcagugcauuaugccaacauuuuguguguaugcucggaaauaugauugcaauauuggaaaaaauagcucaugagugucuuauugcugugaauuaguuuuguuuccuuaauugagugucuaaguaggaagagaaaggaauuuugauguuagaaaccaacuuaaguaaaccacuagguggagcucuaugugcacuuaauauaauuugugauuaacuggauguuaacaaaaguagcagagaaagaccuuuaaggaacagauuauaguuaaaugaaauuaagauuauaaaguuuagauccagcagcaugguuuaauggcuaaagguacuuuucaucuaguuugacaaccuaaggaccugaauucaauccccagaacccacacaguacaaaaagaaagcugcuucuugaaaaugguuuugucugccuucuauauauacacuauggcacacauauaccuacagauacacacacacuacaaauagguaaauacaaaaauuguucauuucacacacuuuuuuuuuuuugauuuauuuauuuauuuauuacauguaaguacacuguagcugucuucagacacuccagaagagggagucagaucucauuacagaugguugugagccaccaugugguugcugggauuugaacuucggaccuucgggaagagcagucgggugcucuuacccacugagccaucucaccagcccccaaauuguucauuucuagagcaaauauuuuacaaaaugaagcauuugagcugauaucucacaagcauauuuuaaagauuuaucuuuauuguuuuaguuauuucuauguuugugucuauauguggauuuguauacauaagugcacguaccuuuggaagccagagggauagguccuguggagcaggaauuacaggugauuguauacguauuuuugauuuaguuuuucuccauuagggccucuagagagaagcuaagagacuaccaguucaaacgauugaaauacuauuaugcaguagcggagugugauucuccugaaacagcaaguaagauuuaugaagauugugauggccuggaauuugaaagcaguuguucuuucauagacuuaagguaauuuaguucaucuuuuuuuuuuuuuuuuuuuugguuuuucgagacaggguuucucuguguagcccuuacuguccuggaacucacuuuguagaccagguuggccuugaacucagaaauccaccugccucugccucccaucaguucaucucuuuuuuuuuuuuaagauuuauuuauuuauuauauguaaguacacuguagcugucuucagacacucuagaagaaggcgucagaucucauuacagaugguuguaagccaccaugugguugcugggauuugaacucaggaccuucggaagagcagucaaugcucuuaaccgcugagccaucucuccagccccaguucaucucuuaacaacugaaucuuacaauauagcaagaucauaagcaguaaaacacuuaaaugaacaauauuuucuugcauucuaagaaaaugaaagagaacgcuaauaauaauugacaaaaauaacuuacaagcuauuuucauaauguauauccuugaaauaauaaaucuuucaaaaaacuuuuuuuuaagauuuauuuacuuuuauuuuaugugugugagauccucuggaauuggaguugcagguuguuguaaucugccagguagaugcuaggagucaaaccuggguccucugcaugagccaacagguguuuaacugcuaagccaucucuccaauacuccccuccccauaacucucuauaaaauauauaauagaugcauuuuacaugcguguggaauauucuccauguaaauuauaaaagcugauuauaauaaccaaagauuguauuuaccucacuuuccauuccacauuccauggccugaugccuaaaacuugucagucaccauggcugacuuacaugcaaagaccagucauuugugaaauaaauuuguuggcuaagauuauucuugaucagccuuuaaacuuuucuuuauuuucaguggccuuuugcauuuaugguacucuguauuuuauuuagacuacuuauccaguauuaguucuguuugaucuuaggauucugcagugagccaaugauuuuauauauauauugcaccuggguuuuggaaacuggcuuacauuaacuaguaguuccaaaugcaaagucucuuuuuauagaauucucucaaauuuaaugaaauuucagauuuauacuuuuuaaauuucagagauguugugccaagguuguuucuagccauugcauuuguauagaaacuuauauaguauauaaacuauuacuaauuagaaauuuuaaacccugguaaucacuucuuuuuauguuuaaguaaauuuuucuuuuucuuuuuuuagauuuauaccagaugauauuaccuuugaugaugagcccaaggauguggccuuagaaguugauuuaacggcauauaagccaaaguauuucacaucugcugcaaugggaacaucaacgguauuucuuaauuuuuaaaaugcacauaugggccaagcaugguggcacaugccaguaaucucagcacuugggaaauugaccaggguaaccagaagcucaagagucacaguguagauacaugagacccugaauuuaaaaaauaaaaaaggaaaagggaaaaauuaaauguauaguuagacucuugcuuuuagcaaguuuagaauuaaauagaauucugaguguuugugcauuggauacuauacuguuugcauauauuuuucagugucuuuuugucuuuaagccugugggccugaggauguacuucagugguagaacacuugucuagcaguuguagagucccuggguuuuagcuuagauucuuuuaauaguuauuaguuauuaagauucuagggaauaaagugaagacauagcuuuaccucauaugacagcuacaaaaaccuauuaaucauuuggaauaggaccacauuuuucugcaggugugauuuucagaaguagaguaauucaggacuacuaguuuucauacuaaugacaagcagccagauuuauguguguuacaaagguuuguuuagcuucuaugucucucaccguaagucucugccugcagugguacucuaccacauacuggccuuucccaugcauagaggaagcugaugccagagagcuucugcaucugcuacaugcugugcaauggugggauguucugauacugaguaguuacaaaguauaguaagaccccagaguaagugcuuucuaaaggauccagccacaucauguuauuuucaauacuuaaguacuuaaaauaggcaguaugucuagccagcuaaucuguacauccugcauccugucuguaucaccaauaucuguuccacuuagaguaaccauuuggccauuaucagcacagaauuaucagaguaggaguagcucugaaucuugugaauggcuaaaacuucugagagagugacaggaauuuuuuuaaggaucuuugguuaauuagugccuaacuuguugucuaauauggagaaauuggacuaaagaaaaaaaacaaggacuugaacacauuguguuguaaaccucucccaggacccuuucacaaauagauuucuguguugaauagaacagucauucucaaccaauggguugugaccccuuuauuuacuuuaugauucauaacaguagcaaaauuucaguuaugaagucaaaacaagaauaauuuuaugaaugugggucacuacaccaugaggaacuauauuaaaggguugcagcauuaggaaggcugagaaccacuggaagagaggggaggagcuagucuccccaagucguauauucgaugaacguacuugguaugaucagaauacauuugucaucacugacucucaaucuuuuuaggaaaugguaccuguugagauuguuuguauauuaacaaaucucauguagucugugacucuacuauuguuuuaguucuccagauaaagaucauauucucacugguucauaauaguacuaacuuuuucuagcauauuuucuuauguuuuucuccaguuaauguuuguucuuauucaguaaugagauaucaaucauauagcugagaauuaguagaaagguaaaaguggacaaaugugauuuaguccacaaauaagauaccauuuauaauucaugccauucaugccugagcuuuguauguguauuggagcuuuuuguuuuguuuuguuuuguuuuguuuuugagucaagaucucacuuuguagccuuggcugccuaguacucucaguguagaccaggcuguccucaaacucacaagagaucuaccucugccuuugccuccaagugcuaggaguaaaggcaugugccaccauuugccaagcaugcuuuuuaauaacguaauaccaaacaucaaaguuaacgugugcuuuagucaguguuuuaccuuugugcugcugugcguugauuuucauucuuugugcugcugugcguugauuuucauucuuugugcuguguguggguugauuuucauucuuugugcugugugugcguugauuuucauucuuugugcugugugugcguugauuuucauucuuugugcugugugugcguugauuuucauucuuggguucaagguggagaucacuugggaugagacugaccaugaaagaaucacgacgcuuaacaggaaguuuaaaaaggaugagcuuuuggacauggacuuucaagccuacuuggcuuccucuagcgaggaugaagaggagguagaagaagcaccagaagguauuuucgaauccuuucauggagugguuaacagaacuaugucuggggaaaacuuaagaagacccccaaacuggcugcagaacauauuuauacacauagaacuauaugcauguauaugcauggguagauguuugaaggacuggcaggaugcucauuggauaaaagcacuuauacaaaccugaugaccuuacuuugaucccuagaacccaugaugaaaggagaacugacucaccaaaaguugucuucuaccuaccauaagcacgcuacagcacaggcacaccaauaacaaugauaauaauagcaacaauaaguaagguuuuaaaauaauucuaaauuuuuugcuagucuaauugucuauagccacaaaauuuauuuaaacucugacuuaguaaaaaugccuagccuguuagacuuguaaauauguaaaauaccuuuaugcccccuaacacacacauacacuuuauugauaauuaauuaguuuugagacaauuucucuguguagacuaggcuuacauagaucugcugacuucuguucccaagaucugugauuugauuauaggcauagaccaaccacacccaguuuuuucagugcuggugacuaaacccaggucauggugaaugcuaggcaaggauuccacuaagauacauccuuaagccuacuugcuauaggcguccuaaguagcucuuguacuuuauuauguaguacuuggguguguaacacugucuucuuuguccuuguuuuacauuucccugacuuccauaguucuuccuuuuaaaccucuuuccuuuagcucuaagugcaucugaggaaaugccuguaguaagaaggaacuacuaacuaaacucucuugagcuuucauuugucucaaaaaugccaaaaaaauguuugcuuuuguuugcaaaucaaaauuggauuucuacuggguucugacuugacuggugguuaugaagguuaucuggagagagagagagagaauaugagagagagagagagagagagagagagagagagaauaugagagagagagagagagagagaauaugagagagaaugagagagaauaugagagagaaugagagagaaugagagugagugaguuaguugaacuugagauuuuuggaggguccacuuaauuuacacagugguaucuuuuuucaguauugguguucucagucauuugauuuuucuccugucuuucuagaacucuauuuaaauaugcaugaaaucuuuucacucuaucuucucuugagauuuuuguuuguuuguuucauuuuguuuuuguuuuucaagacaggguuucucuguguaauccuggcuaccucagaggcacaucccggaugcguuuccauucucuuauauuuuaucguuuuuuuccccuguacuucauucugguuauauccuuuuguuuacacgucuucuaguuaagugucuuuucagcagugucgauucuguugauacaccuguccacugaauuccuuaucauuguuacuauuucacuucuggaagcccugugucccugcuucuucacaucaauaguaucacuuuuuuguaggcuagucucuugaguauauuugucugguacucccucugcaucucuguuuaauuucagaagacuacuuugaacuuuguccucugugguguggacuuuaacuuguguucuuuuggucuuuaauaguuuuccaguuguguucacagcuguggaucaggaaauaagugcucagaaacaauaggucuuaaaacacuugugaucauccuugugguaguccauucucuauucuugauuuugacaugauaauuuuucacuaacuugucaguucuuucaaaauuuauuuuguaaucacuuugaaacuuuuagaaauaccuuaaaaauaguguguacaacuuaauauugucagugaaaaaguugaucugauagaagcagugauugucaaucuuuguuuaggaauuguggaugguugacaugauuguacacuuguuaaauugaucaugcuuuuuacuuagaacuaauuuuguaaaauauaauaccaauuuuuugaucauuuaguucauuugguugcuagucugucucccccucuaccaugugugugcaugugcaugcguguguuaugugcacauuugcuauggaaaccaaggaucaccgucaaguugucuucaauuauuuuuugagacaaggucuccuccucccucacugaauauggaacucacuaacuggcuaagcuggcugaccacugaacuucaaaucuguuuugucucuauucuucaaguauugggguuggagacuugcccugcuuuuucuucaguguuaagggcucauacucaggccuuuauguuagcauggcaggcacuccaucaacugagccguccucaguccacuaagguauugucaaagcaaucugggauuuuuucauuuauuggucuguuucuuuguuaguuugugugguucaagggauucaacugagguacagcuauagcccuucagcuuugaauguuaucugccuuuacaucauuguuguuuuuaucuaauagaauuucaaaacauuaaaaacuaugaguucaguguagauagaaaaugaaaaaccagaaauauuaaacaugauauaaauacuuuaaaucagcagaaaagaacauuuuuaguuauaguuuaacauuuuucuuaguguuuuccuuuuacaugcuguauuauuucuaugcauuccuacuuuuuuuuucuuuuuuucuuuucuuuuuuuuuuuuuuuuuuuuuuuucaagacaggguuucucuguguagcccuggcuguccuggaacucacucuguagaccgggcuggccucaaacucagaaauccuccugccucugccucccaaguccugggauuaaaggcgugcaccaccacugcccggcaacauuccuacuuugaacauagggcuaacauuuuaacauuaagccuggacuuucuucguuucuaaauggucuguagguuuuugcuuuuauaucacugaaaguagugcuuuauccuuauaaguuuaccacaaaauacuguuuuguaguuauugauguaaggaagagaaaaucaugcuuaauagcugcuauuucuuuguauacauuacauauugacagaaccauguaauuaaguguuucauacucuaugaaaauucauguugguucauuggguaaaggcugucaacccugauggucucaguuugaucccaggauccacccacccaguagaggagaaaaccaacuuccaaaaguucucauggcacgugcauauaaauaaauggcacaauaaauaaauguaaugaaguuuuaauaaagaacauuugcagugguccuucuauuggguauaaaagauuuaauauuuuaaggccuugcuggcuggugcuuguuaauuuuucugaugaaguuuuauuucuuaauguacuuaguauagccuucucacagaccuuuuauagcccucauaaauaagaagaugaauuuauguucauuuacuauagguauggaaaauguaaauuuauaugccuguauggauauuguguacuuuucugagaauucucaauugcuuuccuuuacccuaguucuaaaauacagagggaaauaauauuccaugucuauugggaaugacuagguccguguuuuucaacuagacuuuguuugguuuugaaaauagaacuaaauuuuauuguuuuuuauuacauuuguguguguguguguguauuauguauguacauauguuaaguaugcauguggaaauuuagagaauagcuugcaggacuuaguuguuuucuuucuaccacguggguccuggugaucaaagaugucaccaagcuugacagcaggcauuuauccucucugagccauuucacucauccuggaauuaucuuauuuuacagaaaugaguguuugccugcaugucugugugcuguuugaacacccuugguaccuguaaugccaggagagggugcuagaucccccuggaacuugaguuauaggugguuugugagcugccaucugggcauagggaauugaacccagguccucuggaagagcagccaguaccuacccacccaccccauccccauuuaaauuuuaaaacaguguuuacaauaggacaccuaguaguauugauaaauaagcauuaacauuaucauaaaauaaucauuaauuuuucaguguauuuaauaucuuggacucacuggggauacagcucaaugguagaguguuugccaagguucauaaaauccuauguuuaaccuuucguauucuaaaauagggaaggaaaaacccuuaagcucuacuaguuucaaaacuugacuuuaccacauggugaaauaacaaaggucaaguuuucuuagcaccaugguccuuucuuuguauagcugugaaguaagaauuauaauauuaacuggcucauagaaagacuaaaugauguauauaaguaguuaggauaguacuuuguauuauguacuuugucuuaaaacuaaagauucgcuucucucaguuugaaauauguaauuuuuucaaaagcaugccuuuuucuucaguauuuuaauagaucacaaacuuaccuugaucugcaauuuagugcuugugauaguuacaauaguauauuugaguauuaaacauuccugauuauuguuuauaagaauagcuuauuguuugaauuuauuuuuuaaaaaaaucuuauuuacuauaaaagcauucauaaaauguccuugaauuagaaaagcagaccuacaugaguuaucccacauuuuagagcuucagaaaguacaauuuaguacuggaaaaaaucaauuuaaaguaagccaucagagacuuaccacuaaaguuucaacguggaagcaucuugcuucuaauuauguuuucagaaguaagcuuuuaauagaaugaaauacauugccauuuuguuaauguguuccucauguuuuauccauugaauuaugggauacaugacagaauuccauccaacauuuauuauugugguacaaagcacaaacagcaaaaaaaugagcuucaucuguuugggugaacauguaaaagugugauaggaugauggaaagaaugcccacaaccacugcaggggggaaagaguccucaaauauuuaccuaaccaaccucuucccugcucaucgccuuauguaaggaagugguguuagcacugaugcuucauagcgagcgccaugcuucuaucacaguuuagugacuggugguuacaaagacuggaacuugacgucacuuccaaacuuucuucuacuggagaugcuacacuuugauacacuugauaaguuuuauguuuuacauuaaaacccagauuucuaauuuauguuacuggcuugaagaauuuacauuggaacuguagaacaaacaaacuuuauggauugauuuucucugauauuuguuguucauggguuuuguacuguuucuuuacauucuaauguuuaugaagcuagaacccaaaacuaucaauuaucuuuccacacaguaaacuuaauugaauugcuuccuagcuugucuguaucacugauugaugacaacgcuccuaagaguaaaugugguuauucacucacauucagaugggaagaacucaguuuagguucuaaacaacucccuuugccucuuuucuguggccugagaagcuaaucccgugucccaaauucgccccagcaacauugaggcuccuuuuguugaacagaauauuuuuaaagccacugugugauggcagagaggacaaagaggagacugaaaugccacucuucaugcauaggagggaauauuauguaauacucuagcagugacuacaucacaucugaguuugacuaaguacaagacuaaggucuaguugaagguaauuguuucucaauauuaagugagauugauuaauuugguuguuuuguuaggugaagaaggagucaacauaggagaagaugggaagacaaagaaaagucagaaggaugaugaagaacaaauugcuaaauacagacagcucuugcagguuauucaagaaaaagaaaagaaaggaaaagaaaaugauauggaaauggaaaucaaauggguuccaggugagaacuagauauuaaguaaaaguuuucuucugaaugcauuuagauauaauaauaauaagaugcuaacucuucuuuagaagcauacuuuuaaaaggguuuauuuuccagagauuuucugguaaagaaaugguauuuaauucaccucagaauuaacauguaacuaucuuuuuuuuucauguuuauuuaaaaauauuuugucauauaauauauuuugauccuguucuuuccccuuuucccuacuccucccagauccucccauguacuuacccacucagacuucauguacucucucaaaaacaaaaaggaaagaaaaacaauuuucaaaaaaaugaaaaucaaaacaaacuaaaaagaaaauaaaacacauauaucauaaaauaaaaugcacaaaaacaaacaaaccccaucauaucuguuuuguauagccaacuacucccuagcguggggccugcccuaacaugugguugacaaacccagugucauuccauguuacagaaaacugauuuucccuuuccugguggguaucaguuacaaaucuuuccuugccuacuuccccuucucagugcuggaguuuuaccugaugugaaccugugaaggucccguccguacgagcucauauguguguccguccugcugggucgggaacggucuuuccuuggaguccaccucuggcucuugaaaucuuucuaauuccucuuacccauggaucccugagccauagguauuuuauacucuuuccagcucccauuugauugguuucuugguuuuacuaauuauaaauuauuucugucuaauuauaagcagagaccuuuccuggauuugauuccucaacuuaguacuauauuuucuaauuauuacaauuuuuuuuaaaaacuauaguucucaagauccuuuuuccuguagccuuugcuguuuguuaauucauaagguuucacuaauauaaaauauguauuauugaguguuccaucacaguuuugcuauaguuaaaaaaaugugucccgguagaguaguacaaggcaaauuucaaaaugucaaauauaaaaauagauaaaagcuaguauaaacaagaauugucauauacaauacacauuuauacacacaaauaguuauagacauaacugcauguacuuuuacaaacaguaaugguuacagacuacugauacuuacagucaucucuuauaguauguccuacuuauagucaucucuuacaguucuuggugaauucauuccaguaucuccuacagauacaaaaacauguccugucauaugcagauaacuuguauacaucaucuuguauacuuaaaaucauuucuaaaugauuuuaaucaagacuaaauaaaguccauguaaacaguugucuauauauauggacauguauauauggacauauauauguauuauauauaaaauacauuauauauccuaaacauauaugaaaaauauauaaauauguacuauacaguauaaguguacauuuauaguauauauauuguccauaaacaagaaacaguauguuuguucagugcagguacaguuucaagguuguuagguguuuuguuuuguuuuuuauugaaauuaguggguauguaauccaugggugcaaauauugcccauuuuacugacuaauuuugaucugugguuuucuugaaauauccuugcuaauagaguaaaagaccuccugaaguaaacuaggagcuauaccucuaguuuguuuuuaucuugacuuuuauuuguggauggaauguuaauauuagcucaaguuuuuaagaaauauaaaaugaaaaauuaccacccaaaauucuacuacccugacucagcuauggcuuagguaaguucugcuuccauuugccauuucucuguucucaaauguuuaaccauauuucuaaucauucacugcaguagauguauggcauugaaaagaaacaggacaguuuccaaagccacaaauauugguccauucuaagaguucuuugcuuucaucccuagccaauaccuuggcuugcuuuuuuagggccuuuuuaaguuuaaaacuuuuuuuaacaacaguaggacccccacccccauucccucagugaagauuauccaggccacagugaaaagcagacauuggcacucaggcucaccacuagucaguugugugauuuccucuucacacagcagccuucacacauaccauggaucaaccuguggucuucucaagcuacugaaacuaccacugucaaaagaucaaaagauggagcacaggugccagguaucacagccuucacagugcuguaaauauaguaccucauguuguggugacccccaaccauaagauuauuuucacugcuacuucaaaauuguaauuuugcugcuguuaaaaauuguaaauaucugauaugccagauaauaggugacaucugugaaaggaccuuuugacacccaccccuuuaaagaggucacaacccacaggaugagaaccaccggucuaagauguuauaaucuagauuuuuuuucauaaugugagcuauuuuuuaucaaguagcuuacccaaaauagaaguaccaggaaggggcaugggcccgggcacuuucucugucuugacauugcugccagauuucuuucccaaaauaucccaucgguuuauagugccuucaauagucauuaauaguuccagugucagggaauuaucacuauuucacauuuuacuggauggagucaaguuaguucucuuagaacacacacacacacacgcauacacacauauucaaacaguguguguguguauguuaacguagguggugugugaaggugacagaauaauuugcaggugucauuucucccuuuucucgguuucuggaaaaacuaaguuucuucuguaauaauauaauauagaaauagaaacaguguauuuuucaugcugguuauauuacauuugguuuuuguuuuauauuuuuauaguguuuaccauaagaucgcgguuuuuuuuuuuuaagauuuucaauucuuuagacucuuaauacaauuacuuacuuuccccuucucuuaacuccuuccaaauccucccaucuaaccugccuuacucuucuaaaaucaugaccucuuguuucagugaauguuguguaugcgugugugugugucugaguguguauguguauaauucuuaaauauagaaauacaaccuguuaauucuguauaucauuacuuauauauauauguuuucagggcugagcauuuaguauuguuuaaccaauuggugugcuuuucucugaggaagacuguuucuccugcuaucagcauuccuuaguugccuguaaucucuuuuggggguugaagccuccugagcuuuggugucgucccuguuuaagcagucaaguuggugagacuuucuggauguagcuuuugauauucauaagagacauaguguuacgguaaauucccagguccucuagcucuuauagccuguccacacccuuuuccacaauaaucccugagccuuagauuguagauacaucuuuugggacagacucugcaauugcauuuugacucauuguaguuugccauaauggcuuaguccacuuacugcagcaagaaguuuccuugauuaggggugaguacuacaguuaccuguggguauaaugacaaagauucaguuagggauucugcugcuuaguaaagugguuggcuguagguucuccuaaaaacacauaaguucacuagcccuccuagguaguugacaggguuuccaauaccagguuugauuucucucuaguugaguuaggguuguuuuuuucaagauuuguuuaauuuuuauuuuuuguauauuggugaguuuugguaacaaaaacgaauagugauaaaauaaaagauacuguuucugauggaacugucuuugagcuaccuguguugaugaggcugugaguguggauggaaccguuuuuagagcaagcugugcugcugaggcugaguguugcagguuagaguagggagaguagugccuucuagugugggaauccuaggccaguccccaccuuaaccccuuuccuggaagaagaaaauaucugaggaagucaguucagaagaugcugcacuggguccauggcuuuuaagguguuuuuacagucuuugccaaauuagacuuucguaugguauagauggugggguguuuugcuuauguuuaacucuugcuuugaauuaauugaauaucauaguccuguagaguaucuuuuaucaggugaaagcgccucuaccauuuuccucuuaaaguccuaggguuuuuuuuuccauguccaauuuuucuuccagaaguuauauuugaugcauauguuacuuuuuuacuuuggaucuguaacuccugauuucugugccuuugaaucugugcagcuugccgaagaauuucuucaguucuauuuuacuucauuaaguccuuugcuuuuuuaagugcugauuuuauauuuuguaucucaauuuccaagucuauagucugugacucugucuuacugguuuuuguuuccacuuacucuaguuccucagggauuuuuauugggaucuucuugucuuggaucuuucuuuucuuucaggaacucuggaucagacagaguuccuuuuacagacuauuugucaggugucuggaggcauuucuaauccaagaccuauugaauuuuugaguugguguauuugggaccacacaaguagugugaauuccagccacaauuccauggguuugugggcuuugugguuacaaagucucagaggagaacuguauuuuuacuccccaucuucauguacucccccagaacuguagagggagggucaucaucuacugguggcacauuuaaggauccugggaccucccaccaugaucagacuccaaacuuuggcccccaccuccuuggcugagagcccauaacaacccaaaauccauacuagacuauauuagcguaguguguguccccaaggagaacucccugcuucugaacuaacuuaauauuucuauuugagcuuccuuauugagacuugacacaggaauucuucuuguuuccuuauaucuuagccauucauguaaaagauuucauucauuuucuaccuugccuacaauuauauaaaaauaacauaaauguauaaaaauaacaauagaacaaguaauuuuucaguauuugccauaaauaaguuaucagaaugguuuucccagacuuggcuagaaguuagaggacagcuuaguaguauguuauuguaauuacaaacugcaugaaaggcaagaaaaacauacaaauaaacuugagacaaauacagaaaacaauagcucccuaaugaggcccagaugucuuguauuugaauucaguguuguaggaauauugaaugcuaagaagcaggcauaggggacaguuugauguguggugaaguugguacccuggaauuggaagccauuacuuuaagagaaacugaaaggggauuucaaaguuagagaaagacaacccaaauucuagacaaauguaaagccuuuucuaccagugaaauaacuuuagacaauaacagcaaaaugcaacaucuauucagugaguacucugggcuuaccuuccuuguauauuuauuaaauguuuggcaauuaaguuaugugaguagaaauucccagucagaucaucuuuuagauuuauccuuauuaucuucauuuuaacuguauacuuuucacauaguagguauaacaggauucuaauaguauugaguacaaccagagagcauuuguugacucuggcuaguugauaguuuuagccauucacaauuguuuuugaaacuaguuuuuauuuuacuuucaguuccauguguuguugcucccagucaguggggugggagagauuugaaucacuuuccuuucacuugcuuccuuauccuaugcacauuuauaagauuugugcuauaugccaggacucuaaugagccaauaauauggacccuuguuaugugaguaaccguguccuuccuuguccucacaccuucaagaguaauguguuaguugggagaggugccuugauagcagugcucuuuaggaccuggcuagugguuugccucuagaagaaagcccggaacccagaaugaguuccacauuuggagucugguguuagugaugguggucaguaacacuuuaaagcguuugaaauugagugcugcauagucuaauuuauaacacacaaaaaguuuuaugagauugauauguaaguguucauaaauauucccaaugaauccuaagcccauauuuaaguaaaagugccaguuucaaccuauaugaaaacucuuaaaacaugcauuuuguuuuuauaaauaaagccuguaacaguaccuauuuaaguuguuuuaaaucauuuguauccuauccuuugaagacuuuucaaacauuucauguggauaaggucaggagaaauauauauucuucuuggagauuuuguaagaauauuuaugagucuuuuuauaugcaccgaaacugccaaaauaguuuugaauagaucaugcuuauuaaauuauuauuauuacuauauugagucaucugcuuuugugguuagcucuagaaggggcuuuacccuuuauuugugggauuauugauaucuuuaauuuggcaaucuaugccaaauuaugccuaaagguuugcuuuuggguuuuuuuuuuuuaaacaaauuuguacaaaacuaaaggaguuauaaugaaguuguuuuucaagucccauuguggcuucccuuaagugagaggcugaacugacucugaagaauguucuuguguguuugccgagagacuucugggauagacauauuuuuaagaacuuagaacauaaacaacugugaucuguggcaagagauuuaaaugaccucaugaugacaaugagaacaaagcauuuuuaaguuaucguggugguguguuaauucacugcaauguguuugucauuccucuauuuugguauuaagugggagccaggcaaaaaagaaacuacaggcugacuugaacuuaagauauuauuucuuuauugcuaccaacaaacuaaguucgagaaaauauuauuucucgaggauacauucugccucacuuauucuagaacuagugguacagaugagucacuuagagacagaagccuuaaaguuuuaguucacuuucuguuaggaauaauauguucuaaauaucaaagaucaaacacuuggcaggaaauaagagucuuuccuucaaaagaaaucaagacagacguguuuauuaaguacuuauugugcacugggaacuaugcuaaauacuauggaauguaaaagaacgugacuauccuguuuuucguuuagaacuucagguucucagcagagccacauaauaaauacuuaauuuguauuuguuauuuacauaucaauauuaagaaaguuaaauugccaaauaaaugacaccucaguuacaugaugcaaguaaucacauaacccccuuuuauacaccuagccaggcaugguggcauuugccuuuauucccagcucuugggaggcagagggagugcacuuuuauaaguuccagcacaaaucuugucucaaaaaaguaacauuuuaaagauuuaucuaucuaauaauaauaauaguaugcuuuuaagauuugagauuagacuguaugcugaccugcaugcauucuauauguuauucuaccuuguuaugugaaaucaacuuguaucagaacuuacugccuucuccuguaugaaugagggucucaucuuacauucccuagguacauuacauuucauuuaaagaucuguagauaacuugguaucauucacauuucauaugaaaaccauuuaguaaugugaaauguuuuucucauaauagaaugugucuuaaugauucauuuaaauuuuacuuuauguguacgaauguuuugucugcuuguauauuuaugcacuuugggucauaccugucaccgaaggaggacagaagaaggcauugaauccccugaguuagaguuacaggugguuuugagccacuauguaggugcugggauuccaaccaggguccucugagagagcaaccucuuuaagagccaucucuccaaccccagauccauuuuugaauuaaugaauguauuucugguuuggcaucuaacaaaucuguaugucauaaaaugaaacuuaagaguauguguaauuuaauuuaguacguuuauaaguccuagaaauguggggauucuuugccuuacagcugggaaaugggcauaagagcucaccuguuucaaacuggucuuuggggcucacagccuaaaagcccugaaauagugauucugaguauuucaacaucugcuaaguauuuugaaguucaaaggggggaaaacgugcaugugagagggaagguuuguauacauccagucucuaccugauucauuuugcauacugagaccacagguaaacuugagugaguagguaggaugggguaaauccuaaagcuggccaagauccucacuuccaccagaguacagaacauguaacuacuauucucucuucuuugaagauaaugguauuuauuuauucaucuauuuuuguuagaaauguugaaggacacaguggagguggagcuuuaaauauuuauauggcauaaaauccaucuuuuaaaaauagcaaaugucugggcaugguagcacacacugguaauucagucugucaggaggcagggccaggaggaucaccacaaguucaaggccugucugaccuacauaguaaguuagggaccagcccagucugggacucugucuuccuacaaacaaaauaaaauguaacagugaauggaaugauucaaauggucauuuuagaaaaagugguggcugacccaauucgucauucaaaauacauucaaaauacuauaaaugagcaaacagccuugguaaugaggucucauugcaaguacauuuuuaaagugcgagguuaaugacagugaaggauaugugagugaggagcacaguauaggaacaaaagcuucagagaugaaccaugacgacaguggcauuggaagagccaagcucuuaccuacacagccuuauacaaugcuugauucauucuucaguuuuuguuagucacuuguaauggccaggaaacacagucuuucacuggaugauaggaaaaacuagagaagauuuugcuuagguaguuaguaguuauaaccugagacuuguucuagaguuuuucuucacucagucaucacuaaaaggcagaaagugagaugaccucuuggaggcucaaaacaaagguagagaggacacuuagaccuacguaaauauuuggguuucuuuuucuuuuuuacuuuuuuuuucuuuuuucuuuucuuuuuuuuuuuuuuuuuuaauuuuguucacuuauuuugagacaguauuucuguuguauggccaauuuggacuuaaucucuuccuuaaccuggaauuguaguuuauaaccacugugucucacuaauaauagguuuuucauuacuaaccaugugucagauugcuaaauuucuugauuugauuuccuuuggcuaaaugucucucuguuucucuuugucucacacacacacaguaggaguuaccaaaguuacuuaccauuuuguggucuuaggauauugcaaguauucacggcuguauauaacuacuuauauaaauuauguuuguucucuuuguuuuuauaagcuuuuaacuggucgaagauaaacuguuuuuaacugaacuauuuggauuuuguuucucuucuaggucuuaaggagagugcagaagagauggucaaaaacaaguuggagggaaaggauaaacugaccccuugggaacaguuuuuagagaagaagaaagagaagaaaagacugaaaaagaaacagaagguauccaugcuaauugcccagguguucacugaaugccagcugucuauaggaaggugcuucuuaccauauaacccgaguuucucuuccugaggcugggauugugugagccaacacacgcaucuacugugaaauaacuuuagacuuuuauugaaauaaagugggaaaguaggguaaaagaccugccuucuugauauguuaccugcuuuuacuagagcuuucuucaaaacuuaaguagccagcuaauugccacuaauagaaugauuccaugagagauaaagcuagagguuucugggagauuuccuaagucuuuaugggguuacuacaguagucacucugagacuuuagacagcauucuguaagcucuaggcuucccuuacacuuuuacguuuuucuucuuguuuucuuauucuucuuguugauuugagacagcguuucucuguguagcccuggcuguccuggaacucacucuguagaccaggcuggccucaaacucaagagauacuccugccucagcuuccugcaugcuggaauuaaaggcgugcacuaccacugccuggccucuuuucuuuuucuuucuuucuuugcuccccccacacacacacacacacuuuuuaauuggacaaacucuggacuuuuuuuauuuaauuaaagaauaguuauuuucccuguuccuccuuauuguccuuacacauacaugagaauaaugcauacaugcaaucugcuaagccuguauguguuucauucauguauguauguauguauguauguauguauguauguauguaugugugaauuaauuagauauccauuuggcaugcucaucccuagggaagacuaauucuuccuuugugagaaauuuuuaauugccuguagcucuucaucuaugcauugugccuuguaggauuucacccaucuauuuuggaaugucaacaugguagucugucauugaucagguaccauauuauugagauuucaugcugcagcuucccuguucagucuaggagacagucuucugcuuaccucauacucaaaaucauaaguuuuuaguuccaucuauuuaucuacaaaguucaugauuuuauuacauaggguauaugccaccacauuuuuguuauucauugguuaaaaagcauuuagaaugcuuccauucacuagcuguugucaauagaguaacagcaaacauugcugagagaguaucugugaggugggaugucgagucccuuugggccuaugccaaggaggaguauagcugagccauguaguacauguauuuagcuuucugagaauucaccacacuuauuuccaaggugacugcaccagauugcaaucccaccaacaggaaauaggguucuccuagaaaauagggaaacacauccuaguuguuuuguugaucuuaaucauucuggaugguggaagauuaaaacucaguuguuuugcuuuauauuucccuagaaauuagggaaauaaggaugauguuuuggguuuuuuguuguuggcuuuugguugguugguugguuuuuguuuugcuuuuuaagauuucucagcuacuuuuauuucuuuuuaacuauuuugaauguaaaucauuugucagguauauauguggcaacgcuuuccuccugcucugugggcuucugcuuuacucgguugguuaauuuuauuuuuuaaacaauuuuuuauuagauauuuucuucguuuacaauucaaaugcuaucccggaagucccuuauacccucuucccucccccccccccaaccccccacccugcuccucaacccacccacuccugcuuccuggcccuggcauuccccuguacuggggcauauaaucuuuacaagaccaagggucucucuucccagugauggccaacuaggccaucuucugcuacauaugcagcuagagacacgagcucuggggggguacugguuuguucauauugcuguuccuccuauaggguuacagaccccuucagcuccuuggguacuuucucuaguuccuccauugggagcccuguguuccauccaauggaugacugugagcauccacuucuguauuugccaggcucgggcauagccucacaagagacagcuauaucaggauccugucagcaaaaucuugccggcauaugcaauagugucugaguuuggugguuauuauggucuggaucccuggauggggcagucucugcaugguccugccuucugucucaucucagaagaagcuuuucaguuugaugaagucccgcuuguuaauuguauuggccuuaauuccuaagcaaauggaggcccaucaauaaagucccuuccuacucuuagaucauggaguauacugcaguugugaauaagaguguauccauguucucuuucucuguguguuuauuguugguguauagaagagccauugauugauguaagcugauucugauuccugacacuauccugacauuuuuuuaaaucauuucuagauguuuucaguuagaauuuuugagaucucuuauauauaauauucuaccaucuacaaauacagauauuuugacuuuuccuuuucuuauuuguauuucuuuaauuuucuucucuugccuuacugcuccagcuaguacuucaagcuguauugaaaaggaguagggacaguggacagcccugucuuguuccuuauuucaauagacuugcuucaaauuuuucuccauuuaggaugguguuggcugugaguuugauacaugcugagauauauucccuccaggaauacugucccuuggacuuuuauuaugaugauagcacauuggauuuuugucaaaggcuuuucagcaucuacugaucaugugauuuuucuuuuuaauucuacuuaugugaucuguuaauuuauuguccuucauaaguugcaccaaccuugcaucuaagguaaagccaacuuggucauaguggguaaucuuuuugauacauauuuauugaggauuuuuuaaaauaauuuauuuacauuugugugcuuugguguuuugccucaugcauaucugugugaaaaugucagauguuggaguuauaggcaguugccaacuaccgugugggugcugggauuugaaccuggguccucuggaagagcagccagugcccucaaccacugagucaucucuccagcccugagaacuuuuuuagaauguauuuucauccgggauauaggccuguagauuucuuuuucuguuaugacuuucucuggcauugggguuagagugaugcuggcauguguuagcaugcauuguaguaggaguuucaaaguacucuguuucuauuuucuuuaaaaucuuaagaaaauuaaagauuggcuuagaucuuugaaagugugaauucaucuggguuucuuucuuucuuccuuucaacaggacccuuauuacuuuuucaaucucauuuguuacgggucuguuuagauuguuauaacuuugauaguuuggauaacucuagaaauucauccauuucuuuuagauuuuccaacuuaaugguguauggguuuuuuaauuauucccuuauaauauucuaaauuccuuuugucuguuguaauguuucccuguuuauuuuugauuuuguuaauuuggguccuuucauucuuuugguuaguuaggccaagggucugucaacuuuguuuauuucucauagaacuagcucuuagauuuguugauucuuguguuguuuucuuugcuuccauuucacugguuucugcucugauuuuuauuaugucuugccaucuacuggauuuguuaccuuuuccaaaauuuuuaguugcaucauuaagucauuuauuuguacccuuuauaguuuuguaauguaggcacucagggcuauaaaucacccuuguaggacugcuuuuaaucuuucccagaaauuuuguugcauugugguuuuauuuucuuuuaguuucaggauuuuuuuuuucuuucuuaguuucuucuuugacccaucauuuuccaguaaugggguguuuaaucuccaugaguuucuguccuuacuggagauuugcaugguauugauuuuagcuuuuauuucauauggacagauaggcuacauagaguugauuuuucugauuuguuaagaauuguuuuucuguuacaagauauaguuuauuuuauagaugcuuucaugggcugcugaguagaaugaauagucuuugguguuuggauuaaauaugcuguagauaucugucaaguccauuagcuguauaauauuacuuauuucugauauuucucuauuuuuuguucacuuguccugucuaguagaggaaaugggguauugaaaucaucuauuaguggguugauaauaauaauucaauucucguaguacauaaguuggaugcaucaauuucaguacauauauguuaagaugauaauaucuucuagcuuaacuguauccuuaauuaaaaugaagugcccuuuaucucuauuaauuaguuguuugaaaccuauguugucagcuaauaguaacaccugcuugcuuccuguuacuuuugcuuggaaugcuuuuuuccauccuuucccuuuaagauggugccuaucuuuaaagcucauucaggcagccugcaucauuugauuugagaauugaggcuauuaagauuuaaaauuauugaaaggccuauguugauugcugucauuuuauugcuuuuguguuaguugugguugguugguugguuguuuugguuugguuugcucuaaccacgagcuuuucuacccggccucuuuguuccuagaaauaacaacucugagacuuaauuauuuaugaguaaaugcuuaggccauaagcuuugccuuguuccccaacuaguucaaaacuuaauuaccuauuuauuuuauucuaagucccacuaugugauugguuagcuuuccacaguuucaugcaacuguccuucaguauucagagcaaagcuccacaucuguuucccagaauccugucugucucugccagauuuccaccuucuaauccugccucagcucauuguccaaucagcuuuuuauugacaagugauugcuuuugcacagagcacaagacauuaauuauaucuacaguuugcuguuuauguucuugauuguauuuaguauuucauuaauaauguuuuauuugucuucuuucuaggaucucuuggcuauguuuauucuuccuuuagaaguauuguuuccaguauucucuuuaggcuugguuuuccagacaugaauauuuuuuuuuagccuauuugcaucauggaaaaaaauuuuuuucucuccuucaacuauggcagauagcuuuacuggguacaguagucuagguaggugauuguguaaaauuuggagugcauugcucuucuggauuucagaguuuccauugcgaagucggcuguuauucugauggcuuuuccauuuaugugacuagugauuuuccucuuggagcugucacuacucuuugcucuguuuaaguguuucaacuaugauaauguuguggggaguuuuacuuauguucuugucuaauugguauuaacagcugugcuucuuugaacaucagguuuuaucuuuccuuaguuugaaaguuaacuucuaugauccuuuugaacaucuugucuaugccauugaccugugaucaucucugacuacaguucaaagguuugguuuuucaugggucccacaguuuuuuccaaguuuugcuuuaccauucagaguuuuuuguuuguguauguguauagaucuacauagauauaggcaugcagguaacauagauauauagagacuauaaaauauaaucugucuuacauucuaucaguuuuacuuguaaagcuuuucucugaguuuucaguuugcacuaacuuuuuaauucuaccuucauuucggcuugaggucucuucaguauuucugucucuuuucuaaaaaccuguauuguuuuuaugucauuucagccuuauguuuauauguuuucuuggguaccaugcagacauuuucaucuuuuugaguucauugauucucguugugucucuaaacuucuuggguuuuguuuuguuuuuuuaauuaguuguguuuguucaguucugugaccuuguaagagacaccaugaccaaggcaacucuuuuuuuuuuuuuuuaugguucuuuuuuuuuuuuccauuuuuuauuagguauuuagcucauuuacauuuccaaugcuauaccaaaagucccccauacccacccacccccacuccccuacccacccacucccccuuuuuggcccugguguuccccuguacuggggcauacaaaguuuacguguccaaugggccucucuuuccagugauggccgacuaggccaucuuuuguugcauaugcagcuagagucaagagcuccgggguacugguuaguucauaauguuguuccaccuauaggguugcagaucccuuuagcuccuuggcuacuuucucuagcuccucuauugggagcccugugauccauccauuagcugacugugagcauccacuucuguguuugcuaggccccggcauagucucacaagagauagcuacaucuggguccuuucaauaaaaucuugcuaggguaugcaauggugucagcguuuggaugcugauuaugggguggaucccuggauauggcagucucuacaugguccauccuuucaucucagcuccaaacuuugucucuguaacuccuuccauggguguuuuguucccaauucuaaggaggggcauaguguccacacuucagucuucauucuucuugaguuucauguguuuagcaaauuguaccuuauaucuugggaauccuagguuuggggcuaauauccacuuaucagugaguacauauugugugaguuccuuugugauuguguuaccucacucaggaugaugcccuccagguccauccauuuggcuaggaauuucauaaauucauucuuuuuaauagcugaguaguacuccauuguguagauguaccacauuuucuguauccauuccucuguugaggggcaucuggguucuuuccagcuucuggcuauuauaaauaaggcugcuaugaacauaguggagcauguguccuucuuaccaguuggggcaucuucuggauaaaugcccaggagagguauugcuggauccuccgguaguacuauguccaauuuucugaggaaccgccagacugauuuccagagugguuguacaagccugcaaucccaccaacaauggaggaguguuccucuuucuccacauccacgucagcaucugcugucaccugaauuuuugaucuuagccauucugacuggugugagguggaaucucaggguuguuuugauuugcauuucccugaugauuaaggauguugaacauuuuuucaggugcuucucugccauucgguauuccucaggugagaauucuuuguucaguucugagccccauuuuuuaaugggguuguucgauuuucugaaguccaccuucuugaguucuuuauauauguuggauauuagcccccuaucugauuuaggauagguaaagauccuuucccaaucuguugguggucuuuuugucuuguugacggugucuuuugccuugcagaaacuuuggaguuucauuaggucccauuugucaauucucgaucuuacagcacaugccauugcuguucuguucaggaauuuuuccccugugcccauaucuucaaggcuuuuccccacuuucuccucuauaaguuucagugucucugguuuuaugugaaguucuuugauccacuuagauuugaccuuaguacaaggagauaaguaccaaggcaacucuuauaugagacaacauuuaauuagagguagcuuacagugucagagguucacuccauuaucaucauggcaggaagcauggcagcauccaagcauacauggugcuagagaaggagcugagaauucugcaucuuaauccaacugcagccaggagaggagugucucccagcagcuaggaagagggucucaaagcccaaccccacagugacacacuuccgauaaggccacaccuacaaggccauaccuccuaauagugccacuuccugggccaagcauauucaaacuaccacaguucuaccuaccacauguaagcaacacucaccuuauuuauuuuuuuuuaagauuuauuuauuuauaugcguacacuguagcugucuucagacacaucagaagagugcaucagaucccauuacagaugguugugagccaccauguggucgcugggaauugaacucaggaccucuggaagagcagucagugcucuuaacugcugagccaucucuccagcccaacacucacuuuagaacacuugaaugggagugguagauuugagagaagauacucuccuuaccuuucauacuuuuugugcaaugaaaccuggaaguguaggcuucuucguuggucacguaucugaugugaacacagcaggacaagcugauacccaggaguuaggaaaggcuucaguggggcccugguugugguugagcgugcagucacagugagcucagguggguucaccagagugagaagaagcacaugcauauggugcaggccuagccgggucuggaagcuggaucuggcacaagcaauuccugaaccagaguugagagggauugccauguaccaauguguccucaccaccuggacuuggcuuagagggucuguggaugaaggcuccugggucuggcaagugccagagggagaaagagcagccaagagaagaucuggacuuguuaacaacauuuaaaauauauauaaauaauuagugucuccuagacuagguguucugcaccggauuugauaauagcauuacaugccaucugacuccucagugccuuaaagguuuaguggaucauuuugcauucaggaugaauauauucucagcauauuuguugaaauuauagagaaguuuuagauucauuggaaauaaacccagucuguuuagucuaaucucaguucagauauuuuugcuuuauggucuuguguauuaauuaaauacaccaauacaauauaaacagucucuucaaauuauauuagagaaauuuuagcuuucaacuuauuuaaaauagacugauaguuuacagugauagaccauagauaaaacaaggugugcuguguuuuuuuguuuuguuuuguuuuggaaacagggucucagaaaguauccuugguuugcuuggaacuaauuuuuuguagaccaggcuggccucaaagaaaauuugucugccucugauuccucugugguuuuaggcuaccaugccaggccuuuaaaaaaauugugugugugugugugugugugugugugugugugugugugucuuaagugugugugucuuaagugugugugcauauacauauguguguguguguaugcaggugcacagauaggcccuuagaagccagaauugaagcuggaguuacagcugguugugagccaccuaacaugcguacugguaucagaacucuggucuuuaugacaaaguagugauggcuuuuuaacuguuaagcuaucuccccaauccaagaucauuuuuaaacagaauaagggaacagagcauuaauuuauguuuaaaauuuuuguaauugaaagcauuuuccuuaucuaaaaaauagauuguugaaauaaccuaucauuuguaaccuuaguuuauugcuaaucacugcuguuuuucaccuuaaggcucuugcugaagaagacagugaagaugagcuuccuucugauguugauuucaaugaucccuacuuugcugaagaaguaaaaaaaauagguaagccaaccuguauuuguaguuuucuguuggaauccacagaaaaggaugauaugaguugaaauaauacaaauuaacaauucucugaaaauuucuagaguuuggauagcucuguuaauguuuuauaaccaauucuguccuguagaguucagucauaugaauuguugagaagagucaacauguccccucuacauugaaaauauaaaauaaugcgauuauaaaagacuuuaaacggauaucucuauuuuuaugcaguaugacugcuuugccuacauguaugugcaccacauacaugcagugucugaggaagauggcagaacuacaguuacaggugguugugaacugcuauguaggugcuagaaaccuaaccuuggucuuguauaagaacaacaaauacucuugacugcuaagccaucucuacagcucccucguuaggaggcuuuuuaauaacaaugaauuuaacaguuaauggggguucuuuucuggaaauuaucuuuauagcuagcuagauggacucuaaaagaaugcuguuauuuagaaugaauguuauuuagucucugcauuauaauacuucuucaggucucuuucugcaaaagcauugaacaauuaaaagugaacuggauuugucauggcaucauauucuuuuaaauguauacauggaauuacaguauaauagccuuuucuguucaaauaugcagaagcaucuaugcuuccuuuuugcauuuauccuuguuaaauguaguuuaaaaaaaaacagcuuuucucagagcucucuuuuucuuugaauucuuacacuaagaugucuuucuuccuauuuccaaggaguuuugguuccauguuuuuuauaccuccugugcuuucagauguuuucauucuuaccuuuggauguauaggacuauguuugguaaggucgaggccaugcuugggcaagccacugcagaaaccacugugaaucuuuccaguugcucuugugugcuuugucuuccccucaucuuuaugcuacacacacguaagcuuccaauggcuugcucuuugagcaacuccaagcuggcauuguaaagagaaguauuuuaugaaguuucccugcuucucgcuccugaccaguggaauucuguccugguuguuaaagccucuuaguacugacauuuuauugaugaaaaggagauuaaguuggauauauucuauuauugaauaugagauucuuaggaauuggaaagggaaauggaaaccuagccuauucugcuuuuuaucauugcuguguggucaugucuuacagaugauggauuuuagccuuauucucugacuaaaaacguuuauaauggagagauaugaagcauuaaaguuuccuuguucuguguccauagucauuugccauauguaaucuggucagauugcagaacacagagcaggauucaaagaauagccuaaguguuucaguagcaugagauagcugauuucucucuuuuuaaauauauauguguguguguguguauuuauuuugcauaugugaguacauugucacugucuucagacacaccagaagaggguauuggaucucauuacagaugguugugagccacaaugugggugcuagggauuugaacucaggacuucuggaagagcacucauugcucuuaaccgcugagccaucucucuagcccuguagcuaauuucuuaaagacagcuuaaauagaauauaagcuuucucuaauguuacuaucaaacauucugggagaacaauauagguagaauuuguuugcuauaagugcugugcaaucugauaggcuagagcuauuguaauaauauagucaagacagaaacuuucaugaauucugguuuuagaaaugauguacugaaaauagaaacaggauuauauaauuaugauaaauuuuuuaaaagaaauagauuaggggcuggagagauggcucagugguaagagcacccgacugcucuuccgaagguccagaguucaaaucccagcaaccacaugguggcucacaaccaucuguaacgagaucugacgcccucuuguggugugucugaagacaacuacaguguacuuacauguaauaaauaaauaaaucuuuaaaaaaaaaaaaaaaagaaauagauuaguacagagaauauaacuaggaagcaaaagauaaagucuuauaaguagguuaggcaaagaagacucccuugagguagugauauuugagcugagaucuuaggcauacauugcuaggagaagagcguuguacaggaaggaaaaggauauaaugugagaaagaacauuuugugcaguguuggaugaauugaaagacaucauaugacuggggcauggccagagagggaguucuguguggagcuaaaaugaagaucuaauggaaagugaccugcagagcuuuuugucaggacagaaaguugggaguguauuguugaccauagaaagcccuaaagcuagaaaguggaaugaucugguauaucuuuuaacuuaaugcugauuccugcagagacaacacauugauaauuaccuaguaagaacuaggaaacuuaguuuugcagaaaaagucauuugaccuuccauggaaggucauuugaaauguagguguaucucugcuuugccaucuuuuaaguauuuuauaaaccaccaugaaagccagcuauauuaugcccaucugagucauucagaugcuguguuauauguguacagcaugcugguugugugcuacuuuacaguauacaagugauuuuugcauccugucuuuggauccauuuucaggucacuuuauaguugaauauauugaagguaauugaucauccaggggcaguugguagcugauagaaucugaauccucuucuacaaggauauuguaaaaacuagaggcagagcuaggacucacaugaauaaaaagcugggugugaaaacaaugccagguuuuguugucauguguuugaaggaaaacugcaguguauacccuaaagaaagaacaagugaucuuggguguagaaacugcaccaaauccagggaguccauggggagcuuaccauucccauccacucaguccugagacagcauugcucuagggaggucugucuggggcucuuaucucugucccauaagaagcacucaacuaaacuagaagcuuucuagacuaaaauucacacaacuuagaaggauguaaaauagaauguccauauagauaguucuauuuuccauagguauauuauuaaguauaaucagacaauaaugggaauaauuguaggcaccuauagcacuaugggcaaagcaauaacuacauucuugcaguuuacuaauccauggagucccuagaauaacccuacagguagcugcugaauucucuauuuggaacuggagagauggcucuguggcuaaaagcacucacuuuucuuacagagaauucugugucaguuccuagcacacaaauggcaacucaacuguaacuacaguuccaggagaucugaugcccucuucuggcgucuguggguacuaggcauccacuugguauacacacacauuauguacaagcuauagcucagaggauaaaugugcuuacugucacacucaagaccugaguuugaaccccaagccccacauggaagagaagaaccaauucccacaauuuguccuuugaccaucacaguugaugugguaugugcacacgcacauuaaaaaaauuuuuuuuuaauacaccuguuuuacauauaagggcauaacucaauucucuuuuucuaacaugagacaaauuguucguccuuuuuaauaacccuuuugguuuugggggguuuuugggggggggggaguucuucacuacaaaaggacuaagccauguuguucaguacaguuuagugacugucuuuaguuacugguuuugcuuugguuuugagauggccucacuaugugucauacuuaggacucaaaccuuucuuccucugccguccaaguugcuagaguuacagaaaugugccaccauaccaacaaaagugccuucuuuuuaacauaguugccucccagaagacuugugcccccucccuaagcucauggccuucccucuguugugcucuuccuucuucugguucugacauuugcuauccugauuacuucuggauauuuuuuauuguguucaaaguauaacaaauuuucacuguugagccugucuuuuaaccuuccuauguuguuuugcugaaccagguauaaagaaaaaaucaaugaaaucugcaaaagacagcgcaucuucagaggaagaaacugaucuggaaaaacaaaagguagacaccauggucauuguuguguguuaaucaaugauugauauguacaguugaaaugauguggcucacaugaguuuucauugucucuaauuuuaaaacuggauuuucaaguggauuuuguaaauauaagauacauaaauaucuuagccauauaauuuuuaaauguuccuuuaaccaaacauuauuuccguagcuaauaugaacuuauaugcuuuuauaacuaagagauuuuucucauucgcacccuauaauauaacuaagacauauuauaaccuaaaagguauuauaauauaacugagacauauuaaaaccuaaaaguaguauuuucauaucguuugauucuauuugacucugcccuguacuacaguuucugucaaaugcuaauuuuuauuauuagugauuauaaguuuaauguacaaauguuaagucugcauuagaaaggcagugauauuuaugcauaacccagugaucccaaaacuccaaagucacguguacuucuguggggucagcagcacccaugugacugggagugagccuugacuggccauguaaacuguugagcuuaaugcauuuuucuauucuucauccauuacauauagguagcacucauaaagcuauuuaaagauccgcucauggaacuugacucucuaaggaagucccaugugagugccagugaugguaggagaggaauagcauccuuccugugugugauacagggagacguggaggcuccuguguguugucuccagugcugugguuguuuagcugacucuuaggggcucauggucaguggaaacaaaaugcuuagccucagaagcagaugcugagucugcuucaugaaaguacaucaguauugaaagaggcaagggaaaaagagcaaaagaauuuuccuaauugcuaaaguacacaucuggaaacugaaauuuguaucacaaaguaaauuucaugucauuucuuaaaaaggacaaggugaagaugaaauguuuuugacagaccuggggcucuuauuccuucugccugcuaaucagguuacucuacaggaauggaagccugucuuuugaaucaaggcuguuucuucccuccuucccuguagcuaauucucacaucacagccugaaaugaacuuaagcugugugucuugggcuucuuccuaagcuccauucaaugaguauaagcaauucucagaacagcaacuggggaaaacucggcuguacaucucuaguauuuguuuguuugcuuuccucuccguaggcugagauggcuuuacuuguaauggaugaggaagaggacagcaagaaacacuucaauuaugacaagauuguggagcaccagaaucugagcaaaaagaagaagaaacagcucaugaaaaagaaggaguuaguugaggaugacuuugagguaacuggcagcacagucauuauagcgucuucuuuuuccauuaauuuacuuauuuauucacuuuauaucuugguccucccuucacacagucccucccccaugcccucuccucuauucucugagaggguggaggcuuacacuggguaucccuaaccauggcacaucaagucuccucccagugagaccagauaaggcagcccaguuagaggacuagauccacagauagggauggccccaguuccugauguugggggacccaaaugaagaccaagcugcaugcacaucugcuauauauguacaggaggccuagguccagccuguguauguucuuugauuggugguucagucucugagagccccaaggguccaaguuaauugacucuauuggucuuccuguggaguuccaguccucuuugggcccugcaacccaacuucggucaguguccacaaacuccaucuauuguuuggcugcgggucucugcaucuguuucagucagcuucugaguuaagccucucagaggacaguuaugcuagacuccuuucugcaagcauuauuagcuucuugaaggugaaguuaaaucuaaagucacucugacgauagaaauuaagcaugaaguuacccucaaaaagcucuuauuaaggccuguaaaggcaacaaaguaacuguccuuuaaucuagccguucaucccagaguggaucacaccacuguucucugguugagcacuaaaugagaucguuaccuuaaaguugguacaaaacccuguagccuuuaaaugucagaaccagaaacaguaauaugcaugcugagcauggagaggucacauggcaggccucacucugcuguguacaguagccaacuuagugggccaugcuuuuuaauuucuguguauauuguugaugucauccaucaguuuccuucuuaugcugaguaugugguccuaauggccauaugcaugaguccaagcccuccacagaaaacuuuaagauauguauuaggaaucacuugagaguuuucacuagugaauuuggaagaaaaaaaaacgacgggugaguucuuaauugggucagaguggaaggaaggacauaaaugagcuuccuuguaguauguaggauugauugcaagaccacuacuacuccaccuuuuuuauauguuuguauucccaugaaguuucugauaaauuacucuucucaugaaaaaagcaaagaauaauuuccuguuaugagcucuaucuccucccauaaguaaucauguauaaaauacuuuucauggagcuggugauacggcucaguagguaguguacuuaccaccaaaucugacaaccugaguucauuccccauuguccacauguuguccucuaaccucuacauaccacacaaauaaucaaguuuuugcaugagggcuguagagauggcucaguggguaaagaacuugaugaacagucaggagaccugaguuuggaucccaguacucacauaaaagcucggagcaacagcauauuucuauaacccuggagcuacagggaauggacacagaaggaucccaggggccugcugacagccagcuaguugaugagcucucacuucaaugagagaaacugucucagaaaauaagguagagaacauuaaaggaagacaggugacaucaaccccaggcccugcgggcaccuauacaugcauggauacucaaacacugaauuuucaggagaauuccuuuguuauuuuugguauggugucugucaauaucacuauaacuaaguagacucaggucuuucuuuguuguucacuacuaaaccuggcuggauugagggcacacuuuuccacguaggaccguaguacuuuuguagaaacacagaggauggaucuggauucuucguuuuauuuuguuuuuucgcugugguccuggggugcuugcacugagagcaucacacugcuuuaggcaagcccucaaccacugagcaacaucugcagcuaccauuuugcauuauauuuuaaaacgggguccggcuaaacugcucgaggugaccuugaaucuggaauccugagucagccuucaaaguaccugcaauuacugcccugugcuaccgggccuagcuaguagcuacuuuuucaacaccagaauguaguaacugccuaaacuccaggcaauucaauaguguccuaauugacuugucuauaaguuagaaguuggucuuauguuaagcaaggaacaggaagcucugccuugggaaccacuucucuagucagucaaaguaauuauccaaguuauaaaccacagaacacauaugggccacuagucaaauagauuaguuuuaggggaaagaaaacuacacacuucuuaaaggacaggccuuaaaauuccauugagucugcccugaaugugguggcacaugccuguaaucccaguucucaggagaccaaggccaagagggcccuguguucuaaagcaguaaguuccaguuuggccuagacuaaaaagacagaccuugucuugaauaacaaacagaaaacuucuuugagauugcagaaauugguucuaaugccuccgugcacagagugcacacuuguacacuaauaaccacagcucucugcaucucuuuacguguuucuucucuuugaauuugcagguaaaugucagugaugcucgguuucaggcaauguauacuucccaccuguucaauuuggaucccucugauccuaauuucaagaaaacaaaagcuauggaaaaaauucuggaggagaaagcucggcaucgagaacggaaggaagaacuucuuauucaagcaguagagagagcacagcaggacacgggaaagccaacacagaagcaacccauggaucccgccuuguccaugcugauuaaaucugugaaaaacaaaacagagcaguuccaagccagaaaaaaacagagggucaaauaacugcucucgccucaaguguacagaaacaguguaaaggauagugggaagaacgccaccuuucugaaauaggagaaauacccuuuuuugaccauuguaaacuuguucugcuuuggggcuggagagauggcucagcaauaaagaauacuggugcuuuugcagagcauccguguuugguucccagcucucacaaggcagcucacagccauauguaauuugagagacccggugccuuuuccuggccuccaugggcauggcuggcccauaguguuugcauaaacauaguuacaggcaaaauauucacacacagaaaauuuuaaaguaaaauuuagaaaaaauguuccccuuauguaauuguuuaccuaauuguaaauacuucauguuuuauacuguguauucauagacuugccauaauguaauuauauauacuauagaauucuuaagaauuuuauauuauaugaaguucauuucauauaaguacaguuauucaagcuuccuaagaugcuauuuacaaucuauguaaaauagugucaauuuuuucucuguaaagaauaaaaacaaguugaaaauauguauauguaguaccuuaaucucugaaggcaggaagcagaucucugaagcuaguaaaauaauuuauuuuucuagugugaaagauggaagcugugaacuuucuuucugugcuuaguaauuugcauguagaacuaauuuauaaauaaaaagugugaaaugaaauua

SEQ ID NO: 1126 - RNA, 999 nt, Mus musculus
gcgggagugcuuuggagccucacccggaaguuguuguugucugaagcgagcagcucgaagaugcgaauaugaacccucugacuaaggugaagcugauaaacgaacugaaugagcgagaaguucaacuugggguggcgcaaaaggugucuuggcacucgaauacaagcacagcgccuggaucuuuguuggagggcuuccuuaugaacugacagaaggcgaugucaucuguguguucucacaauauggagagauugucaacauuaaucuugugagagacaagaagauugggaaauccaaaggauucuguuuccugugcuaugaagaccagaggagcacaguucuggcuguugacaauuucaauggaauuaagauuaaaggaagaacuauccguguggaccaugugucaaacucaggaaucagaagauguggaugauaugacuagagagcuccaagagaagggcugugggguuaaaacacccccaucaaguccuccugaagucucugaagacgaagaugccaagcucacaaaaaagcacaaaaaggagaaaaagaaaaggaagaaagagaagacugaacgucagguccaggcagagcagccguccugcuccagaagcacgacagugaaggagaagaaggaugagcacgcuucgaggaagcacaguagcaagacuuccgagagagcacagaagucagaacacagagagagcaagaagagucacucgggcuccccugguggcaggaguuccuaccaugcuagggcagaggacccugagugcaaggcaaggaaagagaaacccaagcaagagcacaaguccgccagcaggagggaggcagaggagaagagcagagagagggagagagggaggagcucacucauuccagcaggcacagggggcauucugaugggcggagccauagaaguagaaguaggaauaggaguccauaggcacucuccggagcaggaguccuaccauggcagugaccggagacaucacugaa

SEQ ID NO: 1127 - RNA, 999 nt, Mus musculus
uucagugaugucuccggucacugccaugguaggacuccugcuccggagagugccuauggacuccuauuccuacuucuacuucuauggcuccgcccaucagaaugcccccugugccugcuggaaugagugagcuccucccucucucccucucucugcucuucuccucugccucccuccugcuggcggacuugugcucuugcuuggguuucucuuuccuugccuugcacucaggguccucugcccuagcaugguaggaacuccugccaccaggggagcccgagugacucuucuugcucucucuguguucugacuucugugcucucucggaagucuugcuacugugcuuccucgaagcgugcucauccuucuucuccuucacugucgugcuucuggagcaggacggcugcucugccuggaccugacguucagucuucucuuucuuccuuuucuuuuucuccuuuuugugcuuuuuugugagcuuggcaucuucgucuucagagacuucaggaggacuugauggggguguuuuaaccccacagcccuucucuuggagcucucuagucauaucauccacaucuucugauuccugaguuugacacaugguccacacggauaguucuuccuuuaaucuuaauuccauugaaauugucaacagccagaacugugcuccucuggucuucauagcacaggaaacagaauccuuuggauuucccaaucuucuugucucucacaagauuaauguugacaaucucuccauauugugagaacacacagaugacaucgccuucugucaguucauaaggaagcccuccaacaaagauccaggcgcugugcuuguauucgagugccaagacaccuuuugcgccaccccaaguugaacuucucgcucauucaguucguuuaucagcuucaccuuagucagaggguucauauucgcaucuucgagcugcucgcuucagacaacaacaacuuccgggugaggcuccaaagcacucccgc

SEQ ID NO: 1128 - RNA, 3243 nt, Mus musculus
acauaguccaaauguuuaugaguacaaaaacuuguuuuauaccuaacauucuucuauccaagggcaucagauauaaaaaguaacaauaggaaguuaucaugacaaauacauuauuaagacuucacaugaccagagagacaaauaacagaaaacacacccaaaagucagacuucuaacucagcaagcuuaaggacauggagucagagcuggggagaaugaccauuuagaaauaacuacagauaaaacaccuuauauguucaucacugaguaaauaaagauucuccucgcugaaagcuaaguauuggguuauaaaugaccuauaugauucacacagcacguagucgcaguugguggaaagaccggggcaagaguaaacaagacugaguugacaauuuccauaucuuagcaccuucaagauccaaccuccugccaccaaauaaagccaggaagguacagauacacagguucaguuauuuccacuucuucucuucuucaucacugguguuucuguuuuaucugcuguuuuaauuaauuucuuauucacagaagaagucaauauccugaaaggggggaaaaaguugaacuuucaggcugguuccaaaaaagcagguguagauuuuaaguuuuaaaauaagauuuaaaaauaaaauaaaauaagauuuaauuuuggauuuggauuuaauuuuggauuaagucaagguugaaaaccugaggauuugaaauaauuaucacuuuaagucaaauacuguuuaagaugaagguuuuucaauacaugucuaauuuguaguuuuuucacagacagagcacagugccaugcagcgaugacaggugagccgaggcugucugucgggcugaguucuguuugaagcauugcaguucuguuugaagcauugcuugggagacucaccucaaaaugaccaucuugcaaaggagcucagaaaggaccuuuuauuucugccccagggcagugggaagaccuccauuuuauuucaugcagaagucacacagaaaagacucgaaaaaaaauucuggauuuucuagaauauuuugaucaacucaaaaacagguggcauuuuuuucucuucaaucuacauuucauaaauaaaucuaccuuucauaagaccaucaggaagaacagcuuaguaauuuuuuuuaauuccuuucucuauggacagaugccuuccauuaaaauagaaggaguguuguguuguauacuugaaccauacugagucuccuuugcuacacacgcacacacaggugugugcgcacuuaugacaugggaagagaguuaaguauagguggcaggugugacuugugagucagccuguugggaugaucauuuuauaguauguauuuaccucaaaacuucaaguugaauaucuucaauauacaauuuuacuggucaauuauauucccaguaaagauaaaauacaguuuucaaaaguugaaacauuuaaagaaaacaaacuuagauagagugauuauaaugugugaagaaagugugccaaccucacaacgccgacagccaauaugacauucuacauguuaccaacucauaaaagucacuguuggccccuauuuuguacagcauauacuguaaauugaaggacauauucucaaaaacaaagucuacauuaccccgaaaucugauucauccuccagucaccucugagaugcuuaccgugguugggaucuccuugguggccuccugguauacacgcugcuccuucaccaaguugcuggggaaauaaccuacaauucccaucucauccugguggucaccauaaaccugugugcccaaagcagcggcaguuagggaaaagcugauggcagggcuuuugagaaacuccucuccugguaaugaaaauuacacaagccagugcucccuuuagcugugcauuccagggaauucagagcaaaugugaaauucacuggcagcaucaggaacucugagccucacuaccuuaacauuacuucucuuucuguacucucguacuuugccugaaaucaucuggaaucuauaggaaguuaaggucaauaaaaauuuaaagcaaauggacucccauuuuacaguauguguacuuuccacuuuuuagcaauucaaagugacauauaguaaguacauccugacugacaccuucaucgguuuuagauguaucucuuggaugacaucacccaugcuucaucccucccuggacucugcuuuggucuguggguacauuuuaagucaagcaaguggcuccugcaaaaucaaagaggauuuuccccuuuagacugaccagucacacacaacccuuggcaaauccucuuagacauuuuuugaaagagacuuaacuuaugugcaaugcagaaaccucagcaugcauguuuuuuuuccccugaucaaaacaucaguuugaauuacccuuaauuuuguugugaaaucaccccuuuuuaaaaaugaaucugaauuuuuguguuuccacuuacgguuuccauauuaucuuugcagcuacuguuaaacauuaaacggacugaggacaggaaagccaggaaaaauuaagaguaauacaauuaagaauauauacauauguauguauguauguauguauguauguauguauguauguauguauguguguauguauguauuaaaaacagucucgucuuacacugccagcccaaaacucuccagcuccguuuucuguuaccagcuuggaguaaacauagaucugcugcccuuucuugacaucgaugaaccuacagucuggggcauuguaaucuuccugugcucuugccagagaaauaguaucuggaagagaaaaaaaagggggggaagugaccagauguccuaugaguaagaaggcaaaguguaagaaagguaggagagaggaaaggagagcacagcuggguuucaaacggggguugcggggggcgacaaggaaaucuuaggaaaugaauucucugcaguuagaccccaaacacagaccuugagacacagagcugcaaacaaugagcacauuuaggauucacugcaaaguacaaucuggcuguuugccagacagauuucccauuauaugauagaaagacaaugagaaccaaaccguuaacagugccuuacagacacacuccucauccgcacacaacuucuuagaagaaaguuuauccauaaauacaccaugcccggcacauagaaccacaaggcccccaagcaaaagaaucaauauccuugccaucuuccuucuugcuguuuugacuagcacu

SEQ ID NO: 1129 - RNA, 430 nt, Mus musculus
ugagcuuugaucaguaugaaauugccuuagcuccguuucuucuuuugccccgucuagauuccucucuuacagcucgagcggccuucucagucgaaccguucacguugcgagcugcuggcggccgcaacauuuuggcgccggaacugggaccugaagaauggcagagagaugcuaagaggaacgcugcauuggagcuccacaggaaaggaucuucguaucggacaucggagcaacggacagguacacaugcuagcgcuagcuuaaaauuucaguuuuguaaaguguugcuaaggaugcgguaggauacgaauuaagcuugaaucagugcuaacccaacgcugguucugcuugggucagcagcguguuaaucggaacuagaaacggaaacaggcagguuagccgcagcuuuuuaggaagcugcuuaggugga

SEQ ID NO: 1130 - RNA, 1199 nt, Mus musculus
ccagggaggagaguucagucugaggauuuucauuucaagaucugcaucgaggccugaccugucccuaauaucggagacacagagcccucccccagaaucaggagccucaggcacccccagcuccugagcacaccaacuuugaugcuguuuuauguagagaaucuaaaaggaaggaaaagggcuuuuagccuuaggugacagccuccucuuagacccggugaggccaaggcuaaggcgucuggguucgaggaagagcagaaucucacucccuucuggggcuccucucgucucggugucagagguggccagguuuuacauuauaugccaccaguuaucacuacugaagauagcucagauguacgguugcccuggaaacugcugcuuacaucaucuagaauuuggaaggagccuuguaauaguaaaguguuugaaaccaucuacccuugggcacgagcaggacccagcaagugagcuuuugaccucaguggcccccaaacuccaccccaaaagaccucucuaaggcauuauuuucugaacucacacccugugaagacugccuguccacacacgugcagccuguuccauuuuucucaucuuugccugcuuuagaccaccauuuauauaaacgaacucuccccucuucaaguuuucuuaagagaaaauagguaggauuugucuuucugagucugguuuauuuugcuugauacaaugaucuccaguucuuggguuguuuuucaacauggaaucuggggaucaaacuaaguuugguucucauggggacaagguaauuuaacaacagaaagaucuucccaguaaccauuaugccccauaacaccucucucucucucucucucucucucucucucucucucucucacacacacacacacacacacacacagguuaaguggucaacuugccccaaaaacauuuugcuaucuauccuucugaaauuaaguccuucaauagagcaugcucauaaaugggccaacuuuacauggcuauauucaagcucccugaauagagucuguuuguucguauuggacuaccucucaggcucgccucgacuggcuauagcuccccagcuuuuacaucuuggcuguucauguucuggcuuaguauucaacagaugcaguccaguguauucuaugccaguguaaagcccacaccucccucauuaaaccuuacugggguggcag

SEQ ID NO: 1131 - RNA, 1199 nt, Mus musculus
cugccaccccaguaagguuuaaugagggaggugugggcuuuacacuggcauagaauacacuggacugcaucuguugaauacuaagccagaacaugaacagccaagauguaaaagcuggggagcuauagccagucgaggcgagccugagagguaguccaauacgaacaaacagacucuauucagggagcuugaauauagccauguaaaguuggcccauuuaugagcaugcucuauugaaggacuuaauuucagaaggauagauagcaaaauguuuuuggggcaaguugaccacuuaaccugugugugugugugugugugugugugagagagagagagagagagagagagagagagagagagagagguguuauggggcauaaugguuacugggaagaucuuucuguuguuaaauuaccuuguccccaugagaaccaaacuuaguuugauccccagauuccauguugaaaaacaacccaagaacuggagaucauuguaucaagcaaaauaaaccagacucagaaagacaaauccuaccuauuuucucuuaagaaaacuugaagaggggagaguucguuuauauaaaugguggucuaaagcaggcaaagaugagaaaaauggaacaggcugcacguguguggacaggcagucuucacagggugugaguucagaaaauaaugccuuagagaggucuuuugggguggaguuugggggccacugaggucaaaagcucacuugcuggguccugcucgugcccaaggguagaugguuucaaacacuuuacuauuacaaggcuccuuccaaauucuagaugauguaagcagcaguuuccagggcaaccguacaucugagcuaucuucaguagugauaacugguggcauauaauguaaaaccuggccaccucugacaccgagacgagaggagccccagaagggagugagauucugcucuuccucgaacccagacgccuuagccuuggccucaccgggucuaagaggaggcugucaccuaaggcuaaaagcccuuuuccuuccuuuuagauucucuacauaaaacagcaucaaaguuggugugcucaggagcugggggugccugaggcuccugauucugggggagggcucugugucuccgauauuagggacaggucaggccucgaugcagaucuugaaaugaaaauccucagacugaacucuccucccugg

SEQ ID NO: 1132 - RNA, 1327 nt, Mus musculus
uugcugcugcuggcugcugugcccgaacuccaccauggaccagugccccauaccuaccuugcuggaacauggcaacuucucucagguccuguuuaacaauguggagaaguucuauguuccuaaaggagauaucacgugagauauacccucacugaaaaguucaucccucgacccaaggacuggaucggcaucuuuaaaguaggguggaagaccacucaggaguauuauaccuucaugugggcucccuugccaaaagaccaaaacaaggauucagccacacagcaggaaauccaauucaaagcuuauuaccuucccaaggauguggagugcuaccaguucugcuauguggaugaagaugguuugguccggggaacaagugucccuuuccaguucuguccagacccugacgaggacauaauuguuguuaucaauauggaaaagguagaagagauggaacugcucagugaggagcuuuaccaagaaaaccaggagcugaaagacaaguacacugaccuccaugagcagcuacagaggaagcagguggcacuggaagcaacacagagggucaauaagaccuuagaacaggaaguggaagagaaggccuccugggaggaagagaaggccucuugggaggaagagaaggccuccugggaggaagagaagaccuccuuggaggaagagaaggccuccugggaggaagagaaggccuccugggaggaagagaaggccuccugggaggaagagaaggccuccugggaggaagagaaggccuccugggaggaagagaaggccuccugggaggaagagaaggccuccugggaggaagagaaggccuccugggaggaagagaaggccuccugggagaaagagaaggccuccagggagaaagagaaggccuccagggaggaagagaaggccuccuaggaggaagagaaggccuccugggaggaagagaaggccuccugggagagugagcugcaccggcugauagaaugcaaccagaagaugaucucagaaaagaaggccuuggggaucagaguagaagagcuucagaagcagcuccagaagauucuggagcagacaguggaaauguggaagaagaaggaagcuguagcguugaggaagcagcaggagcuaaagaaggagaacucuauccugucggaacagcucagcagcuacaagauuuuuuaucaggagacacuaaaagaccaaaucucugaugagaacaaggcacugcagagcuuccuggauaacaaagacuucucuucaccucaaggaucugcugagccagaagucccgucagcucaaguugcugcugagccuuaag

SEQ ID NO: 1133 - RNA, 2912 nt, Mus musculus
auuuagaaaguugcugaguuuuuauuaaagaauaguuacacugauagaaaaauagccugcuauuguuaccacuaaaaucaaugaaaagcuggccuuaacaacaacaacaacaacaaaagacuuguuucaaacaacaccauuggugugcuugcuguuugcuuugguguucagguucaguccuacccugcgcucagucuuaacugaggacauccuagcuccuucugcaucaguuagagguuggaucauaaagagccuucagaugcuugacuguguagcucacaaccuugaaaggcgacaagagcugggacucuccugugagcuggucauucuggaaggagacaaaucggggccugugugcacaucuguuaauucuuuucaggagucucuugggcacccagauagacccugauggggcagcuguguuucucuguuccuguugaguuucagucugggcuugagcacaaaggucuaccuguccuugggaugcccuggguuuacaucaucuaggaagacaugcccgccccaucccuuuuugggcgccacuaacuugggauaaguauccuccauccuguccccaagccgaggcagaugugaaugagcucuuccggccucugugucucacccggccguauccaugaaauuucagccggggacccagauauuccaauaugagcccgugacucccacggugucuuuuccucuuccagggauugggcaguagagacaaugaguguggcuuuguccaggcaccgagguagacauuuguaagcuccaguguggagccaacccuuuucccaccaugugauuauugcgguuugggguuuauuuuggugguuucuaguagcaagaagaccccuugaggcuuuggggaaaagagugucucagugucccuuagaaaagcauccuucuguuguugacaguguguacuuagaugcuuacgucuuguggucugaggacagagacaccauuuccugcccccuuucccagcagugccucagagugagaucccggguuucaagcuugucuucuuaaaggggaacaaaucagcauugcguugugacagaugggcaggauugucuucgccagcaggaaucccugugaggaaggaaaaaaaaaaaagaauaauauaaaaaaaaaaaaaaggauacacugaugucuaaacagcccguggguuccucugcaugaacugugccaggcacucugcuugccuuccuuccuggggagagcauggcccaggcaggcugccugcccgcggcucuggacuaaucugagguauugaacugcagcuccuccgaucuggaccuagaguugcugcagucaugugucacaggcccaugcuuucuguggccuguccagagcgcucuuggguugacuuuacaacaguuucaugucuuuucugcuguguaagcagccauucucauuuacagcccagcaccauagauccccuugcaagcucagagcucuugcuucuggcgggguaugguuuugcugaaauugaaaaccuuccucuaauuggauccacauguuucaaaguguggccaguucuguguuuccagcauuugagguuuucuccuuagugggcuaagcauaucaggacuguggagucaaaauuuaaaguccaaggaaccccucagcaccccacagggauuguagcucccggagccacuguuaaaugcugacaccaggaugcagauucuaguagucguguagauugcccuggacuccccuguguggcauucacacacuugagcuagcguuauaaacugagucaugugugacuuauuccugggacagauacuaaggauuaauaauuuguagcaaaaguugcuguagagaucuuaaauuguggaugguagggucaggaaaacucuaaacaaaaagccugauaugggcugacuuggcuuguggcuauggcuaaaugguagagcccguggcuagcugcacccuaaagcauugcaaagaaagaaagggggcgggggaaucuccaucgaugacugccaacagcaaggcugcuuugccagguucaaccccaaugcggguucacgggccuguuacccauguuccugagaggugaaaccauuucaauccugcacaugggucagaaagaguucugcaaggcucccugugggcaauuaaaggcuuuggccaugaaagugacacuucuuucucacuugauugcaaugaacuucuggucuaugagugaaucaauugucacaucugcccucuuuaaugugugucuccacuucugggggacagggauacagguucucauaaucuccuguuccccaccucugucuugaacacauaguagaacucuaauggauauuuuguccuucuuccccuaaacucuuuauguaguguuucuguccuaugggguauuauaaggcaucuauugaugauauaagauuuauggaaggacuaugucuuuaaauacaaaauauguagcaugcagagaauucucacuacgcccucaaaacgcccucuaguggcacucaagcacauuugcaaauucuucagcaagcaacugauuuauuuuuaagacaaaccaagaaaaauacauagauaucuuaaaaugucucuugucugucagcacuccucacugacaggagagaugaauuuuaauggcacucucagagggacaccacuguauuuaauauauaaaucucuucucuuaaauguggcaacaggaaugcuaugggcucuuggguguucccugccccuggcacaggcuuggaucacuccauaaaugugugugagaugaaugcuugaguagagaugagugauacgcuguagggugugagucucuguggaagcgauggagaaaucaccgucuacuuccaugccuguaaggcucugcgccugagaauucaaucaaccacaagcuguaaaauuuaaggaaaaaaaaugaaaca

SEQ ID NO: 1134 - RNA, 430 nt, Mus musculus
gucgaagagaaaccauucauuuauucuuucuuuccaaguaagagagccucgcuuuguguccuagucuggcuugaacuacagaugcuucuuucugcuggagagcuggguuauaggcacaggcuaggcaggcaggcauuuccucugaacauaauugauuccuuagcaaauugaauaguugcauagcuguaguccaaguagaaacuggccauugaauuuuccaguguaaaucaggagauacaaauguucuuugugcccagcaguugauagaauaaauuugagagagaaucuaacuuucuaguggcaggguagauggaccaugaacaggaaguaauccuagaugaugaauggcacacauaaucauagguacaaucugaucaguguggaggcagacuagcagauucugcuuucuacuagauggcaccauaugcau

SEQ ID NO: 1135 - RNA, 3102 nt, Mus musculus
agguacaucugccgcaccuaccgggcgacccucgagucccggccccuuuuuugccgcuccgucgcccucccgcccucgucggcggaggagcugcggacgcucugauuggcucugggggaagcgggaggcgagaacaauggcccccuccccccguuaaaagggagcggcgcccgggcccggggacagggacgcgcgugcggagcgcagagccgggccagcagccgcgggcacugcgggagucccgaagccgccgcgugcaggcgaugggcuggggucacugagggccgccagggccgagcacggaggugggacccaaccagugcgucgcccuuuucaccgcgccaacaugccccgcggguuucuggugaagcgcagcaagaaguccacgcccguguccuaccggguccgcggcggcgaggacagugaccgggcgcugcugcugucacccggcugcgggggcgcccgcgccgagcccccggugcccagccccgggccgcugccgccaccuccgccgccggcgcucgcggagcgcgcccaugcugcgcucgccgccgcgcucgccugcgcgccaggcccgccgccgccacccccgccaggcccgcgggccgcgcacuucggcaaccccgaggcugcgcacccggcgccucucuacagucccacgcggccggugagccgcgagcacgagaagcacaaguacuucgagcgcagcuucaaccugggcucgccgguguccgcugaguccuuccccacgcccgccgcgcugcucgcagggggaggcagcggcgccaacggcgcuggcggcggcggcggcggcaccugcggcggagacgcgcugcucuucgcucccgccgagcucaagaugggcacugcguucuccgccggcgccgaggcggcccgggguccugggaccgguccuccacugucccccgccgcggcccugcggcccccgggcaagcgaccggcgccccccgccgcugucgcuacagagccgcccgccaaggcagccaaggccccgagcgccaaaaagccgaaggccauccgcaagcugcacuucgaggacgaggugaccacgucgccgguucuggggcucaagaucaaggagggcccgguggaggcgccgcggggucgcgcggggggcgcgacccgaccccugggcgaguucaucugccagcugugcaaggaggaguacgcugacccguucgcgcuggcgcagcacaagugcucgcgcaucgugcgcguggaguaccgcugcccagagugcgccaaggucuucagcugcccggccaaccuggccucgcaccgccgcuggcacaaaccacggccggugcccgcggcggcccgcgcgccagagccagaagccgccaccagggcggaggcgcgcgaggcugcgggcggcggcagcagcgaucgggacacgccgagcccuggcggcguauccgagucaggcuccgaggacgggcucuacgagugccaccacugcgccaagaaguuccgucgccaggccuaucugcgcaagcaccugcuggcacaucaccaggcgcugcaggccaaaggcgcgcccccgcccccgccgccgccgccaccccccgccgaggacauccuggcuuucuacgcggggcccgacgaaaaggcgccccaggaggccucgggcgacggcgaggcggccggcgugcugggccugagugcgaccgcccagugccaccugugcccagugugcggggagaccuuccccagcaagggcgcccaggagcgccaccugcgccugcugcacgcugcccagguguuccccugcaaguacugcccggccaccuucuacagcuccccgggccugacccggcacaucaacaagugccacccgucugagaauagacaggugauccuccuucaggugccugugcguccggccugcuagagugcgcccucgguccgggggcccccagaacugugccuucacucggagacccacaaagagagagcgccccccaugccugaucuggggguccccuacucccauuccagggugaaaguguccucuucgcuucgcuucgguggagcaugaccaccuggucuucucgcugugacuccuuuggaccccaaccccuuugcguugugcccccccccccaagccccauggcgcaacaggaguccgucucuuucuguacaggggaggaaaaaaaugcuguauacguuugucucgugguuggacgccuccuuuugaggggcaaagcuguuuuucuugcuaguauucgcuguguucauggucuagaaaaugcgguuugcucugccuaccaaucucugcucucuaugucuguagcguacggguuguuuugggugaaucuugaggaauaaaaugccuuuauauuucacaggcuguaaauugaacuucccacacgauuagcuuuauuauggcuugugaacugcuggagucuggcuuuaccuuuuuguaugugaacaaaucaaauugcuuaaaaaagaguuuucuuuaguauagccacaaaugccuugaccuguugucuguuggggauuguuuuuugggggugggaggaguucuaacgagaugcuguaguaacugccucaguauaucccggaagacuuuugguuuaaucaucuuuguugagguagggcuauugaguuccuuugacauguauauguugauugaugcacaauuguuauuuauucuuuauuuauuuauauuaauuaugaagauuaugauauuauuugauugcagauucucucucucucucucucuuucucucucucucucucucucucucucucucucucucucucucucucugagcuuucccccugccacuuuugacauuucacugugcauuuuaggaaagaaucguuuuuucuagaggggucugcugaaaguuuuaacuuuucuaucuaucgagggaauuacagacaacauaccauuuuauucugcuugaggggccccaaggcccuuguacaaccgacagcucuuacuuuuaaaugcaaucucuuuucuacauacauuauuuucuuaauuguuagcuauuuauagaaagcuucgauagaacuguuucaacuguauaaauauuuacuauucaaauaaaauauuuucaaagucaaaau

SEQ ID NO: 1136 - RNA, 270733 nt, Mus musculus
ggcgaggcggccgggaggggggcggcuuguggccggagcgacacgcgcccgucgcgacccuaugcagugacucgugcggcgcaggcgccuccugccccgccggcggggcccaggcuuaccgcggcgggauguucucccgaaggagccacggagaugugaaaaaguccacgcagaaggugcuggaccccaagaaggacgugcugacccgccugaagcaccugcgggcgcugcugggugaggcguggggcgugggcugugggucagagccaccugccgggagggccgggucccacccgcggcgugggccugauggggucucagguccgagugauguagagagcugggaauggugcgcagccgaccuuugcuagccuagaucgggacccuugaggcauuguuccugaaggcuguacguuggcccugggcgcugcucugucgucccaaguguaaacuuagccaggauucucuuuugggugccuagccucggguaaccucugugccugagagcaggcacagaggugacuauaagcuguccucuccaggaaauaaaccaagcacaaguggggcgggcuugaacacacacacacacacacacacacacacacacacacacacacacacacgcacacgcagcccuaccucucugccaccuccucucugccaccucccucucccucucccauucuaaaaauuuaaauucuugacaacuuggguuagaccaauagcucauguggucccaucacagacuucguugaacuaccaucucucacucacucuccuuuuaaaauguuacuauguuugaguguaagacuuuagguaggauugauuucagcugaccccaggacagauuagaugucauuucuucucuccugcccuucucucuuuuaaauuuacauuuuuuggggguugggggagggaggauggaaggguccggcugauagcuguuuccuugggucuuuggugugaagggggcucugaucagaggaagcuaggcuuucuuuggguccagggaggcagcuucucccuuaucaucagagugacaaccauuacucccuuuugccuucccuauucauggccugcaggguggagguucugcagagcccaagugggccuggaauugacuugugauggcuugaaagcucuccccugugggugugaaguguccacagguuaucugaugcuggugauguguagcuuggcuaggcuaugcauuaguucuaucuucugucugucuggacagacuuaucuguauuugggggccaaggaaaagacagguuucuucuacauauguauacuguugaaacaauaauaaaaaauuaaaaacccaguguuuuuaaaauuuuagaccaucugccacuugagaaaauagggcacaaaagaauucauuuuauaggugagaauuuuaagcauucuuguuaaugagauuaagaguugcuaauuauuucuauuuauauuguguaaacuauuucugagugggggauuggccagccaaucagccaaccaaugaaccaaccaaaugcaaaacucaaaaccaugacuguugccucaaaaccuacucccuucccccucaaaacccaccagauuuugacaacugaaguuacuaucucagauccccagauauuacacuuaauguguucaguuuauaaugaauguaaaucaguuacuguuagaaggauuaguuucuggacuucugaaagcaaaaugugauguucuugguaaguugaacuuucuccuuccuguagugaaaugucuaggcacacaagugcuuuguguuggguccuuaguaucugauuaguuccugcugcaggggcauucuugauaaaggagaacugaacaguauuuuaaggcauuugauacuuuggaacuuuuucugugcugaagaauuuaaaccuuuguucugaccaagaaggccaagauuaaguuggcuacauuuuauaaagacagaaaaccuagaccagagugguuucuuagagauacacugucuuuguuaccguccagagaaaauggauacuuucaggucugaguauccuuaauuucuccccuaagguguguggcuccuuccaggugcaaguggcagggauaggcugugaaccuggccaauggcaucucuuuaugauuuuaucuuuuuaauguguguguguguguguguguguguguguguguguggugggcuuugugcuagugaguauaguuaccauagaggccaguagacagauccccuggggcuggaauuaaaggugauugugaauugcucugagggacuacugggaaccaaauucuguauaagagcagcaggugcucuuaaccucugagccaugucugcagccugaaucaucuuuguaugugaaaaaaaaaucuguuuaaaauacuguuugcgguguagaguucuuccauauuucauuaggaauacuuuuguuguugaugguggccaaguuuccuuuauguccuacugugaucuuuaacuuuaggggcucuuuuuuuuuucaaaaaaauaaaaauaaaauugaggaauucuauauacauggucuagaccuaggccucccugcucauauguagcagaugugcagcuugaccuucaugugaguccugaacaacuggaacaguauuccaaaagcuguugccuguaugugggauauguucuucuagcuggggugccuugucugaccucagugggagaagugccuagccuuguagagacuugaugugccaggguugggaggauacccacagggguucccaccugcucagaagagaaggggaggggagaggggugagggagucgggggagggggagggagaaggauugugguagggaugauugagaggggggcagugaacaggaaguaaaguggauaaguuaaaaaaauuaaauuuaauuuuuuaaaaauugaggaguucuagccguaauauuugguguaaacuuuugcuuuacaauaguaguuugacgacuuuaaagaaaacuagugcauuaaaguauuaauucccacagcaucaaauauuuuaucugguuauuaccuuuaaaaaagacaaaguauuauuaaacugaaagauaggaguuaagucaaugugaaggcaacugaagggaaugaauuuaauuaguauugcacauuauguauguguuucaacucuugcuugucacucaagugaaauagggcugguauuuuuucacauauaaggaugaugcuacuggucagagucugcagcuugucacugccugcuacuuguagcaucacaacuuggggcaguaccuagccugcucuugaaccucagcuuuguuacucuggauaugguacagugagaguaugauacguaaugaugucagcuuggagcaggcauuuaccagauucuucuuuauugcuuucuucccaccauuaauaggauacuuuuuuuuuuuuuuucccccgagacaggguuucucugugaaacccuggcuguccuggaacucacucuguagacaaggcuggcuuuaaacucaagagauccgccugccucugccucccaagugcugggauuaaaggcaugcgcuaccacugccaggcaggauaccuauuuuaagagguauuuucuccacucuucuuuauuauuuuauauaaugguauggccuuauucucuuuuugaaaagaguuuguacuucagacaacuuguggagaaaugguuaacuaugaagaguaaaauauauuuuaggauuaugauaaugacuccaauucagugcuacuuagauagcuuguccugacuauauuuuuaaaauuggcucucacagggcugcauuuuagaugguuuguaugcaucauugggaagaacagggagauacuugcguucuccuuaugcuauuuaaauuaucauucaagaaaguaacugaguaaacuaaacaaacaccccucccccacaacuccuacguauuacuguauugcuccagugaacaaguaauucagccuuugggagguuauggcaggggcauuauugcuaguuugagaucagucuggguugcauagaaaguucuaugucagucaggucuacaagauccuauuucaaaagacauuaaaaaauguaagguacauuuauaauuuaaaaacuucuacaaaguacauuuaugauauaagagaagcaagugagauuaacuuaaauauauuuuauuuaacauuuauuuauuuauuuacauauauguaugugaguacacuguugcucucuucagacacaccagaagaggguacuggaucucauuaccagggauugugagccaccaggugguuguugggaauugaacucaggaccucuggaagagcggucagugcucuuaacuguugagccaucucuccagccuccgaacuuaauguauuauaucaguagguaaaggcuaacacauaauuuugcaguacuuuguuuauaugacuuaucugaaaugcagugucuauuauacagucaggacacauguuuguucuuacuagcuacauuucacaugcacgguaccaagcuaugacuggcaacugcugggaguaggucuggaguuugggaaagcagaggcauaggguagggcaguucuagccaguagaagaugaaagaguuguugguaaauauccauauggcaaugauguaugagggcggcucucacugguauccauuaggaguuagagcccuggacacagagggugcuugcguggagccuuguguagcucagaguuagagguauccuaacaagcagagucuggugccaacuuggugguucagaucagagaggguucggcuuacuugagcuggaagcucauaccuauccuuaggugggaauuuguguggagaccuuuuagcaggcuaauaaagaagacugagaacugcccaucuccuaggacuaccagaauaauggaucaggaagggagagacagagccaaagguuccuugaaagaguuaugucaggggggacaggcaaacaauggauuguuggaagaggaaggccaggaugagagauaagagcagcaagaacuugugauacuucagguacagugggguuucaaaugcuggcugaagagugauuaauaggaauuaauuugggauuggaggcugugacauucaagauuauuuagaggccagcacuuggaccucggauuuguaagaaaacauuuucuuacaaauuuucucuccauugauagagcauucuauuucauugauauggcauucuauuucuucuugcuuuaacuaggggcaaguucacucacaauuuuggguguugccuuuuucuuuacucauauuuauuguguguguaugaguuacauguguguagucuaugcacacucuuguguguauguauauacacagagaucagaggagagcaucagguauccugcugucacucucugccuuccguucagcuuaagacagggucucccaguaaaccuggagcaaggcugguggccagaaagcucucaggguccucuguacagcuguuagcauggguuguaggugugugugccaccaugggugcugggggauuugaacuggaguccuguacacuuugaauauacagcaugugugcuuacccacugagcccucuuccuagcuccuuauauauauuuagucauuacuguucuucguguuuuguaccucucauucuuaguuucaaacauuugugagcacuauguaccauaaugcaguagccuaggcuggccucaaacucuccaucuuccuuucuuuaccugauguauguauguggcaccaugcucagcuuuuucuuucuccccccgacccccaaccccccccgaccccuacucuucccuccccuucccuucccucucucuguccccuccucuucccuccccucccuuccugcucccuuagcuuacucuccuuucuucuucugacuacaguaauaccucuaaaccagcugguguucuuuccuuagaauagacuuccccuuuuaacuuuagucugacuagcaacacaccccuuuauacaguuugaugauuggugaugggcauuugggaucaugggaguaucauagauggagcuagggaggugcaaggguuucuagcuaauaauggggcguggcaaguuugauguacuacagguuaagugugagaaaaggaagguccaaguggaaugucugggaugagauugugguaugugggguugggaacuuauaaugagaggauagaaaaccaugauaugauucuucauuaugaugaacucaucggcucucccuacaacuaugaugaagguagugcucccacuucaaccuacagcagagaaacugagguguacuaaguuaaccauuugucuaccaacucccagcugacaagcugauauucauaucuaccaggcuggcuagccugguaauagaagccuuuaauucaaacuacucuggaggaugaaacaggaaggcccauuaggccacaaacugaguucaagaccagccucagcaauuuagugagauguacucaaaaauaaaaaguggaaaaaaaaaaaaaagcuaauguugugcuucugcuaguuaucugauucaaaaggauauuuacacaucagaauagauauuuacccaccagagugaauguuaauacaaaaacaaaaccuacuagguuuugccugucuugcaaaauuucugugacguucauagcucucauucuggucuguuccaggagaucuggaagauccuauuugacuugagcauggcagaagauuuuuuuuaaaaaaggcuccuuuugugcuuucugauucaguucauuggguucuguguuuaggccuggcagguagugagauauuagcauagacaagucuacaacuugaaaaggcugggaacuguaaugucagguccuugcaggcauuuuuuggucuuuuucaguuggccaaguuaaugccaaaugacuuuguccauguucccauugcuuguuuuucaccaaucacgaaggcaguguaucuguaaccucugcaauguaaaaugaacuuugugcacucguacgaucccugucucuaggauucaggcugucuagacuugagaaaggugagcccagggccaccaccugagcugaaaugcucugugugugauaccugagaaugauugcuuuccaaugccaguucugagaaaagagauuaucuguaggccccaaauauuuuucuauaaauauuuauaauuuggauuuuuauuuuguugauaagcacuuuauuccugggcaagccugaguacuucuucaaguuguuuauaauacugaucuuuggucuccaaacugagcaaaauagguauaacuauagcaaauugugucuguguuuuaaaguuggauuucuuuuuucuuuuuuuuuuuaaagauuuauuuauuauuauauguaaguacauuguagcugucuucagauacaccagaguagggcaucagaucccauuauggaugguugugagccaccaugugguugcuggaauuugaacucaggaccucuggaagucagugcucuuaacggcuaagccaucccuccagccccuaaaguugguuuucaaaguagcaauugauuccauuuaaaccuugaaaauuuuaaaaaauaacaaaguuacuaaacuacuaaauuaagaacaauuaauauguagacguaguaaacaguuacuuaucaaguugucuuauccuugagauuuuaaaaauucaauuuggaaacuuuguuuuguuuuaauuaguauaugaagauaugugugcaauuguguauauaucugcuguguauuuagauaguaugguauaaggucaaggcuuaggauucaguaggaaaagcagaugcuuaaaugaugaaauuuuugcacaguguuuagagccauacaguggaaugggaaggagcuauggagguggucaccauucagggaggaacuccaccaagccuccuggagguguugggagugcuuacaaaggaaggucagggcugaguugggauaugaauaauagauaaagggcuuugccugguggauaaagaguggauaaggacauugguggagaacagaacuacaaaggcaauccugcagggcaccaaggacuuaagcauacaguagcuuuuguacuggguauagauagacagugagaacccauuggaauguucaaaauagaaaagguggcuguuuuuucuuaaggaaggaucugggugucccagccucuccuaacauuugaaaccuagaugccaagagaaaaucagucuuuguccauuugcagugaaagcucuggggagguaccuggucugucuuucuauuguauggaaaacacauagcuuaaaguaaaccuaguacucagagggaagucuucagagauggggcugagggagcacuauggauacugugcaagcuacagggucuagcauguuuaugccaguucuacccuugagcugcccaguugcaggaauuagucucauccugcuuuugcuuuaguuagcuaaaggcaugucugggcuuugcaacuaaaagauggccaggcaaugugcuaguaagaggcauuccagauugacacuggauauagggggagcuaugaauuuucaauauuuuuuuaaagaaccaugggaauuugaguugauaguaagaggaagaauuaauaagaagggugagaucugcagaggggagggguaaaggaaggcugcagacguggcuuagccgauaagaacacggacugaccaggcauaaagacuugacuuuaaagccuuggcauucauagaagaggcuccuagcucugaguggaguagaaacagaacucuugggauugcugcucaccaauguagcuccagguucagcgauaguucuuuucucaagggaguaaggagaguguuagagugggaggacccccaacauucucuucugacacaugcaugcacaaacauacauacauacaaccaacucagacacgcguacacgcaagcaccgcagagugggggugggcaggaaaagggcuugaugggaggaagccucuucacugcaggacuccuaaagggaacaaaaauguaguacuggaugacagagauguggucagaacgcucaggacauacucucuucucuggaggucaguggugacaucugcuugagccagcuuucuugcugguguggugauaggaacuuggaaugucauacucugucuucugugccauguauaaucucaaaauaaggaaauuuggcaacauguaaggcuugcuucuguucuuuucagaguaaaaaggcauucagccagaaggggguggggggagcugcguaacaugagcuuaguuuaguagagcagaugucacauugccagcucugccacucuguguucacgugcucuggggugggugugaggugggacugcauuguaggaggugaucuggcugugacuguggcaugugaggguuugugugacuuaaccucguguaagcuguaacuccacagcauugacagaucuguucagguaguuaguuguccuaguccaaagucuuuucucauguucuccagccaaucagagugauuccucaagccagaggcucuuucuaaucaugaaauaagcuuaugaggugucggugugugacuguauuauacauacucugcacuucaagcuaucuucccuuguaccagccucccagaucuguccauuccaacggcguuuccggugagaggauucagaauguauuaucagagccuggugauugacuauuagaugaaacucagaaaucgugucguaaguguucgccuuaugaagauacugugacccuugguguccuugacauuguuuccaucuagaagacauugaaugcccgcuaaaacccauguaucuccaacauuaaaucuggacuuuugcuguuagaguugugauucaguuaaaagaaaaagcuacuucgauagaaucgaggagcucacugacugugucuucugugugauuucuguucugcauaugcauugaucugccaaggacaugcaaagugacauuacuuguggccugcuguaggagggcugagaauguaggguucuugcuccugcugcauacagugugauugauuggcagcccucuguauucaucaguuucuuccaaagcuggacuucccucaggccucucacagcggaguaacaaaccuagcuucuugacagcuuugucgugagacuccuuguacucuuacaguccaagacaucucugcucaggguucuccuuucuaccucuccuuuccagggcucagacccccauguagucugaagccucuacaggccguucccagauuuccuuugucucccucagucagucucacacguguguaauucuguccacuucucagagaacgcacaccaagacaccuucucuuacccuaucaaauguuuucuauccugcugucuaaaacgauucugggacaggaugaacacacacacacacacacacacacacacacacacacacacacacacacacuuacaaaagcauucacgcauaucacaguuccacagaaacugccuuuguacucuuguccugaaauuaccuuucuguagaauuuccacagcauuuucaccucucauuggccacuugugcauuuucuuuuuauucaugcuucuuguguucugccucaucuucccuacuaaaugaagcuuauggcaaacauggcagcuucuugcuuaucuugaugccucucaguaacacauuacucuauguagaauaaugcuugggcuggagagaugguuuagcagucaugaacuuguauuacuuuuguagaggaccagaggucaguucccagaagacauguuagauagcucccagucuccuguaacuccagauuuaggcagaccucuagccuccaugggcaccugcagucaugugacuacaccccuucaauaauuaaacauaauaaaaauaaauuuaaaacauuaaaaauuuuugaaaagaauauucauuugguauacuguuuccaguacugccuucuuucaugcauauuaacucacuuaaugcuccuaagugaaauggagacauuuuauagauaagauagagagcggauaagaacucuaugcaaaacucuguaaccaaaagugucugccccuaaggcagguagcucuagagccccuauucauuuagcagcuguaugucagucacagugcugugcuaggcaaugugugcagcauuggggacgccaggguuugcacuguaagucuggauaagcgaguuuaaacaaacaaacaauaaucucagaauuauuauacagauuuacuauauagaacuuauuauacagaauaauuauauagaauuauuauauagauuugaguugggagggaucuagccacccauauggauauauuuuuaaaaauugagagucuuccuguccuaaagauaguuuuuacuagugagaagaugccagcacauauuauuuaagacugugaaucaaauuccccuuaugugggugaauuuauuaucagaccaggccuuggugcccaaggagagcagagguaaggaagcaguguuucugugggcaaaggggacaaguuauccacgugguaaacugaggcgagguagugaggaauggcuuggacggugcuccuggaaaaaaauaggaggaauauugccaaucagauuguaaauuuacaaaauccaaaacugacuguccccuuuucuaagcgaacacuuuuuuuuuccacaaugaaguaguugaauauuuaauaguauuuucaaacugcacagaauagagaagaacugaagaacgaauauuuagagacuaaguuaguuuauuucuguccccuuguauuugugacauaaagcucugucuucuauggacugugucugauaagguaaggguguguuuaccaguuaggccugauguacuagagcugacacagaacucugaacuuugaagcagagguagacagaaugucuacauagcuuccucagcaugugccuucauauauaacacugucaauauuuauuuuggaaagaauauucccaucucucucuggugcucuuaaaauaggcacauacacaaauagaucaccuucaauuaaaaucaaaauuaaauaaugaaguggaacaauauuaaauuaaauuaguuauaucuucaguucauaaaaacugcuauauacuaacaagaaaaauuauaauguauauaugucacaaccagagaaaugagagcuauaaccauauuuaaaugucauacuuuucuaauacuuuaagauauacaaacuuaaauauauuagcaaauuaccuaccaauuaucaaaauugcaguuucccaucccaauaacauacaugugaaguuucuaauacacauuugguaagacuauaauuuaguauagucuuucugggaaauggcuuaaucagugaucuucaaaauguauauauaauuuggcccaauuuccuccuuuaaacuuguuauauuuaaagguuauucuuuaaaaaacauguugucacauuguuugcauguuguucaucgaagugaaauucacauaaaagugaucauuuaaagguaaacaguuuggaggcauuaaguaaugucucugguaagacauuauagccauagcuucuagcuuuugaggcaagagucucuguaguucugacuguccuggaacucacuaucuaauaccaggcuggcucccaucucacagagauccuccugcuucugccucucaagggcugggauuaaagggaugcagcaccaugucuggccuuucaaaaauuuuuauaucagcaggcaaaggagcccuauagccauuaaacagucacaugacugcuacuuguguguuucuguuuagcuugauaaaacauuuuuuacauuuacauuuuuucuuaauucucagccaaaagaugugucagcauuuauaccagccaacacccaugugugcaagaauugcaaaccagugccagcugaaggaaggggcagaguauccagaaaacagugaaaggucacauuuggccuuagauaugacugucugccagauagauauaaaugguguccagagcauucaccagcucacauccguucacuaacuuuuauuccaaaucacugaggaauccugaguugauauucuguaaauuauuuaaggauuauuuacucaauuugagagaaauaaaucacugucuuuugaagagagagguuugagcuguuaagucugucuagaguagagacucuccauuggucuuuaaguuauuccagagaauuaaguuauuucacuugccugguauucacaaaucaaggcccagcccucauaggauuuucauucuaccaagacaagcaauauaugaauaacaaaaaguuuauaguguaauuuuaaguauugauagaaaaauggaucuuggucaggaugugugugcgcaugccugucuuguguacaugccuguguagggcgucagaagaggcuuucugauguguuuuguugaagaccugaguugagaaggugauggcuuugucauuaucuuaggaacgaguauuccaaggaaggugcagaggcuucaagucauaacugucuuggaauugccccagagccccagaguucgaugaaaaggagcaggggugaggccaggaggggaaagauaagauaggagccccagggugugauggacagggagcugaauugcugugcuuccuguuuggguaaguagaccugcucacuagacgcuggcugucucacugcgagcucucuauugcuuauggguuaguuaccuuucuaaugcagugaugcaacaccacgaccaaggcuuagagagagaaggguuuauuuggggcuuacaguuacagagggcuaaguucaugccuugucccagcagggaaguguagggacuggagcuggaagcugagcgucaacugggaugacacauggcuuuugaaaccuugaaggcuaccggcagagaugaauuuucuccagcaaagacauccuuccugagccuccccaaacauggucaccaacagggaagccuaauauucaaugccugagaagcgggguuggggguuggagaucucauucaagccaacacagcuuacuuuaugaagagucaaaaccuuuguccuaagcugggcagugacuggagacaaaagagaagagagaaggaagugguauuggacagcucugagugguguagaagcuguggcaugcauacuuguggagaaagaggggacacacaguuuguguccuuccucgcucugcagggaccagugaugaggaugcaggcuaggaacacuguggcccauggaacaggaaagguagaguauucuggaccaugugcugcggccccacaauggacugcacugguaauuggguaauaggcaaagacaggcaauuagaaagcacuguagacauggaggaagagggagacaggccauuggcugaaaaagacugagcugagaaaaaugucugugggucagaauaguaaugacucagcuauauaaaugaugacaaacagcagcagacccugccgggaggcucauugcagguuuuaacgcuuuuuuuguauuuugaggguuucuuaauaaaaagaccugugagaacuuugaauuuugguuuaguauuaacuguauuaugaauuagugccaccgagccuugugucuuucucagacggugguugagaccaggcguacccaagaagacaggggcacacacguuccugggccucagcguguuaaccacugaaagcacggcauguguucucuucugaccacuuuuguacauguucaguuguacuguucuguacugugguauugcugugaagagacaccaugaccaaagaaggguauaaaagcauuuaacugggggcuugcucacaguuucagagggugaguccaugaccauccuggcagggacauggcagaaguagcuaagagcuuaauagucugcaagauguaggcagacagacugggcuuuugaaaccucaaagccaccagucacacaacuccuccaauaaggccacaccuacucucucccaaaacagccccacccacuagggaugaacgauucaaaugugguggccuuucucauucaaacuacuacagucugcuugcaguggcugcuguagccuaagccucugggauccuucagagacaauguuaguucaugccagcaaaucaauaaaugccugccucccucuuuagagagcagcuuaaugguuagugcuugcucuucugcuugagagcccaaguccauuccaaagcccugcuuguaucccacaugcuuuccugagucuucuuacugcugucuccagccugaagaucccaucaccuguacgaugguagacucccagagcugucauuucugagccuagaccaucucauuagcacuuuauagucugucuggcagaguaagagguugacucauauggucuaaggcuaccaggucuuguaaaugaaagcuuguugugauuggagauuucaucaccuuuuuuggcaucuuaagguauccauguuugcuucuuuccacucaguacaagcucuugaauaugacauaagcaucucuugcuguaguuguguuuucuauccuuucuacugaauuauagauacacagccuuucccaaacauaacuaaucuccuuucagcaauuagaucauuaccaagcacuccgagcaagguauggugccauuccuaaagugcacauauuggacagggaauuugugaaaauugcugcuuuuagaaaugaucaagcuauuauucuauguaucauuuguguuaacuuuucuucagaauugaaaaguuguguuuucaaguuuaaagaauaguguauccaauguacagacugcauaguugcuaauuucuuuuauaguaguucaguuuugaacuacuguaaacgaaaguuuuucguuucuuuacaaaacacugggaagcaacuuuucuucuuuuagcuuuuuuuuggggguugcauauuuaauacaccuauuaugaaaauuugaauaaugugaaugagcuuugaguaguguaaaaaaucauuuaaaauuccgcaguccuuuauccauugcugguauuuggguaaaccugcucucuugcuugugcauguuccccugucucucuugcuuucagcugugcuugugagcacccacacacaccaccuguuugcacgaguuaucauuauacauagucuaaugcuguguuuuuaugaagauaccuuaaacguuugugcauuccaggaugggaagacuuauauuauccuuacguggcuguauugugucuuacugggcuccuauaacaaacuguucacuacuccgguaguguugcuauagcaauuaacgcugcucacauuguucugccagcacuggugcaagauccucgcuacccgcccuaauguucugaguuccagaaagaaagacacacaugcacacgcacaugcuuccccuccgauacuccugaguuauuacuuaguaaaaucuauauuccaucuuugcugcccuagacccaaugggggcagggagggcccuggggcugcucuucccaggcucuuauaucauuggugugcucucucuucugcagcucucaagaaagcuuggaucuuauuugucuuccuucucuugguccucuugcuugggaauccuaaauucccugccuuugucucccugcccagcuauuggccaccagcaacuuuguuuagcaaucagaaccaacugagggcagggacccucacugucuuacaugcaggauucuugugcaauuuugggaacccaauuaauauaauacaaguguuugacuaaauccacaacacaguagguugugauuuuuaugcucuuacauucugucagcagauuguaugccuacaaguggcucccagugaacagacaaggguuuuuuuuuuuaacuuguguaagguauacaacagaggucaguaauuuaggcugaugacagagcaagaacaucauuaugauuuucuaaagguaaggacaguccuuugggggaaggccacuuaaaucuuuauuaaaucaauuucacauaaaagccacccuuuuaaccuguucaugaagaaggucauuucaauugcacacugucacugauacccuuuuaaaauauggagaugacucaguggauaaagcaccugucccacaaauucugcacuggacucgagugcagaucucuagaacccauguaaaagccaugugaucuuggggccauauguaaugccagaaguaguagagauuggauccccagagcaagcuugcuugccacacgaggacagaaucagggaaccaggaggucugggucagugagaggaccugucuuaagaaauaauguggaagauagcuucagguauccacaaaugugcucuaauaugcauaugcagcugcaaauaugggaacacauacauaucuauacacuacacucauaaagaugcaaaaauguaaaauaaauuaagcuaccuucuagguuuuuuuccccccuucuggauuuaaaaugaaccuguagcuuaugccacaucucuccuguuucucucccuccccccacccccucuccccuccucuccucucuccccucucccccucucccuuuucccccucuccuccccccucucucuaagcaaauugaaaugaagugcauuuuuuagguguuuccuugcacucucccaccacuuuuuguaaguguggacccaaucaacugagcagcggagaguccagccaugugggguccaagcuggcaugaagugcccucucuaacccuucuaucuacaggcagugaagacuauaccuuccugcuguuguugcuggaggguuaauugagucacucuaugcagagcuguuuuguaggcuauuauuauaugauuaauaauaguuauuugacacagacauuauuugauggccuucuccaccuucuuaaccacuuuuuuguuucauuagcuguugagaguagcgaguaagaagugacgaucuaugucuugcuuaccuauuuauaaacuggucccaguccacuuuagaacaguauacaaguaugauugauuggcuuaaaauguuuaaugagauuucugugagcuuuucuuuucuuucucuuucucuucuuuuuuuuuuuuuuugggggggggcggugaauuuagagacaggguuucucuguguagcccuauuuguccuggaacucacucuguagaccaagcuggcuuugaacucaagagauccaccugcuucuccuuccugugcuggaguugaaggcaugaaccaucaugcccugcuucugugagcuuuucaauugguacuaguacuuauuucauauuuuauuucagccaucugucugcaaagauguuuuugucuauaacuaagagaaaauaaauauaaauguauaaaaggaauuucccuuuucuauauaaagagguccuaacuagagugagauaaucuagcuauucuguaauguugacugaccaggcuuccugccucucugcugugucauccucacuaagacagauuuguacucugaguaucagacccacagccaccuggauggagugauacccaugauauccagggcauuuaaaaagcugcuucuccuuaagucuauucaggagccaugagcacuuccccaguacuuccaucagucuucuccuguguggauggaucagcacugugucacagacuuuggccuaugacuguaacuggccaggguuauguugccaucauaauuggcucaguuacaucaggcccacucccuaugggugggguauaugucagccuucccaguggguacagcucugugaaggaguaaaccaauuuucuguuaggaagagugaagggcugacugagggagcggguaggugggugaaggaacuagggagaacuaguaguguuggcuucaggcagcaauaaugcuuuugucugaagugcauggagaacccuuauggaaaucaguugccaauuauggcaagcguacauauguacuuacauauggggacauuaaaaauuaguguaauuaguauguaacuaaggagacacuauaguaaaauaucaccauaauuuauggaauaaacagaacuauccaagaagccaaaagauacuuuuauuuccugaaaaugaaacuguauuguagccuggcaguguggcacaugcuguaaucucagcacucaggaggcaaaggcagguggaucucugugaguuuggggccagccuggucuaaguuaagccaggauaguuaaggcuacacagagaaacccugucucuaggaaaagaaaaaaaaaagacuauguauuauauaauuuuggucccaacaugucuucauuccuucugaugguccaguaguagaacuugagcacaggguacaugagucuuuucucuuggccuuggaagcacuuaacauugcccuuuguauuaacagugacaagcuccuuagaguguggcaccgaaagccugguuagacuaggugccuucauucacuggucgcucuaacgugcuuguuuuguuacuaugcauuauaaagcacguaauuuuguucauuacuugugugugugugugugugugucugucugucugucugucugucugucugugugugugugugucuaugugugucuguguaugugugcaggugccuacagaggcuggaagagggagucauaccucacagaacuaaagucauaggagauuauaagucauucaaugugagugcuagaaaccaaacucugguucuuuguaagaaccagcaagcacuuuuaaccucugagccauuucucuauccccuaguaaaaacuugugugccuagcauguggcuuggcuucagauaaaugucauggaugaaauagacuuggauuuuggcugagggacaaugaaagagugaggcugaugagaggcuuaguggguaaagguacucgcugccaagcuugauaaccuagcucucaucucuggggccuauaugacagaaggagagaaccaacuccagcauguuguccucugacuuucauuuuguaugcuaccacauguaagugcucccccccccccccaguaaguaaaaaagaugagcuauggugacuaaguugggaacagcgggaaaggaggacuugaguacaacaagaugguagauuugagacuugauucaugggccaguaggguggaagaguuguugggguuaggguugaggagugggcaggaaagauaagaaauggcagggagaaggagaaugaaucacgugaaaccaaggcuuaggagguggguaguaaucaccaggucugggcucuggcucugggugugggugguagagguggagccugacaacuacauuagcgaugaggaagccaggcaucauccauguaaauguugaaaucaccaauaaggaagacagggagccaggcccuaccgucacuggagaguguacuggagcauaagagacaguaccacuccaguuggggaugggguggccauuggucugugauggauggugugaugaacagcaaaggagcuuuuuguauaugugaggaaaggaccagaauggcuuagaaauugucgugcgcgcgcguguguguguguguguguguguguguguugagauuucaggggcuuggguuuauagugccacaugaguguaggcagauggugaaagccuugucuguggcuguaagggaaguguucugaagggauugccagguuuagggaagaacucuguuaaaaauaugguggaagagaggagaggagacuuguugauauuacuggauauugcagaugggugggcuguguuagggaccugggaugagagucaguagaauccauauuuguaugguguugguaucuaagauaagggucacaugagaugaauacaaaccugaggaagccuugggaauugucugaauuacuguuccugauugcagccuuaagguuucuuaggcaguuuaugguaggcaggugagggagagggaauggugucucucagagaacuaggaccaauuccuccugcuccauuggguggaggagauuaaaagaggagccagaauuauucugaguacauuauuaguuaauaucugaaugacuugggaagugacugcauaucaaauaugucuagugccuaaaaguggauggcacuagacauauuuguacuacaugggacaacauagucuuauguguuacaaagaauacguaugaagcagacauuggucaucugguucuuaaagcuucauagaaauugcauaagugucuaagacugaaaacaauaugcaggaaaagagaugaggaacagcagggaggacugagauacauggcagaguaauguugagaggugggguuugcuuuugaucugacucugacaucaguaacucaagaacuuacuguuggcauuuggguuugugggacagaacccagaugaagaguaagaauuagggccagauuugggcuacuuugugugcugagcucaaggcugaaucuguggaagguaugggcucauuaagaguacuauauguugguuuucuuugugaaauucuuuggaacuguugaaaucagaacuuuguguuuuaguuacuuugagagauaaagggaacugguaacucagaggagauaauuguuuuuggauuagggucuuacuaugcagccuugguuggccuagaacuugcuauguagaccaggcuggccucaaacucagagauccauuugucucugccuccuuaaucaaaggcauguggaaccaccccuaguacauauuuuaauuuuuaaaaugugaauuuugguuguauuaacucacauuugugccaagguuaggguuauggcuccagggguaaaguguuugcugcacaauuuuugaggggcucucagaacucacauaaagcugggucuaguguuuauguguuacccaguguccuaaggugaguuggaaagcagagaagacagucuguggaagcuuuugagggcuaggcauccugggauaagcaucagugaacaaccaagagacccugucuuaaacaaugcagaaggcaaggacuaacaguugagguuauccucugaccuccacacauaaauguuggacaaggcaggcauaaauaucuuccuguaaauaaguguggcaguaauucaucaucuucauuaucaaggaauuugcuuauuaaaaguaaaagagaaauugaugucaauucauuuuaaaaucauauaguggcaagcuuggaagcuuugcugucauuucucugaccagauuucuuucuaauauaucagacuuaaauaauagaugguauauagaucugaacuaauuuuauaaaaugaauauugacaguaguuuaagggaugagcaaaugcuuauguugcuauuauucugaaaauacuuagaauguaauaauuguagaguaggucagauuaacuuauuuuauauuuagaugaaauugagcauauuagggaugguauggcuguggacuuauuuuguaguuacgauagaagccaucauccugucuucuuaguuggaaaucauuuugaccaauauuguaaaaaguuuugcucugauuuuacaaauaagucacuuuguuguuugcugugaucuucaggaaugcuuuuguuucauccauagaaagggauuagguuaucaaccucaugucuaagucuugcgcgcaccggacucgaccagcaagaacgaugcugcaacaggauccuucugcacacguuuauugggagagcuugauugcagaggcgaaaagacuucgagcccagaacuggugcugcuuuuauaggccuaggagaggcgugucucauacccggauugguuaugcacuaagccucauuugcauguuccucaucugauuggcuacucucucucaguaccucacagagccucauuaucauaccucauuugcaugucucacauccgauugguuacucucuuaguaccuuacagaaccucauuaucaugcaucauuugcaugucucacaucugauugguuauacucucaguaccuuacagaaccucauuaucaugccugggccaggcagugucuuuacaaaaaacuuuacugcauauguacacauugguuguuuguccaaucuuaugcaugguggccagcaguagucagugccacucagcaacggcacauguggcuucccacaucuaaguucugcuggcaugcaagcaggaugaaagcagcagugugcagcuaggcuggaccccuccugcuagcugacuugggagggaagcagagcuuacuuagauagggugcugaaccuccuucucucagggaugaacccaucuugaccaccuauuuuaggccuuggucacuuuauccucagagucuaaaucuaagucuugcuuuccauuguacacauuuauauuucuaucuacauaagcuuuguguuuguauauggaaacauaauagucuuuaguaagguuauaauuuugguuuuuugagacaaagccucaauuuguaucccagacuggucuagacuucacaaugcauuucaggucagcuuugaaccugugacaguucuccugucucaucuuccuaguagcugggguuauaugcuucauucaucauacccagcuaguauaggauacaucuuaagagucuucauaugaaacuaauuuuucaggaauggauuuaucuuauaauaaugauagcuuaaauguguuuguugauuagcuauggcaauguaaucauuccuuggauacuuccuguucuaugacgaauaagcugcugagucuggagaggcuuccugguacaguuuguggccucuccuagauaagcuccugguguuuacccacgcuaacacuuuacagcacuuuauagcaugaggagguacucagauguaccaguugaugucacgaggaguccuucccuaacucaggcuagaacaagucacuguugacaagaaaguuugcaucaaggugcagcugugcauggcaucaugaagaaaagaaggcacuaaccuaggcaauuacuuaaauaugagaucagaaucaugucagccucuaaggcuaauaauauuggcuaauaaagccaauuauaucaggcuuaucacuagugacauacauuucugacaaaaauuucaaccuugucugccuaguuuauuguuaauuauuuauuauuuuucuuaugcaugcucucucucuuucucucucugugucucuguguguauauguguauuguguaagugugugugugugugguuuauuuauaugugaacuuguauaugaauacacccuuauguccaugcucagagguugacauuugguguuuuuuccauuguucuccauuuucuugagagagggucucuuacuuaaguggagcuugcugaugcagcuagacuggcuacccaguaagcccccagaucugacuggcucuaccagaaauugcuaggguugcagaugugugcugcaauuggccuuuucauagguacuggagaucugaacugaguucuuaggauugcuggagaaacacucacugagucaccucccuggcuuccacuuuucuuuuucauggcaaguguuucuaaauguuuguuuuaguaagucaccuugacaagucuucacuuguccuuuuucacaagucuaugguuuugaucaucuggccuucaguaacauuauccaggaaacuggauuaaaauagaaaguccacacagauacguguagcucuggggugugguuaaaggaggcugacaguccucucuuucucauggaagagccuggcuugggcuuccuccucugcguuugaguccaacagggacuccugagugugcuaaaggcuucccuucacuugguuagagaucuguuggaacaaguucucaugaagcuauguuaugacucuucuuacugaggagugauagaauugccauugagaaggauuauguguagaaagagauggaaggagaauuggccugguuucauggguaugcuuguuggcaguauuuacuguugaguugggauuaagcacuauuuagugugggauggccucauuaaguguaugaauuucugagucauugaauuugauagcuucauacauaagugagguuguguuauuccuggugagagagcuuugccagaagcuaaguaauuauuaaaaacaacuaacauuuauauguugccaacugauuuucuacaagcacucugcacaugcuuauuuucuuaucaccauugccaugcaguauaggaacuauugcuaguuauauuuuucacaugaaauugaggacuaguguguacuugguugucucagaccuuguagcuucugcgcuugaauccagacaaucugcucugaagguuuugcccuuugccuuuucuguuuacuuccaacuagaaguggagaaagaaucagugucaggcuuagugacaggugugcaaagagagaugcuaggaaaguucugcaguggacuggcugcugguggugaaggagcgggagugauauagguacuucagaaacuuagagaggacucaggcucugcagggcugccuggcauuugcuucccugugguguuuuggaagcccuuggcugaguugcaugaugguaauaagauggaaagcaggcuuccuugucagagcuggagggucagugugguuuccaccuuggacuccgccuggcccuguccucccacuccucccauccccuuuccucagaagacccugaggcuguggacgguccuuaguccucugcagaaagagcauuuaguggcagaugugccacuaaauuugaacuguaguuaaaacaagcacaguccuuucucccagucugucuguaccuccccugugugacuuccaccuaguuucccccuguccagggacaugucauacugcuucauucccuagggcaugcuagauuuccugaucaaaucaggucuucucuuuuagauacagcccugcccuccacucauacaucaguauaccccugaaucaagaacaaaauuuuacugauauuuucuuaaaacaauugaauaaaagaaacacucuacaaaaguuagugauaagauaaugacuaccacuguacaucuccaagcaggaaauccugaggccauuagaacauaaaugucauguuugaacaggcagauucugaauaaggccuucaaggguuccuggaaagacaguguugcuccuaagaauguauggacuugagcauugcagugagcaugccacauuuacaguauuaguuaggacuucagacacagggaacacuauucugcuacagauugaauggcagcauuggguuuuuaucuugaguaauauuuagaauuuugagaauguuucuacuuuccuuuagauauauaauucuaaaguauaaauuccaguggucaggaccuuguaaacggcacaagcaauaucacuggcuuagaggaauggacaauggcuugcugaaaauggauagcugcucugaugaggguuuuuuuuuuuuuuuuuuuuuugccugggcugaccaggcccgugggaagaaagaacccuagugggaaugguaacuguaucacccaccucucuggcauguagucccuggucauagcagaacucugugucacggcaggaacacaugauccauaguauggagguggagugagugggggcaggguauacauggcuccagggauguguuaggaaugcacacuaggucacuuggacugcuuucucuucaguaccuagagcacuggugguggagaaggaggggcucauaucugcaggaucuccacaaguugcuuuucacaaguccaaagaauggucccuuuuugaaaccccugucaaagcugcuucuuccaugggcuuccauguuuccuucuccccaaagaaaacucaccagacccauccacguccuccaaacuuuucgcugguuugugagggucguucccucaucaggucuggccuucgugggugggccguacaguuucuuggacauugaugugugaguggugcccacagugcaagacagagcucacuuaggugaauagccaagugagcacacuguuuuuuuuaucucaugagaggguaagacuagguuuauuuucucuccuuucugaaaauguuugugaauccuaauaauguaaaugcaaacuucucuuuucagauaacguggaugcaagcgaucuuaagcaguucuuugagaccaacuauucucagauauauuucaucuucuaugaaaauuuuauaacacuggaaaauaguuugaaguuaaaagguaagcauuucuacaacucuuuuuugagcacuuaggaaauuuuggaaguuauguugucaugagccacaaguucugcauuuuuaaguuuucuuucuucccaggcuuugggaccucaugcugguggacugguuggcaucucugucucccuugagucuucccucacacagggguaaauugaacagcagauggcuaaagggaaauagaaggaacucacagaaggcauggauuccaaaggaguaauucauuuaaagagcaggggaggaaaauaaugcauggacgcuauuuuuuuuuuuuuuagauccagauuuaaucuguuugguugcacaagcuauaaucccagagcucuggaggcagaggcagggaaagcaucagccuggccuacauagugagacuguaccacuaaagcccaaaaugacacaacaccaccaacagcaaaaccaaauuccaucagaggggaugagagaugagaugagaaucaagugucuccuuuguccauaucuccuguccuuagagauuuucuguauuaucagugagucuccucugugugcucauguauguaugcccaugugagggaaaacaacgcagccgugggaguuuggugagggaauuguguagagucagagccauacucuccucacccuucuugcuguuucuccuugagcauuacuuggccuaucuguguugguguucacccccacucccacccccacccccuuccugucagcaagaagcagguuaacagauacacuaggauuucagcacagagguguagcacgcaguauggggaagcugccaucauuaucuuugcuuuuccguuucaugucaucuguuuuggaaguugcuuaggaaaaacaaaggagaguguuuucccuagucucucguaccaacuuagcacagcauucugcugcaaaucucucucuccagcaaacaucaaaaacgggugcccauuaacuccauccagucuugccaggcugcuugggagauguuucagauccugcaggcuaagggcggagugccacaagacuacacccccgucccccaccuuaacgccauuuguagguucuggguugcugccugugcagugacagacugccuauauucaggaaucuacuacucuuuucuugggguugguuaauuugcugggggagcuggcagaauguagggaaacaaccuuacuuacuuauaguuauuagaaaauucuuguucauuuacuucguuacacaugaauaacacagauuuuagugggugccuaugaacagacagauaaagagcugugugugagguuuggaaagcccugagcacaggaaaguccuugcuauggaguuggggaaauccacucugcuuauacacgauaccuucauuuccacaaucugggaucucccucagccagauucuuuuggauuuaauggugcuucauuauguaggcaugauugaucaguauuagucacaggugaugaacucagccuucaggauggugcugguggauggggcugaaaguaggauuuggagugaagaacagcauugcagauagaggacagagcuugagcaaaggcaaucaagugcccuuagggcauguuugggcucuggguaucuuuuccuugugacuuaaauuaugugaaugaaauguauaggaaaucuaauccugcuugccaggagcccugauuuucaggcuaaugaguugggaguucauuuuuaguucgagcccuuaaaaacauuuccccugagacagguguccuguugaguggugagugcauaggugaguuggggguggggagcugaugcugucacccaugugagagcugcugcucugcuggagaacuggagaggacugacagagcaaggcgauggguaagggaagagaagaggucugugagacugaacacagaggagagagaaaagucaaagaacccuucaggcucccaguuugauuuaugagguauuguuguagcugcaggaaccuuugaggagaaagguauuuggagguaugagggugaaggcagcucuggccagucuguauuugagguacuuugggacacucaggaguaaguguuggcugggcagcagcuauguuugggagaaguggguagaaacuugcuguugccaaggaugaaaguauaucaaggaaaagggagucagcaaauaaaggggaggagauauauuaguguuguugggaaagguguuggggaauuauguugucacagaagcugggggagagauuucauuaaggcaugugagaucagaaagccugaugauguagaaagaugagagcucacaucugaccugaggacaguucuuggugaggaacugucagaagucugacaggcagacauggagcagugagguguagaucccgggaaggcacucuugcagcugugauguguagacagagagccugucuuaagcuggucaugggcgaggugcuaagggcugcaccuacagcccgaggacugggacagccagauggagaaauaacacauagugugggugcuggagaagggguccagagagucaaguaaacaguagagagacacaggcaagagcagagaagcucuucugucugagaauauagacacacguuuugggauaagaaagaaaaacuaaagggcuuccugaaguggcccaauugcugugaucaaacagaagugugcccugugugugaagugggaggaauauggagguuagaccguguaguagccugugccugggaugccagcauuuauuuauuuauuuaaaaaaaaaaaaaacagguguuucucaauuucuaugucagauuuuuaagguguaaaucuuaaucuuaggaaaauuuauuuuugcccaaaggguagcuaguacaaauauaaaaugaucuguauuuacuuuggcaguuuugcucuacuccacuuugccuuacaguauguggaggagaaaggggccaaugcuuugcacaauuaaaauagcaaugagcugggugugacagcucaaaccuuaauuccaguacucaggacgcagaaacaggaggaucucugaguucaaggccagcuagguuuacauagugaguuugaggucugccaaggcuacauagugagaccuugucucaacacacaugcacaugcacgcaugcaugcaugcacuuaccccaaaacaaauaaaaaucaaugaaaaaacuuaauauauccaauccccaaaaagcuaccuuuccaaaauuauuuuuucacaccccauuuucccuucuuuccucuauccucauuuuucaccuuucuuauauccauucuuuuagaaaauuguggcauuuuaagacuauaucaguuaguuugugcuguauaaaaacacucccaaauuaaaugcguugagacaaccaccauuuagcuaugguucucuugaucugcucagacaugcuucugguuuagccuagcuugagcucuuuggucagcugguuugaguggccucacucacaugacucacagguggccagaugccuuaguucuaggaccauguggaugcucacccuccagagagcaggccagauugcucuccuuuacaggguggccucagucucagcaucagcaagaacgccucacauuugcuggagucacauuggucaaaagcugucaugaggcaguccagauugaagggauacagaaagagacaucucugugggaggaagagaacucugcccccguaugggaacucucagaaagacucagugaugaaccaauaggagcagggugagauauuugggaaguucuuccuuuuagugcaaucuguauugaauuggaguccaaaaagaaaaaaguguacccccaaaggaagaaaaauguuuaguaggaauaacgaaaugaauuuauggcaacuucagguuuccaguuauucaggauaaaaccuuggagaaucugguucucucuucagaaaguaucauuggcugccuccucaccuaugcuaauaucaccaaagcuucuaguauccucgucuagacugccacuagccacagagaaggucuccucacuucgauucuuugcuuucuucuaccuucacguuucuuuucaaaagaguaacugaagccaugacuuaggcuuacugacucuagcccugcaauggcuuuucauccucaaagucacuauagugacuguauccugccucucaucugccuucuuugccacacuugcucucuaagcuuaucugcuccaaugucuccaucuuugcuguagccuccagggccuuucugacucuaucaagcaugcuuagccacaggaacuugguaugguccacacucccucccugggggugacucccucauauuucuguauggcuugcuuuuuugcccguuguaaagucccuuucacuuugggaaaguugucuagcuaucacuuucccaggaaaguauuuuuugccuucccuuaucaaauugcauguuggauuuuaauauuccucauuugcuuuugcucauguguuuucuagcuuauuuauaguuugccuccucugggcaaaauguaauauuacccagggcagagacuuuugcuucuuugguuuauuccuugguccucaagcccaguagaauuccugaaaaacagucuuuguaaaugaaugaaugauggcuacuucuuagagcuauaaacauucaguuaggucaggagccugaaacugguuguuuuuugacuuuguuauuucacuuguuguugagagagguucuugcuaugaagccuaggcuggccuugaauuccuggugauuuuccuuuucccacuaccagcauuacaguugugggccaccaugccacacuggcuucacuggauacauucauauccacucauuuacauaauacagccugugacuacagagucugauaguugcaagagagauccgaaaagccaaaacuguuugcucucugaugauucuuaaguuagaugcagcuaaauacaaugacugggacauagcauggacaauaagugguaauuacuacuggagguggguggugcaguucuuauauuauuaucaauuaauauuaucaaagggguauugugaggcuguggauguagcucaguugguagagugcuugcuuagcaugcaggaaauacuagguuuaauucuagcaucacauaaaacugaguauaguggcacaccuuuugcaaucccaguacuugggagguagaggcaggagaaucaaaacuucaaggucauccucaccuauuuagcaaguuggaggccagccuggggugaaaugagacacugucucaaaaagcaaaaagugcaaugugaauuuguacaaugaaggacacagacuuuucucaguagauguccauguucuuuggcuguuaauaauaucauuuuuccuguucauuuuacuguaauuugagccucuuaguaucuaguuaauaaaccaauuagaggaggggaggugagaaggauugugggaggaggugaccaggaguggggcagugagugggauguaaagugaauaaguaaaaaauuaaaagaccaauuagacaguauggagguucuguacgaagugcuagacuaagagauauaguguaagggguggcuguagccgacacagacuugaugugccauuucccugucugugcauuccuagcggcaccccuccccgcaguagguccccaugcaugucuuuagcauuuaagaugauuuucagcaucaugugugacguucuaaagcuuaagugcuagcuuguugacuaauuucuuuuucuuaauuuccagggaauaauaagucacaaagggaggagcuggacuccauccucuuucuauuugaaguaaguuuugguuauuguuauuugguuauuauuauagcucuuaaaauccuuguuagaaauaagguaucuuaguugauccuuacuuuuaccuguguaauagaaauggcugugcaugacuguacccugcccucuuuccugccuucuacccauguuuuaccacauacugucaauaauuuauaugauuuuucuuuuaaaaaauguguagaaguguuacuaguuggaagaguaaacaaaauuuaaauaguaauagcuuuugcuauuuaacuuuccauaugaacuuuuauaugaauuuugcauaaauguucucuaucccccaaacuucaggugacuuuucuuacugacauguaaaucugacauguuuuccuacacauauauguaauauuuuaaaaauuauuuauuuuuaugaauaugaauggggguauguugugugcauguaugucugcacugcguaugauaauucauuaauaguguagaggaauuuuaguccagcaacauggcuacuccgacaagggaucacauccaaagaguuuguagguuuguaugaucccgucagaaugcagcaacacucuggguuauaguauguuuaggcuagaauacagacacgcccuuagugcacaccgucaaccccuaacaauaaaggaaaaguuaguuuguagaaggaagagucauguuugaaagugacaucuaauugaggggcaaagugacaaaucagagaacgauuggacagacugagucagagauaggauacgccuaacucacgagaacaggacaggaaagagaggcuacuuaagagcauggagguggguguguguggaaguagaggugggggguagugggguuggggguguauggggguuuuacuggaacagcuugacagagacagguucucagagagaacaaacuagacacagaaugagccagagaauaagaaggagccagaagacuagaauauauuacuaaaguuaguaugaggccagacagaacaauucugucagaagccaagccagauugaaucagucagcuuggaagauuagauuguauagaggcuagaagcuuccaggccuagggcuaaggauagagcagagaaggaaauauucugggcucaguccaagauguauauucaaacagcuuggguacaacucucaucucauuacaucaucugaggaaauaaaagugacauuuauacauagcuugaaguaguggugcauaguuugcuauaagaagauaaacuccuccauguguguguguuugugugcacgugcauguauguauacaugucagugaguucccugauuaggcucugcuggcugaccagaaagcuccaggaguccuccugucuuugcuuucucagcacugggaccacacgcaggcaccaccgugugugcucauaugaaaagggcuuuucuaguuaagcugucuccccaacccaaagaagaaaaguguaugacuguaaggaaaggccaaauguggagaccuggcuggagggaagacuaggaaaggaagcuguggugaauugugaggggcuguuugaauggaguaaauuauggcaugggacuuguuaugauaugguagauguugggaccggccagcucagagcccuggauaugggucugggaagcaucugagcuggucauuuugccagcucuucaguacucacacugccaggaugaguuccucagcacugcucugauuggaaaagaacagagucagcucuccagcucuuaggcccuccuggccagcucaccugcugucucugcaaccagggccagcucuacuuuguugccuaggugaggugcagggccuguuuuccccaauucugcaacuggugaggaccagcucuccguaucgaaugacccuggggacacucuccccaccaccucaggcggcaagggcaaggagucagggagggcaucucuuggauaauaagcgugcauuauuuuaucccucacuguauuuacugugguuacccuccaguacgucaagccuaugcaaaguuauuuuuaucaggagcauuaauuauugaguccauugcuuaaaucuguuaacuauuauaugcuucacuaauuucauuuauaucuguagcaagguauaaauuuaccaaagaaucuaacauuuuaacauuacaaaguuugauaaaaagccugugguccuucugccccguuuugaagacuagaagcuacuauuaaaggagaccuuccuccuugauaaccucuuccuugucucuguucaaucccaagcaccuucuuucuccuuuuaaaaggagucuuaacugagcuccuuguaaugaugcaugccuuuaaucuuuuuuuuuuuuuuuucgagacaggguuucucuguguagcccuggcuguccuggaacucacuuuguagaccaggcuggccucgaacucagaaaucugccugccucugccucccgagugcugggauuaaaggcgugugucaccaccgccuggcacaugccuuuaaucuuagcacuuaggaggcuaaguguaucucagacuucaaggucagccuggucuacauagugaguuccaggauagccagagcuacauagagauccuguauugauuggugguggggguguguguguggaggguuaauauauuaccuggcuggggugaugguucaguggguagagcacuugccacacgagccugacaaucuggguugcuguuccccagaacucccuugaaaagccagauacaguaaagcaagcgucuagaaucccagcauaccucuacuaggagauaggagggugaguugggagaauugccaggaguucuuaggccagcuaaccuugcauacagcagugaacaggagagacacugucuuaaucuagguagaagaggacagacaccugagguugcccuuugaccucugcauauauguuguggucggugugugcuaauacucaacacacacacacacacacacacacacacacacacacacacacacacccuaccacaugugcucuugaguaauugguuguguaguuuaguuuugaguguagcagagggguccucauggcacagucaccugugacuuguuuuaugcucucagccuuauuccugaugcauuauucuacaguguaaaauguagcuuggguuuauccauucacacugcuggauucacuggguaggugugacucauccuguucccacauugggucuguaggggauuucuguuuucuuugauugucuguggauguuggccaagcuuugcaguggccuguguuuuuauucacaucacuggcacagcccuagaugacauuugcaaauagaaaugauaaaaguaaucaguauauuuuuaucccccaaagaguuuugcucauguucauguuuuaccaauaagaauaauauauucuauaauuuucaguggccauucugucagauuacauagauuuguuuccauuucuaguuugauuauuucaaaauaauagcagauggguuuuuaauuuucaaguuuuuuuuaaucucugcaucaaucagcugaugacuccugugucuuccaggucuagguuuugcagggacuaacacuuugcuugcauuuaaggacuuaauauuuuuuaugguuuuaagugaugauuuaauuuuuguauauuuaaacuuuuucuuaggaguuuguauauacuguauuuugauuccauucuuucucuucccuuaacuccuuccagacccaccucucucccuaucuaaucaacgucauguuuucucuuucuuuaagaaaaaaaaaagguacccccauuccuccccaaagaacaacagaaucccaacaaucguggagucuguuuuguauuggccugcuacuccugaguguuaggccuguucuggagugugguugagugaagaaaacugauuuuccuucuugcaacuaucaauugcaaauaugcuucuugguuauaagugggaguuggugcccacuuccccuccuccaugcuggguguuuuguauucuauuucugguaauucuaauacaugaagccuuuaguaguauaaaucuuuuccaaccagaggcuucuugcauauguugugagaucaauaugaaucacacagaugaaaguuuuguuaagucuuuguuuuuagauggauuuguuucagcuauggacaggacuuugggaguggucucauuuagaacuacuuugucuuccuuugaggauuacuaauggggccucaggaugaaugcccacaacuuccugaggguagagcucaggggcuggagggaccagaugucuguccauucuagugcuggcaugggacuuagcucuuuggcuccagcagucuuccuugcuugaagauuacagaucauuccucuacccccauguccuuuccguuuguuuguuuguuuguuuguuuguuuuguuuuguuucugucucaucucuuaccuuuuuuuguuuguuuguuuguuucugaguccucaaaaccaugcaaugauuuaagaguaauauguguucuuguuucucuuggaacuaguugucucacacgugggaagccuucagaagcccgaguccucaccuucccacaaaggaagucugaugccuuccuucuugucuagaaacucugcacaagggagggagcucuuagugauacauugcuauuuacagagucaguugcuuauauagaagaacaaauauauguuauucaaagcuccauaaagcuuucccuuugcauaguaaauaugagugaaugaugaacuugcauuucuuuuguuuauguucuaugcucagcucuagcuuuacaaguuagguuguaauuuguaugguucauucugggcacuaagcaacuucaucgcugcuuucuauauuagaagugguuuaugagaguucugaggugaauacucaacaauguaaauaauugagaaaggcuucccuuagaagagguagaguuauuaggaugguaaauuacagaagugacccugcacaaggauauucuauaaauaagaauuggauuggaagaagguggauaauuaagagaguuagagaggcauggagcaagacuguguaagagagcuacaucuuaccuuaguaagggacaaagugcgagggcagcuuuggaaguaggaacaguaguuuuacaguguagcagacugccagacaguacaguguucuggugagugagugaugggcaggucguaaguuucaggguguggaggguuguacagagaugagaucuguuugucuuuaccccuggugggagcacaugaaccucuggaaggugaccuggcuccgucuacuuguaguaucacuuaggaugccugcuccucuugcuucauggggaugcuucucauucuucuucuuuacaauuuguuucauuguuauugugguuaugccuagauuuuuauucuuuuaaaaacauuuauguaucauugccagauauuucuagauguaggaucucagaacaugaauuaaaugcuaucugacauugaccagaaucuauuucacaagggccguccuguuuaacccuucugaaauagaugacgucuuucuagguuuguuuuuuuugcguuggugguuauguuggugguggucauauguacggcuuugacgucugagcuacauucucuguaugucucaguuuuuaaagauuuuauuuuuaauuauguaugcauaugugugugcauauguguauaugagucuguguggguucaugcaugugacuguaguaccugugaaggccagaagagcccaucagaucuucuggaacuuuuacuagauguggguacuaagaacugaacucaggucuucaagaacaguaugcauucuuaguugcugagccaucucuccaccuucauuucucagcuuuuauagaagacagguggggaggucuguggaguuaggcgaccuuucacaaauugcacauuuaucagguaguaacucauagaauuuacacuuguguucuuaacucugugguaguuacuuguacaguggaaugaggggauguuuaacuggcugaggaaccugaagacugggccucaagcucauauugucuucucuugagaaccaccuagaugcagcccccaggagguuauuuuagugauaccuaagauuuguuaauuaggugugaucaggcacccugauaggaaaaugacugcaaugaaggagagguuuuaauuauacuuguucuugccuuaaagcuggagacaugucacagagggucuuagaggucacccagaggugaaaucagcagguacagagaaaauugagggcaggagucuuuauuauguuuaaaaaaauggucaagacaaguauacuaagcugaauuuaggguuauagaguugaaccauuugagcugacucuaggcugguuguucauauccgagugauucaggaggcucaagauuuggagagcacaagaaagaauuuggaauuaguuggucuuaggcccuuucuagaagaauuagcuaacccaaggagggccaguucuucccuuuagaaaggccauagaugucagaccaccaagaauauagaaaauaagaaacuacccuaauagaagagcagucugcuaccuugaaugccaucccuuuccagcagagaaguuguaugguuuagaagaagccuauugucaagaaauaagaaaacuuaaaauuugauagcaagaaauuucuucacucaccuauaccugauuaaaacacacagagaagagguuucauuuacagagccugugugugcugucauugaacuuguauacacucucccugccaaacucacagacaucacagagucugaaauuauggcuaaacacacuugauuuucagaauccuuauucuaaauuuuaucaaaauuauuucccagauuauacuauuuaaaucuugccauuauccuucuagacacccaaaugcucuuucuagucuguaaaaugaggcucagcuggucuguccuucccucuccccaggggaguccuccucuggagagcaacucccucaguuccaggccacuuugccagguguguuucuucucugccuguuaagccaugugccuuucuuugcaggggcuuuaacccuuuucuuaccaccacucuuuuacugcucaaacucacugaauaaauucugguaaguguugcugggaugagggauggggaaugcuuauucuucuagugaacuuguguaauaaaccauaguguguguguuauuccuuaauguggcuaugccuuagccucuuaaugaggccauaaaauuccucagccuagcagucauuacuuuguacuugcuaauauuuauuguugaauuaaagucucuuaaauucucaaccucuguucauuguaguuauuugguacuuuuguguuaauagcauuuucccccaccuagaacaagcuagauggaagagacaaggcucagauaugucugggucuagaucggcuuugacagcauuaagcugaugauuuugauagagguaccuaccuucuuugcuuuggcuuccaggccuagaaaucaggggguaggacuagugagccuagaagucacuuacaggucuguuaacccucaaaacuguaacugcagcuuuguuugaagugucuacaauuuuuuuuaaauguuugaacucugguuagccuuuuaaaauuacuuauuuuauguauguauguauauauaccauguauaguggagaagcuauggaguuuccaggcuacuacaccugaaaggucauuccucuuuguuaaacacaggguuagauuuucacuuuacuguaggucuguccuuaugggauuggagacuuccaagaauuaggguuuuacuguaguagauuuccuaggcuucuuaauagucccaaggugcuauggcuguggccucagcauugcuugacuuccauggagcaaggaaacauggcuucaaagcagcuuuuuggaaauauaaaauugaaaagucaugcaaauuucauucuuuuguauucaugcuuugggaugaaaaugccauuaauauagcaguaaaucaaauuacuuggucccgugucucuccaccacaccuuauagacucauccuuuacccccgccuccaagcuaaaggacaugaauuccucguuccaggauaggucauuaugucucuucucugucccuucuuugguggucugggaagcacugaagugagagguaaauugcagcaggugagcugcacaguggguacaggugaugccugggccuuuugaaaggcacacagaugaagggcacacagaugaagggcaugaauaaccacaggcacgggugucugcauuucccucaguacgcaggguggcauaaguacguuaucuucccuccccaaagauuguggggaugcuggaucagagccagggcguucauuugcaaagccuugcccacagcuguguucaggaguuauuguaugaccgcuggugagccuagggcugcaguagguuuuacaugucacuuuagcagauuuccaugguggguuucuuccucaaugcucaggugagcuuuguagagagaaugaguuuagcuucucaugauuucuccaaguaaggaaaagagacuuucaacuucuuuccugaaaucggucacauggcuugucccagcacuguguuaggagcucugcaaguagggugaaaccaaagucuggcuuucauuccucugacacugcuuuggauuugagugccaccccuagcuugauuguugauuuuauuacuaucucuucuuggugcaugcauuuacuggauacuaaauccaguaaauacuaaggggcauguuaaaacauaggauucaggucucucucucucucucuuaucauaguuauucugaugucuguuuuuguuugugaacugaacaaacuggaagauagaaaagauauaaauguuuagcuuauuuuggacauaauuugcuuauucuauugugcuauauuaauaguuugaauuagaggaccaaggucugaggugaagguauuuguuuucaguggauaaguuaacugccacacugcaggacugcagccucucuuaugauuugggaucucgaggugagaaacuugggauuggcccaacagaguguacugaauuacucaguucaccuuggaggaagggaaccuggagacaagacguuuguggaagucugaaauuacauucuugugauugauuaucugccuuagcaaggugccuuacccaccccaucgugguagcaacugaccugugguaacugacacccucaaagaagaucacguagacgagagauaggaaauguacacacgaauccuuucgagauaauagaagagagcgcacaucaagacuuaauggcaggccauucacaauaacaaguuagcaggugguguuauggucgaacagagcacgucuucuccuuuuacaauguucucacaauaauguagagaccuaguuuguaugaauugguuucuuuuuaaaaaauauucgcuuagaagagagcuguacaggugcuugcuguuuuguguguuuucgcuggcuuguuuugugugguuuauaacacaguagcuguuagagagcgacaucuaguguuugugcaagugacacuggguaggaaggaaagagcuagcuugaagccuuccuucccugcagcuaauccuuagagcagggacauuuacugaugacaguguggccagucccacaauagccuacaggucuguaguacaucuagugucauuucaaucuuaaguuucugagguggcagcaaccaagcauugcaugcaugcucugcuguuucugucuccuucccuaugcagauucucucaaagugaauuuuuuuuuaaauaaaagaacgauauggaaaggagagccaauuagauaugcuaguacaaaauagaagaggaugaaagacauauagauuuuagccaaaaaccagaagcuugcgugaauuggagacuaacuaaagggcgugacugacaccuuuuaugugaguuucauguguacaaagacgacuucuuagagcugaccuuucuucagggcaaagcucaccucuuauggcagaauuuuaugcuacaaaguugagagucuaugagacauccuagugagguguuuucuuagagaggguuagaccugaauaugaugugcaagugaaaagauaaacuuauaaaauguaucauguuucugcuuccaaggcuucaaauguuugaaaguuuauguguuagugcguaaugggaaugcuuuccuguuuugucugugguucugcacaucucaugcuccauccggcagaggaguaucuaaccaacuagucuauaggcaucaguccucugcucucucccucagccucuccagugcucuccugcaaugcagugcugguucccauugccaucugggcuguugcacucccagcacucucucaagggcccucuucaucuggucucugccuccucauuccugucuuauucuugucccuauuggcaaccuuuggaaguccucagagcagcagaaaagcuuucugggggugggguggacacuguuuaaucuuccugaaaugcccuucucuuguaggcucacccuuuguuuucuuaaggauuuuguucagagauauuucugccuuuuccccuuagauuaugcugucaaggcagagauagugcuucuuuugucuaucucuagucuuucucaugguaccuggcacagaauggguacuuaacaagaauauuaauuaauuaguuuauuaaaagguaacuuaaaccuauaccaucugaauggugcauuuauugaauuuauuauuuucuugugaguacaugucucuugcauuucuuauuucucagcauuuugaacaauuuauaucuacauuauuuuauuauaauauuuucaguugcuauuucucuuauauuaaaugauuuggagaaucuauuuuuauuaacauauuaaaugccaguuauguaaauacagcucacugcuacaggaucuuuaugcucuauucuuauuagggaacuacuuugauuaauccuuguugcuagaaggugaauuauguacuuuguugaagaagggaagauauguggcugauauaauucuagcucagaaacaccuuuccuuaaacuucagauauauaaaagcauacguaggugacuauauaauuuucagaucauuaccacccacccuuuaauguguaugucugagguagauguaauuugcuucagaaacaccaggaacugcauugcuguauaggcccauggugugcuuugggucccuguuguccucacuuucucacuguccugacguccacucugugacucaugaucacuucaccgcagcugaugaaaaggccaaggucagccuuguugcuguuguuuaaggaauauacuacauuuucuauuugguuuuugccuagugcuuuuuagauuuauauugaauuuacaacuuuaaguguguuuuguccaggcauuucuuguguguguucuuuuaugugguucuggggaguucgugauguguacuguacuggcucaugggguaaucuguaauagucuaguuuagugcuaaccaugcuuuccauccucauuaguuaauauuuuaugauuucagaagguuaucuaauuacauaucuacuucauuaguuuccccaaguuuucaucaucucuucaauauaacacuugagucuuuaagaacauaaaucagaaacacuaaaacucaauuuuccuuuuuauuuacuuuguuuuugaggacacauuucaauuuuucuuugggauugucucuuuuguggaaccaucauugcagcugcaugguacuugcauggaauaaagucaccccccaccccccgcccuuuuugcugcuuuggguuaacuuaaguaaacaaaaaccuuugucauuaggauaccuuugucuuuuuaggucuucauugauguccuaguuaggguuuacugcugugaacagacacugugaccaaggcaacucuuacaaggacaacauuuaauuggggcugacuuacagggcuagagguucaguccauuaucacuaagguaggaacauggcagcauccaggcaggaggagcugagaggucuacaucuuuaucugaaggcugcuagcaaaagacugacuuccaggcaacuaggaugacggucuuaaagcccacacucacagugacacaccuauuccaacagggccacaucuccaaauagugcuacucccugggccaagcauauucaaaccaugacaauugauaaucagguuuucaguaucuugguugauuaaaaaaaauguagaaugucugauaugucucucuuuaaaaacaguauguuccauauuuauuuuaaauguccuuuuuguguuguuugcuuguuuguuuguuuguuuguuuuucgagacaggauuucucuguauagcccuggcuguccuggaacucacucuguagaccaggcuggcuucaaacucagaaauccgauugccucugccucccaagugcugggauuaaaggccugagccaccacgcccagccuuuuuuguauuguaaauuaagucuaaguucuuagagauuuuaagucuguuuucuccugggcuaagaaaucauuaucuuuuaagcaaugaccuaagcauguauugagauguaaaauguuuggagacacaguuacauuuucaguuuuauuaacugccaccuagugcuucccugccaugguugguugguugguugauuucuugauuucuuucuucuuucuuuuccuuccccuuaccuuuuuuuuuuuuuugacaggauuucucuguguagccuuggcuguccuggagcucuauagaccaggcuggccucaaacucauguguguguguguguguguguguguguguguguguguguguguguacuaaaacuagaauuccuuugauuucuuuucaugacuuuuuaucgaucuguuugcuugugccacugcuuauuagaaaauauugugugcuaggcacugguccugauguugaggauacuugauguaucacuaaaguguaaguccuuucucccagggaauccagcuguaauggcagagugggccuuaugccuguccaccugagaagaaugcuggaagguuguuuugaagugguugcguuccaggaggugaaaugugaauuuaguauuuacagugaccaauaggaaucugacaauacagaacuguguuuuacuuauuccauaacagcaugcugagagauuaaguaguauuguguaguagaaaggauuucugguauaaguaauaaagcauuuuuuugagcuaaaauguauucauuuuauuguuaagauuaucuguuuguuuguuuuagcucugucuuacuugaauuuaaagguucuaaacaaguauugaccgcuagugaaaauacucuguuuauaucagaguugaguuauuuuuaguaacugguaaaaauccaccagacgguagugaaaaagauguguccuguagguugauauggaagugugugcaggcuguccgugguuccuucugaagccagaaguuguguagucaagacacccacagaaugcucuccugaagggacuuccaauucucaaucuaaguucccuguacauuuguuacuuccaaggucaaggagcuaggaugucuguucuuuuaaaggaagucuguuuccucccagggcagcaucuucucuucgcacagcaucaugcccuacagcugguuuggggaaggguuacucccuggcucucuagucccgagcugaacagguuuaauuggcuaguguuucagguagauuaacuggucugcauuaguaucuuccucauucuucacugcuuuccauguagacuugaaaucaagugugaaccaacuuggcgugcugcagucaucugguaauaguuuggggaacaaaaaguuucccaucuaaauuaaaugaagacuggugguuuuaaaguucaugguagcaucuuguauaaacuccagcuuauguuucauauuauuccuggucaugcaguauguucugaagaaaaaguagcuauagauaaucaguuaaaagaaugacagauucccugaugugcugaucgguaguaagaccuaauuucgauuuugagugugcuguaauggauuaccauauagauucagcugagcacugagcauuaaacagagucauguguuuuccagaaaaguaauauuuauucacacuguguggcuuucuugaaauuuuuuuauuuuauucuccagugaaacuacaaacaagaugucaauagcuuauguggcauucacagcaguauagcuuagaauaucagcugcaguacaugaaaugccagauugcauuugccucaccaaagguaggcuucaucugggacuucugaggcacaggcuuagcauuuagacuggguaguuguguuuggcucuuuauuuauugacccucauaggauuuaauccauaaaaagcaccccucacaauauuaguguccagaaagaugcguuaguauggcuauuguuucagucucugaauuguuguauaaaauucugucauuuaggaaauauucuuuuaaaaaaacuagugugugugugugugugugugugugugugaaucugcuugugaacgugcaugcccauguaccauggagugcauaugaaggggaagcuuguggaaguuaauacucuugcuuccaucauagguccugggaauugaacucagguugucaggcuugauggccagugaauuuaucuaucagcccaucucacagguccuucuggaauuauuacauucauuagacccaauguuucauaucuaaaccuuggaguuucuuucuuuuucuuuuuuuuuuuuuuuuuuuuugguuuuucgagacaggguuucucuguguagcccuggcugucuuggaacucacucuguagaccaggcuggccucgaacucagaaaucugccugccucugccucccaagugcugggauuaaaggcgugugccaccacauccagcuuggaguuuauuucuuaaucuccuuaauguagccccauuccauaaaucugaauacuuacgagaaguaguaaggccuguccugaccugaccuuacgugaauuggagaugauuuugugggagacuuggacaauauggaaacaucuuuacgcuuaccuguuugaugcuuuuucuguuuucuuauauuaaaaggugcuuuuucauugccauauacuaauaaaaaaaacaacugaggaauauuaauaucuauuuuggaaacugaaaaguaguuugguuucuauuaaaaguuaaaaaucugaaaaccagugggcaugucauaucaagacaaaauccacucugaaucuuuuuuuuuucuuucuuucuuuuuuuuuggcuuuucaagacaggguuuuucuguacagcucuugcuguccuggaacauguucugaagaccaggcuaaccucaaacucagagauccaccugccucugccuccccugugcuaggaauaaaggcaugcaccaccacggccuggcucacccugaaucuuuaauacacuuagcaccuucuugaagagugguauccagaagugguccuaccuuguagcuaggagcuucccucgaaggagaauacagaagaaggugagcucuuggcucaggcaaacagaacugucaggaaguaggcagcgaaccauaggaggacuucacguccauccaugugaagccacuucugaaugaauuggaaacagcugggggagcaucuggccccugaagugggguacacuucucuuaggguuccagccuuucaaucugaugagaauaagcgaauuaauaauuuaaacauuacuguggcacacaacaaagaugaguugcucagauuccccuuuaguuugccaccuacugugagagaggcaugggugauagcuucugggucuuagugccuucagucuuccuguggcgugcucuuuucuccaugggccuggaguauagcagcucacuuccagcugccugggacugugcuccagaguucccucagcugguagggcuccccugcucauccaguuuccuucccauuccuucucuucucucagcuguuuccuauuuguauuguagucuauuuuagucuauuuuguagucuauuuuccaaagauuuuugucuugugaagaugacuguucauuuguuaccaaagacaguggccugggcccugaugugguuacagguggcucuugaguuguuugcucuggcagcagccgagcuguggaggcucucauuucuaguucagaugcugaggugcugugcugugcugcucuccgcuggcugggcuuacguacuucugugggcucuugcucccauguauuguauucuacagccacaguggcgguguggguaggaagagggguauuaaaaauuauauccuuuuguaggacaaggcucaugugagcuuuuauugucaucauguagaggaggacuuccuaaauuuuucuacuuaugacccccccccuugucagagaaacuuuaccugccccagguauauagguaugaaauauauaucccaaacaguuauuguuaauaaaucucaaagaagcauaaagcaaaacuuugguauacauauaacuuuaccauuuauuaaagaugaaaucaaauuuguauacuaaugagaaagauuugcuuauuuauuuuuaacuuaagaauuagaucuuugcugaguauuugaaguaagauguagugugucuucagagcuuuuugaaguugaucaguguuuuuauuuugugauugucagugcugagaaugccacugcacaaaugcauaguauaaaguggcagaaaaaaaggaaagagaaaagaaagcgcauuucaaaaauugcuagauuucugaauccugucccaaucuggugccaaaauucauuugaugaucaucccauuaccaacucaaccaacaguguuaagaauuaaguacaucaaaccaaagauguauguaauucuuauguucugaggcaucuauaggaaacuagugaaaaucuuucuagccuguaauuaaaccauuacaauucuauaugagcagaaaacuuuaugcacuuguuaaacacaguauaauucauaaacguauaauaguuucagacccgagcugugguguuucagguaguguuugcuagcauugcaugcaaagugugugcuguguuuggagccaaggugcagcuguguggugcagcacacucaggcacugccagcaacaccgaggauucauuacguuugguuuugaauuaaguguugguuguugcauguucagaaaccuugugcucuugccaacuuuuuuugugaucccgauacuguuaagugauccuauuuggaguuguagccuucaguuuaagaagcuggcuuauagagaacugacguuuuagggaugggauguggcucauuguuagcacauuugaauaguaacugugagguucucauuugggacccuagacaccacagucuguacauaaacaaauggauguagaucaaugguaagaacugaccuucacgucuucugaugccuuuguaaaagcaaaauuuuuuugagauugugcaugagggccaacaccuuuaauccacacucaggaggcaguggcagguggaucucugugaguucaaggucagcccgaucuacaugaguucuaagacagcuagggcuauacagagagaugcugucucaaaaaggaaaacagaacagaacauuuacauaucuguguaugauuugcguguguguguguguguguguguguguguguauguucagucgugcauacuuaugugugugacuguagugugcucugugaggccagaggacuguuuuuuugguucuugcuuuucaccuaguuugaggcaggaucucuugcucacaacugcuuauagcagacuaauuuccagagauucuccugucucugccucuuguaucccuguaggauugcugggauuauagacacaugcaucuacaggaugcaagaauaggaauuuucaucucacaaugauaauguaaugcacuuuuaaugccacaagauauauuuuggccauuugcauuuuuucuuuuacauuuuaaagagaggugguugcugggauagugaaguggcuucgugggcaaaggugcuugcugccacuuaguccguuaccuacaguguaaagagaaagccgacucccacaaguuguccucuaaccuacccccccaacaagaauauagugaauauuuuaaguaguuauauuaaaauuaaaaggaauccaaguauaauuuaccagaaugugcucuaggguguguguguguguguguguuaaucucauggaccuuuugaaauuuuuucuuugcaaaccuaauaaaaucuuuaaaaauuguuuuagaauuuuauacaugaauauaaugcauuuguucgaguccagucccuuucaccccccuccuccaguuccuuucuucucccuucccauacacuuuccucacccagcuucauguuucuaaacucaugaaucauuuugugcucuuuauauguguaugggcauaggaccaucaguuggagcauagggacacauucugaagaaguuaacucucuagccagcuuuugcuagugagaccaacuuuuauuagcccaguauucuugaguuucagaaauuuguucauuacccacuaaugggugcuuuccuaaguacaacuuaagaccuacuuguaggcauugcuuuuaugagauucauauauuuacauuuauuuguuuguaaguuggggggaggugaggugagaaacaugagaaacaugggccuaucuaaaacauauauuucauuuguugcuuuuguuucuuuuuuucuuuucuuauuuuguagaaaauacugcaguuucuaccugaacgaauuuucuuucgauggcauuaccagaguauagguaagaugaaagcaaagccaauaauguauuagugauaauguauuucuaccaauugagguuucacacugcuuuauguaguuaauauucccaagauagcuuauagagagaaaugaaggcuuuguaauuuaaaucaaguccaacuugaacuuuguaggaaaguaagcuuaucaccauaacugguuagaguagagaauaagugacuguggacccuaaauggucaugucuccuccaccaaggcucagggacugucuuaggagggggcgggaaggacaaucagagucagaggaugaggagggcuguuguucucauguacuugcuuguacaagaccugcacagaucaagccuguuagcauucuggaguggaugggagaaggguuaaagaaagggcagaggacauaaaguugggagggggcucuauuguggggggcagcaggagucagaguagggaguggggaauggguauggugaaaagagauuguauauauguauucaauucucaguguauacauuucaaaaaguuaaaucucucauuuuaaauguucccauugcauucuaguccaugggcuucccaggauuguguuaaagaugcacacuuuuaggucccagucugaccuucugaauaugguggucucuuaacaagggacacagaaggauuccugugcacaucaaguugagaagcacugaucuauuuucuuaaacaaucucacauuuuuuuuuaacaaaaaaacuuguucuucaagucugcauuauuauucaaaauugcccuauuuggauacuguaaggugugccaaccagaagggaacuugaaacaaagcaagugucaguguuaucucuucuccucagcucuuuacuugagagcauuuaaaugcauuuaaaaugcccagccuaacuggagcauucuaggguauaguucugcaugccuuuuaaagaguuccugcuucaguccuuuuaccuauaagaguuugccaguugauacauuuuuucuuuuguaucagauggcuacauuggaggagagugugaaccuuggaauagaaucuuuauuugaauauucacacauuccaauguuuauugagggagagacaaaccuuugggacaaaaagaagaacaugucaccauucuugcuuuggaauggucucuugccccuuggguagguaaaugagaaaaguaauuacaguguaauugaugcugugaggggaauauaguggggagggagaagaaagguugaauaauucugccuaggagaguugaaggaucuuaaagagaagucacuuccacccgagccuugaaagguaaacagggcuucuugguugggagagcaacaucaugugcuaaaucaaagagcuugaaaaaagaauucuaaaauucagaguucuaaauucaauuuaggauuguuccugugagaacagguaauaaacucuuauaaaaaauugaauucaaguuuugcguuacaaauuuaaauuuaaagaagguaaaguauguauauuguauauaccuaugacauucaaagacuguaucauuaucuaagagaucaugcuaaucuuuaaaucuuucaaauaagcaaaguuuuccuuuaaaucugagcaaguuugcccuagcauuucugcuuaauuggagcuuugugauuauguauuuaaaguaagguaaacauuuuaaaacugcagagugucagcuaacgaggcugggauuugugagguucugugugugggaaugagaagugaguggguagcauucuuggcuaugcagguagaauggcuucuaauuuggcuuacagcauuuauccggaacccacacuguuuucuucagauagcacuucaggcugucugaagaguagggggcucaccucagugugaauaaauauccuagaacucugcagauuaauuagcauuguguugugaaauuuaacaaguccuaugugcagaguacauaguauucuuuaauguugucuaaugucaugaaaaugaguuaaaauugcugacaugauuugcucuuuacccguuuugguaacaucuaaucaagaaugagcagggucuucugacuuccugagcugggauugcaaacuacuaaucugagccauuaaaguccccauggucuuauuuauauagggcaugcaaagcugucuauacagaguagucagauugcugaaguguaaucauuugcauucuuaucuuugaugcuuauguacccaguucuugaggcagauagcguuuuuaaagguauuuuuugcuguauuaauaaagucaaguagacaguggcauguagaggcccauaucucucuuaccuuggucuuuagguuagauauacuuuggcauccgacuuguuuugaauuguaaagauuuauuuuauuuuuauuugugugcgugugugugcgagagagagagagagagagagagagagagagagagagagagagaaagagagagagagagagagcccacgcucucuaaugcaugcgugcaaucaugugcaugugcaaaugagugccaggagucagaucuccugaagcuggaguuacagugguugugaacaggccaguauucacaagagcagugaguacucuuaacuccaagccccuuuucuagucccuuauuuugaaguuuagauuggcaauguguauauugauguaggauacauauaacugagaacauucaugggaguuaaugucuguguaacaccucuaggggcuaggcagcagccugacaaaguguguauuaguuuuggagugaguguuuacugacuguggagucaugaagucccaaguagccugauguugcccacaauguccagauggaggcuauuaacuauugcuuuacagaaggguuccuuucacagccuuuugauuuuaggauugguaagaggcuguuaauuugucacuauauacugacuuugugugucuuaagccucuggcuuccucucuauuuuacuugaguuuguuaaagaguuacuuguuacuugaggucuugacugaguuaacacuagaaacugaaacuguaaacccaggugucaggagagugguguacugugaacagcacagccaucucucagcugacccuggguucuccacagucagugucuggcauccuugccaguggaauacugcuauacgauccagauauuggguaggaccugguguaaccagugccguuuacugucccaugguagaauugacaagucacuuacacagagaaccuaaagugaaagcaaucuccaccccaagcucuucagucucccugaguagccucauucugucagaaggaggcaggcagugugaaacaucaguugccaccaugcuuugucuguuucuuguccugucuuuucaucugucuauagcaacaaagacagucuguuucucuuaaaacaguuuuaauggaagcaauagcuauaguuuguccuuguuuuggauuuuacuguuuaauuuauuuuuuauuggagggucagugagaugcucagcugguaaagguguuugccaccaagccagacgaucugaguucaaccccuggaacccauggcgagaaaacuuguuguguaaccuacacacacacacacacacacacacacacacacacacacauacacacacacacaaaugcaauuuaaggcuagguuuuugcuguaaaucagugcaauaguaagcacauuucaacucuguguuuuauaguaugaaguaaacauagaucuguuauccagguuuauggaggccuugcuaagugaugcuaacccgggacugaacucuuuggaaaguuuugugacugauagcgaaugcaaaaguguugaagcuuuuccugcagucagcuuuaagcuuggaaguugcaguggcuaaagcggcugcuugacaguaauugagagcuggcagagaaugcuguagugacagcaaaaccggauguuuaaugugagagcaggcuguacugcuccuggugcccaugugaugccaacacaggacuaacguucugcgagugucugcuuagaaagagguuccuauucacgagcauccacagagcaggguuccuaccugguucucagugcaguugugccuguuuguuuaauggcuggaaaacuguacuuagagauguuuuauagcaaaggugcuuaaaauaagcagucuuuugguuuaaagggauaggacucagugaaaaauacucaauaccauguaguauuugauuaugcauuuuauaugucauuaauuacuaagucuaauuuauucaaccaguuuuuauucuacaguauaaaaaccaagugcauuuacuuauagugaaauagugaaauacaauuuuugacuuuucagcccugucccuggguuuauacucgggcuacccagugugucucccauggugggacauaugacauaacaagccuucccucacaguucuuacuccacuggucccaccucugagcagcuugaguuggaggaccuucccugauccccuugcagcuguccauccacuucccacucaucccucagggcugggccgccuguacacuugacacuaggacucucccaagugccucggccaggaugggcucaccagagggccagguucauaucucagcuuaggaaggaguggcuggaacuaaugcuccugugaacuuggagccaguucucuuggcuaagcugcuagcugccccaccgcuuggccuuucuuucaccuccuuggucauugaaaccuugcuuuucuuagagacucaauccuucuguguuguuccucaggaacacagaagguccuggccucuuuuauuuagugcuacuuccagaagugguuuggcaucccucuccuuagacugugucagcuuggugcuacauugucucaucgccuuuuuuguggcuuuguccucuccugauccuucuuguuacccauaagcccauuguuccucuucuccauccucaaggggcuuccugcccuuuguuaucauauggaugucugucugauuacaagucuccauccuucuagucucuuacuagguacaucuaggccuccugaucuuauuuuuauuuuauuguucuagaaaacagguuuauuggggaggggauggaagauagauagauagauagauagauagauagauagauagauagauagauagauagaugaaugcagcaucacccucaaaacuuccucauucuccuuaguuaucccuuuguucuuuucuucccuaccccagcaccaaucacuaauauauuuucacaagauucacuagauaugacacugaaaguaaaauucauaaaagaaaaaaauugauaaguuguguuucuucaaauuaaaagaaacuagucugccuuugcauuuucuagagucugauuuagauagaaucauauagcauuuuucuucuuuguuuguuuggugucuaccuuggauaggguuacuauugcugucauguaacauugugaccaaaagcaacuugggguggggggaaggguuuauuugacuuacauacccugauucaguagaauccaauucagagaaaccaaggcaggaacucaaacugggcaggagccuggaggcaggagcugaugcuuucuuguuugguccucauggcuugcucagccuucuuucuuauagaacccagaacacacuagcccaggguauuagcacucacaauguacugaguucuuccacaccuaucaccaauuuaaaaaauccucuauaaacuugucuauggucugagguuaaggaggcauuuucucaguuuagguuccuuucuuucagaugucaauagcuuguaucaaguugacauagaacuagccagcacagcaucuuuaaugcuauagcaauuaugaaauucaucuaugugguauguucuaauaguucauuauuuuuauuucugaguagagcuguauuccauuguauggcuuugccaucaucuguugauuuuuuuuucucuugcugauaauauucaguugauuuucauauuuggcuauuaucauaaaccuacuguuagacauuauguacaggucuuuauguggacauaagcuuuccuaucucuuguagaguauacuuaacugguaaacucuuuauagaguggccauaucauuuuauguccaaagcaauuucacaguucaguuaacagcaguuauuauagucacuguuuaguuuguugauaauugucuucuccucucucuuucucuuuuucugaaacaggguuucuuugaguguagcccuagcaguccuggaacucacccaggcuggccucaaacucauagagauccacuugccuuugccucccgagugcugggacuaaaggugugcacuaacaccgcccagcugguugugccaucucauugacucaugggcuugaacuuuucaugugauuucuguguaucuucaguaacauguauauaucaagauuaaccauuuaaaaguuacauugguuuguuuguuuguuuauauauuuauuuauuuaugauuuuggagagucugauaauuuuugguaaaagucuuaucagauauauuccuuggaaauauuuucucuauaacuuacuauaauuuugaagaauaauguuuuuaauuugaaguuauucaauuuaucaauuuuuauggguuauauuuuuuagugucaucuaggaaucuuuaagauauuuuauuuaauauucauagaauaccuauaauguauuagaucacaucuacuccccauuccauuccuucaguucucccuuaccugucccaccacuuucuccuucaaacuacaugucucucucuuuuuguuuuguuuuguuuuguuuuguuuuuuugagacaggguuucucuguguaucccuggcuguccuggaacucacuuuguagaccaggcuggccuugaacucagaaauccgccugucucugccucccgagugcugggauuaaaggcaugcgccaccaccacccggcuuggucucuuucuuaaaaaaaaaaaacaaacaaaacaaaaaaccaaaaaacaaaaaacggaauccuuuuacugcuuccuguaaguguguagguguagaccauacacuggaggauguguaggcucuugggcccuaaucucugaagaaaacugacucucccucccucagcagccaacuggcuguaacuccaguuccagggauccauccagugcccuuuucuggcucugaggguaacugcacccacaguguucaugcauacauacauguauaugaaugcacacauauaucacauauacacacauaaauaaaaauagaauaaaauaaauauagguauuuaauauccccuuauauguuuuaaauauuuguuuguauacucuauuucuaaucaauuguuuuaaacuucuaggcucaacuuuaaagaagcuuuuacacacuggaaauucuauuaagguaauccuuuuuaugaaaguaugcuggaauauuuuucuaaauuuuuuuagauuuauuuacuuuauuauauguguaugagaguuuugcuugcauguauguauguauaugcaucacaugugugccuagugccagcagagaucagaagagggcguuggauccucugcaacuugcguuauggacgguugugauuaaagaccaugagaacuccuccagcauguuugauuugcauuugagaacacauuuuucauuuuuuuaaaaaagauuuacuuguuucauguauaugugaguacaccguugcugucuucagacacaccagaagagggcauuggaucccauuauagaugguugugagccauuaugugguugcugggaauugaacucaggaccucuggaagagcagucauugcucuuaacugcugagcuaucucucuagccccacauuuuucauucuuguuuacucauguaucuucuuuuauugccuuuguuuuaaucauuuaggaauauagaaaaggagcuaugugugguuuugaacuaaggaagagauggaagugaguguagaauaaaaagggguaugcugcuccuuuucuauugggugcugcuugccauucauucagaucaugguaauggugcaggaagcagcugaguauagacgcaaggcaaggaaagcagccccaugucacucagcuuggucuucagagucucauuuagcaccaaagaacauuguguuaagauggcugaaauucugcucuguucucacauaguggaaauguggaaggagggugucucugccauugcuccauggauaguugagcacugaugauggggagauguugccuuacagagugaaauacuauuaauaaugggagccagacacugccuugugugccuuuaugugucuuuaugugcauguuagcucacucaguccugcugcuucacagauggguugacuaagaaaaugaauuuuccauguaucacagccagaaaguaguggaguaugaauuugaaaccagguugccuucucuagcaccuaagcuuuuaaccuuugugcuguauguauugcauccucgcuugucacugagggaagagccuguguaauuuaaugauaacuuuaucccccuuucccucccuuccuuucugucccuucucucucuuuucuccuccuccuucuuucuucuucuuccccuuccucuuucuccuucuuucuccuccuacucccucucccucuuucuccucccccucuuccuccucaucucccucuccccuccuucccccuccccuuccuccuccuccucccccaccucuuuccccuccuuuucucucuuuuugcugaccucuaaauugagauuuuccuuuuucagacucccagguacugggauuacagguguuauaccaccauuccugacacauauucauucucucucucucucucucucucucucucucucucucucucucucucuccauuuuccuuugucuuaagacugaugcuacauugcaaaacauuucuacaaaucuuuguuaaauguuuguuuuuuguucuguuuuuagauaagaugugaaggaaucagacuauuucuuuuguggcuucaagcacuucagacaaacugugcagaagagcaggugcugauuuucgcuugccuagugccugguuucccagcggucuugucauccaggggucccugcacacuggagacacucaucaacccuagcccuaguauaguugaugguaagcagcauuagcaggugugacauguugaaaugacuccucuaauuuuauuuuuuauuuauguguaugugcauauauaugugugucuguaagcuugugccucauguauauggguauaugaagaagccagaacaagaugaucccccagggguuggaguuagauugugagccaccugacauggagccaaacuugguccucuggaagagcagcgaacccaguguuguuaacuugugagacaccucuccagucccugaauugcucuugaacuuacucugaggcuuuccuugguguugauguucuugaauagaaaugaagcccaaagaaucacggaggauucccaaagacauuauuaucaaagccauagguucaacucagaguaccacaaaauaaagacuaaaaaaaccugugcacagggaguggugaugcaagccugugacuccagcccuuggggggagugggguggaagaggcaggaacaucaagaucuuaaggucagccuugauuaccuacuaaguuugaggccagcaugggcucuaugagagacucuaucuuaaaaccagucaaccaaaccacuaaccaaccaaacaaaucagaacaaaaaagcuggagccuguuuucuauuaaauuauaaugagaaaauucugaagugauggaaaaaggaguggaauucaggggaagguguacuucucacaaguguucugugccagcugaugaaauuuaaaccugcuuucccaaaccacuguugcucucaccacuguugcuuuaggaggccauucaucuuacuuugccagcuguguuuuuccauguaguauaucugaaaggacaguaguggccucauuggacuauuuguguucugugaaugagaacuuaauguguaacacuucuuugcacuggauucaggcugaccgaaacagacuuugaagggaaaagaaugguccagagagagaagccucuguggaccucuguccugggcccuacguccuguacauacugccuugggguucagucugagaaguuucaguggcugcauagauguguuguaauaaaggccauuuuaaaaccuuauuuaaaauucagcuguagugaauacacucucauuauuuucuaccuuucagcaaaaauauacccagaggaaaucaccccacuucugccagccauaucaggggagaagauugcugaggaccaaaccugcuuuuuucuucaaauacuguugaaauacaugguuauucaggucagaaaaaucauagcuguuucacugaugggcucauuuucauaggauggagaguuacugccuuccuucuuucuguauggcuguauugcuuuccuugaggcaauuuuauguagugauucauuaaacacagggcaugcauuguugcugggccacuucagcauguacuuuucauaugaauuauuuaaggcaguuuuacauauauaugugugugugauuucauacacaaaugcaguauauuuacaucauuuucauacuuccugaaucucccccuccaucauccuucuaaauucuuuuuuuuuuuuuuuuuuuuuuugagucaggaucucacuggguagcucuggcuggcuggccuggaacuuauuuuugaccagguuggccuugaucucaucugccuacugaguaugccaccucacccagcuucuccucuuuaaaauauccuacugauuacaauuacagcugcccagaugugcaugagugcagggccaucuacuggcucaugggcagccuacugugggccacaccgaugaagaaaauugauucuccacccagcagcugccaccugccaaaaccuccuccucuguccauuucagaguguugacugucuuggccuugugcaggcaaccacagcugccgugguaggaccugcaugucuaguccaaaaccauuuugucguuguucuuccugaccucugacauuuagaauauucuaucuccucuuccuggugucccuaagcuacggggaaggggugaugcagguguucuuuuggggggccugagcaccugcagcugcuauucucugcacugugaacaguugugagccuguauaguaaucaucauucaucgcacagagaagcuuuucugaugauauauuuagaaggaacuugauagugugucccuuuagcaaaauuaguaggaucugccguugggccuuugacaccuagucauggguucuuguucagguuuacaauaccugcaauucuuauugucuuuugagcuuuguugagauacaguuucuuuacagaauuucagcauaauauuuccuguuuguauacauuaauuuaaacuguaauuaugcaaauauucuuucccauauauuaucuaaaggcugcaagcuuggaguggaagaauaaagagaaucaagauacugguuuuaaauuucuuuuuacguuguuucgaaaguauuaucuuccucauuuguuuccaucauuuacuaaauuaaccaacaucuacaaaccuguacuugguaaguacugucugauuccugugugggugucauccacagggcagcuguacaguagcuuccauaguaauccuugugaguguucuaaagcgaaauaguuacuuuauguucauauugaaugguaaugcuguuaugagaaguuaaaguuaccuaaucaacgauucaauuaugugaacccacuaagagguuuugccucauagaaauaaagagauccaugguuucuguaaaaguagaauguuaugcuauuuuuguauguuugcuacuuuuuaaugucauguuuugcauuucucaaucuccucauauguguagugaauuuuagugaugccacacccugcucaauggcuagguaggccagcccagggcacagagcuggaggcgugcacuuuauguugggcuguuaucuaccaggaugcugacaggucuuaugggggagaugcuuuugugaugggacagacuacagauaggaagcccccagaacacugggaaacagaaaagauauuuaacuuagccccuacaguuaccuuuuauaagaaauuauaauucacaggauagaaucacccacuaaaguggggaaagugguuauacguuuuucucccuagaaagacagaaauuagguagauggauaauuaagaauagcuuuggaagagaagaggucacgugggacuguacucugcuuguagaacuuguuaaacuaauucaacacacacacacacacacacacacacacacacacacacacacacacacagagucacaaacaaaaauggacacaaacauaugagaagggagacuagcugaagcauggugcauuuuaaaaacuguagagguccugggaccuguauuuuguuauauauauuuuuuuccaaaauuuauuucugacuuugugcuauauguguucauuauaaaaacacuauacauugcugaugcugcuagguugaaaguuauauguugaaacuggucaugguggcucauagcuucaguccuagggcuugggaacuugaggcagcagaauugugaguuagaacccaaccuuggcuauauuuagagauucuguaaugaaaaagaaauaacaacaaaaaauuauuuauugucgauauuuuuugccucauuaagguacuccagaaauauaaguaguaguuaagauacaacauaggacuuacagcaauuugugucucaaauccggccauacaguauacauauuugaugaaacuuaaaggacugacuuuuucuuuugaaaagaugguaccugagacuucaaagauguaacaugaauuucugaguucauuuagaugaaaagucuugucuuucugaguauagcaauuacagacuuauaccacagugucuggcuuuagauauuuuuuguuaaaguucauguaugauuuuacauuuguuucaguuauaaaauaacauuaaauuaaguauacuagaaaugaagauaauauucaccauuauaguuucaaauaauuuuaauaauuguuaacaagaacaauuaguguggcuauauacuauugcaguauguaggcaauaauggccaccucuuuuuauuuauauuaaaaggcaaaaucagaaucaaaccugcaagaauaugcuaauuuuaaacauuuauagguuaucacuuuuaauugcuauccaaacaaccaaauauauguaauauauugauuaauuggaacaguucacagggauuauguaauguuaagauucacuaacuuaauugcguauucuuuuucuuucuaucagaaauuccccauuugagaccaaagccaguauauguuacuguaacucgagauaaugaaacaauuuacaguacaaaaauuccauacauggcagcucguguuguuuucauuaaauggauuguaacuuucuuuuuggaaaaaaaguaucuaacugcaacacaaaacacuaaaaauggaguugauguauugccuaaaaucauccagguaugacaaccaucauuuuaaaaucucuuucucuuguauaauaagcacacaagcacauuagcaaaguaacugauuguuagaacuacagauuuuguagguuugauuuacuggcucacuugucugcaggucugagguuuuagaggagcuaugcaguguuggaguugcuauaagaagguagucucaggggcaagcaaaauucugggacuauagcucuuguggauacuuuccugccucccuucuuucuccuucuuguagguguuguguuuucugagcacaggcacagggucuugccuuuccuucaccaguuggaaggcccucauguucuguagaucuggccuauggaaagggcucaugcugucauguagccuuuggcaucucaggagaggcuugggccagcagcucaggaucccgggguaguuguugcuuuaugaugcuguuccuagagagaagucugccuuucucugaggccuucaggaaagacuugucagguaggagggccuucaguguguguacuugguagaacacuacuguuuuuagaacuuagagaucagucgcaucacugaggggucaugguuuuguguggguugauuaucguuguuucuuguccccaagaacagggccagcaacuguagugcacuuauugaagguuugcugaugucaaggaggcuccagaaauaggacguugcuccaagcuggaaaaaaacauaugcuggaggaggcagagcagaaguugcuguauuucaaggucauuggugccuuggucgaaggaggagcaccaagcaguuuauagccuauggauccauuguagaggacuuacuggagacccagagggcaaacuuguuuucaaaagaaucucugguauagaaguacagugagaacaacaaagggcuuccugagagguaguucaaaacaaaccaaaaccccuuaacuuuauacuuugaaagaugaaaugaaaacaguaaugaguauauuugucuccucaaaguuuuuauuucagauuugaaauaugauauucuuucauacacguaaaguaagugagcuggcguggaggugcacaccuuugccccuaguccucuggaggcagaggcaggugaaucuccuugaguuugagaccagccuggucuacaaagcauguuccaggacagcugggcuauauagagagacccugugucaaaacaaacaagcaacaaaaaaacuaguauccuuaucaaggugaucaaaacuuuuaaaacaauauacuaguuuuauaaaugacuuuaaaauauacuuaaaguucuguuucacaauagaauucacauuuuugcuacaaaguccuuugcuauacaugcagaguuguuguuuuucuguuccccaagugaaacaauaucuuuuucuuggucuagaacuuguacuuuugauagggaaaagaccagcuaaugauguguguucuagacccagcuucccuagcacuaggcuuaacagacuuucuuguuccguugguuguuaguuggcucuuuguuacugugccaaggauaccugaaguagucaacuugaagcaguuuacuuuuggcucauacuuuuagaggcuguaguccauggucagucaguccuauggauuugguucugcguaucggggauuuaaaaaccaccgagauggcaaggcagcugagcauauuuguuuuuauaauucuuuaauuauaguaaaaaaaaaaaaacaucacuuuuacuaauuccgagacaguucucccaaugacccacaggccccugggaagaauggguagaacaguggcauauacaagcugacgacucugaagaauuguauauguuugucaggugacuacugcuguagucuucucuguuccugaacuuugcagaggcagcaauagaaugugcugaguguguuggcagaucaggauagaggaaucaagcgguaucacacucaggcaucaccaacaaaacaacugagacaugcccuacccuugagaguugcuucaugagcaguggguguccauacuuagacugacucugagaaugcuuuugucucaguaugagcugugggguucagagggcaccaggguggcagagagauugagguaaggaauaaguggcaguguguaguuuucugagccaugguagugcuggccugguagauuguuucacugaugggucuucugcauguaccagaggacuagacaucgucucugcaucgacucucaugccaauggcuucacauuccagcuugauucuagugcauggaagccagaucuccuucuagagccagcucuucauaauuguacagcacgugcuuuauccacuaagcagucuuaggucuggagcuuauguuuaaauaacuugauacuacauaauucuucaugcuaguuuaauuauuucauugcuguaauauuaaccaccucaaaacuuagugccuuaaaacagaaccccguuaacacuauguuuugucuuuacuuagugggacagaaucuggcuugauaccuguaauauauuucaugggcccuuggguggugaucguuuagcugguggaugguuggucuggaggaucuaaggugacuuuauccacaaaccuguuagugcuagcuggagagauagcuggcuggaacuaguuaaucuaugcugucucacuaacaaggucauuagauuucuuauauggccaccggggccuccaagaacaacauuugaagagauggaaaauguuaacuaccagccuuuugagccugggccuuuugagccuuuuguuauaagcagucucccaaguuuucacaccucugugacagcagaguuaaguguguaaguauagagcccuggugugaugauggcacacauugcacuuacacaucaacuuacucugugauuucacaaaugcaaauuaaacuuuuuagcugacaagauuucacaguccucuucccugaaauaacuuaguaguuuuccuguuaaagucacugaguucagggaggauuauuugguuaauuaggaaauugguaaguagagguucagguguccauguuugaggcaacugcugacguucaucuugcuuuguacccugugcaauugguggcaaucagaguacuuggaacaaggccagaccuggguguaggggcguggaucaguggcagaacacaugcucacacuuaugggagugugcauugcuucucuaguccugcaacauucacaaaccccagaagguaaugagcaggacaggacccacauuuugcuaggugcucgugagugaggguguggauugcugagaucuguggugacauuuuccagacuguuggugguggugcaauacaagagaagguaccagagcuggauggugcuggguccacagaacaggacaaaagccauucuaacagcagcaccuugucugaccgaagacucagcaacuccagucuuuguagcauugaagaggagcaucggacaguguaugagauggugcagcggauccuccugucaacacgggguuaugugaauuuugugaaugaaguauuucgacaggucagugugugcuauacagucauaaaguugaugucaucuuuguuccugucaaucagcuucccauugcuguaagccaugugcagggacaucaguguaaacacagggguguauuuugucucaguuccaagggucuuaguccagggucacuugguccuguugcuuugggccuuuggcagggccgcauauuaaagcaggaacaggaagcagauugaggccuguuuaccucauggaugggugagaaaaagaucaagagauuagcgcccuacagucuugucugagggcacacucugccaugaccuaugcuaucccacuacgucauaccucuuaaaguuuaugccacuucccaguagugccaagccaggaccaagucacacguuggcccgggggaagauugguacauuccagauccaaacuguagcauugugguuuuacuuaugacaugguaaauagcauugaugauuuggccuaaaaauuucccuuccaguccuacuuuuaguuugucacaaguuuuucugaccuacauuuuuuucccaucuauauaacaaagggaaauuaaaaaauacuuucauguuccauaguagacucagcucagagggugggccuaguaaacccaguguuuggagacuuucagcacucacacaacccagaggcacuuucagaaaguuguaauuucccugucauguuacaugacaugaaugaauguguguguguguguguauguguguguguguguguguguguguguguguauguauauguuuguggcacaagagcaaugagaugaaugagaaaggacauaaaggagagaaaagcucuuuauccagggcccuggaauaacauaccucagguaggaaaggaagagcugggaagagcuggagcagaaagcuggaaagagcaggggaaggaaaagaaagugagcaggagcugggccgcagucgagcggugcagugcuuugcagcaggcuugguguuccugggcagacguaucugggaucaguuuugacuggcaucuuauggcuagccaauuuuauuacacuagaaaucuaucuuauaacagauaaguguaccacugaucaaugauuaaaaacuuauaaucccaguauuugagagauggcagcaggaggaacaggacuuuaagcuuuaacuacauggcuagcuugagauuacucugggcuauauggaacuuugucucagaacacuaaggaaguaacuaacuaaauguaucauuaucaaaauugauuaggaaucauaauguauaggguuguuuuaguuuuguauuuagcaaaucuuuuaccuugguuccacagccuuagaguacuugcuguguuggauauugugacgugugugugugugugugugugugugugugugugugugugugagagagagagagagagagagagagagagagacagagacagagagagagagauugaguggcuucaagaaaguauuccaaaacucucucucucucucuuuuugguucuuuaaaaauagugaguguggauuuauuuauguauuuauuugggcuuguacauguggccagagauuagcagggaagaagaaucuuaggucuuucuugcacuuaggaauuuauaagccaaaccuuucucaccauacaagucagagccaggaagacuuuauaaggacuuuggacuuugguucuaaaguugaagcuuuggcaugaggacauuuaacauuuuaaaaaagauaaacaguuuugcaguaagcaagaaacuguaacauaaauauauacuagaaaaaggaggaaacaggauuggaaauuuaugaggcagagcagaagagcucagcguauagucuuccuagcagaguggagcagcaggagauagacuaaaccagguaaggaaaugaucuugcacagaccucggaguggcagguaaaaacugggaccuguugaaguggagggucuaaugagcaggccugagacagcuggcuucucucccaguucucuuccguguuugugugcuuucuguccaauacgaguauccugcuguagcuauagauguuccuuuuuuccuuugaaaggcugagcauuugcaguauguuugcaugagcaucaguugcagcauagcugcaugugcugccuacuuuuaugucagcuugacacaagcuagagaagggaaccucaauugagaaaaugccuuauuaagauucagcugcaggcaaaccugggcauuuucuuauuagugauugauuggguagucccguccauuaugggugaggccaucccugggcucuauaagaaagcaugcugagggaaacguaaggagcaacccaauaaaccaacuuccuccauggccucccucugcaucagcuccugccuccgaauuccagcccuaucugaguuccuguccugacuuccuuaaguaaugaacagugaugggcgugcacgagccaguuaaacuccuauucucuccuacuugcuuuugaucauggugcuuauggcaauugaaacccugacuaagaggauacagaaagucaaguuucauugcugccuggagaaaccacacauuugagagagaaggugaugggaaaggaagcacuuuauuggcaacgaggugacaaguuggaagaugaggacucuugugugucuuagaaaaagaagaagccauguugagggguugcagguauaagacuccauagauacugauuuuggguaugggcauaguggguaggcuuuugaauuuggcaggaaugauacuauuucugaauuuugguuaguuugcuuuucugucacacagacuguuguuauccauaaaagguucuggguucguucugcaaauuuaaagagaaguugcugacuaaauagcauuaugucccaugccauuuuauguccuuuccccaggaauagcuaacucggcaguuacaaaaguguauagcaggcauguuucaccccaggguagccaaaggcagcugucccuggagaagcaggaaagauagcugaaagaacaacuuucccugagcaagacagugaagugaagcuuuucacagagcaaagaguuuaacccacuaggugacuucagccagagcuuuccucuguagcaaagguggugggagaccugcaguugacugcucagcugugugaucaccaaacuuagugauuaaucuagccaugaagccagacuaauuuaguuagauuuuucucucuguagcauuacuauauauucuaguugcuaugcauuccuguaaauugauaguuuauuaagaagcuuucauguuuucaaaauuuauuuuuuauuuaaugacauuuccuuucugcccuuugcucccucuaacccaucuccuauuuaucuucuuuucaaccccccacccccccaugucccuuuucccacucccaucuccuuuuccaacugacauccaccugggagaggguaguucucccucucagcuauuacuuaccauuuuuuuaucuaggugugggacuccaugagauugccuucuuuccaaauuaccacaucuguugauguuucuguugauaaugccauuguucaggcuuugcugagacuguagaagguacagucucaaagcagacuuccuggucaucuggcauuuauaauccuuucaugguguucccugagccuuggguguaggagcugaguuaaagguguaucugcugggacuagccccucacaguacaccaaucuaguuguguccacucguaacuuucugugauggccgugaucugauguagagacagcagcuucuaauuuuauaaauagaauguguaguguuaauauguugccuucugguguuugcaugacacauauuuuucuaccuuuuuacuguguacagcucacauacauaugcuuuggauuuucucuuacaaauuccauguaauuuuuaaaaacuuuuuccuaaauacaguguuauaaccucuguguuuugauuacagcuuuauucuacuuccauguaacauagaaacugcuuuucuuggauguaaaucaagucuuaccuuucacguucuaauuguacugaggguuauuuuuuguuguuguuguuguuguguuguuguuguuguuuuuggcuaauugucccuucuuucuucaguacuuacuguaauuguuuaauggcuagagaacaucacaccucucuaacaccucagcuuauagaacuuuguuauauauuugaaauccacauuauaaaaugaaugcauauaugugcaccauacuuuucauaacacacacacacaaacccuauucauuuagaauucuccaaaagcucguuuugucaaauuucugaccuaggauaauuucccuuuaugucugaaggauaauuuuuaguacuccccuuaguucaugacuguugguaacaaauuuucuuaucugaaaaugucuuuugcuuucaccuuugaaguauauucuucgggaugcuauguucugucuauacuguacuagccaugcucucugcauguggaauauuuagcuuuuuguuucauggcuucuguuugauaguuacaauaaaccaugaaguuuguuacuuugaagaaaguguucuuuucucccuuuuggcugcuguuaauguuuucagguugcccuugguuuuagcaguuguacugaaagauuguuguaucuguucugcuugccuuugagacucaugacuguggacuuguucucugagcgcagccauuggcgcacacugcucugcuccaucucugcaucucugcccagcccccguccgaugcuugccacgcuguggcgcugcccagcucgccauccuucuugcucugcuuccuuuucuccucgguguuccagauuucccuuguguuucucucaguuuccacuuuagcuucugcccagccuccacacacacacagcuuuuaaccuggauuguuuuguuuucagauuuaauuuacuucagguucuaaaauaccugguaucuagauuuucuauucauuggaucauguguauuuuuuuaaguugugaguuaauucaaaaugacagcauauuuucaauaauguuuaguggcauguuauauaucauauuguuguggcuuuugguagagauauuuuaaaaauaauuuaauuuuccccuauuuaagaacuauucuuugcucucugugaggaggauaauaugcuaugucuuuauuucagaguuagauuacucaguugauuuaauagucucuguauuuucuuuuuuguaaaguuuuucuaaauaauguacaauaagcaauugccagacuuuagcgauagagucuaaaguguuuauagauugaaugagccaauaaagugcggaagaaauagaauggguugaaggaaggcuagaggaguggguugacagauacauauguaauaaagcaaauauagucacuguuaauagcaucagugugaaaauuucuuaauuuuauuugugugauaauguuuuucuuuuauuucuuuucuuuucuuuuuaaaaaauucauucuuuaaucuauuuuugcaguccagacuuuaucccugucccaguccacccucucacuguuccacaucccauacccccucccccuccccuugucuccaagagaauaucccuaccccucaccaccaucccaccagaccuccucacucccuagggccucaagucccucaaagguuaggugcaucuucucugacugaguccaaacccagcaguccucugcuguauauguguugaggaccucauaucaguuggugaaugcugccugguugguggcucaaugucugagagaucucgaggguccagguuagcugagaccgcuggucuuccuauggggucacccuccucuucagcuucuuccagccuuucccuaauucaacuacaggggucacuggcuuuuguucacugguuggguguaaaaaucugcaucuaacucuucagcugcuuguugggccucucagagggcagucaugcuuggcuucugucuguaagcauaucauagcaucagugucaggccuucgggcuugcccuugagcuggaucccaauuugggccugucacuggaccuccuuuuccucaggcucuucuccauuuuugucccugcaguucuuucaguuuuugacugugggauggcaacccuauccuuaaacuugaugcccugccuuucuacugaaaguggacucuacaaguucucucuccccacuguagggcauuucaucuaagguuccuccuuuugaauccugagaguaucucaccucccaggucucugguacauucuagagccacccccccccaccuccuaccucucaagguugccuguuuccauucuuucugcuggcccucagggcuucaauccuguucccccacccaauacccacuugggagggagaagaaagcaaucacaggagaugggaggggggcggggggaggaaccuggguggaaagggaacaaggaggggaagagggaaacgugauaauuuuuuaaaacccaggaagaaugaauaaaacaacacguacuuugucuuaaucucuuauguuuacugaguuacacggcagaauacugauucauucauuuuuuuaaaaaucuuuugauaaugcugauuccuguguucugcaauuugaugugaucuggcugccacccugggcaucucucuaucuuaugcaccaaugcugaagugauaggugccugucuuuagguucuuuguugugaaacuuaggggugguauuaaaacaggccugggaaguaacuuuguaaccuugggaauuaucucugguucccugugacucaguggucuugucugaaaaguagucauuugagugugggguagguaggguccuuccagccuaccuugcauagagaacuaggcccuaaauuugagaugcagcaggcaaaugcauuuccucuucaagucuuuuuuuaguccuaucacauuaaaucacaaauacauaaaaaaauuaauuucuuaauauuaaaaauuucauuggcugagagaugguucauuuaguaaagugcucagauucccaguacccauguaauaaagugugcccugugccuguguuucuagcacugggagguggacauaggaagaccucugugguuucuugaucagccagucuagacaaauagccaaguccuaaauccagugaaagaucuuuuuugauaaaauaagaaggugaaacaauugaaaaagcuagccaguguugacuucuggccugugcauauauacauauggguguuauugugguuguuguuauuguuuguuuguuuguuuugauuuuaaguucuggcaaaugugcaguggccaguugguuaacauuugcggcuguacuugguguaauaaauguagaaauguagaaaacugugugagaagguaguagggaggaaggaacaaaggugagauggaaagaaggugagggaaacagaugaaaagggcaaaauaagcaagaagaggcuguacuuuuagcagucuccagcuucuaccccagcaggccaauuccagcucccagccuggcucaccugagcacagauaagugcagccagcuccuguccccaccacagccggucaauugcuuuacaaaccauugccauguuuuuuuguuuuguuuuguuuuguuuugagaaaacuuacaagcuuaguuauaauuauuuuauacauagaaaauuuaaauaccuaccuggaagacaaaaagaucuaugagucuucauuauuuuucugggcuaauuaugaagaugucuuuuuuuuucuucagauaagugguguguacaaaaguuugucuguacaaguuaaauguuucugaagugagugauggaaaugucuguaaucugagcuuaugugucauuaaagagguuuuuuuuuuuucuuucuaggcauuuuuguugccuuccugugagauaucuguaacaagaaaaguaguucaaguguauaggaaauggauccuccagaacaaaccuguuuucauggaggaaccagauaaaaaggauguugcucaagaagaugcugacaaauuaggacuuucagagacugacuccaaggagguaacauuaucacuuggccucugaguagagaguacguacaucuuggcaaaaguaggccagcucagccaagggucccacccugcccaugaaggcaggccuuuaggugacacucucagguuguuagguucugugagggcguuccuaaaaagcagcguucaugcuccaucuuuggugggcaguugucuccuuuacaguuagccuaggaaaacacauacacgcacgcgugcacgcgcacacaaacacacacacacugcuacuuucguagacacuguugcaagacacugcuuucucacauuuuacaauucucucuaugagacugagaagcugauggccucuccuugauucauuuaaauaaauaguuguuggaaaaaauuaaacauagaauauuuugccagauuugucuuuugccguuaacugugcaaaagaagucuguauuaaauauuugaaaagcuuagcagaguaaagaguaagcgucucuggggugucagcagcauugagugcgccuuccugcaggaggcacuguccucuuccaaacucaggcuugaagcaauguaaagugacaucacaaaacaucccaagaacaaaaggaaccaaaguuauauuuauguuccugauuaaauuaauuuucaauauuuaaaauuuuuagccacagacuuaaaacuuaaguguuuauacugauucuguuauuuugauguuucaauauuggugaaaucauuuuaguaguuagcuaagaagucagaucaaucaauaagcaaguagaauuucugugucccagcaucaggcccacuuggcucuccuaggacauacugagggcugagaccaccuuggaugcuggggcuugagugcugagcagagugaaggagcugagcauggaaacguaggcuucuuccuacuuggcuaauggauuguuaucuucugaaggccucaucugaaaguucuggucauaaacggucauccaguuggggacgcacguauuccuucacaagugccaugagcagaggaugugugacagaggaggacaacacaaaugugaaagcuggggcccaagcuauguugcagguaugcuacuguuggggacacaaagauggccagguggagaagacauaauuagaaugacgacauguacuggaauuuugagcacuaggcauuaaagaggccuuaaguuuuucuucucaucugcaaguggaaaauauuuuuuuuuauuuaaaaaagacaugaaacugguugcaggcuuuuuuaaaaggauuauuuuauacugacugugaaauguauaugauuuguaccugaaaguaucuuccaaucacacaagcacaucugaauaguuacuuggauuuucacacacacgcagagagagacagaaauacaaauaagauaaaucuuaaagaaaggaaagaugauuuuacucauguaaaucagagaaacuugcugcagcucauauuuauagccugugaccuugacacagauacuuggagggguccuuguauccuguagcucuccccuuucauauggacugcagaccuccaguagcucuacagcuugaaaagcaacaggauuucaauuguuuuuguucucauuguauucaguaacauuguauaucugugcaccacaggcaugccagaaaagggcauuugauuaucugaaacuggaguuacagaugguugugagccuccaugugggugcuaggaauugaacccaggaccucuggaagagcagucagugcucuuaaccacugagccaucucucuagccccaaucguauccucuuuuaauaccaaguuaagaacaaugaauaucugaaguuucugggccauuagcgucauccuuaugaaugcuacuugagugguuguucauggggaaagaggcuagauggaggucugauaagagcauuuuuuacugcugauugggaugaguacaaauuggacauaauuuugauuguuguucccuuauucaaugccaauauauggauaaguauuccuguguuggccuuuugaagcuauuauuaaaaguaaaaaugcaguauaggaagacuuaauugggagugagcaggauuuuuaaauuuaagagaacaacacaugaaauuaaaacauuuuguguuauguuauuugugguuuacuccuauaaaaacauugucacuaagacugcuauaguuuuuuaaccagaaaagucuuuguccuccuuuucuuauucaaauccccauugugacuuuuaucugguagugaugauuagugauuuuucauuuuauaaagguuuuaagucuuaaaguugucauaguuuuuugaguguguugauuugaaccugucugaucagccuaugauuuuauuuaggauuuccuguacugaaaagccagagaagcuggguuugugcccacagcuucagugcuuauacuguuuaaccuaaaggagaccuacaaaaggcuaaaugucagauagauagaacccaucugauuuaugggauuuuuuaauuuuuaucuuauguguacaagucuuuugguuaaauguauaucugugcaccacaggcaugccagaaaagggcauuugauuaucugaaacuggaguuacagaugguugugagccuccaugugggugcuaggaauugaacccaggaccucuggaagagcagucagugcucuuaaccacugagccaucucucuagccccaauccuauccucuuuuaauaccaaguuaagaacaaugaauaucugaaguuucugggccauuagcgucauccuuaugaaugcuaccauuuucuuucacuacaguaauuuacucucugaggaccugagucagcuguaguaucacaagacagagaccuuggaccucagagaucuggggcagagcauagaguacccagcugacucuuauaaugugcuuuuaucuuaagaguuuacugacacuauuauuucuugcuacauaauagauuucuccuauuuaaaaaaaaaaaaagcccuggggcuggagagauggcucagcuguaaaacuacacuaugugaagacuggaguuucuagaagccaggugggcugcccagcucaccuauaacuagggaaaucccuggauuaaguuaacuggacagacacagaaaaaauuaguucuaaguucagggagagagccugcuucacuguguaagauguagagggacugagaaagauaccugaugucaacuucucauguccauauguucagcccccauccccucagcagcauacacacacacauacacacaccccugacauacauacacgugcaaaaacaggcuugauucuagaagaugcaacauguccaugugacauuguguguuuccagguacaccacuauucaguuccuaacgccucucaaggacacuaacaauauuccaccaggaagcaggguucaugugcugugcugugagcuucuaucagcaucgcauggguuuccuauaaauugauucuuacuccuccaacuugaugucuuaaauucacuuuggaaaaaguuauagcucuauugccuagccacagggcucuucugugacuuuugcaucccagaccuugucacccugauacaguggucuuaguuuuuguuauuuuuaauuauuguuguuguuuuguuguuacugugggaagauauaacaaauucaaaucuuuuaugacucauggcuaaaguaacacugucuauauggaauauccgggaaaggccuucuagguguacaccuaggcaagccgaaggggugggccguaauaccuggagcaugugucggugccauuugcugcauugacgcagucuguggaaguaacccagaaggauucauugguagaaggaagguaauauuaucuguaggccaacuuuucucagauguagaugguuaauuguauuuucuaauguaaaauuguuggcuuuaaggucuuucuuacgaaugcugcaaaugucuuuuugcuggaaccaugugccgaaguucccaugcuccugagagaacaaguagacgccucuaaagcuguucugauuauuuuucggcggaugauaauggagcuuacaaugaaucaaaagacaugguaagucuccuccagauuaacaucuaaaacagcugccuuggcuuuucaauacaguuaaagcguuaagguuuccauucaucuaaugucuucucaaaacgcaaaaaggugagcaucagccccuugugugaaauguggcaaggggguacccagcacuuggauaauuaguuuauuuucaugauuguuuuuuaaaaugcucauguacagaagguaguguuacguuacucuguaguagauuucccacuucauacuuauuagacaguuuuaugauaaguaguaugggcuuuacaguaugauucuuuauaagagcaaaguuugguaguguccugaaguacuauaaacuugacuuuuauuccuucgacuuguuauuuugaaucuaccuuggaaaaacuauguuuuaaaaauacuauggagucagagugacagaagagugcagucaaaaguguguccugaauuuuccuucucuuuuuucuuugcuguuuuucuauuaauugcguguucaaggguaaaauguuagaugucuuccauccugucucccauaguguccacauugcccucgguguucucaguggcagagcagcaagcccugagccaugcuucccucauccccaauguuuucacuggcagccagucuuagaaaugccucuggucugcgcuggguguguucaucucacuuagccaccuguaauucgcacugaggucccguggcagugacacccuucuguauuggaaauuuucccaggaccacaucugucuuauggguguccuagagccagcacuauugguguuguacaaggugucugucuguccacagugggugagaagccccaaaauaaggcaagagugagcugucagaggccacagaccaccaagaggagagaagggugggaccagaagaauugugccuugcagaaguuuacaaauaaguaucaaaaugggaauuugaaaguguaaauuagaaggucaccuuucccggucuuuuaaauuaguauuuccaucaagugcaguagcugaguuuggaagcauuacagcagugcacagugugauguaaacccuguccccucucacagcagucagaaccagccaugagaagugcuuucagcuggcugaugcuccuggcaccacagcugggugaagaguauuuuuuuguuucuuuucuuagaaagcuaugaauucuguauauauuacacauuuuauaauucuaggaaguaaaauaaagcaacuguucccccgccccccuuugguaauuuagagauuuccagauaaauguauaaaaagacaauuguagaaauacaaacaguaacuaaacaugguagagcauagaaagggggcgcgguuugcugccuggauuuucuacauauuuaaauucaaaugccucaugcucccccuccucacuuuccuacucuccuuucuuucuuccucuuuccucccuuccucucuguuucuuuucuuuccauuugguaguuaaugccugagcaucuacugugagcacagagaagugcaccaaauagccaaagcuucauugugacagggacuagggacuguggacuggauauccuggcugugaguggcaggauacuuccaacucugucugucugucucucucucucuuacuuucucucuuucuuucuuuuuuaaacauuuauuuauuuauuuauuuuaugcauaugaguacaucaccauugcucccuucagauacaccagaagaaggcaucagaccucauuacagaugguugugagccgugugguugcugggaauugaacucaggaccucuggaagagcagucggugcucuuaaccacugagccaucuuuccaggcccuagcucugucauuucuuuucccauuuuuucucuucagaccuucuguccugcacuguguacaugugaguacacgugucuaggucacguggugcauuugucuuucuccuacauauuucaaaucucugacagugcuaaacaaguagccagauggaaaagagugcugugagaaucgauguugccaaacaaucaagccaaggacuaaaccaauggagccaaauaacaagagaacccagagcaagucuccagaggucauuguagcacgagaaggcuaagauuuugcaucaucugucuacuguacagaaacaggagaaaagaaaccacuucccacacaucuuuuucucugaucuggaccacauugcuuuguuguauucuuuguuuacuuuucacuagagaguacaaagagcaagaagaaaguagugaagguaaacaaaugguuagagcucaaaucuuuacagaaaccaaaugagaguagacuucucucuacaaaagauaauguguucuccauccccacugaguccaaggguaugagaaaugcaacuuggcuauguaagaaagaaaaaaaaaaugauccucugcuguuuuaaacgcugauugucauaauuagcaguacuauguuaauucuuuaagccuauuauguaaagcccucuucuguaagacugcaguagcacauggugacugagcuguggugaccacagccaugccauguguucacuguugguauaagcaggaucugccaagcacaaacgcucugcccaucaguguucaguccugaccuuucuaaaccucuccuaucuucugcaggaaccacagucaaguggugguauugauugccuauguccucauauuaaagccaagagccaguuauguuuccuaucacaaagucagaugggaagcuacccagguuaaguaacauaaugauggagaaugccaggguaccguauaaguucagacaggcucaucuauuccuucagugagugcccugaugugcuggcucaacuggagaaaaccaucuugcucgccuuccuuagaggagaaaagucaggcugggaagaugccuggaagaugucguccugccaauuggcauggaugugcaaagcaugcuguagaacuguggcaacaccaaguaguuuauguugauuaaaauaagaugcuuauucucuaacuggaacuuagaauuuuaauacucccaaacaacauguguggcugauugcagagaucucauaccuacaaagugcuuuggagaugugauuauuaauaugagcuuuuauuuuggguggcccagggagcagauguugcaaauccuucucaggauaacagaagcugucaugcagaagccaaaggauaagcaugucaaggacuuguuugcccagagcuuggcaggguugcucuucaggguaagucuuuuuuauuacaugcugcaaauguagaauuaaaguaggcuuggcaaguuaguuuuaauuacugaaaaauuuacaaguuauaucaaauuaacuuuacauuuuuagaaaaauuccuucuuagcauuguccuaaaaguugugaucuguuuuccaguuugaguuuuguuuuuaggcuuccuucucugccauucucucccucuugguuugcuugagagugguaggccuuaagaaagugacaggcauaagcuggguggugcuggcacaccuuuagucccagaguugggaggcagaagugggcauaucucugagcucaaggcuaggcuggucuacagagcaaguuccaggauagccagggauacagagaaacccugucuugaaaaagaaacaaagugacaggaguugaaaaagaaaccaagugacaggaguugaaaaagaaaccaagugacaggaguugacaggagucuuaguggagagaaaaccagguagaucugguggcugugggguaaauagaaauguggaagugggguaaaacuugaggcuaucauugugucaagcaacuguauguaaugcuucaggcuggaaggaaggacuauacgggagaacuuauucuuagggagaugauggugcuucuaugguugguagaagagagagccagccagagaugcugaggaaggaggcccaguuugcugaguggaaagcuagaagguuguucuagauguccagcaaagugagcaggagcaggugaccugguaaguucugguaagaugugggugguugaaaauggccuaaagaauugacguuuacuuggagugagugaaucaggaagguggagguagcaaaaguggacaaggcuuccaagagcucuugaucuggaagggaggaggaaacgggaacuauguguagaggggaagguuuggagcaggugcuauuuaaauguuggcuugccagugugacauucuagugaaagcaguugggauggauuggugcagagggaggugacacucagcaucuggccaggcuggaugacucacuucauuugaucugagagccaaagagguaccaguacuuccugcgccagugggaguagggucaagagcauggaucagcugacagcugaugggcugcccaggaaagcggaaauaacacagagcccugagggcaaaugccugggcuacacugcuuuuuuuuuuuuaauaggguucauagaauuuaugaacauuucugaaagaaaacaguaaaaaaaaaaaaaaaaaaaaaaaccuggaaauauaugacaucuacguuaggccugacugaauaguuugauagucaggagcacuaugagcugaagugaagguugaggaaggaaacauccucuucaccaguuccuagaucuugacugauauauaugaagaguguauguguaguacagaugguguauguagaggucgcagaaggaauuggcacauacucccuugccucaucgauucucucuuccuuugacuacuuugccuaccuagcucauggguaaaugggauaggccuacacauucuuuuuuauuugaucuuuuuucuaaguccaggcuguacaaugagccuggauugguccaaacucucaauucuauugcaucagucuuucuagugcuagaauuauaggcuugugucauuauacuaugccuaugugagguuuguuuuguuugcaauaguccaaccuggcuuguugauguuccuguacugucaugugucauuugucauagacagaaauguccagauacuuguauguguguguguguguguguaagaguguguguguguuuuauauuuguaaagaacuaguacaggguaagggaauuuuacguugccguuagccuuuucucuuuuccaacucuuccuguaguguuuauuuucccucuguucuguagauaaucuagguuaauaaaguuucuucuaagaaugguggaauuuaucucauuuaaaaauauuuaccaaguaacaggcgggugccucagguggugccugucgucauagucugaaggcgagaaagccucaccucugcucucugcacuaggauccaguacuuggcaguguuuaaugucccugagagucaggguaggagagggugugguugguuaucaguuguaagagaagaaguccgugaggcaagguauauccuuguggcucaugugcugagcugugccugauuaaacacugaacaucagugcugagggacccuugacguacgcugacccacugguuugcguuuaugagaaguguaacuccagaaaggccugcugccuuucuccaggacucagcucaaguuaguggcacaaccuagugcugggacuaucacuuucccucuucuguuuggaaaagcauagucaauuaggaggcuguccugcuuuuauguccagugcuuccugucuucgaggauguuccaccauguucaagugcuguugugaauuuuguuggugauucauagaucuguauacaugcuugugacuaaagugaaagaagucagcuucuuucuuucugcuuauuucagaggaggucucaccuggccuagaacuuacuauguagaccaggcuggcuuugaacuuauaaacauuugccuguuucugccucccaagggcugggauuaaagacaugugucacuacaucaucucuuuauuucuuauuuuauacuuaguaaagggauuuccagucuuggcaucuuacuacaccaagacauucaucuagcuuuguuccugcuaccaggacuguggcaaugggaggugauggcaagagacuucagcagucucuguucucuccucuaagauuacgucucuugaucuaauauugggcccauuuuauuacuauuaguauuuuacugaguauuuuuauucauacuaaaacgccaguuucugucuauacauuuuaaacuccugucuucagaaguucaagcccauuaccaaaaagcauaaucacaauaaaauuaauaaucuucauguaacagaaaauauuggccuaauaauaaaauggaccuacuauuagauaaaaaauaguaauuaguaauugacuuccuuucaugaugauggguucucuguaaagcagguggcuaaccaggaaagcagucagcuccagccaugaaaacagaagcauacacagcauuuagugggugguggagcuauaaaaauggauaaacaaaacccaagcagcaggaggagagcugucagauggaaaaauccagagucagaugucugggagaugauggaguggaaaaauuugacugugacaguggagggaaagggccauaagcagaagagagucuacuuccaggagagcauguggguuuuuaaggugaggacgaauuggagaaugucggucugaagcacaagguucugggaagaaaccuggagcaggaguaggcgugccucucagaaggcgcugaagcuggguacgugcugcuagacugaaggucuccuggcugacggugaaggcagucucauucagugaguugucuuugaauucugcagcagucucagcugcucaaagucuugcagcacaugggggcuuagacaacacaugcaggaagguguuugagauagcuggacagagauguuuugucuucuuacugacaacagcaguguuagccauggacuuuagaauaauauuuccucagauaacuuguuaccauaauucaaauccuagauacaggugguccaaaguaaugaagaggguguuauuuuaauuuuuuguuuguuaaaaaucauaaauuuguuugguuucagacacuuauuguggcuuggauccgagcaaaccucuguguguacauuucucgggagcucugggaugacuuucucagggugcugucaucccuuacggaaugggaggaacucaucacugaauggucuaacaucauggauuccuugacagccgugcuugccagaacuguguauggaguugaaaugacaaaccuaccucuagauaaguuaagugaacaaaaggagaagaagcagcguggcaaagguaagagcagagguaccgggugagagagugcucauguguggaccuaagcuuuuagugcguaguaguucauaacgagcugaaccagcugccucguguuuuuuucaaugcugcuguuagauugugucuauuacuuuguccccuugacugauaacuaaagagacuguggaagacaacagagaaaaguacugagaggaguaacagugaccagugcuuucuacauggucuucacccuuaugguagcucuuuuaguuacagcugugucauagacagaaaaugaaaaauacaaagaccuuauagugauucagugagucaggguggcuuaggaaagaagugauaaagacagacaucaaagccaggcaaguccagcccaaauacuacacugcuaagauacaugcugccuagaacguguggaaaaauuccaagugcuugagaugggagccauuuuggcuuuauuguguuuuuaggucaaacuguuuuaagaccugaggaaguaaaagugguaguuuugaguugugaaauaaugggagucucuguuggagaugacaguggcacccucuugucacuguuacaguuccuaaggacuguggcacuugaguuaacuugucuauucacuuauauuguaaagacucaaauguguucguucaaaugcauauaguacauagcaaaugcagaaacaaacuggaccgaguaggaaguggcuauaggugugguuaaacagcagaaugccugggaggcucgugggcuuccuggggaaauagagaggcaccuucucaggguuauagcaaagagagucacagaauacagacauuucugugggugauaaguaauuucacuugguucugagaccuugaaggccucuuuucuucaaagcuuugccaaguuacauauguuugauaauagauuauguuuuaguaauaguaaccuuuuguagacuguaucaguuggcuuuugcuaugugacaaaucaccuuaaaacauaguagcuuaaccauucuuuuauuuagaccaugauuuuaugaguugauaauguggguugcacacucugccacugcuaauucucauuuucauuugauuuucuuugugcuguguggccacuuagagugcucugauucuaggaacugacuggcugucagccagggcagugagugugacugggcuacacacacguuucauaauucagcacguuggcacaugguuguuaauauaauguuauagaaguaaaauuuuaaggccucacaucuucagucuuacuaccaaaguaagucacguaaugaaguccagagucacugugagaacaaaggauguggauacagagagaugugaacuaguucuagugacgagcuaaccauauaaaugagcuaaggacuggcuuaucauguauucauugcaggcugagaauggcuugccaaagcuccaguuaguaaaagcaagcagcaagccaaagcaaaguagcuuauguucauagcuuucuaguagaauggcuuaauuccaguuuagauuuuaaugacacggcacaguaauguuuuaacauagcuuuagcaacaggucacuuuuucuccauaguugaagcuaaacagaauuguuuuuagaaauacauacuagacuagaaauccuauucucuucugguucucucuugcaugucugagguuuccaugugaacuaggcccuggaaguaucacgauacuaucugcaggagacuggcuaccuaagacacugcuucucagucuagaggagaguuuucucugcugaaggggaagaacugagacacaaaguaccacuuacuuuuucaaaauaaguguguuuccuacauccugaagguguuuaaauacacacacacacacacacacacaaucacucacaggaacaucucuacaugugugggacacacuguauccugaaguacuuuuuuccuaccuaguguauaaacacaguccuaugaaguuauaaauuagcaauggaaaguaaacaacuucaaaagugcuguuuuccagagagauaggagcaaauuauuuaaauaaugaccaugauaaacaucuuaauuuauguuaccuuagucaaaaaaguaauuuaaauauuuauuauacaaauaugggccuaagcacuaaauuagugaaaacagaagcuacauaccaaggaaacuguaaaaacaagccacaaguuguaucuggucuucauauuuauucugagcaaaaaaucuccuaaaugucuuauucuuuuuccuucuguauuucuuuuggggcuuugaccuuucuuuaaaauauuugacuagaagaccacgaagaaagggaaguuaaaucaaagaccacauuguuuuugaaacuuuucuaaaaugagauuuuaaauuauuuguagguuuuuauuaacuugcccauuugaccaaguauacacgggucucugugggguuuguagcuggguuggugucuuccaaagccaguuccauuuuaauaccaggacuuuauuauaaaguuuuuagccuuuaaguaaugguuuuuaaaguacccugggaacugaccuagguucagauggcauuguucuuacaucgagaagauuguuuaauaucuacuuuugcauguugaaggaaauacuaugcagacagaguuuguaugaaacuguauuuuuaggguacugacguaguuuccuaaacuguagcauaagaaagugguucuuaaucuguggcagagcucugcuaguggugaauuauuguaauguaggguauuuuuugacucuugguaauauagcaugcauacacacacacacacacacacacacacacacacacacacacacacacacacacaccccauuugcugaucagccuaggcauaguaaaaugaggaauaacaaucuuacccuuuuucagguuguauccuagaaccccaaaaaggaacagcuguugggagauccuuuucucucagcuggcguagccauccagaugugacugagccaaugagauucagaagugccaccacaucuggagcaccaggaguggagaaggcaagaaauacuguccgucaaaaagcaacugguaaauauuuaacaaaucuaauuauuauuuaaaugaauuuauagaaaauuuuaaauuucuauucagaauuuaaacaguaaaccuuuuauuagaugagcugugucaauauuuuauaaacuuucugaucugcuuauuucucaguucacagguuuuauuuuuuauuccuauaaucuguacugugaacaggaacaugauaaauacaucuuuagucuuggugaugucauuagcagaugguguuccuuuuagaguuccagcuaagaaaaugagggacgcacuugggcuuaggaaugaauggacacagucucaucuuuugcuucuguggaagcagagaucuuccuaugccugaagaggcugcauucacagcccauuugggcuggcacuguacgugauggagaaccugcugacuagcagacugcucguuacgguuuacuaaggcaagagacaaaucuuuagaaaggaagcuggcauucacugugaggauaguaagguucucuucuccauuugugcucugguguaggauagaaacaacagcaccuuaguguuugauaguuucuuucaucagcagaaccaugcaauuagaguggauagucaacagcuucagagaagcauaaacaggauccucaaaccauaaaacaaauguuugauaaauaacacauauuuucauugcugacuagaagccuaauauagauaguuuagcaucccguuggcauuuuuugucuaaguauguuguucucuaacuguaaguuccucauuccuuauuaugccuuagcauuugcugguaauuaucuuuuuaguuauuugcaccaccuauucuaguuguuucccuuuguucuguuucugagaaacuugauuccuaaaaccaugcaguacugaggaggcccacugauucccaucucaguucaaccuugaguauucccgcugucacugguuccgucagggaaaguacucagaagcaugugccaaaggcagugaguguccuucccaagcugugcagacuuaugcugccuucaccacccuugaauuccaaguauaagcacuaguucaaaaacagugcauuuuauuuguacauguugaucagcaacaaauacgugaauacuccauaugauacugcaaaucuuaauuuuccucagacauuuuaaaccgacaaugugguagaauaugcauacuuuaccagcauacuuuagaaagcauucaggaaaggcaggcucugauuaaugaucuucuagguauuugagggccauguggcacuggacaaaccauuuauaaagguuuuguaaagauauuuguggaacauguacuuuaaaacuguaauguugacuucugcagaauuaacuacauuuuaaaagucugcaacuguuuuauauuugaaauacagugaggaccauaaguuacauaagucuuuguguuuuauauauacacauguaugcauguguguguauauguauauauauaugcauuuccuauuguauuuuaugccuuuaaaaguaauaaauauuaugaauuuguuguuaccuauuaauggucuuugaagauuuuuguauaccuugcuguuuauuaaaaguaacacacaugagcacaugagugauuuuacucagcuuuauuuuccuguuuuuuuaacaaggcccagaguauuucccugcagugugaguguauagaaggcauuuauaugaguguauaagcucacugaggucauucucuauguucucaggaggaauuaguaucagcuagcaggaauuauuaugggauagccacucaaaaaugacuuuguuucucuacugucauuaagagagcaguuaagcucuucauacagugguucaccucgcagauuucaguuagguaaagaagcugucacugaugcugacaccagggaaacaggcuuuauagggaggauaucagaguguaacugaagaggccugucauggaaagacaacucuggcucucagugucaaugauggugaggauucagauauccaaacucagggugaucaaagugagucuuaaucgccacauaaaacagccaguauuuuacuauuuguaaaauuuauggugaucuauuuuggaaaaaugcauaaccauuugguuacaaaaaggaaagauuuuaaacagugcucaaaugaaaugcuggcugcauacagagguaaacagaucuucuacacuuugacauuuacauggauguugcccuuuacauauuaucuuacauauucaugaacuauauaguaaucucaucacuggaaacgcugauagcaagggacagggaagggacaguagaguaaaaaguuuguuuaaaugugccaccauuguauaaggguuuguuuuacuuaugcuuugcagagguacguaaaauaacaacauagcaaauaaucacuuuuauuucuauuuuaaggauagcacugaugauuuauggauuuuaaggauaguuuuauguaucugaagcacauuccauguuuguuuuauugaguguuuauuuaaccaacagugagaaaaucaaaaguucauaccaagaaacuuuugcucaacuaaaugugaaauacaauauaaaaagauagguuucauguauaucaaauaaaauguauaacugagucauauauuuaugagcuuuggggauaucuuguauacuaaaugcuaaaugauuagcuuuuaaauacacucggcucucaguaaaucaauuucugaauuauuuaugauguaauagaaaaauuucugucuuggaccagauuuuccuuuucucacuguggucuuuguauguguauccuuuaggaagagauacuaauguguugauaauguaauaaugaugaugcugagcaagcaaccagacaucauucugaugcucucugauacacagcagcaaaaggaagcauucuuaaaugaaacuaguucuuuuuguggaauaaccauucuaagucaucaguguuuggcugcaagguuggcuguauuuagagacugugauuuaguucucucauuuuauugauuucuuuaaagccuaaaauggcuuccuuuaaauguuugggggaacgcagcaccuuaagaacuuagaaguggaaaaagcucuugaugugcucugauauaauguuacuuuaucucuccuggaagcuaagcgaagccagucuaucagcaacuguguccaccucucugaggcuuugccugcuacuaaaagcgucccgcuccuccuccauaccgugagcgcucucuuaccuggucucucuuacuccucuugcucucacaggcugucagguacuguacuguugucucauguguccguccacacccccuggcuucucccuccugccacccccagucacacucagaaggugucuguugcacuugugcuaaauuucaaaaaauauuaauuguuguuuuuguguaguucauguuuaguagcuauuagguagucaaaaauucuacaauccugcuaguuaucagauucauggcuguaauagagauuuuaauuaaaaaaaaaacaaaaacaaaaaacacuaaccagugcuaauuuucaaaacauuuguucuuagacuucacccaguuaauucaacuggauuaaguuuauguguauuuuuuucucuagcacagcaaugugaauagaguuaguaauaaucuauuguauaucuuguaauggccugaguagggcauuuugaaugagcuugucacguaaaugagaggguaauagguacaugaguuauccugcuccaaugucacuucucccacauuguccaugcaucaagaugccacacuguguccuaccacuguguguaaucacuguugugccaguuacaaaggaggguguuguaauaccaaaaauuaguuuucucauguuuugccuagucacuucucaaagggaauuuauuuuauguguugaauaauuaaaucuacaaagagauauuuuucagugauuuuaaggugaauuauaucuuaagagggaaauguuuucauguuccuuuuauguucugaauauagauauagauuaagauguuuucaguacuggagauagugugaguacaguuucuauagcucagacacuguagcaccauuguaguuuggcaaaauaaaaucaaagcugaaguaaaauaccaugaggaaagaaguuaguuuuaacugagaauggggacuauaauguugcuuagaaacucucuuuaguaaacacugagugugaaaacagugaggcugcuggcaucggagggggacucucaggugaguggcugcugagcaguaaaugcuugcggaucagcuuguccaggaaaggcaucuucuuagaggugaugaaugaggcauuggaaagaauuugcuagguauuuggcuaauugacaccaaaaagaaaucuuuaauguaaaaaguuuuauuucuuucucuauuuuauuuccguacuguuacauuuaaguuuuuuuuacuuguuuuucuggaauauguucucagaaaaaaaaaauucuuccuauuaauaucucuucauuuguaaaaguuuuguucuuauucagaguuauauuuucauucacucaaauucuucguguguguguguguguguguguguguguguguacauggcaccagcagaaauugagugacuuucugcagugacucucaacuaggaaugauuuggcaacaucuggagacauuuuugguugucugguagguagaagccagagauccuacucaauauccucacuggaagcagccuagaccagaagauggucagaccuaaggaucuauugugcagaugggcaaauagcccuguaaaguggagcaggcuggagcaggucugugucucccuaucucugccaucuucacugauuuuauagcagggugacuuuaaggacaaacugcuacugccauuugaugugacagguacaguaaugagugccuucucagucugacuccaggugugcuuuauuaguuagugugauaccauuguccuuugugacugucccgugaguagacuaggcugagagaagugaguagccauucuacuuggcugguaauuugcagcaugguuuguguucugauguaccucugaguggauggcgaucuacugcuaagcugcagcuaaaugauaaguaagucauuucaguucuccuucuugcuggcuacaaguugagguuuuuuguuuuuugcuuuucuuuuaguuucacugugucagugguugcuaguuuuguuuuuauuauggcagaagucuuuguuuugguuucuaaucugugugagucaacccaccagaauuguaauaauagaagcaaugguaguagaucuggaggugugggaagcaaaugguguuuaaauuuggggagagucaaaaugacccacuuccauuaauaugaguagggagaaaucugugcaccuugggaguaguugugacagcuggggaguccccucucuuuuucuugaaaacagucccucccgcuugucuugcaguguuacuuuuuucucuguugggacauuuaucagucuguagcauuugcaugcuaugcaaggguagauuuuucuuuuuucuuuugggaauguuguaaugguuauaacuagcagauagacugucuuccuuuaucccaguauaugggaccuaaggggaggccuugcugagcugccucucugucuuuccacaagcuccauggaaguucuuccaguuaggaccuggacuaacuuacucucaggaagcaggaccuuguggacauggagagugcuaaauggaaagcaucuccugggcuuuugugagaucaaguugguaucaccagugguauuuuuuaaacuaggaccuuacauucuaauugugcuugugcauccuugcaugagggauaaauggaacauagaauuuuugcuuauuuaauaagaugaaauaaggaagucuguaauuaaagagugaaugaaaaguagacagacaucuggagaaaauagaaguuagcugcagaacauacacauuuacuucagucaugcugacucuucucaguggggguaaaagccacgaauccuuaugaucauuuugcugaugguuuuaguggagcuuuagaaaacaguggguuaggaaugguguugagaaacuacauccucaagagacaggaaaguuagugcuuuugaucgaguguuauuagacuucacagaggauaaaugaacugagucugaggcagaauucuguucuucaaagugauuuaaacaaaaauugugugacauuuaaaacaggaugcaucaaaucuaaauuuauugcacaauuguuuuguaacucagaugucauuuuuuuuguuuguuugaaaggaaauccugugucuuuacauuuuacaucaguaggaaaaucauuuucauuaguuaaaaaaaaaaaagccacucagauggacacaguagaaugggagcagccucagcccaacaugaacuuucuucaacaacaucgugccagcagagggagcccgagacccauuaggaaggaaaagguguuaaaccaucauucuccugucccuuguauagagcucucgcugaauacaguguaacacacagcaaggaauguggcuguuccuuuccuuccgcuucucucgcccauucuuccauuccugccauuuccaguucuuucugcaggcuuggauuuucuccaucugagaagucccucuuaacaguuuugcaaaaacaaagccuuaaaagauguauuaggccugccuuuugggaaggcagacagcuggugguagcaggcucuguguccuccgucugcugugcugaggaccaguggggacacucuaauuuggaagccauggugcuguggcuguguugcaucccaccagauggcgauguucuuuaucuuuacaaagaugcugccagaguuggcucaguucuuauuuacuucugcucagaacucagaaacuggcauccaccaguauuuggcaccaggcuucagagaaaagaaaaaaaacccucucuucccucuguccacaauuauuuuuggccaauuauuuuucaggaaguuuggaagcucuugggcucccucuacugauacaggaaugacaaauagaguaguaucauuucaccaucuugugauauagaguaagaagauaaccggaaggccuggcccuagaguguagggaccuggggcuaaauauucuagcagaccugugaaaagagccuagucuuugcuuuguauggguagacugcagugugugcauaagccuugugugacuucuauggaaaaauacucaagagaaggcaaagaugaccugagaaagaugagacugccccuucaugccauauuggccugucuuuuuucucagguucccauuaucauccaucuuuaaacuauggucuaguuggaacuuugauucauaaugacgacucacacaaagcucauaguuuugaggccuuguaauguacuaguguaguagaaaauggaauuuucauuuggguagaaaaaagcagagcagcaaucauuuguggaaaucucagagucauccuguguucacacaucuccucggcuggagugaaccuuuacuguggcuuauaugcaggugggaggacuucacauggggugagcaucacccauuggcagugacucuccauuucagcugagcaaccaggugacauagucaguguagcuaauacagacagagcuugggagcucucuguuuaaaauguaguaaggcucuaacugauuuauuuuuuucauuuuuggaaaacauggugacaugggauaugaaguuguuuuuuucuaccucaucagugaguuuggagcugagcaguggcuuugcaugcaggauguagaacaagagguauacaugcuuggggcagcaugggcaugacaggcagagaacagggcugagauuagcagaggggaguguggagcaggaggaagaaggaagcaggugccaagaggaucaguguugcugaggcuacagagagugggaacuccugcacugugaguagggaucgguaugugagguaggggugacacagugcaggugagcacagaguugagugaugguagacagucacaccuucauuaaaaugaggggccucucugacagccauguagaaaauagcaaacagaaggagccagugacuaguuaucagacuacucaaaugaccuaggcagaaggugauacaauccuggggcugggaguggaaggggaggggguaggguuccaugacugguucuaaaagauucaaaugaacugugcacuuuagaaauggcuacaaggggacccauucuccaagggaguagaggauguaaaguauuagcaagguuaucuaauguugagugcucaucuuuggcuuuccacuuuauaccauguagaugauguuugugcuuagugacuaguucagcuuuguacauuguaaucugaguauuaacuagcacuuuacuuugcacauuguacauuaucuauuagaagagcugguccaguugggauuccuguuuccuuucaucuuaguuuaguguugugcucuccucaaguauuacuuauuuaucuaugcacuuccuacacggcugagucuuuccuuccugcugggagauuucaaaugacucagaguuaucauuuucucuugcucccuuccuucaccuggaaaacaaaagguuaacuagaauuaagaaaaacucccucacggcguggaguguuacugauaaggagcaggaaguuggaugaugugcacgcagaucaccuuacggucuaguuucuaaagagaaaucugaaacuuaggguuugaaaucaguuaagugugaaauggucuggauagucuccacccccaguccuggguguuuuguguuaaugcuuucagaaguggaggaguuccagcaggcagagagcaccgccgcagccgacugugacuaucuugugguaggacagcagcaggugccccggagcagcagcaccucugacaucacugagcgcuuguacucagacuccucucaagguauguauguggaagcuucgguugcuugcuuaacugguggauuaauugugaggacagggucucccucuuuuucuguggcaggcccaagacucaguuuguugacuaggcugaccucgaacuugcaggucccuccugucucugccucccaaguacagagacuaauugugacugaguccucaguuauuaguacaaagccauagguuuugucuugggauggggauaagcagcagguaguauugcuuauuacauuuauucuaaaugagacagagagagagagagagagagagagagagagagaaggggagggagggagggagggagggaggaaggaaggaaggaaggaaggaaaggaaggaaggaaggaaggaaggaaggaaggaagguagguagguagguaguagguguauguguugcuaguguguauaugugcgagucuggaguccaaagguugacuuguguuaucuuuccuugaugacuuccaucguauucauuuauuuagaggugaaacguuuugcugaucuuugaaagcuuaccagugagcucuaaagaagcucuugucucugcccugccccagguuacagccccauguugccucauccugcuuuuuccacgacuucuggggaucagagcucugguccucaugcuugcacagcuggcccuuuaccuuugagccgucuccccagugcagguauuuaccuuuugauuugaccuuaagaaugugacuucuggaagugaaacuggguugcuauucaauagccugggaucuagagaggagucggaagugacuggaauaggagggauagagaguucccagaggaaagacacuaaguaaggccugaggcagaaagaaagcaugagaggcaggggguccgggcuaugggaagagcuggagggguuggaaugggaacgaaagcuggucagcugugugcaggguuauuagcugcucacagaccccacugaggugggaaggcgcccuuuuagagcacacucuaaaagguuucucuagcuuucugcggcaacaggguguggaaggugaggagacagucagucguuacugaagcugcagacagugcuaguguaucuuacagugaaaaaacaaaucucagugggcacagugucugugaaugcgccagccauuccacucuagucccaugagucagucagaaaacagccugucuuguuugucaccgguucuccugugucuucugauaguagaguuagcagaugaggggggaaaacuuuccuuagaaacuccccugaaauaagauauuguaacaaagauaaagaugagaaaauauguuaucugaaaacuuucuguucuuucaaguguuuuguguugaucauuaggaacaugaauauauauguugugguagaauacuugccuaguauacaggaagcccugaguuuaauuuuggacuaucaggagaaacaaacaaugaaaaaaaguugccuuaaauauuugggagaaugcaccaguuucuuggggcuuuccucuaagacaaaauuuuaauccuuuaaaguuuuaacaaaguuuaccugagagaagagaagcuccaguggucuagugugcagggcagugugcuuccuucccgaagagcucacacagcauugcuugcuugucuaagggauuccauuggcccaggcuggcccugaacuugcagccgauuccccagccuccaggugcuagauuauugucacgcaccacuaugccuagccaagaggagguuuuuaaguucucugaccacaugcauguaugagguaguauauauguguaguacagugauuuauauaugcagauuucaaaacagcauaagauaaacauguaauauuuacuguguaaaaauuuaaauuaaagggcuauaagacuacuuugauuuucuuaauuucguuugauguuuuucuaggaacugguucuacuuguuaauuucuuucaaauuuauuggcuccagauuauucaucagaugcucuuaugaucuuuucuuaaaucuuuacaggcucuguggugguacugcuuuuuaaaucauugacacuguuucugccuucuuaugcuagucuuuguacuccaucaacacagagcuguccuguauucccuuccuugugcuucccaggccaaccuaggcagccuuuguccagugcugacuccacacucaccuccccgagugaugugcugcaugcuccuggccaacggaguauacuaguggaacuaugaaccacagugaacagcuuuccaucugcuccgacugaagcuaacugugggcuguaggccagcacucuauguagacuggacccuuagaugcugccagugcagacccauaauucagcaccuuuauguaucuuaugacaucuggguacaaugguuuaucugucuguuucugccccugccggccugccugcuugccuaucugucugucuccuauuuuaccuucugaaacauucauuuuauuauucuuaccccaucucuaggucaaaagguagaacauucgcagaauuuaagcucuucagaacccaagucuguucaagagaguaaaggacaugugacucaugaacaugaaggaauaacaguaagauuucuaagagaacuucccucugcuuugaugaccaagcauaaaguauacaaugacaaugaauuuauugaugguaguuaaaguuuuucccacuuagguugauuagagguccaaauaaucuugaagucucuuaagaauguacuugcuuuguauguaaaauucuacaaagauggggauacagcaugaaguagaauguacuuccagauugcauguuguacaguucacuuuugaguagguauacuauaaagccuucauuucagagucccauuuccguauuuuacauggaaugcuguaccugaucaguauuccuaaagcauaucugggguaguuuuguuugauuuuuguaaagaaggcauuacuuagcaaacaaauauaaaguauaaaaagaaacagccuauagcucauuaagauaaccucuauuuuuguuuuaaaaccuucccuggucccacuugcuuggaagauaacagaguugaguucuuguguuucuguguuuaagaaagacacgugccagccugauugcauagauguuacuuuggccaccaguuugguuguuguuuuggugguuguuguuuguuuuaguuuugguguuuuguuuuguuugauuuucaagacaggguuucucuguagaccaggcuagaucacagagaucuuccugcauuugccuccaaagugcuggaauuacaggcguguaucaugguauuggcuuuuuuuucucugucauuugcauguauguuaaugcaaaugagagauaacagaagcauaaacauaacacaaacauguuacuuaguuucugacuuuuuuaaguauucugugggugcuguguucacucagcugcauguuuguaggguacccacauguuauuauauagcaguuaacucauuugaacuuucccugcuauaggauagcucacuaugaaucuaucacuauuucccuauucuucuguugauggcauuuagauucuuuccaguugggcuggagagauggcucagccguuauaaggcuaggcucacaaccaaaaauagauucuuuccaguguuuugguuuucugaaagaugcaacuguguaccuucuuagguauuucucaagcucuccauguucaaauguucaaauguuucucugugugacuaugucaaaguagaauuauuaaauuaagcaauaaaagauuguucucgucuauaaaacgaugcuucuuccccaagugcuuauaucucuacaagcaaugaaaagaguucucacaagcacccugugaugucauacuuuugaaaguuuugcaagugaugcaugggaaugggauaucauauuugaauuucuuagauuacuaagaaaguuuaacuuuccuuguugauuggcuguuuuaucugugaagugccagccaguggcuuuuguuguuuacuuuuuucucccuuuacuuguauuaauucuuugcauagccugaauauugucugaaguuuuauuuugacuguuauaauagacaucuucccuaugugugccuguuuuuuacucuggugucuuuggaaaacacaaauucuacuuuuucuauauucuuuaguaugguagaauuuuauggaauuaaaacauuucaacuacaaaaggauaaguuauuccuuuauuuuuauucuauaaaaugcuuuacuuuugguccacacuuucaagucuuuuauucaccuggaagugucuuguuuauggagggagagggugacccagcccuuccccccagcugcaugucuagguuucauuuauugaaucuaauuuuucuuuauugaucugaaagaccaaaucucugucauauguacuguuuccugaauauaucagccuucauuuuguuccucggguguuuugucucugaacaggaccacaguguauuaacagcuauaguucugauuccuuuucuuucucuccugaccucuucugauggaaguuagucuuuggacuaucuuuuaucucucucugugugcuauugagaugccuuuucuccaucuugucuaguuguuucuuguugaucuuuguccauguccuuaaguuucacugcagaggauccagcauccagguacagacucauaugguguaugcauuuguccauucuguucuaugcuaugucuggguauccauggaugcuuuucuucugcuauuuuagagaaaucuuguagugaugccuccaaauacugccauccuuuuauucaauauuaucuuuuguuccagaauucuagauagaaacaaacuaggcuuucuuacccugcccuccaggucuccuaagcuuccuuucacauuauccauucuccuugccucuauggauguagucuggguuauugucucaccaauaaaaguguccucggucuuucagcaguucaauaaaucugacauuaggagcaagccuuggagguauguccuaggagcuccagaugcaagcagaguuuccuuuagauguggcuuugcacuugagggguuugggcucucacacuucccuugagguaguguuuuguuuugugcacuuuugccucacugguguacuuuaugcuucugaguucaaauguauuaaguauaucuuggagcucuaauaaugucauuacuuggucauuuuuuauuuucucaucuuuuaugcauuuaaaaugcucacaaauccuaauucuggauucucuaucugauuugcugaaaucaucuagggaucucucucucucucucucucucucucucucucucccucucucucucucuaucuaucucucucucucuucugguacucuuaugucuggugguuuguuuccuaaguuuuuggugaucuuuguuauguuaccuauugggcugaucuaaaucuguggaaaacccaagugucuaccuuaaugaggacuguucaggaaagcauuugcauuuucauuuuuaagcaaucaggaagugccacuuugguucugacucucagucuugccacuagcaaugauagcacuggcuuuacucuuagcagggcacuggauugccugaguguucccuuuccuauacauagagcuugcucauuaccagugcaugcuucugccucgagucccuccugccuugcuucuaccacuucguaucuauagccuucuugaaccgcucgccucuaacuuucagccgauuaagguaacacuuuauuuuacauacuuuucacacugaguacauuucuauauuuugcuuauguacacuauuauuuuuuuuguguaguuuguguauguuuuaucccucuaagcaaacuguaaauugcuagaaaauacagguugccuccuguuuuuuaauuuuuuguguuuaauauaagguccaguguuuacuaguggucagaaaguucuguaguacaucaguaggaagguucugagcagcccuuugaaagucuggguggaguguguacuuuuccuacccaaacauucaugggagcucaggccuccuggagaauugugugacugugugugcauuugauuagagaagcaaauagaacuucuaaauaaaccacuucugcaggauuugacaccccuucuuaguauauccacucagcugcauuaguugaccaaguagagaauaugaauuggacuuucagaucuugagaaacauguaacuuaauuauacuagccugugaacauauccuucaaaaggaaaauaguauucaguguuuuguuacuauuauugcuucuuuuauuuaaaaauaggcuaggaacauaacaaucugguaaaaguuugaacuuccugguaaugaaagcagcauuucuuuucgucugaagauguugguucgaaggagcagcagucccgcugagcuggagcugaaggaugauuuacagcaggcacauggaagaugcaggcagagacagacaaguacguuucaggaaauggggucugcgcgugccugcugcagaguaggccugcuucagucuccuccuccuuucuaagugaagugguuaucuugucaguagagaagagcuggccguggagaauauuuuugaugggaaucuuagaaauuauguaguuaauccaguugguaaaacaguuuccguuaguuaccuauaccugagaggccugucuuucuaucccugggccuuuauccaggugagaagaacaggagggauguaggggaguggacagaugcauaaggaaaagcuaccuuucccacaaaguccccacaggcaagaacacaaagcuucagagagagguacauggaagccagugggcaagugugugaaaaugaaauuucacuggaaucccgagauguuaucauaggcuacaaggucugggcccugugcuucguucuccuguccucaggucaccuucuugucagugaguguagcagaguggcagccccugcacacccaggcugaccccugcugggguauuucaucccagcagcucuucucaugcacugcuucucccucuaaugccuguagcucuauagagauugcuccaugagaccuaacccauagcucaucugcuuauugagacaacugucaguucuuugcaagcggauagaggacagcaguagagauggcccagcugaggggcugucagcagaggaaggaaagggugggugaacugggcauuguuaggaaauuaucauguggcuucaagcagccggguugucuaggcuuauccugugcccaacuaaauaaauaacuacauaagucugucucugcauaauuacauuuguagaguuuaaaggagaaaauuuucagucgugguaggacaccucaucccagaaucugccugcaugcugaagccuuguuuaagucuaaacacugggcuugaaauaacaggguaaccaugcaaugcuguaaaaucaguuacuaccauacgccuccuguuucucaccauuuccucauguuauggauggaucuuaaugggaacuaggacuugguguaacuuuggaacucauggaauaacugagcaaaaacaaugaccagaauacuacuucauaaagccuauuaaugccucacucuuggaagauuuaguuuuguuaagcaaguaucuuucagggacacuauugaaccccaaccagguucuucaaauuccacccaaaccccugaccaaacccuaucuugugggcaaguguuacuuacauagagauaauuuuguaccuuaucuucauauagcuguggucucaaaauuugguucucugugugccaggugaaaguacugguagugacacaguugugggcuacagcaaugaagcagagcuaccugugagcccguggcaggccugugaggaggacccggaccugagcacucccacagaugcuguggcugacucugaugcccgccacugguuacaacugaguccuacugaugcuucaaacuuaacagguaauuguguuugaaaaggauuauugcugcaaagaggagaccccagaguuccccacucagauccccaggcacaggcacaguguaacgggugccacucugaaccacgucagagucccagcuccagucaccgcucacaauugcucgugaguucuuagccuugauggaaaaagguuugcaaucaggcagacauggaaggaagucuaccaugcuuaugaccacugucuaccuuaggaagaagugauggugucuuuggaggcagaaaauauuaugguuuguuuuuuauuauuauuauuuuuuuuuuuuuuagcuugcauguaccacacauauagagaaaagagguugacuaucuuacuauuuaaauuuuuaaaauuuuuuuucuuuuguuuugguuugguuuugguuuugguuuuucaagacaggguuucucuguauagcccugguuguccugggacucacuuuguagaccaggcuggccuggaacucagaaaucugccugcuucugccucccgagugcugggauuaaaggcgagcaccaccacgccuggcaacuauuuaauuuuuuuaacuauuauaaaauuuuauacauguaguguaaaguuauaacauauauguggggugaucggucauaauaauaaaaugaacaacaaugggcuguugcuacccaguuuaagauauagaagaauaccugugggggcugguaagaugacucagcgguuaagagcacugacugugaaagacuccgggaggagccccucacucaggccucaggacaauagcggacacccaagaacucacgacagaccgagcuuguugcaaaccacaugaggcuuuauucggggaaagccagagcucuggggacgacucauaucccacgcagggguagaggagucguccucgaggggaaagaguucccaguuuuuauaggcccucaggggggaaaggagaagggggagauuaggggauuuccagaucuaaacaaugucuauucucaagaaauggguaugggagggguacaaggaaagagucuaaugaagauacagcaaugggcacacaccuggucagaacauuggcagacauacagguucaaggaguggccagagcacugugcaccucuauuuuucuaaaucagugaagcuaguucuguuaacacuaacgucuaucuugccaauuucagggcuucuguguccuuuuacauucugccaggaucuuucaacugcucuucugaagauccugaguucaaaucccagcaaccacaugguggcucacaaccacccguaaugagaucagacaccuuaaauaaaucuuuaaaaaaaacaaagaauaccuccaucauugagauuccagaagcccuauucaaaccuguuaucuucuuccagcagccugcaaugcuagccccauuuaaaagaaaaaaauaauaauaaucccuggaacugaggagaugguccaauggguaagagugcuuguugugauaguuugagggcuggguuugaauccccagaacccauguaaaaagccagguauacaggauuuagcucuaaggaaauccaguuuuacaaaaaaaaaaaaaaaaaaaaaaaaaaaaaaaauguauccugcagaaacucacagaaaaugguuuucaucuggaaaacaaccaagaagcaacacugggauaggucagaauggaugacauguauuuggagguguuuggcugagccaucucauccuuaguauguuuuugaaugcuuuacugagaagccuucauguuuuacaguaauguaacuaucuaaagagaagcagugcaucuuccagaggagcuuugccuguggauuauuacauaagcagcuguccaugggcagagugguaugguagugcaggggaggcggcguuagguuuggagcugguuugucuucucuuccccuuuucauguacuuuguaaugucaguguuuauaugaauauuaucuugacuugcucuuccugaauaaagaaguuauuaauugaagaacagaaacaaaaccugagugcagcuguuuaagccuuuaacuucagcauugugagcagagacaaguagaucuuggaaacucacuuaccagccacucuagcagaaaagccaagcuuucuaauucagugaaaggcucaguuuuaaaggauuaaaguagagacugauagaggaagauaccuaaccucuggcuucuucaugcaugcacauagguaugugcacucgcauccauguacuacaccacccauaccacgcagaccuaaauaaauaaauaaaugaccugauguuucccacugggcaugguggcacacaccuguaaucccagcauuuaggaugugagucaggaagcacuuaggaaauaaagacccauuuuuaagugcuaaaaaucaacaaaaguacaaguaaagccuaaauuucauuccaaaugguuuuucuugaucaagcaaacuuuaauuuucauugggauuaaaaucaaaguuaaccaaagugucugauauuuuuguaaauccuuggaauuauaacauuaaaguaucauucaaucagcauaaauuguauuuauauaauaauguauagaauagguaaugauccugauguuaauacuacaggauuuaagacuucuaauucuguagggcaagcaggcuaaaucccucuauuucuguuuugugagacccagggaaaucaucccuccccccuuccugacccccacauauauuaaacaauacuaguaagugccugagucagaauuggccucuggaugcugagcugucucugcacuccccacuauaucacagcuagaauaauagaugggaagcccuuugaacugcuggaggguuguuaaugcauuuauuuagggccaguguauaagagauuucugcacgauggugcgauagaucuagugcugaguuuuacuugaauguucuuaaaggugaaccagaugcaguuauuuuuauugaaaggaaagaaaauuggaugagugcuucuuuuguuuguccuugagaaagauuaguuuugaucccauuucagaguaugcaucugacugcuuaguguagugagcuguguaacucuguauggugcaccauguugugguuaacuccuccaaauacuuuguucuucuuugaaacacuaaauggagacucagcacacauaguucaagaguucauccugucagcuguggaaagcacaaacuguaauaugaugaggcuuaaggauuaucacaguucugaacuuaacuuucuguucuuaagagaacaauuucuucauuaaaaagaaaaagaaagaaagaaagcaacaaaacuugagauacagaaagagcaagccaucuguggguuuggguguguggcucagugguagcuuuugccgagcaugugucaggcccuaggauugaucaccagcacuacagaaaacaaacaaaaaguguuagucucacugaauaauccuacccacuaucagcugcuuagaaugaagaaggccagaguuggggagucgggggucagcuaauaggcuacuuuaauauuugcuugcuguuuaaaucaucucauguuacugaaaacaauggcuaaguuuauuaugcauuguucuaaaauauaccugggcuauguuuaaucaggccuauuaauacaucuaaguaaaauggugguaauuaggagaaauugucucugaacacaggugucacauagggaauuaucaaguuuagucaagaaacagaggaaaaaaaugugggaacaagcucuguugucuuuucaacaggaaaaucaaggcaagguagggugagcagugaacucaguagacuguaaacacugaggcugucuaguugauugggaucuggcccuggugcgggaaggguaggaguagaugggcugaucugucagagacaaagguagauaagcaagggagaagcuuguguugauucauuuacauaugaaaagcccauacucucagggagggaggaguuuacuauuucuauaguaaaguaacaccaggaggggcagucccucucuaagaugccauagccccaagugccauagcguuaagaguacaaaaagugaaaagaugaaguaauauacacaucacaucugcucagaagugugguguaucuguggcucugcuuugacacuuagcauuguuucugagcuuauccuuuaguuaacagagaaaccuuugaucuagaaauacagauuuagauacugugagaaauauaaaaagauaccuggggcugaagagauggcucuugucauacacuugucaugcaagcauacagacuguaguuggaugccuaaaucccacaggaaaaccaagcacguauacuagucauuuguaaucccagcucuccaaagacaaagaugaggggccccaguggaagcuggcuaucuagacuaagugcaacuggugagcucuggguucagagagauauucauucucaauaaauaaaguggagccugauugagaaagacuaccaauguccaccucaguucccuauaugcacucacacucacauacaugcuucuacacauguguaaguguauacauauacacacacguacaugugacaaaaaaagaugaaugagucacagcuacugaucucuuaggaguuuacaaccaagaauuaucucugauaaugugauaaauguucuguagcuuauauaaugaaaguuaaaauccuaggauuucuagacaaagagcauuugauauaaacuucagaacuuaguccuuacaggugugggauugugguaugugauagagggucuucuugagagagggguagaagaaauagaaucccuaucucacaucaugccugaaauuuguuccaaagguauagaauucuuaaauaugaaaaggaaacucuaauacacuuggaagaaaauguccuccagaaaaguaaaagaaagagagagaaaguaaaaaccccaccuauggucagucuugggguagagaggguuucucagugacaaaggaaaacaaguaaccaagggcugacccuaagaaauguggugauaguucaaccucagcagaucuaaaacuuucaaaaucaagggaacuuuaaaaauuauuugacuaguuaggaucccaaaaagaggaaguccaacuuugaugaucauuccuuucuaggucuuagauuuaauauaagaucugauaauagauagcugaugccucauuuuggguggagccagugucuuccucugauggauuauguccuccagucuggaaggcagauuaucuguugugugcacagaaugccccuaacuaucaggacagugugaguaagagaagccuuaguaaguaacccaaaccaaugaacauauaugcuuuacgcuuuagauaauuauuuaguuaaaaguauuaauuaaauuuuaaccuuaaaaucaucauguaauguaguuucagaucucuuuuaguuaacauauuuaucacugaccuacauccaaaugucccuuacaggaaauccuuuaauuacaguuguagaugugaauugaacacuguucacuuacauugaaguugauuuguagaaacaguuuaucaguauucucugucaucacacacauguuugauguuuuaccagccucugauaugcuuguauaucaugaaauaauauaaaguaaguaguaaaagcuacacuggcauggguaaacugccuuuuaaagucugaacugagauugaacaguaaugaaaggagaugagggaggggcgggaagucaggcugcccugcaguauaaugccaacuuguauccugaucuucugaucccugagcuggcaccuggcuucucuaucccuacaguuaagauguuaacaagagucugagaggugauagcauuuauuuucaaagaaaagggcuuugcuuugcucaaacucugucaacuauguaaaauuacagcuguauuaacugguccuuuggucauaaguacccauuugccaguuaaaaaucuguucaauauuuucaaauuucugaauuuuauacuuaucugcuauaaucauguauuuggagaaagaugguaaaauuuuacauauguuuaagaguuccuacuuuaguaauuuuaaaggccucuauaacauuuagaaacaaaaugacauaggcugcuaaugaaauuaaagcaaauauuugguauuuuggaggugaacauggaauuuucuaaaaucucuuaaauccccauuuuuaaucaagcguuccuucauugaggacccgucuacauguaaaaugucagcaucuguucuggaacucgugccaccagccggauaauuuugggcauaaacacuuuagcucauuaaaaucuucacaguaauauugaaaaaugaacacagucacucgaaaaccuucuaaagagcucaacauauuuugauagugggggauguugccuacgauuuuaaucucugagacaagaaugauucuugaaugcaaagcaggauugaaacagauuuucugugcagauccuuagaaacugagggucugguugguggaggcacagcagugcagguggugagugaguacccagccuucaugcauguggagcugucacuucagcaaagcagcagugccacugggaugcuggggcuggucucacuuuguauggcugcauucauaaaguuggggaauuaggaugaagcaagguuaugagucaccuaauuuucuuacccaccacuaaggaauugaagcaauauggcaaucuuauugaaagaaauaaaugucauaucaugcucuuuauucacuugagggcuuagguugauucauaagcauucauuaaagcauccucaugucucugcaaacagcagcugccugguacuguacuugauuuuauaggaggagacucuucugaggcuuaauaaaagucacaaaaugaagaggacccacaauuacgcuuuacccucugugccuucaguuuuccagacauggcuuguggaaauucugguuuggauggcuauacauguuaaugugucuucuccacggaguguaugguguuccucuggaaggaaucgucucgcuuuccccuaagcaacaucagugcuuccauggauagccuucccaugacaccaccugucauccuugcugacucuuuuaucucugugccuggggagucuuccaucacuagcacaaaaagugguuggauccaucuuggcccugcuuucugcuuuucugauucacuccucuggcuccuuguugacucucuuagccccuccucaggugcauacagagauuugcuucauuugccuagacaaggccuuuaaaaaaugcagaaaucaguccauucuuauuuguaugggguaaaugcuagaauaauuuugggauaauuacauaaauaagaaaauaauauauuagagagagaaaaugcuggcagaaaugggagaacucaguaaauucucaccaaagacucaaagcagaagcagagcaaaggugacuuaaacagaaagcauaaagauuuagaaauaagccaaacauauuagcuaccacaauaaauguaaaugaguucuuuaaaggagagaagaccaccaguguaguguggguggacagcuggguaaaauuuaaaguagaaauuaucagcaagagcaauaauucuacguuuacaugcacuucccagcuuccagacauauaaagcaaaauuuggggaaaaaaaagacaugaguuauuacugauaaaaccauucucauagaagaaauaugaguauaaacugccauuaauugauaagcaaaaaaauacuaauaagaauaagaaaacauaauacaguuagcucaguugaguggacacguguggcuauauguauuuggcagaaguucagguuuguuuuuuuaauuagguauuuucuucauuuacauuuccagugcuaucccaaaaguccccccauaaccccccccacuccccuacccacccacuuccacuucuuggcccuggcauuccccuguacugaggcauauaaaguuugcaauggccucucuuuccacugauggccgacuaggccaucuucugcuacauaugcagcuagagacaugagcuccaggggguacugguuaauucauauuguuguuccaccuauaggguugcagaucccuuuagcuccuuggguacuuucucuagcuccuccauugggagcccugugauccauccauuagcugacugugagcaucuacuuauguguuugcuaggccccggcauagucucacaagagacagcuauaucaggguccuuucagcaaaaucuugcuaguguaugcaguggugucaguguuuggaggcugauuaugggauggauccccggguauggcagucucuagaugguccauccuuucaucucagcuccaaacuuugucucuguaacuccuuccauggguguuuuguucccaauucuaagaaggggcaaaguguccacacuuuguucuuuguucuucuugaguuucauguguuuugcaaauuguaucuuauaucuuggguauucuaaguuucugggcuaauauccacuuaucagugaguacauaucaugugaguucuuuugugauuggguuaccucacucaggaugaugcccuccagguccauccauuuggcuaggaauuucauaaauucauucuuuuuaauagcugaguaguacuccauuguguaaauguaccacauuuucuguauccauuccucuguugaggggcaucuggguucuuuccagcuucuggcuauuauaaauaaggcugcuaugaacauaguggagcauguguccuucuuaccgguuggaacaucuucuggauauaugcccaggagagguauugcgggauccuccgguaguacuauguccaauuuucugaggaacugccagacugauuuccagagugguuguacaagcuugcaauuccaccaacaauagaggaguguuccucuuucuccacauccucgccagcaucugcugccaccugaguuuuuuaucuuagccauucugacuggugugagguggaaugauuugcauuucccugaugauuaaggauguugaacauuuuuucagguguuucucagccauuugguauuccucaggugagaauucuuuguuuagcucugagcgucauuuuuuaaugggguuauuugauuuucuggaguccaccuucuugaguuuuuuauauauauuggauauuggauccccuaucuaauuuaggauagguaaagauccuuucccaaucuguugguggccuuuuugucuucuugacggugucuuuugccuuacagaagcuuugcaauuuuaugaggucccauuugucaauucucgaucuuacagcacaagccauugcuguucuauucaggaauuuuuccccugugcccauaucuucgaggcucuaaaaccauccaguggaaaaaaaagacagcauuuucaacaaauggugcuggcacaacuggcgguuaucauguagaagaaugugaauugauccauuccuaucuccuuguacuaaggucaaaucuaaguagaucaauaaacuccacauaaaaccagaaacagugaaacuuauagaggagaaagugggggaaagccucgaagauaugggcucagguuuuuuguuuuuguuuuuuguuuuuuuaaagauuuuauguauaugaguacucuguagcuaucuucagacacaccagaagggggcaucaguuucuauuacagaugguugugaaccaccaugugguugcuaggauuugaacucaggaccuuuggaagagcagucaaugcucuuaaccacugaaccaucucuccagccccagauauauaguuuuuaacuuaacagcuaagauacauacucuuagaaauuacacaaaauguuaacaaguuggccuuuuguaucagcagagauaccugauuuguaccacaacauauauugugauuaugaugaaaaaauaagaauaacaaaauuuuuaaaaaagaaaauaagaaacuaaaaaccagacuucaaauaaaacagugcuuauuauaaucuuuagaauguagcugaacucuuauggaggacaagauauggccuacuuuacauguauguaagugaaauguaacauguguguccuauuccaaaauuaaaggaaaagauagcauaauaccacagugaaaagcuaguaaaacuaaagguuuacaugaguguacuaaaaguaaaaaaagaaaauagaaaacaugcaauagccuaaaaacauucucuauaaauauuaacaaagcuagauugaucaagaaaacagucuagccagggccucauugagacucucuuccuaagugauucuagauuguaucauauugaccuuuaaaaccaacuaucacaaauacuaugagaaaaacaccagacagucccagcugagaaacaguuuauacaaucaauaucugaccaguacuccuugaaacucugaaggcugucaaaagcauaaaaguguaagaaacagcuacaaucuaguugguuauagagagaugacaagcaugguuccuauuugccacuagagucgcagcgggguaaaaaauucaguaaaagcaaaggaacucuacagaaugcagagguggcuuacucgguugauaacgugccuguugugcaagugugaggaugagugugaaucccaaaccgcacauagaagccagguuuggugguaugcaccugggaucccuguaauccuaugaggauaugggaaguggagacaagacaaugccaccagcucauaggaugcauagacaacagugaacaagagagccugccucauacaagauggaaggcaaggaccaauacucugaaaguuauacucugaaaccacaaacacgcgcacacauguacacacaggcacacacgcacacaugcacacacacaccacacacucgaauuuuuuaaauuauaaauaaagcuuagacauuaauacuguuuuagcacugacuuguuaauuguaauaaauauucuaaugugaaaagcugauaacagagaaacuaguauggauuauauggauguuauuuguauuuuuucauaaaucucuaacgguuuuuaaauauaaugccuauuuuuuaaaaaauaugaaaaacaaauuguuaaauaaaaauguauuacgacuauaaacaaaaaauuagggucuggaaaaauggcucagcauuaagagcaugugcuauucuuguagagacccugauuacauucccagcacccacaugguggcucacaaccaacugucacucuaguuccuggaguuccaaugccuuauuuugacuuccuugagcaccaggcacauacaugauauauguacauacauacagcaaaacauaaggugaguaaaucuucaaacauuguaaaagaagaaaaugaaaugaguagcuuuuacaaaucagguaaagcuggguguuguggcacaggccuucaaucccagcacucaggagaccagggcagauggagcugugugcauugaggacagcuugcuuuacauagugagcuccaggacagcaaacacugcacagugagacccuuaaaacagaagacaaguaaagaaaugaaugaaaaggguguuuauucccgccccccuuucuuuuacccaauugcaacuguaauggcaaauaggaacaauacuugucaucucuguacccuucaccuagacugcagucgauucuuaggauucuguguuucugacagccuucagacuuucaaggacugcuaguugugccuaucuaguuaacaaauauagauagccccacuuguucccucaaguccuuaagacagaucuaaagagcuguuaaguaauuccacagggcacagguggcaagggaaaguuaguaacaaccaauuuuuagagauggcaaagaagaugggacauucuagauagaauagcauugacucuugucagcaucccugacaguuugacugaaaucauuguaauuggagggauagccauguuaggccuacauaaauaggaggcagugauggacugaacacaggaagccagugcauugauuugggaauuaguaguugagcacaguagcucuacuuccuauaauccuaacauuugggaggccgaggcaagaggagugcugguagggugcuuucuucuacaaacuaacuucauuguuuggaauuaaaggcuacccuaggcuagccuugauuucaaggggaguucuaggccagucuaggguaaagagugaguuagagucaaaaaaaaaaaaaaaaacaaaacaaacaaaaaaaaacaccaaaacaagcaagcaaaaucccccaaaauacgaaacaaacaacaacaaaaacaggagaaaaagaauucucacugcccacaaguugcugacuuuauuguagaagauaaaguaaguagauggcagcguuucccaucagugauccccacuguacuaaguacugaagcuaaguaaugcugucuuugaaacaaagggauuaaagagguuagagcucagcaagagagagcuuuuuaggaaaagcguuucuuggaguuugcguuccaggaauaagaaaaaagcauaagcuagguguuauaaaaguaacuuuuacucuccugaagcaguuguggucuugaaggcuuacugcaccauucuacuaaccucgggcuaguccuggaagcugcuagcaucuuaucuaggccucugagauuuacugcugaauaagcucacccuuucuaguucauucugaauuuuggcucgccaguucaacucagcuguucuggcucaaacuccucuucaagcugacugauucaaucuagcuucucccaguuucugacugcuaacuuuagcaauuuguucuaaucuucugacuccuuuuucucuuucucuaaccugucucuguacaacugucccaguaaaacuuugccuucucucucuacacuguucccuuaaguaccuucccuuuccucuuucuuuucaugagaguugggcauaucuauucugucaaaucuuucucugauucaucacuuugucugccacucaauuagacaucacuuucaaacaagggugcuuucuucuacaaacuaacuucauuguuuggaauuaaagguguguacuaagggccugucuguauuccagccaaagggauuaaagguuugugcuaagggcugagccacaccacaacuaggaacagauuuuuuuuuuucaguaaaauaacacaaucuuggaguucauagugugaucaaauauccugcaacaagguauggaaacaugucucuauaauccacgacucagaagacugaagaggcuagauucaggccaacaugagguacaaagcaaauugggggucaaucugggcuguauaguaagaugcuguaucaacaacaauaacaacaacaacaacuauauacauacggcuuuugguuggcuuaguaaguagaacuucauuccugacucauauuguaggagagaacugaguccugcaaacuguucucugacauccacaugucuaacagggcuucugcauauccacacacauacacaaauacucacaugcaaaauaaguaauuuuuaagccuuagccuacauuacaaaaugccagcguucagagcaugaugaaccucagcaggcaucaugccuacauggaccaagcuuccacugagcccugagcauguggagcugucaggaaggcucacucagugguagcaugcuggucuaguauuugugaggucaaagguuggauccugugugagcagauuguauuaaaaaugaguguagaauugauugaagaaauggaaacaaacaaaaaaauagguauuuaaagaugugacuaugugaaugacaucugaaucuguggcauuauucuguaugagacugaguaaaggaugaugggagagaggagagaggugucuugagggucauggaguauuugaaggcccaggagauggagaauugguaaacgagggaagccaggauaugucaucccugggggucagaaaaugaagcauuucagaaagcaggucuaauugccuaaaucaaaugcuguugggaacugaaaauuaaaugcuguagcugguccacucaagaaaagggcggugggcuggaggcucagcacagugggggcugagcuuuuguacacagagccagauuugggcaguuucugaaguaggaguuugggaacuagaaugaaaagucugggcugcugaaggauuggagaauacaccucucuguggguaugugaaggguaugugggcagugaggagggagagcuguaagggaaggguauguggaagaaguguucacugcccaaagaaauucagaagcuuaagaaguaagaaaauaucauguaauguuuuugcugcuagcuacugauuauucuauagaguguaggagaaauacacuugcuaugauguaagcacgcaggugccuuaaaugcauuucugacacucaagaaaaacuacuuuucuuuuuucaaaaaaaaaaaaaaagagagagagaaagaaagaaaaaggaaggaaggaaggaaagaaggaaggaaggaaggaaggaaggaaggaaggaaggaagauagauggauggauagauggauaccauggccuggcaagauugcucaguggguuacgacacuaccugccaagucuaaugauauguguuugaucaccaggaccuauguauauaagaggaggaaacugauuuccaaauguuauucucugacaucuucacuucauggcaugucauaugcacacacaccaauacagacaucaauaaaagccaucaaacaauuuaaggggccagcaaggaaaggcacguaacaggaaaaggcucuugcuaccaagccugaagaucugaguuagauuccuaagauccacgugguagaaggagaggacugacugcugcaaauugaucaucaugagaguuuccugguugccuguuauggugcauguacccacaucccaccugcuuccuucacacacacauauuccaaaaguaacaacgacaaauaagauaaagugaaauccagaggcucaugguuuuaggaaguuugcgaguugaucaguuugaucuucuccggccuuuagccaccccaaagcagcagccaucuucagugaugccugugcaucacugaauucacaagacguuuguuucagaguaugagacauuucacuucagcauugccuguguguuggaggauaugcuugggcuuuggacugcuaacacagucccucuguccuauggccuuugcccacacagguuuugauaagcuacccacacugcaacagaaucuaccugcucacucuguccaggcaugaaccacaugccagugcaugcuuaauauauuuaacucacuagagaaaugcaaaugaaaauaucacauuauaccacccuuuacugaggggaacaaguggcacuuuuguacuccacucagggugaugcugccuaugcugguucauggaaaugccacuucagaaaauggacucggucucuuuucuucacucgaauauguacugagcaugcacuuaggauacacaggaucucacuccaguuauuuaccaaagagaaaugucaguauauguucacacaaauacaugcaugugaaugguccuggcaguuuuauuccuaguuacucaaaauaggaacuaauuuaacuaaucuucaucagaagaaaagaugaacuuugauauaucucaaaauggaauguuaaucggcaaucagaggaacagacuccuaauguacacaaucuuauggaagaaucucaaguguguuccucgaaguaaaagaaacuggggagaaaggcugauuacuagaauuccauuuaaaugagauacuagaagaggcagaccugaaagagaacacaaagcagugcauauaaaaugcuuaggaugagggauggggcuaacugaaagggguguuccucagacagauggaagugaaugcuguugugguuauuggggauaaauggugacuauuacauggcugcauguauuccuuagaccuaaagggggugaaacuucuuaguaugcgaauucuaugcucaguaaaccacccaaccaacacagauguuucuguacccuaagacucugggucgccugcuaucaugguacucaucguauucaaaaucucccucaucuugccugcuucauaaaaucuucacaugaucaccccauuguacauuauuucuuguugggcauucaauuugaaagaaucaaguguuugaccuuaacagauuaucuuuuccuguuccaucaaauucuaaacaauuuuuuaaucuuaauuucuuuaccaagaauucauaaaauuuaagcacagguaauuugcaauaaugcuuuaaaaauacuaugaugauuaagucaagaucauguugacacuuucuccacagacagcagagaaugccuugcagacgacuguagcauuauugcuggaggaaaccucacugguuggcacccagacuccgcugcuguguuauggcgaagagucuugggaauccuuggagaugugaauaacauccagucgccgaagauccaugccaaaguuuuuggcuaucucuaugaacugugguauaaacuggccaagguguguucugauguuaccuuuuauacuaauccagaaaaguuagcuugaaucauuuaauauacaaacuauugaccauuucugaaaugcaaauuagacguuuagaaguauauuugauugcucaagaauaaaucauaguaucuguaguuuuaaugcuuuacuaaaugccugagaguuauuucauuuaguccaaauguauguuaguagaagauauuaaaauaggauacuauguggucucauuauucauuuuaguaaagugauauuauuuugauuguauaaaguugggaaauagaaaagcaagaagauacuuauagauccauuuuauaggauaaccaguauugauaugaaaauauauuuauuuccauggauaaaaacauuuuacaaaacuaagaguuuacucuuagaacagauacagauuucaucccgacuuuuauuuuuauacuaaauauauuuuccauuauuaaauauuuuuucaaaacaugaccuauauucauauagcauaauuuaugaaaucauuucuuaccaccccgggguucagaaucucucuagguguucacacauuagaauaacaauuccauucuuuuguguuuagaguuucaacuacauguaguaagcaaaacacaacuuaaaaggacaagaauucucauaauaaaagaaaaaucuguaaauacuacacauuucuuauuccuuguauaaaaaaugggaguaguuucuuagcuguacaagacaauacugcuauauuguuguaacaguagaauguuaccuugccuaauucucuuuugaauuagauacgagauaauuuagcaauaagccuggauaaccagucgucuccaucuccuccucucuugaucccaccacucagaauguuugcaucauggcuauuuaaggcaaguguuuauucuuuauugcaauuuccucuucccuucugaaauugaguuuaaaaacucuaauugcccaagacugcauguuuugaagacaggcugggucuuacuacagccagcucaucccacaucucuaaacaacucuucaggaaaacugagaaguaaaugaaauguugaaaugcucugcaucuggacuugauuuaaucuggaaacaucaucuccuuggcaggcuacaacucugccaaaugaauauaaagaaggcaaacugcaagccuacaaacugaucugugccaugaugaccagacgccaggauguucugccaaacucugacuuccuggugcauuuuuaccuugugaugcaccugggacuaaccagcgaggaccagguauccugugauuccuuuaucauggugugccauaaugggaaacugcuugucacgcuuuauauguaccaaggcuucugaaaauauaccagaaaugcuuagauccucaguaguuuccacuuuucacacauaggucuucaaaagucugaccagggcgucucccauuccugcuucuuccccucaccaucucugcauggaccuaacuaaaucugaacuuuauuuuacaacccauaugauccagucucugccucuauugucaacuugaaaauaccaucucagcuacuuuuucucugugguucuggucaauuuaaaaauauuuggagauucauguuuuaguaauugaauucuuuuuaugagguacaguuuuccuaugaacuaaggguuuuggcaguucuugauguggaguuacuuauauuucuuccaaagaaauagacauuugguuaaguaggaacaaaaagguucaaggccuucacaaagcuacaguccccuuuguagauccuggauuuaggauuacaggauguggccaauauuuguccugccucccuugggaaguccccuagcacuugugaggacaggaagagugauccagauaggcauauauauggacuuuugaaaagugcuauuauuaucuucucccucccucuaucccuccuuccuucccucccucccucccuuccuuccuuucauauguggggcugugggcauuguguguguucaaguauggaggucagauggcaccuugcagcagucacaugaguccuggggauuaaauguaggucacagauuuaggagcaagcuuggcauuuguuuuucuuuaaaauguacuuccauuuuucccgugcuggagaaguggucaccauauucugugguucccaaguacaagcuuugagcuguaaucauugagcuuuguuuuagccaugaccauacugucccagugaguuguucuugucauguuugcucuaagcagcaucggaagacagugauaacagcagcugggauuggacccacagauucauucacuuauuucaguagaugucuaaguagggauauugugugcaguccccuguauucucugcuuaacuauucccagcugacccugcagguagaagcaccuccuacagaaugaugccauacaggacaccuaagaagauuaauggguagaaacaggaaagagaaucaacuccaaagauaguaaugagcucccgcaguguaggcaccacaguaggaagguugacuuaacugcgcucuauguuaaaauaguauuuugauaaagauucuucauggaaaauauaugauuugggaauaauggucaacuguagaauuuucugauauaacagcaacaacaauaacaacaacaacagaacugaaaucagcacaaaguaguaguacuagaaugguuuuuuuuuaggaaguugcguaagagcugugaguuugaaaucaugcucugugugaaguguuggugugaagugaaggagugaagcaggaaguacgaacucaaaguagcaugaguaugucuuuaugaauuguuugaaaacauuuuauucaggaaagguguugagauuauauacuuaaaauugucuucacauuucaauguacaucauguuuucaguuaaaggaagacaguugucuuguagacagcacaauggcagcagcagucccaucagugcagacauuagggcagaauggggauaucauacaucucuagucuauaaucacccuauugugugcaccacuaggagucuggauuuuuauguggcuuuaauagaauuaacuauuuuacuuuaaccuuacaauuauuacuauauauuuuagaagccccaacugucugccaaacagaauuacccuaaagugaacuuuauuucuuugccagaagaaauuuacccagaguccuucuaaugaaagaaaccuuucuuauuuaaguaaaaaaugucucugguuaauuaguuuaacuuuuggcccacauguuuaaguagaucauggugguuguuuuagaaguuauauguacuucuggaaacacacgcuauauucauuauaaaaagaaaagaaaacauuugcuacagagaauacaguuaaauucaauuuuguaauugguaagccgugcaccuguggcugguaccaugucaaggcuuguuuccaugcugugagaguugcaaagaaccacacuuccaucuauuguggcaugaaaaggauuuguuuaugcaaagggagaagucuagagacuauccuuggcuuuaacaauaaauaauagcaaauacuaaguuugcuauuuaaauuaaauacauaaucuauaaauaauguguuacaugaauaauuaaaugcaacaguuagguuaaaauauuaguauuuuaauuuaaccucuacuaguuuuauuuuacagagaaaacacaagauguguuuucuccuuugcccucuggauggcacacuugucugcucaacucaguuaaauaguucaaacuggccagaagagccagaacccugugacagugugugugcagcauggugguuuaccaaacgcuucuccugaaucugauagaauugggguuguagccacagugcucagugagaugcugagaugcaaacaagugcucagacauuagauagcuuuucaaauauugcugagacucaaaugcaaaaacuauccccucucucucucucucucucucacucucucucucucucucucucucucucucucucucucucuccauauauguauguauguguguguauauauauauauauauauacauacacacacacacacacacacacacauauauauauauggucuuguguacaaucauguaaaaagcaugacugcaucuaauauuauaccaaauuuguuauguaagccaaacagccagaaugccaaauguaguacuucuaaaacaacauuuguaauaguauuaguuacaucacuaacuuauuuaauagacagcauaauggccuuaucagauggccuuuucucucucgcugugauguaguguggguuuguaaugugcaugauuguuaaaagaaagaaagaaagaaagaaagaaagaaagaaagaaagaaagaaagaaagaaagaaagaaagaaagaaagaaagaaagaaagaaagaaggaaaaaaauccauaaaauggagggguuuuccgugauaaagauuccccaccuacacccuaguuuuuuuaagacaagcucucaauguagccuugacucacuauauagauuaugcuggccucaaauucauugagaacugcuugccucccaaaugaugggauuaaagaccugcaccaccaugccugguccuggauuuuuuucagugcuaguaauguugucacugguucaaagccaugaaggaucuuccuguugccucuccagcccagcugcacugugccuggaauauuggguggaggugagggauguuccugucuccuagugccagacccuguaccaggaacaguguggugucccacucauucuucuccacacauaauaucugcccuauuuuaugaauaaugaaagcacaaaacaucuugagaauuuuugccaaaugccauguauucaaaaggauguuagaauucacagaaaagcuuucuggacccauugggcuugucuuuuccauugacugacagcuaacuuguuagucaaacacuccuugaucucauuccucccuuguuugguuuugcugggccauauuccuuccccuucauacuccucucagaguccccucugaccuucagauaccuucccaguugcugucauuuuuccacuucucuucuaaagcuguucuugguugcucucaguuuguccuaauguuuaagcagcuuuuucaccuuagucuuccccaaaauauuuugacaugaaaggaacuaugauuuggauuuauuaaaaacauuuccuauuaauuucaugauuauuuaaaacauauggaaagaucaauacgugugaaauggaaaaggacaguugaggaaaggaauuuuauuuucauguuuguaagaacauauaucaaagacuggaaaguuuucuuuucuuaaaauaaguaaacuauuuuuuaacaaugacuuacagauuuaccgucuuaauauaauuuaauuugucuguuauacaucaaaguuaaguucucuuuuaaaugcaaaacuuacaguaaaacaaaguuauuguuacaaauuugcauauagaaauuucgggaaauguggaucuuugucauuguagucuauaaugcuauauuaucauauuuucuaaggcagaaaaaagaaaaccagcaugaaacuuuccucaggugaagaauguauauaguucugcucuacaauaaucauugacauacaaauuugaauaauaucagcauaauuuuugauaugguagaauaugauaugauaaaguauaacuguaaagagccuucaggagggcugaguuuucgucuuggccuucaugucuuagccaagucauuuggccucaccaggcccugguuccauaguguaagaggagcauaaucauagaguuuuacuuccuuuaguaacugugaguccuuaugugaagauugagggcaauuagugcaguaguuccaagaaccucauguauuucauuuuuccaauaauugaguacuguguuuguuucauuacccaucugccaucuuacauuuuaauauaaugaucugacugaaaaacauacauuacaaguggagaaaugucuacucccuguguugugggucagacauaaguagugauuugcucuuuauacccaugauccaggaaugucuugugguccuaugguccuacuugcuuuucaccuaacucaaugauagaugcuggaaggcugaacucugaaugagccagacuccuugcaacuaguuuggcauaguauuugaaagacauggggaguagugggacagcaucuugaaggagcugggcccucuaaucuuuggaaguucugcccagacacuagcaucacugcaaacagcaggaucucugcuagugccagccuucucagcuuagaguguagcugggugugucugcugucuuuuccuucacugcugagacucaugguugguucuuugacacuucuggaaauucuguaagccagcugacacugcugucaauuguccucaaacgcucugcaaaacagauuguguugucuacauguaagauucuggcauaaucuacaacucugcuccauagugcugcugaguccuggaaaugcaggauaacaacaguucaguucaucuccuacauaaaccugccgcauuaaacuuacccaacugggguuuuucucuuuuaacuuuagucacuuauuuuguagccaauaauaugucacuuguuuuaagaauauuuuaacuugcucuuugaguguacuuuuuaacuauaccaauauuaaaaauauauauaauuuuagguacuauauauauaggauuauucuaucuuagaaaucaaaauaaguuuaugcuuuuucuuaacggauguuacagccuccucucaagagguauaugauggaauaauauaauaauaaacagucgguuguaaagagauccccagggucuccucagugaguguaggacucacgggugagcuaugaaagcaaggugcaggggugauccuuguaaauuggccauaccuggcucuucuaauaaccucagacagccugcaucaugcagugauauguaaucauugcaucaccuuuucucaaacaaagaacugcucuuugcuagaaauuuacccuuauaacuagaacuuugugugcuagauauguauaaguucuucagcauaguuaaagcuaaacugauaugaguauucacuuauggaaaaagaauuaucauagcaaacccaguggaaggcagagacuuauuuuuacuugucuuguuugucucauaucaaagggaauaauuuuguuacuucucugccaugcugauuuuguaugguaagcuauuuuuacagaaaucuugacucagaauuuuaauucagugcugucacaguagaguacacacuuucgcauuuagacauuuauaugacaccuaguguauaaucuugauuuucucaguauaagagcucacgcuauagaaguuucauuuuaaaagaauuuuuuuagaaaguagugauuuuuauuuugaccuuuuuuuuuucuuucuuuuuuuuuuuuuuuggucauuacaaucccaacucaaaauuguguccuauuuuuuuccacacaguaccacuggcucaugacacagggacauuacugcuuuacagagaauauccacuuuuucuuuuauagcuuuuccaugaaugagagauuaaacaauuuuccagauuucuaaucucucagggaaaaaaaaaaaaaacaggacagaucauaguuccaccaugguuucuaccagagaaccuggggauucugaaugguguacaagaauuagacuucagggcugaaguaauaaaacccguaaaacuauucacaacguaguaauuucaaaacagcuggauagaaaauauuuaucauguucuaaauuucucacauuuuauaauuauauauuuuauauaauuugaacaugcuaucuauguggacuaagaaaauacaauuauaaauuuuacccuaaauuuguuaauacuaaucagaugugugauucuuccauuuuaaaaagaauuuuuaaagccauaguuuuguacuaugaggggaaaaggacuaaucugaaucuauuccuguuguaacaaugggucuuguaucuccaugcuucaggauaugacuucaaaauggcuuuacuaugcagccuuuauagaugacaagccucaaguugacaccuaugagaccugagaacaacacucaguuuugcuucucacuagccguaggguaccaccuaacugagagugcucauggaugagguaaacuagaagacucuaagguccuugagcauucuuguauuuucuaguuacuuuuaaacauuuuuuaauuagaaucauaccauccuuucuuuuuuuguuguuguuuuuuauucaagaacuguuuuacauuggauauuuuuucucacuauugguaaguauugaguuuugaagguaugaaaugcauaaauaucuguaauauccauuaauuugaacaaagaaccaaauaacugguauuugggugucauauguccuuguagcuaaauugguuggcaaaugaagagauuggacuuggcaggacuugggaggguuuaaagaguggcaggauuuacaagacaagaugcaggauggggguuugcaugucacaggacucaggaaaugcccaaggaccagagagcaacuuugacuuagugccagauaauuauggauaaaauaacacgugaacaugaguaagcaggguagcacuguaaagagccuccgacugucuggaucgucagaagggccaaguauagaccaugcaggcaugacccuugaaccuugcuuacauagcucacugcucaaucuuccagucacugaguaguuuucaucccacagauaaugguuuugaagcaagauguucaacaugaguugagagagagagagagagaacacgaaccguugaaggaccuuacaccacagcgguuauuugggauaaauuauaaccaugagagaaugaugauagcaagaacaaaaagggaauuauaauagcacaggaacaaguuaacaaggguuagugaugacugagacauagauuguguguaugugugugugugucuguguguguauacauauauauguuuuguuuauaugaaauauuggagaacagguaagguacuguauuggacagaaaguauucugacaaagguagaagaacacacagacaguguucccauugcuucucaaagucaagugcaguucugaagggugcuaugaauugaggaaaagagggaaggcugaugcuuaaucauacauaugguucaguguuaagcauuuagacaauucaugccucuaccuuccuuuaccucagaugccauagcaggaggcacauguguguucccaaagaauucuuuccuacuagaaauuagagauuuauggaaaauauuuccagggacguuuucuauaccuaaaauacacauuuuuuaacccuguuggacuuaaacaauugguauguaauuauaaauuuacuuuguuaucacaauagaauaucuaaagguuuuuuauuuuuucuuaguuuuguuacuauguauuuuuaaaaauaaucugacacucaaaacauuuaaucucuuuaaaaauauaauugcauucauuuaaauucacuugauucagauuaauuuacccaacacaaggguuuacuucaggaauaugcaaaacuuuuauguuuuagcaaggauugaugaaaaacuaauaguuauaaagauagauggugcguguucuucucacuguauauauguaccaaagucagaaugguaaacgaacaccgccuuguagugucuagggcuuuccgaguaucucucaaguuucaugaaaaaguaccagcuauagagcuguuaaacuuuuucaagaaaaauaaauuucauuagacuucacucaacuauccagucauagagacuucgggugggugacuccuggaaacaauuggauagaaggguuuuucuuuuauuuuauagcuauauaaccaauaauaauuuuuguuaaucugccaagcccacuuauaccucaauaaggagaguggaaauacguuaacagugacaggcagcagagguuucaguuaugagguuucccaugugggcagagaacuuguuucauggcuuuaaaauguguaagaugauagaucgcacaggaggcuguucuggagagcaacaaacguaccugagagcccagaaacuaacaaaacauuugauuuaccucauuggauuucggguauaaaacuucucuuuuaaguaaaugcaaucaaugaagaauagaaaacaugcauauuccaucauaaaucuuuuauguauucaacaggacauaguaggugauguguuuuucuucuccaaagucuguuuuuagaaguguauuuuauuuacuauagccuuucccaaggcucaagccacccgaaccuuccguaauggagucuuuagaguguuucuugucuuuucccagacagaauaaauguaaaugugauagaugguagaaagggaaaacuggaaacuuuucuuugucccaacccauuccacagucacugugagggcggaguggguaaccaaagcaaccucaccucaccaccugagaagcuggcuucuuccacuuccagacuuagauuaggcuuuaacugugcuuugugaugggcuagucagcuuuucacccuauaacugacucugggcauggggcuugggcacaggcugcuccccaggagaucuuugguaauaucuaaaggcauuuuugguuguuacagcugggacagagguccauuggcaucuaaaauguagaagaaucugugaugcagaaauucaaaagugcugaagcuggcacugagcugggagaagagcuaggcagcacaguaacaaagcuuagcagucccgaagagugcaucagaccagccuccuccacuuaaccaggagauuaaagcacagaaacauuugccaaagacguagaggcaaauguuuaacgcugauuauaagaaaguugccagugucuguuuuguuuuauuuguuuugauuuucaagaauuuucauagugcaacuuaacuagaugaacugauuucuuuuuaaagucaauuuaagaagugaaaauuaauuaauuuucugauuaauucaugugaacaugcaaauuacuugagguagauuuugccuagaagcacaguuugugaccugaagcuggaaaguucaagguccuaggggccuaguccagaacuugaagccacuuccuucccuacccacggccuugccgcacuccugagaggaagcauggcuaagaggauggcuugcuuggaggaguguugucauggauauauagauagugcuuccuuaaaaagccaagguagugcuguauugaagaguaaguaaucuuuguaagcugagauuuguagggaaauucugacuuaccugggucuguguuuaugcgugugugugugugugugugugugugugugugugugugugugugugugcauacgcacaaggaauaucccacucugcccaucuauacuuuauucccuuuagacagagccuuucacugaaccuagagcuugccaccucugcuggcucaugagcaaaccccagugaaccaaugcugggauuacagguuuguguggccagcuuuuacaaggguuauggggagcugaacucacauccucaugauugcaggaagcacucuucccuacugaguuaccuuccuaaccacugaagcgauuuucuauucacauaugacaagugagugauccugagaucucuagcuccauggggaugucaggcaccuucuugugcugcugugaggaaagggaauauucagccauggcuugugcucuggccucauccauaagugacuguaucauugagucagcagcucuguggcucuuuuuccacagugaaauggguucccaguggcucucugugacucugucaucaaaggacauguuguccugcguugucacgagugcuguuacugcagccuauucuccugaggcuugggguguaguucaucuaccuacaagacugucuuucucaucuagaacucuggagauuuuuaggagaauucauguuuuuucucugggcagaggcaugccaaaaggauggcuucuagaaguauuacaguaugcuaaaguucuauuggcgaagagaggaugccuaagcucccgucugcagggcaaagguuguuugcuuuaaacacgacugagcuuuagaguccacgaggauauguuuggauacacgcaagcauguuaaguggcaggcuugcuuucugugagaaugugcuugugcucuccuuguguggaacaacaacuuuuuauuuccccuaauuucuuuuuacugucuagcaguaagugguggugugguaauuacagauuguucagcuauaaaugcuacuuacuggaacacaucuuagagagaacauuguuuucuaaagaaacaauaaacaacaguuuuccuuuuguucucuuguggaaaaauauucucugguagguauuuguggguagaaaaauuugagcaaaagagacccuuccaguaaggagacauagcaguaaaguaccugccacuguugacucaugcuggaauguucuugggcacguacggcguggucauuuugucaugaccuagugccauaugucaucuaguugguccauccuugguccccguggcacguuuguucccaugcaggagcuuugcgcucuggccugcugucacccagccacauguagcaaucuccuugucucgagaaguccuugcugaaagcagggaggaagugagugacuuauuaaaugucuaugcaggaugucuucagguaguuugacuuucauuuuaggguuuauucauuuuauuuuauuaauuuauuuaaguaugaguaggauuuuuucuuuuauugaaaauagcucuuuuucccccacauaacagauccugaugauggcuuccccucccuucacuccucccaguuucucccaccuccucucccauccugauccccccuuucaguuauuagaaaacagacauacuugcaagggauaauuauaaaauaugauacaauaaaaauaaaccaaaaccuaacacauuggggugggacaaaacagacaaaaggaaaaaagccaagaaaaggcacaagaaacagacagagaaguagagacccacucauucucaccuucaggaaucccauaaaaacaucaacuagaaacuauaauauauacacaagggccuauagaguaaaaagaaaguuauguauguauguauguauguauguaugcacacauauguauuaaaaauaagauaacaauaauaaacaaagaaaagcccugagauaauaugagaagaugaacauccugugaugccauugaguucuuuuucucuuggccaccuaaugcuaggugugcaaccuauccuuaagagcaauuuguuuccucugugaaucuccauuggagaaaacugaguuuuacacucuuucugcuuucucuucagcagcauucccugagcccugagaggaggcauuugauggagacauacuauuuagggcugaguguuccaaggucucucauaugcugcaugucuggcugugggucucuggauuuguuguuuuguuucuccuuugguagccugcagaguaccuuccucugccauagagcuagagguaaaagcucuauguagauagcuaccugcucuacuucuacauguucaaugaguuauguauguuuuaucuucaacaauggggccuugucaucaguuugugaagagcaaccccgugggaucucuuaggccaacagcucaauuaaauguaacucaauuccaguacuagaaguuucaguuugugacaagagagagcucacuggggcuaugucuccugcauuauuuggcaauuuuguuuagaucaucucauauauguauauauuuuaagaaacuccuacugauuuagguuuccauaccacuccucaaaugaucuuugaauuuagcuaucuuucccuguauucccuuccucaccccccucuccccuccuuuccccaguugauccuuccauuccagguuccccccuccccuaucuauccauaacuaccuauucuauuucccuuuccuagaucgauuguuuugucucucauaauugcuuacuuuauuucuaaccucugugguucuauguuuguaguuuaguuaucauugacauaacauauaucauugaguuaacaauauccacauaaaaucaaauguauauuguguuugucuuucugggucuggguuagcucacucagguaaaugguugccaguugcaaccauuuaucuucaaaugucacauuuuuaacaucuuaguaauguuccauuguguaaaugcaccacauuuucuuuauucauuuaucuguuaagggacaucuagguuguuuuuaguuucuggcuacuauaaauagagcaguaauuaacaugauugagcaaaugucucuaugauaagaugaagcauccuucagguguauguuauauacccgagugguauagcuagcuagaucuugaguagauugauuuccaucuuccuauggaaugcuacacuggcuuccauaauggcuguacaaauuugcacucccauugacagugcaugagaguuccccugauucuacauccuugccagcaugaguugucacuuguguuauugauuuuagucauucugacacgugcaagauagaaucacaaaguaguuuugauuugcauuucccuuguagcuaaggaagcugaacaguucuuuauguguuucccaggcauucgaguucccacccacucuguuacauauggaccccccaguuuaaauuggauuguuuucuugauaacuaauuuuugagauauauauuggauauuauauauaugauauuagcccucuguugaauguauaguuggcaaaaaaaaucuuuucccauccuauaggcugccacuuuguucaaaugaugguauccuuugcuacacaaaagcuucuaagugucaugagguaccauuuauuaauuguuggucuuagugccugugcuaacaguguucugcucaggaaguuuuuguaccaaugagcucaagacuauuccucccuuucucuucuaucaguuucaguguaucugguuuuauguugaggucuuugaugcaucuggacuuggguuuugugcaaggugauacguuugaaucuaagaugcugguuuuguccaguguguacuuuuugcuucuuugucacaaaucagguauucaugugucuguggguuuaugucugcaucuuuaguucaauucuguucaucaacaugucucguuuugugccgguaccauguuguuuuuauggcuaccgcucuguaguacaauuugagcucaggaauagugauuccucuaguagguuucuuucuuucuuuuuauuuuuuuauuagucaagauuguuuuagcuauccugcguuuuuguuuuuuccauaugaagcugaagauuaucuuuucaaacaucuuugaagaauugugucagaguuuucuugggauuguauugaaucuuuagauuguuuuuugguaguauggccauuuuuacuauauuauucuacugauucauaaacaugggagaucuuuucauauucuaauaucuucuucaguuacuuucuucacuguugcaaaguuuuuaucauacaaaucuuuuacuugcuugguuaguuacuccaagauauuuuauauuauuugagaugcuugugaaaaguguuuucccaguugcuuucccauuuuauuuguccuauguauauaggaaagcuacugauguuuacaaauuaauuuuuauuucagcuacuuugcuagaaauguuuaucagcuguaggacuuccccagugaaauuuuuauggucacauauauaccaucaugcaaauaaagauacuuugacuuuuuccuuuccaauuuguaucccuuugauuuccuucagugguuucauugcucuagcuaagacuucagguacuguagugaguagguuuggagagaauagacaccuuguauuguucaugauuuuaguggaauugcuuugaguguuucucaauuuaaguucauauugccaugggcuuucuguaaacugcauuuauuauguugagguauguccuguguaucuuugaucucucuaggacuuuugacaaaggccacuucugcuucugaugaucauaugguuguugcuguuguugguuugucuuucaguugguuuguauggugaauuacauuuaucuacuuacauaucuauugaaccaucccugcauuucugggaugaaacucauugauggguggauaaucuuuuugauguguuguuagauucuguuugcaaauauuuuauugagaacuuuugcaucuguauuuauaaggaaaguuggcuuacaauuuucuuuguuagguaauuuuuuuagauagguaguuugaguaucagaauaacaguggccucaaaacaaauugggcauuguuccuucucauucucuuuuguggaauaauuugggaauauuaggcauugacuuuuacuugcaagucugguagaauugugagcuaaaaccauuugacccugggcucuuuuucaauugguagacuuuccauuacuaugucacugcggguuauaguucugucuaaauuguuuaugugauauugauauaacuuugguauuugguaugcauccagaaauuauccauuuuuuagauauucaaauuugguggaguauggguuuuuaaaguauauuuuuaugguuuucuggauuucuucaguuucuguuauguuacccauuucaucucuaauuuuguuaauuuggaucaucucucuccaucucuuaguuaauuuggauaagaguuugucuauauuauccacuuucuuaaagaaacaauccuuuguuucauuuuuuguauaguuuuguugcuauuccuauuucauugauuucagcccugaguuguuuauuucuugcuaucuauuccuugugggugugguuuauuauuuuuguucuagagcauuugaguguguucuuaaguuacuagugugagaucucuccaguuuuuuguuuuguuuuguuuuuuauauugucacucacugcuaugaacuugccucuucaaaccacugucuuugugucucauaguuuggcuauguuguguauguaguacauguauuuucauuaaguucuagaaagucauugauuucuucuugacccauucuucauccaauagugaguuguuuaguuuccaugaguuugcagcuuuucuguuauuucuguucuuguugauauucagcuuuaauuugugguagucagguaggaugcacaguguuauuucaaauuuucuuuuaccugcugagacuugcuuuuuguucaaguauguggucaauuuuggagaaaguucuaugagguacagagaagaagggguauuuuuugugugcuugggugaaauguucugugucuauuagguauauuuggcuuguaauauaagucaguuucagcauuuucuuguuuagguuuugugucagugaccuaucuguuguugagagugagguauugcaguuucucccagucaguguuugagggucaauauaugauuugagcuacaguaauguuuguuuuauuuauuuauuuauuuauuuauuuauuuauuuauuuauuuauuuacuuuggucuuuguuuguuuguuugcuugcuucuuuucgagacaggguuucucuauauagcccuggcuguccuggaaguaauguuucuuuuaugaauuugagugaccuuguguugggugcauagauguuaagaauugcaaagucuucuugguagaucuuuuuuugaugaguguguaauguccuacccuaacucuuuugauuaguauugcuuugaaguuauuuugucaaauauuagaaauuauacccacuugcuuccauuugcuugaaauauccuuuaccacuaguuuauccagaagugaugucuauacugauguuaaggcaugugucuuggauuuccagaaggacagcauuauccucacgauucaugagcaguagcauggaguugcaucagucaggauuaaggagucuuauguuugguucaugugacugagaacuagggcuaaggaaauuaauugggucaagugguagaaaguaaacucuuucucagugguacugauaucacaguacuguauauauucuugugaaaagcacuaauuugucacucuucaagacuauuuugaauacaaguuugucuggguuuagaugccacaucagagucucugacugucuucccuccaaagaaauaacauuaccauuuuaaacuacuauaugccccuaaugauaaagaacaaaucaaggauguugguuuuccccaccucuguucccaaguguccuauuaguuacuuuucucaucauugagaacaaauauguaaaagaggaagaauuuauuuuggcucauaguucagagaaauauagucccuggugauuagggaggcauggugaaaggaacagcaugguggucugugguguaaugggaaacaggaaaacauacugucucucggcucacuuuaucuuucccagccuucaguuguagaaacaagcuucucucccuggaaaugccucucucacaggccugaaggugugcuugguuaaaggucuguugccucuuaaucuaaucaagguuuuaaccaaaauuaacugcccccccccacguccccagagucuuauaauuguuuaggauagauaaauaggaaaauaaaauaaaaaacuauggucuguaaaaaaagaacaacuuuguauuuaugucuguacuuagaaaacuccaauauauauauuauauguguguguguauauauauauguauauauauauacauacacacacacacauauauauacacacacacauauaauauacauacauacacacacuggaauauauacaaguuauuagagcuaauaaguuaauuuuguaaguuuauacaauacaagguuaauauauaaaaacauaccauauuguauuucuaaauaucagcaauggaaaauuuaaaugacaauuccuuuuauaguaguucagacuuugaaaauucauggagauaaucuuauccaagcaaguauaauauaugaacaucacaaaauacgcauguuacuauugaauacuaaaacccauauaaacaaauggaaaauaucucauauucuuagcucugaagacaguacucucaaagcugaucuacagauuauacaaaccuuauuaucucagugauugcuuuuacagaaguauaaaagcugauccuaaaauucauauggaauuauagagaguucugaauaggcaaaauaauauuuuaagaacaauaugaaaucuuaguuucugguuuuacaacuuacuaaaauaguauaguauuauuaaguaguuaauauagagcaauaaaauagaauugagaauauggaaggaaacguaucaaugagugacuaauuuuugguguagguacaaaaauaacccagugggcaagauauaauuuuucuuacagugcugagacaacuggacaucuuagaaaacaauaaaagcagguauugaguaaaagguugguucauuggguaagaguacuugcugugcaaacuugaggaccugaguucagauuccagcacccuuguaaacaucugggcaguggagaaccauuggggcuugcuuguggccagugugacagacccugucucuaggcaguaagacagaguaguagagcaggccaccuaaugucuccucuagucucuaugaauguacauagauacacauacccauguacacauauuugauauacugcacauacaaguacagacacacacauacacacacgcacacacaaugaaauuagccuccaucucaaccucauacuauaugcaaaauuugacucacaaugaaucaguggucuaaaugauaugucagagcuaaagcuguaauauuuuuagaggaaaguaaagcuggaaaugugacuaucuuggaauuaauguuaaagccuugggaaugacaagggucaaaagaaaaggggagaauagaagucaugcuuucccagaguuaaaaucuaccacacaccaaagacauucaagcaagugaaaagaugacucacaaaauguuagaaaauauuuccaaaucacaugcccaaucaaggucuucuggccagaauauuggaaaaagcuucacagcucaauagccaacagcaaacccaugguccaaauauaaaaggaugaaaagcuuaauagacuaaaauaucuccaaagacaucaaaauggcucacaagcacaggaaaugauguugaacauaaucagucacggagaaaugcaaaucaaaaccacaagguaccucuucacacucacuaagguggcuguuaagguaauuuuguuaaaagggaaaauaauuaugaccagauuuggagaaauuggaauccuugaacuuuccuggugagaauaauaaaguggagaaacugcuggugggaagcagucccucaaaauguaaacgcaguucucagaagcggcaguuccacugugaaggaacgggcuacagagauucacacaucuguagagugccacuguugcaccaagguagaaauagcacacaugcccaaccagcuaguacaguuaaaaacacagcagguguggggcucacacuugacagccuagcccucaaaaggcugaggcaggaggauuacuggaccuuuggcuacaugaaaccugucucaaaagauaaaaggaagacuaucaacacaauagaauauuauuuuuaaaaauaguuaaaugccagacauguuaaaucaugcuggccagccucaacuacauacaaccuggaggacuacaugaacauuaucucaaacaaaaacaaaauugaaaacaggauaaaccuugaaaacauguuaagugacagaagccagauauaaaugucacacacuauaauauuccauauucugaaauguucagagcuagcaaauccagagacagacggcagauuagugguugccagguaaauggauagacggaaagcagggaguggcugcuaauggacauugaguuucauuugggagugaugaaaauguucucaaguuagauaguggugauguuugcuuaauucugggacuacacuaaaagcuauuuuguacacauuauuuuauuacauaugaaaccuuuaauaaaguuguuacacauagcaaaaauaagaugcaguuggacagggcugcugacuuuccuacucuacuauaaaacagucauauguaguguuucaaacccaccaggucuuucuugcuuuucaaaagccaguggagcuuuccuuggcagaugaggggugagcuguuacgcaaacauaaacaaguuuccagaugcuuccuaugggcuugcaggcuaccuuugcccccauccacacauuacugugcgacuggcagaagaguucuauccagaagaagugucuuuaacacaccccaccucccuucugcuugugcaugccacuguccuggaaacucuaugucacagugguccucagggcacagagcuaaaggagucuuugagucucagccacuaagcccaauuacucgauuuauaucccguuucucugggcuuugaguaaccuagucacacccacagaagucacauuuuugaaaaccugccgcucuucuccaaauaaauugcaucuugcuuggccauuuacacagagaaccuguagcauauaccacacaucauuugacucagauccugagaguaauuugcaguuucauacuggugccauguucaacuaugccuuggugguguggggguggagagguggggggaggaggauauguguaaugaccaagauuuuauuuuugucaccagaggucagguagcagcguauggucugucuguaaaaggauguucuuguacacagagcaggagcagcagagagccacuagcagagaagagagggccaggccuggaauuugaaggcuucugaucuguuaggauaacuauaucaggcugauacuuacaaauguguccuacagguacuaaaagguugugguugugguuguuguuaauuuaaauuauauccacacauaauguaaaacuauuccuguucaaucagauauauuuuuauaauuuccaguggugggaugaaucuugucuuuuuaauuaaccaaauuauugggauacagaaauguuaccaaaauaaaagguuccuguggucuauacuagauaguagguacagugaaaucauuucacuacagaauauuucuuaaaaggaaaagucaaaugaggaguuaaacgauuuugcacucacauauuuuauuucuugacgacugcucagccucacagagggacuaagugacuuuaggugggauaaccgaucuguuugcucuggagaagcaggcgcaaguccuccaaggaaagaccgggagacagauggucggcuauuguguuacagccaucaucugcugggucaugagcaaauaguaagugaaaaauauacacgugauugugagagggcacagcgguggccucaccagcgcaagaaggacgaggcuucugcucagugggguuucggagaacgcuguguugagauguuagaugugcaggguuaauccauuuuaaacuaggauaaagugaacauuugcccccauuucugacacuacuaugcaauauuuugaauugaaauggcaaguaauggccuuuuuuuuuuugcuuuccauaacaacacaagcacuaaauuauagcugugcaauuauguaaacaauggaaaugcuuccagaaggaauccuuccuuuuaaauuuucauuucguguaauuguuggaagguuuagagcuguaauaaacaaaauuauuuuacacauuuaucguucuaaaggucaauuauaagagaacuaaagaagcagcccugugcagaaugaguaagccaauuugugccgccgucaccauauguuuuccuuaucacuuauaguuuuuccaguuacuguguacauagcauucaauuaaagugauucauuugaggggcuggauguaguuuguguuuauagaacugugcuuuggaggagaggaaacaacacgccucuauuugaauuaccugauuuuuuugcaagaucagugauaagagacagauguucucaccagucgcuuucucauaagccagaaccuggugauaagcugcaaaggcacaguuagcaucucacagucuggcuuucccacucagccuggagcuugcauacggaccuuucacuaaaacgggaaggggcaguguguccuguucaccguguggcagcaggucacagggugguuucucuccaguaaaaaacgugguuugucugcuccauccuagucaacuuaaagaauaaaccugauuccugcuccagacuccauuuaccgcaaagccuguuguuuacuuuaacuacuuguuuagucuguuuaaaagguacagaaaaaaaagaaaaucagaucuuacuaccagacucacuuguuugagugcuacaauuccucaaaaggcuaaagcuuagaaaacuuacagguuguguuccugaauuugcuuccauuuuacccccaaguuauauacacaaucucuaauugcuuguuaaagggguugucuuaggguacugauugcuagagcuuuuuaauuucugggguaauguaugaucaaaguaacuucucuauguuaucucugaaauuuuaaaaaauaccuucccucaguagauuauuaaaacauucauucaauaaauuauuagggggccaggcauaguagugccucccccuuuaaucccagcacuugagaggccaaggcagguagauuuuugugaguuagagacagccuggucuauaaaguaggcuguuacacagagaaacauuguuucaaaaaaacaaaaaccaaacaaacaaaaaaccuaacuaaauaaauaauauugagugaaccuuugaaguacguuauauagaguaaaaauucuucauuuugaaaaacauugcuagcacuguuuacuucuguacuuugaaagccuccauaaaacaucuauuugcaucugcaucccacugccuacugcucauuaaggaagggucaucucaucuuagggaagagagaaacacauugcuuugggggugacccacaguauugaauccaggccuuguggccucaguucuagaguacuucacaggguuugaacacagggaaauuucccaacagugguuacaguagagucagccuugagagaaggaaggaaucauuugauaagaauaacagccuuuuuguucaucacaacccauccuuacaacuuucucaggccagguggaggugguacagccauggugguuggcccuaugacauuguaaaccuccguuuuaaagacgagugccuaucucaaaguaaggacuucuggcagcuagugauguuuuuacaagaaauucaucaucauuugcuuguuaauacuauauuguuuuaaagaaguuucugacaaaagguaaucuuuuucuauuguaacuuuacauuucaaaaaugugagucacuuugaaaaaauguacuagacaaauccugcuugcuuuauagugaggcuacuacaaagggcaugaggacuagcccuggugugaugggugcgugcugaaugccauucugucuuguucauauggaaagcccuauaggcuauguaaacuaucagaccaggaaggauuuuauuuugaauuuucaaagauugaugguaauaccuugagguggaggaguuagagaugaguggaaucgcuucucggccuuuugacugagaucaaauguagagaugaguagagcucauagugcaugguccucuguugggaacauggauggcagaugcucuccugagugccauguggcuacuccuaauuuuaaaguguuaucucaaagguagaccuuuuggacugcuccauuucaguguagauaagcaaaguaagccagcauguggugguaauuuggcugacuggucauauggcccccucuuuaacccccgaauuaacccuaccccagugcuguccuuagugacuauugcaaaggcacacuuucucuccaggcucugucuuacgugggugguaaaguagggcaggcuugccaucugucauugucccucuuuuucccaucucuuugcccauagaagcagguucaguugaagucacuggcccagguccagggagugggugagcccugugacuuuaucucaaguacuuugucucugccaucucuagcaccagugacaguuuuguaguuucugaguguaugguuuuaaccccccuaagucuuucugcauacucaccaaugaagcaaguuuauaaacuaugguuucagcuuauuauucaauuccuaguccccacaaaccuauuccagaaaaccaucuuuaaaccaaaauuucuaaauuccaguggugaaaauggcucauuugaguuuagugugugcuaaaugcuuaaagguuuuuaaagcccuuaggcuucaggguuuuagcuccucaucucaccagauggaauuaaggcaaacauaacaaagcuaacaucauggcuguuugcauuauuaaucuucagaugcauggcauucugguaccuugcuagccagguuugcacgaauccauucauugcagcauaugucaacagaaaugugcuuccaucugcugcuggaaagcuugaugccugauauucugagacaaggccccagcacaaugcauaccucugugaguaauuacagguguguggugaggagcccagggcauuaaucagaggcuuaauuaugaaaaagguagaucuuuuguuccacuccuggagcaugagucuacuacacacuuucuaaccugcagcauccaucugcucagcccagagaauguuugucuuggcugauauagacccuaaaguguaucgcaggaugugauuaaaacaggcuuaaauauuaacagggaagaaaccuugguuuaggguuuuuuuuuuccaaucccuuccuuuuaucuaucugucaucuaucuaucacauauuuuccucuuaucuuuuaucuauaaaucauauauauccauuuauuuuguguaagaaaacguucacugaaaugccaaacuucaaguuuuaaacuaaacuacuucucauaagugaacacuaauauaguaagcauuacauggucauuugaaucauguaaauaguauuauuuaauguuaauuauaucuucuguaagaaaacaugucuugggaaaauguuaugugagcacauggaaguuguguuuaagaagacaaaucauaaaaugaggugaaucuuacuaugaagggccuaagauaacuauggaaauuaauauguugcuaugcuuugcucuaauaguaagucaggauuuguucaaguagccacacugacagccaagguucuuacauuuugcuauuuacuuauauauugacacuaacuauuagcugcacuacagcaagucacauaacuaaaguacuucagcaugugguuucgauuugugugccuggccagagucugugcaaaagaagauuguaguuuucauacuaaucccauuuauacaugcacauacucacacagauggcuuuagagggggucugggcuguaauggugugaacacuauccugugguggauuagauccaccagaagcaggaaugaagaacucuggcuugggggccggccagcccuccacgggauucuauuauagacacaggauggagagcugucagggagaucauccugaugccgagcucuggcaaauggcugcuguuggcuuuguguuugcaccucuugugcacaucagaucuguggcaacucccugaccuuagugucucaugaauguuacaccauuaccuuaacacuacccacauucccauuuguuaaugccugaaacucacaggaguggucauuuccauaccuuugccuauaagcuuuucuaacagugugcucuaaccucuggggacugaagcuaaagcaggagcccaguuuuuauuuuacugacagguguuugcaaguuuuauuuauacgucucucuuggcacaccuguucaaggagcccauuguuaaguggaauacaggacagauguuuagcuagccucggugucacaguguggcuuuuggugucuccauucccuuuaccaaaagauauguaugagaaccauuggaauuaugcaucccccguacucuuucgcacaaaaaccuaacagaguguucugcuaucuuguuagugguagucauacauacaugcaaaaaaaaucacuuuggaauuuuguucuugacauuacaguuguguuuccuuauuuucauuuucaggaugucuuaaacaccaucauaaaaaacugcucaccccgcuuuuucucccuggguuugccuggcuucucuaugcuggugggggacuuuaucacugcugcugccaggguccucaguacagacauguuggcggugaguaugacaauguucagcaucccagcuccugggagacuucacaauugcuaacaaggcucagauuucuccacucuuaacagguguugacucauuagugcgaugugaaacugggcucucagaguagauacccuggcagcugaucugugaaauuguaggaucagaugacauacugguacuggaaaggcguuucaucaaaaggccaaagugugagaaaucauauccccacuaauaugucagcacauuuacagggaagcagggccuauccuagagacacuuauuaguauucucuaguaaaugauauuaugguuauaaaugcaguaaagagagaaucugaaguguuuguuugaaguuauguguuguuguuuuauuaauaguuuuggcuacuguggaucucauagaaauaaauagaauuuugugguucuagauuuggaaucaaaucuagggcgccuuauaugucaagcuaccacuaagauauaaagaugaugagauuuugauuuaccagggauuuacaugaaauuaguaugaguagucacaauucuaaacuuugucugauacaugguuaauuucucacuuuccauuggaggugguuaaugcuuguaaaauuaauaauuuguguucgaauuuuuaugccuuaauauuuucuucugagacuaaauuagaaaguaaagagauugggagagacaagaacaaaagggaagaaugagaaaaggaaaaaaaugaguaagaaaaauguccaauuucuuuaagaugccaacuucccccucuugauuauuucugaauugggggaaaucaucuuuaaagaaccuucuugcuaaguguuaagacuucaaguuggcuuggaaaaaaugacuugguauaggcaagacaaucauacuucguuagaauuuuauuacuugcuaggaggaguucuguagagcacacuacagcccuuuaugcuauaccacacauaguggugcucccuguggacaugggucuuuugcauacaugagcuauugaaaguagcuucuagacauaaguuagucaaugggcauauaaaaaauacucaacaucuuuaaucagaaaugcagauuaaaacacaagauaauaauuucuacuguuaagaguugcugucaucacaaaggacaauaaguauuguugaagauauagaggaaagguaguccuuguauaaaucuuugugggaauguaaauugguacagcuauuguugaaaauagaaugaccuuuuaaaauuagaauuagauaaaccauuaagugaucugaugagucuacuuagauguauggccaaaggaaguugagucagcauguugaagagcaaacaggcccucacgcucucugcaacaucauuccuaguuaauaaguuagaguaaugcuuaaguguguguacauauggaugaacaaauguaacacauacaauagaauauucgccauccuuaaaaacaaagaacccuugucaucuuugacaacaugagugauuccagaagccacuuugccugggaaauaagccagacaugagccugcaucaucucugagacaugugaaauauuaaaaguccaaugaacagaaacagaggagccugguguaaaugggugauguugaucaaaaugugaaacauuuugguaaguuuuugagaccuccucuacuguacaugaugauuguacuuaaaaguauuguacucuaaacucaaaauuuaucaagagaauguuucuccauggaaaaggacagccaucugagaugauagauggguuaauuaagcuuaauuauagcuuucauuuuacaguauguaugcuuuuaacuauacauacuguaaguuaucccccuuaaguccaugcuucucaaaguuccucaugauacaacccuuuaauacaguuuucauguuguggugauucccaaccauaaaauuguuccuacuuuauaacuauaauuuugcuuccauugugaauuauaauauaaauauuugauaugcagaauaucuaauaugugacuccuguggggauuacaacccagaaguuacgaagugccuccuuaaauauauauaauuuuaccuaucauaccuccauaacucuaaagaaaagaaaacagcuuuucaaaauggcauuuuaaauggagagaauaugaauauaaaaguuauauaaaaagagagggauucuuugcauuacuuuucuguguaaaugugagguuuaaagcugugcaccuggugagagaggugcuugguuggagcacaccugcuccacuaguuuucagguaucaccauugacuaugaauguuaaguauccugcuugcucaggaaaccagaaagaaauuaaugcgugcacaggaacaaaguaacaaagaaaucugggaagcuucuacauagcagcagcaguaguuaacagccaaagcuagaaccaauccaaaaguccagcagcagcagaacaaaagccuuggugcaagcacgacgcucgaggauuacugcauagcagcacacagcagagagccccaggucuagcuuggucuuggauugaguauggcucugugagugaagagagcaagaacuacagccaacacccuaauguuagguuguaaggaaaugggcaguuccaucaagggagacucuuaggucucuucagaaaguaccccagaggccacaugguaauaguacuuauacugcaaaggggcugugaaccuuguuagacgccugccucugaggucagaugagacugagacuggugguauccacuggguguauaccguggaaauacucaccaguccugauguuagccaacuuuagcagcucacaguacucauuccaaaccuucauauuuaaaaacuaagcaaaccauugcauacugacuuuuaucucugaugccauggcuccauuccuaacugauaucacucccccccuccccccgcuuuggaugacaaccuccaacuucccuccuuaugaauguccuugcuuuuuacuugaaaaaaauaauguuagguuguucucauugccccgcucuuucaaguucaugaacuccaaaauuauuuaaagcaaccaugacagccauuugucuuucuaacugaaugaaucuguagaacaguuuuuauagcacuuguuuaugucaaauguagaaaugcuuucuguucgcuggagguuugcauuuucauuuaggcaaacuucucggccuaaacauccacaaggaaaauaaccagagauaguuuagcacuuuauacccagaaggaaaaugauaaagauucccucucaaaaccaggacaaaguaaaacaugcucugccagcuuccagccuauguaagaaacgugguguuucccuccuugugugcaggcaccccguucagaagcucucacucuccuugguucccuugucugcuucccaaauaccuaccaggagaucccucugcugcagucagugccagaagugagugauguugucacgggagcggaagacgucaagguacauaacugaaucuugaguuuagcaucuacagcuggagcuacaucacugugucuuccauccuaugcacugaccuacuuuccccugacauaugcuguaucuuuugaaagcuuugguaguuguuuucagaaguguguuguaugaacugugaauguaucacagucuuagcauauugcaguuagaccugauagcucuguuccucuggugguuuuuuauuagaucuguuuaucguuccuagggaucauaauuauguaaugaaucaucauuugcaauaauucuguuagcuuaguuacgcugcauuaguauagcaaaugaauuuacaagaaauaauuccaguaagcuaaauauucaauuccaauugcuggccugauuaaaugcuacuaauaaccugaaauuccaaauuauuucuuggggaauaaaaguaaaauuuuuuuuuuuuuuuuuugguccucagcuggcuuuugaagcaaacaaaaaguccccgcaucagucagucaauccauaauaccugauuauaaucuguaauucaauguacagugucuaauccaaucaaaauaaaauggagauuuuccuaucuggaagucucagaugcuuugcuugauuuccacuggaucccuagaaaugcugugcugcagauuggcucgguuaaccagggaggcacuugcugaggugagccaaguucucccugaaggaagggcugcccgaacucccuggccuuuugcuagcuccagggugccucugacauggucagcacaugcgggaaaccaacaaugacaucaaauuuucauuuacugaauuuuguguuuuuagcauuaccucauaaauauuuuacugaagaaugcuaccgaggaaccaaaugaaugugcaagguaaaugaugaacaagagguaaacuauguuagaauuuuaagaugcacauuuguguauaaacaguuaauguuuuaaaaacuccuuuacauuucucucacacgcacugaaauguauaguaagcauugugucagaaaguugcucugcuuagcugcucaaaaugucaucauuacaugugaaaaggaugaagugaagaauauuauagaguacauugucuuuuacauaagaaaacacaagauuagaaauaacugaugcucucaguaaggggaggguaaagcagcaguccaucaaagcuguguguuuccgggagggauucugaacugcagaggugaggauuugugucucaggaaacauuuggcaaugugugggaacguugggugcuucugccaagcaucuaagacugcuacagucugugaccaagauaggcggcuuucuaggccaacugugguaaaaaguccccaccucuccucucgaggagaagcaacacuaagaaugcagguugagagcaucccugucuaaaacucaacucccagccucgucaggccacuuccgccugugagugugucucaaggcaguugcacaggucauggcccuuaggcaugugggaaggcagaggucuuauaacucuuuaaugucuugugcacuccugugauuuuaaauuuuguuaauuuuugcucuuuguuuuuggacuuuaccuaucuucaguagauggauuaguccaguuuuccuagucugccauuuucauaagcuaugugcauuaccaguuuguuaacauugaacuauacuuggguaugagauacacccaccuugauucauagauucugguucagaaaguuauauuacccccagcuucuguaauuucccauccccaucaugcccucaugcuguuuggaugucagaccagaaggucauaaaacacauaacggcucuuucuccuccacaugcagauuauuuuuugcagcaguagauuaguauccccgugugcuaguauaucucacuagcaaaagugucugagaauguguccauuucaucuuugcugugaaauauuuguguguucucugguuguaugacuagucuugucagauuugucaccguuacuaggcuuuuuaaacaguacguuuuugucuuugcuuaccucucuauauucauuuuuauuuccagcuuugagcucuaaaacucuucuacuuuugauuuuauucuuuugcuauuuuuaaaauauguauacuugguguauuuuuaacuuuuucccuuuaacguuuacgaguacugguaaggguuuauugguaagggcuaccuuuuguaaaguuuuaaguuuuaauaugcaauauuuucaauucuguuuuuucuacuuuuuauuaugacuccuucaugggauuguacuuuuuauuaauuuccaauuauaugguuauuacuaucuuuaaaauuuuuagaauuuuuaaaauuuuauauaaauuaguaguuugccugaaacuagauuuauacauggauaugagcuaccauguuggugcugaaaccugaacucuaguccuuugcaagagcaacaagugcucuuaacugcuuacccaccccacccucuguuucuauccuuuacugcuacauuuguuucaagugauuauagugcacaccaaaaugcauaugugaugacugccaagcaucuaagacugcuacagucugugaccaagauagguggcuuucuaggccaacugugguaaaaaguccccaccucuccucucgaggagaagcaacacuaagaaugcuuaccgagcauuagaguuaauauuuauauuuguuuuaugcccccauguauaaugaguuuuagcagauagcucauauauucucgaaaagaauguacauaggggcuagagagauguaugucauuaaaaguaccugguguucuuccagaagacuuggguuuggauccuagaacccacauagugguugacaaucguuugaguucuaauccuaggugauccaguacccuuuucugacuuccuuguacacuacaaauauacaugcaaaacacccguaaacauaaaaaugaaaaauacuauguuuaaaaagaucaagaagggaauguaucuacuguucuuuauuaggcauacuguucuagguauaaccuuacaguguuuuauguaaucugcauuccuuaucaguuauuauuauuauuacuauuauuauuacauaagucuauauaguuauaauguaauuaauaguauauuauuauuaauugaucauuuacuaaaguuauauuaaaagcuucccacuguuguaucuuaaucuauuuucuaguauuucugucagagacuguguucuuaguugcauagacuuuugaaauuguccuaucucuauagagaaucaaauguauuuauguuuguacagaugauuugucuuauuuuagagaccaccuuaucuugauuucauacuauauaauacuuguuaccuuuuaaaaauagguuuuuuuguauucucuuuuaaaugccuuugcaaaagcuauauauaaucuggauuuuauaauuguauaagguuguguaaucuucauuaucuuaacugaaacuuuaauucauuuguauuuguuauugcuagugaucuuuugcauguuugucuuuuuauuuaauauuuuauuuugaauuggagcuccuaaguauuucuccuguuuauuaccuuuguuuccugacucuuuugcuaugcuuuuuuuuuaaauuggcuuuuaauuuuuuuuccauagucaauuucauugucuuggauuuccauuuaguucucauaaagacuguuuauaaaauguaauaugguuuuagcagucuugaaguuagucugucuuuacccucuucuaaacaacauguccccugcaacauaauccauguucuuccugucauuccaccauuccugacccuaccccccccuccacgugaccuccccuucucugcuuuacucagcacaguaaagugacccacagcagauuccagucagccuauccaugcuuuugaucauuuccaaauuauuuaccuggucauuuucaugacucuuggcauccccagccuuagcuauacuugauaccucaaguuggaugucuuaauauucaaauguagcacaaccauaacugagucuucuagugccuaugacgugcuuugccuuauuaagccucagauuucaccucaaaaacugaaaauauuaucuacucaguuuuucagcccaaggucuuguguaauaucuuuuguuuauuuucuuaaucuaucaaauuauccuuauaauuccuuuccuuaacuuguuuuauuuccuuucccuaacuuguuuuauuuauagaaagucacauuucuuugaagaauaguuuaaauuagcauggaguuuagagcaaauaccagugaaaauguauuuauuuugaaaguuacuuuaaaauccaauauaguauuugucuuacauuugagguauguacuauauacuuuuguaaggaaaacaauuacaaaucuaauuuucaauaaucuaagauccaugcuuuuuguuccuucucaaaauuaucuguuauuaaaauguaauaacaguuugagucaacaaaaaugguugacaugguuugugguacuuaacagaaaauaugccgcuuguuucaugagauauuuaaguacuaaccaucauuggcgauuuuguuuauccugaaaacuagcccacuggaaguucuuugucuuuucucucaaggaaaauauuccguuaguaccccuguaauugcugucccuuugaauuaauagauguagaguauuucgucauuuaagacauauugaauuucaugagccuuuuccucccucugcuucucuuuugaaagaugcaucgccauuugcucccucggggucuggaucugugaagagcuugcacagagugccagccauccucaggugaaggaugccaucaaugugauagguguaacuuugaagguauucauauuucuuaaugguuuuuguuugcuuugguuuuuuauguuaaguucucuccuaggaauuuuuaauuuauuuauucaauuuucgucccaauaucagcacccccucucuucacagagacccccucucaaagcuccuuucccuguucccccucccugucuccucugauuagggggagcucuccuggcuauaacacucccacauacaguggcacaucagucacugcaggacuaggcgcauccuuccucacgaaugccagacaaauuggcccaguuagggaagcagaauccaugggauucacaaauccacaaauucagggacagcccugcuccaguuguugcucuccuaggauuuuaaccagguuuaacuguaaucaguccauuuuucaaagucuuguucugggugccaugguaaauacuuuauaaggauaucagaggcugcuucccuaggccauuuauagucuugagugguuuuggaccuagccaaagcuaguuacggcucgucugguuacuggacauuuuaggcuacagaaagugagguuucaagcugugaccucucuggcucgacugggauaggagccuggguguucaccugcugccugaacuucaggcauuuggggaauauuccuucuuugcuuuguuacugaaagaugugcuguuuauugagcaucacaagaagcuagaauauuguugaucucuaacuacuuuuuagaauuucggugauagcucugcaagaugagcgccacaauuccuauuacaccagaggaaaccauguccaggagaaaacaaucacaaguucaagacaauacaggcaugagcacuggaagcagauguguguggcauucaaggcauaauuggacuuccacuugugcaguucggcugccuccuaaagcagagccuauauccugccuucuugguuccugugcaaacacuagacaucacuagcacugugacugucaacuuugcagagccagugagucugccgggcacugugcugagggcuuugccaguucucaggcacaaacacaguuuccuagagaagaagggaacucguaugcaggagauauuuaggcugcgggagguuucagcugaaucugaauugaaauuucacuugucuaauccugguguccagacccuucucucccuucccucuugcagcuaugguaguuacaggguuacaguaggcccugggcaauugucauuagacaagugacaaccuuguuugcccaugguacauuguuuucuucggcccaugggaugacaacccacaguguucuucaucuuuggaaugggacacugcaauguggccccugccugacaaaacucaauaccucuugucccccgauguguguccccuguccccaucaccucaucccacaucccuccuacauaaccccuggguuauaucuuugaagcuggucaaguaucugcuauuggccccuugaagaguguaagaauuugucaacagugauaccacauggccaaguucgcucuggccuggccuuugaggucauauuuaauacugggcccuaucuuaggaagugaaguggcacugccacuauacuuaacagaugaggaaagugggcugaccaagguccucaacagcuccaaccaggaugcuuuggggcuuuguaauuauaagaauaaacacuagguaccagaaaacaaucuaauuaugcauauugugccucuguccuguccguguccaucacagugcuagcguguuccacugcugugcauugcugugaucacuccugcccacaggcuagaguacuuggcauagcaugcaagacagacagcagccugcuccaaagcaauuccaguuucuagaaaauacggaccguacucaccugcuggacucaucuugugccuucagcucucugccuuuaaucaguguuggcacauugucagucuuucauggcugugugugaggugggugagagugaguggggaaugauuucuuuuaucccuaccaucuuucaccucacuuacuguguaugcguacugauaccccaguggcagucccugucucaagaucccuagcuaccucagaaccugugccuccacugcacacacacacugcugcuuaccuagagggaaacccaacugacccucugcauccuuccaggcacagcucagcccucccuccuaccacuuuuucucuggcuaucccaugccucccucuucugucccaaguccccuugucuugucuccuacugcucuugucuguuuccagcucuaagagccuuacuaagcaccuauccuuccacuuccucagugcuucauccuccccuuaaacaugacauguacaccccacuguuagcccucucaauagugauaacaauauaagaaaguaguaaaugcauuacagucuccuguagcacuacuguggagaaaauggugggauaaaacugaagaacaggaagguauggauugcuuccuagacuuggugaacuuuugucugaguaucugagcaauacagcagugccaaggacacuagaccugggaacuaaaacaucccgaagcaaagcugggagcaaguacaaaggacagaagcaccagggguccugagggugggaggaggccagugguauucagguccucugaagucuagaugaggagggaggcugugaggagccccuggaugcucaugugacuuaaauucagcaacacggggucauuggcaagcuucguguugucgauaaugaaguguagauagcagcguagccucuagguucuguccaaggcaggaagcacagauuguccuuguccuauuuguguauacucagcaugauguugaagacuuugcacauauuuccucuuugucaucugccucaccaaaaaguaaagcauccagaagacuggggacaucagaccgugucucaguuacuuuucugucccuguaaagagaaaccaugcugaaagcaacuauuagaauaaggaguuuacuggagcuuacaguugcagaagguuagaguccauggccaucauggcagggaguauugcagcaggcaggcaggcauagcucuggagcagcagcugagcgcucacaucuugagacagcagcugggagguagaggaagaugggacugggaaugucaugagcuuuuaaaaccucacauaccuucuccaacaaggccacaucuacuucuucucaaacaguuccaacaacuggugaccaaguacuuacagauacaaucuuuuuuuuuuuaagguauuuuccucauuuacauuuccaaugcuaucccaaaaguccuccauacccccccccacuccccuacccacccacucccacuuuuuggcccuagcauuguccaaugggccucucuuuccagagauggccgacuaggccaucuuuugauacauaugcagcuagagucaagagcucugggguuaguucauaauguuguuccaccuauaggguugcagaucccuuuagcuccuuggguaauuucucuagcuccuccauuaggggcccugugauccauccacuagccgacugugagcauccacuuauguguuugcuaggccccggcguagucucacuagagacagcuauaucaggguccuaucagcacaaucuugcuaguguaugcaauggugucaacuacaaucuuauggaugccauucucaaucaaacuaacacauuccauuccacuccuuggcccccauaggcuguggccauaucauaaugcaaacugcauucauuuaaacuuuaaaagucccuauaaucuuucacaguaucaauacaguuuaaaaauccaaaguucaaauucucuucugagacucaaggaaaucucuuacuuaaccuuaaccccuuguaaauuauaaaagcaaauguaauacuucuaaccgacaacuacauagaauauacauuuacuauuucaaaagggaggaaucagggcauagugaggaaauaauggaaccaaaacccaccagaaaaaaaccugcagauccuuuaucucugugugugaugucaaagauagcucuggaagcaguuuuacugacugaagcauauauuauucuucuuuucaagccaccacaggcagcuuuaggaaacacagucagggucauugaacaugcccucccccuaaagucugguuuuauacacuucuuaguauguuacauaucagucauuuuauuuccccggguaggaagucauuugguuaauccccauuuuacuguuugugaaaugaagauagcaccuucuuccagaacugucaaugacaauuuaucaaugaaugaguuauauuugugcagaagauucggcacacaaaggacacucaagcauauacucuuuuaauuuccucaguuuaucaauagugugauuuauaugagcugaauacagaauuugaaauuugggcuuuaauuucuaggcaaacauugaccaccuucuucuauggaauauauaaaaauguuagugaguucaaacaggcaacaaaauggaauggaguugucauguucaaaggauguuaauuggacauaguuuucuucaguugcauaugagauauguauauagggcuagcaagagcaaucugcucuguucuuccuccagaauauacuccugcugagcugcucuguuaacuugggguuucggguuucuuuuguaguuuccuaacaagaucguggcucagguagccugugauguucuucaguuguugguuuccuacugggaaaagcugcagauguuugaaacugcucuaccccgcaaaauggcagaaguaaguccuuuaucuauacugcuaaagcaucugcacuucuucuuacuaauguauuugauaucuaauuaacuguagauccuuggguaauuguuagagaagcaacuauuaaacugccaugugagcccaguuuucaggcuguguuggcuggcuccucuccucuucaauucuaggcacugugcaaagaagccugcaguguuccagccagaggcuggugcuuggagaauuugaaaggcagacacaaccacaacaaagagaccuuuuguagguugggcuuuauucauugagaguaauuuggauggugccaacaaguaguaggcagcugguuuaaugcuuccuugcagggcgggggccuggcuguuguguaaagcaggaguuguucccagacuaaagcccugggccacgcuugcugcuguggcaugguuacuuggcaguaaugagaucagugcaguauuaaucucuaagggguagugggcaggagagggggcaggaagaacaggaagucucaucucuaccacagcuucuuaagucagcucccucggaguagggacuaacucacagaugccugugacucggcacccccgcaccugccuguuuuauaagcacuuccuuaggcaagcucuauucuuugcccaucccuuggagacucugaggaaaugugauuuguccccaugaaggaucucagggagagagaagaagugauacagauucauucccuccuacccguagacagacuucacuaguuggcaucacugguuguccucucagaaucacaucaagagucacaagugguuuuugaccugaagugaucuggaguggaauagaccuuuuacucugcugcggaguguaaaguuaggguuaggggcaccuguaauuauucagacaggacaccugugagaguggagcucugugcugauuuauaagauagcaaaugggaaccuuuucauaauuauuuuuaaaaccauuuuuauuucacuagaaaugugggacuaauaguuucacuagaaacugugacuauagagagaacuacccuugccuugaggucucagucccccauuaaggaagaccauuacauggccauaauuuucaaaucucuuacaacuggcugaguaagcagcaagcuguguuacauugcaaggccaucuagggauucuuaacuuauggcuuccaaacuauaacuauagcuauguacauuauauaaacuauauaauaacuacauaugaaaacuauaauaaauugcuugacuaggucuuaucuuuugugcagauucuuguggccacaauugcguuccuuuuaccaagugcagaguacucgucaguggaaacagauaaaaagguaaguggcagguuagguagcuuuccccagaguuauuuuuacauauaagacagaaugggaaugacuauugcuaaugauggugucauuuauaacacccuucuauguuggcuuuaacauucuuuccuauggaaacccuuuugcucacuaacuuacccuguacuuguguguccauuaaagacugaguauacacagggacaauucuguuuauuuucacaugcaguggguccuaaaggccauaauguaaguucuggauauguuucgucuucuaguuuauuguguccuugcuccuuugucucuuggacuggugcauggcgcugcccgugagugcccuccuccacccuguguccacagcaguucuagaggagcugcacccaucccgggcccccuugcuggauuauaucuacagggugagucuccccuaagccuugggcacagacuguagaucuacagauuaaaauaacauaauguuguacauuuccuacauuuauauauuugugccuucugaaaaugaccuguggaaaguuaugcauuugggaagacaugaauaauuaaugaguaagcagaacugauacagcuguagagaaucagugguugccaaggugaagaugcacacacugcacaugacugucagauuuaagcaacugccaugaaucagaaugccccaaucuucaucacaagugaccuguaucuacuucguuucuaaauggacuguuuauguuauagccuauauuauaauauagggccugcagcauaagauucacaaagaucuguuuaucagacuaugaagaaacccauaaugcuuuuaguaaauaaaccucaagaggcagguguaguggugaauguuuguaaucucagugcuugggaacauggaggccugccucaaaaccagaaccaaaacaaaaguaaaagaacacaaaggaaaaaaaaauccuuaggauaugaguuaagaagucucacuuuagccaggcgugguggcacaugccuuuaaucucgggaggcagaggcaggugcauuucugaguuugaggccagccuggucuacaaagugaguuccaagacagccagggcugcacagagaaacccugucucaaaaagacaaaaaaaaaagucucacuuugugagaagagacuuuaaaaacugcauucaauuuacuuuuauuuauuccauauaauucauggguucauguguuguacugauuuaaacgcagguuguggucacccggcccucuaccaugauggcuuucccauagccuuccucucguuuccugggcuggcuccuuccaccuugcugccuuuggaggaagaaagccugaggcgugugcagucacacaggaacagaaacaggcaccuuucaccuguguuuuccuuugcccugagcauguagauguugucacugacuugcuaguagcaaaaagauauuuaagaauggaaagaaggccacauuuggacauguuccuaggaaggagcccucucuccuaagcagugugggagcuaggcagaguucaggaaaugcuggcacacggagccaugcaugucuguccuccucagguucugcacugcugugucuguggcuccagcacauacacacagcaaagucacuauacucugaccuuggcugaccugucauccacggauuaugaccccuuccuaccucuggcaaacgugaggaacuccgagccaauccaguaucauucaucagcagaccuggggaaccugcugaccguggaagaggguggguauaacuacagauauacaauguuaugugcaggaaaagguaagagugcaggcuugucugugcuuguguuuuagguuuguuuuggauccaguguugacauugaaaucccaguuuauaggaucucugauagcaaacucccuuccuuguuucuuccucuuuuuuccuguuauuuuuacuccucucuuuuuuuucccaucuuaaauaaugcacaugguuuuguguugcauacccaugaaaugcaaaaggcacauuuucuauccccaagcagcuuuccagguaguggaggagguaggacauugcugggcugguagcaucuucaggacuucccauagggaaggacuuaaacuggacucaccaggguggacagauuugaaggagcucauagaguauccaggcgaggagccccucaugcagaaacuugauagcaacccaacccugagacagaccucucucguguaccuuuuguggauagagauuuagcaggccgugaucaggugagagugcaggauguacagugugccacaaaguagguucaccccuauuuuaaugacuuacuuauuagaccauuaccuguucuugacauaauuacuacuuuuaaauaaaguuacaagcaagauacacagucaagccaucugugaucacauguguucagauugcucauuguuaaugacuacuuaaaacagaaggaaggggaggagcuucagaagaggcgaagcaaaggauagccagacauucuagcuuuguauuuccuuccuccaggaauccagaaagaagaggguacuuggauugucuucuuguguaguaguuugugagacccucagcuaguuuugccauugguagaauguagaucaacucuggcuuacagggagugagcgcaugggaagccaacuucacugaaaugugcaggaggacgucaauguuucccacauggcucaguaccaggcccauuugggauuguauuagaagugucgucauggcaugguuuacagugugguucauagggcuccuggucauuuccccacuguagaauuaaaacauucacaaaacacaaaccaaaagcacagugucuguaagcaaaagcagaggggaguuacuuuccccacuugguauuuucccuuugucaguuuguaccuuuaucauuaguuuugugccuacccuacugucaugacgaaagcguguuucccucuaugaacugugaacuccuggcugcuuuccuguggguuucuagauaguaaaauuucccagcuggagaccuuucuuaguuguauagaaaucuuacauauuucucuuagguugugggggaaaguuuaaguuuagaauagauguaacuggccucuuguuucuuuaaaaaacaaaaaguuuugugugacauuuucuuuuccauuauuggauauagauuucauauacauugaaaaaaaugauaagaacucaaaaauucaaggugaucuugcucuccucacuucuuacucagaauuucuaaaguuucagagauuuguuucuuucgaggauuuuuauacagcaugaaacaacauguuauaaguaagccauuggauaaugucuaaaccuagaaguauuuagcaugaagucauauauuuacagcgauuuaugugcuaauuaauauuugauuuuuuuucacagugugaguuuaaaagcuauuacuuccuaaagcucuaagaucaaauuauaaaccuuaauuuaaauauguaguccuuuauccauaaaauuuuuaaaguuucauuuucacuuuuuuaaauugacuuuuauaacuuuugccaguugaaguuuccucaacuacucucagccugaaguacuauuucaauuucuaguuauguuuuaguguaucuaccuguccguuauaccucauuuuauaaagcccuaggacucauucuguugucaaagucuuuguauauauuuaagcuaaaauuuuauaaaucaguugcucuugauuacuaaaucaugaaauacaaauucaguuaaguucuucuaagugccuccaugguuuauuaauaugaugaauuuucuuaaauauuuuuaguguuccaauaacaaaacauaaacuaucacaaugauuacuaaguauauuguuuccaaucuuuuaaaauagcaccaagguuuauuaauauccuuaucagguuuaccugcaaccaacagaguaggaucccuagcccacuuucagaucucauccggguuuuuacucuuaucugagccccugaacuauuaucugucuaaccuggaaaugcuucucuuugacuuauucucaugucuauagacuuuuaaagucccuuucagagugacgucuugguguaaguugguucuuuagcagucuguuucaacuauguuuuuauauucaaauagaauuagagucagaaaagagaaaaaaucagucucacaguuaaaaccauucagcugggugugauggcacacaccuuuaaucccagcagaggcagacauagguggaucuaugcuuuacaggccaaccuaaucugcauagugaguuccagaccagccagugcuacuuaguggcaccuugucacacaaaacaaaacaaaaauaacaaucagacauucaaacuaaugacugaaauugcguggugcccccauuaucucuucaugguuucuuccugcuguucacagaaaagaagagaagaaguguggaauugaucccccucacugcacgaauggucauggcccaccuagugaaccaccuaggccacuauccacugaguggggguccugcugugcugcacagccuggucagugagaaccaugacaaugcccauguggaaggaacugagcuguccucggagguguucaggagcccaaaccugcagcucuucguauuuaaugauagcacccucaucuccuaucuucagacaccagcagaaggaccagcuggagggacuucaggggguucccucucagaugugagagucauugugagggauaucucagggaaguacucuugggauggcaagguuuuauauggaccucuggaaggccguuuggcacccaauggaaggaaccccucauuucagauuucuggcuggcaucaucacacauguggaccucagaaagauuuguuuaacggugaggagggagaugaugugcuugacaaguuacuugaaaacauuggccauacaagccccgaaugccuuuuaccaucacaacuaaaucuaaaugagccuuccccaaccccaugugcaaugaacugggaccaagagaaggcaaucauggaggucauccugcgccagagcgcacaggaagaugaguaugugcagagguguaacucggauucuucaguaacggucaccagccaagggcagcccucacccguggagccccggggacccuuuuauuucugcagguuguugcuugaugacuugggaaugaauuccugggacagaagguaaccaagcucugaauguuuuaucauuucuuuuauaugaggguuauuuuauuauuauuauuauuauuauuauuauuauuauuauuaucaucaauuugagguuagagaauaagaaauagaaguuuuucugaauuucaauauuugcagguuauuuuuuuuaauuaaagauagaacaauacugguacacaguugaguuccaaauaccugucagaccuuugaaagcauaugaaccaugcuuuuuucuucuugccucccugaccauacuauuucuguuuucauacaaaaugcaaaugaaccacaaauguaaguaaaccacugucuagccacagaauugaugagggaugugaacuugaugcaccucagacaaaggcacaggaggccaagaagagcaguuuuauccaguagguagugugcguauuggaggacaccuuagagaagagggugggauugaccuggaccugauaguggagcuguaaagagaggguggggaauauagucacagaacugguauugaaaacaaacacaagcacuugcacacgagggauauacucguugacuaaagagcuuucuagugucacuagaugccaggggaauuguuauguuucuauauacgcaaggaaaauugggcucauuuugaaagcuucugaauuaguuacuuuucuuuugcuaugauaaaacacuaugaaaaaggcaacuuauagaaaaacaaguuuauuuuggacauaugguuccaggugcuuagcauccauaauggcagggacagcaggugacagaaauggcagcuggaccacagcugagaacucauaucuccuacugguagcaggaagcaaagagagugcacuggaaguugcuuguggcuucugaaaccucaaagccugccccuagugucaggcuuucuccaaccaggccacauuuccuaaauuuacucaaauaggaccaccaaguggggaacaaguauucaaauacucaagaauauugggggaggggacaugucauucaaacuucuacaagaucugucacaguucuucagugaaggagauuguagauggaucgauaagggcuaucuuaguguuacuauacugugaagagaaguuaugaccaugaaaacucucauaaaagaaagcauguaauugaggcucgcuuacagguucagagguuuacucuauuguaaucauggugggaaacauagcaacaugcaggcagacaugggguuagagagguagcugagaauucuacaucuggauccucaggcagcagaaaggaagagacccuggacuugagcuucaaaaaccccaaagccuacccccagcgacauacuucaucccacaaggccacaccuuccucaauaaggcucaagacucccuaauagugccagucccuaacguccaagcaucccaauaccuaagccuaugggggucauuccuagucagaccaccacaaugucuacauuugguaucagauuagaaaacagcagaggugguucuguggucacaugaugucuucuugcauacuuuuuuuuccaugcaggaagaauuuucauuuguugaagaaaaauucaaaauuauugagagagcuaaagaaucuggacucgcgccagugguaugugaaauaucauuucuugucuaacuuugugagaacaugguaucaaauacacuuucaggaaaggaaaaaaaaaaaaaguacccacagagaaacccagaguguuucuguagcccagaaucuguugugguuugguuugguuuuuuccauucuguuuuguugagacgaggacucuuaaguugcccaggcugaccuucaacauacucuuuagcccaaguaggccucaaauauguaauucucaugccucagccccuaagucgcuaagaucauaagcuuucuuuaaucaaaaaguuuuuaaaaaucccauaucuuguucuguuuuaacuucauggccucuuuuucaugaauaacauauacaucauuguauauauacauuaaaagauauuguuauuagguucucuuaaagguguguguguacauucaugcauaagcuuuuggguccauuuaguguacuuuauauguacguguguugagggcugucgaucucggagugauuucuucagugguugcacucuaucgucccaucagcugaguaaggcacuccuaacuccugaauccuacccuucauuuauuugaugacagccacucuggcugagaugagauagaaucuuaaggcaaauuuaguugucauuucugugguggcuaaagauauugggcacuuaaaauuauuuguaggccacuuguauuucuucuuuuaagaacuagucuguucuuacacuaguuggugauuugaugacuugggguuugguagucaacuuugcaguucuuuauguguccugcguaucgggcccuuacauugguugucaagguuuuugauuuuccucauucuauaguugucucuugaggcccgugaguuucucuugcucugcagaagcuuuuaauucacauaauaccauuugcuacuaguucuugggauuauuuccucugcucucaggaaagcccugucuacucuuuguguagaaguaguuucccuguuugacucuagcagcuucagucuaaaauacaggucuuuuuguuuauuuuuaauuuguguagcccuagcuguccuggaacuccaucuuuagaccaagcuggccucaagcucagauauccaaccugccccugccucugccucuccaagugcugggauuaaagucaugugucaacucgcccaacuuuaaaauguaggucuuggagcuggugagauggcucaguggguaagagcacccgacugcucuuccaaagguccugaguucaaaucccagcaaccacaugguggcucacaaccauccguaaugagaucugaugcucucuucuggagugucugaagacagcuacaguguacuuacauauaauaaauaaacaaaucuuuuaaaaaaaauguaggucuuuaguccauuuugaaauaagaugagaaauagggaacuaauuucauucuucuacacauuaaacagucuguuuuucacccuucuguauguuugguaucacuguuaaacaucagugguugcaccugaauggguuuguuuugaguucucauccauuggccuguauguuugugugucagugccaugcuguuuucuaagcaagcauuuucacuaucauuuguguucagaugacuuucuugugguuuuauuguuuauucuuaaguaaaugcuuggcucaagucaguauuauuugcauaucagguuuguaacuaugauauuuuuugaugguuuuaauacuugaaccuauguaugacagcaacaucuagucaaauaguaaacucuaccugaaauuaaaauagcauacacacacaaacacacacacacacaucacacaccuuuaagaggacuuaauagaaauaacuuugcgucacaaacacaaaugauacaaucuaggggccuugauugcauguucuuuuguuuguuuguuuucugucaaagaauuaaagggcuagaaaauauaaagugcaacagauagcagcaaagaaaccccagguaccauagacagaauuagcaguugaagaaagauauuuauugggggugaggaaacacacacauagcagacacauagagaaaaaggcucucuccaaagcagaggaaggacuuggaagacaaaaguccaauaccuucuccagagcuggggguuuuaaaccucugaaggguuuuccuccccuaccuuaggguuagucaguuugaauacagacagaaugauugauugguucauaacuguuguguggcagguccugaucuagccuggaacuuguugagccaguuucaguagugggccugcugacaggagacagcugucaggcuuuucucuccagucaggaagcugaggaagaagcuaaccaacuuggaaauucaccaucuuuauuccuagcuccucuuccuaucugucugccuaccagggagucugucuaccuucuggucucucacuaaggacucagcagauaaaaucacauuaggcuuacuuauagcuccgugucuuuucacucuuucagaagcauguagaauuaagauacauuaauucauauagaccauuugugggaaucaaaaguccuuagauuuuuuuuccuccuuucccauauauccuucaaaucauucauagcuucuuagagccacacacauauugaagcauguacuauuuugugugugcuuucuggguguugggaaugugggagggugguuguugugagccugauuccaucugcagaagguggugugacagccuuuucuucuaguaacucuagugcuaagcauuuuaguaucaagaaauaaaagaaaguauacagguuuaaaugauucauuuauaguuguaauugaaagaaaccauccucagggcagauccugcaacucaguauuuuaaauguuuucauuucuugacucaaguaaagcuuaauuugaauuucaaaaccauguaagaacuguuuuagacccugauacugccaucccucccuucauucucuccaggacagaggcugagcccucuggaacuuccaugagggauuucugaagcacuugggcacuugccuuacucccucugguccuuccaugcuaaacaaucauuuggacccccaucacagcuuuucuagcacacacugaauugcucccugcuucuccaguguuaagugaaugcacugguaucuuguaauuguagccaauuuguugaauguuaaugcacuuuaguugcaugaggugcaaucgaauuagcucccuggggugcuguugcaguaaaauauggcuuuggguagcugauuggcaaucuucugcccuuugauuaaccuucacuuaaaaucccaauuccuggacuuaugucuggugucuuggccucuaaaugcacaucaauuuauuuaaugggaaaggauauuuuucaagauugucuuuuaaaaaccugaacuccaucuggggcucuucaccuguagggacaucuggccugugccauagauuggucugauaccaugcaagaacacaucuugucccucaacucucaggacauuuuuauuuauuccugguaucaauuuauaucacuguugugggggcacagugccuuuuucacauguuuuaagaaaaaguaaucuuucgcuaaggucuguauacugugugauggcuguacauacgaaucacugaggguuuucucgacacuguguggugaaggaaaugguaaagucauguuuuccuuuguuugguuuuuaaaaucacaagacacacaagacagcacaagaaaaaagaacucuucuggucuauuccuaguaauaaagaaaaaaauguauucuaaggaggaaggcgaccuuguugauucuauguauauguguuccugaauuaccugccccuccaugcacugguugugcaguuuguagauaugaagugcuguugauguuguaauuaccauuucaaaagccuggcgcuaauaaggccaggcacagugucugcauccuagcaggcucucugcagugcuaauauuuuguaggaugugaaauuugaugaguguuuacaacuaaaggucaccuuugcucacacccaccucagugaauccuccuucauuugagcuuagcuuuuuguguuccuacacugaguuaacgaggacgcaagaaugcaggauggaauaguccugggcuuuacggauaaacacugauguauuucagagaaaucgaagguuggggauuuuuguaaacugaaugcuaaggaguuuuaagauguaaagauaguugcagagagaaaucaaguaacuauaccuuuguucuuuuguugaaacugccauccaagugucaaauuauuacaguucuugugauaagccagucagguuguaggggacccuuuuuguuguccccugccuguuucucaagguaguaaaugauauggcaguuucuacauucccuaaggucuugacaacaagauugugcacucucuguaggggucaucacuaccaaaaaauguauccucuuuacagcaucucuuuccauuuccuacagugguacagccauguuguuuguuuacauguucaaguugagaauuguuccuuuuauucuuuuucuguauuuucugguuuuuuuuuuuuacguguauuuguuccaugagaaugauagggggacaaacagcuaucuaaugaauaggagagaaugugccuccuccagugauuuauauaacauuuuaguuuagcuuccauuagccuugcuuaauaagcagaaaaauaaccaugaagaaggaaauauuugagaauuuguuaaaauauggaguccagaucuaccaauuuggaugucuaaucauauuacaguguugagauauuaaauaauuagacaauagaaacauuuccgcauugcugaagcacuugaugcuuuuuccuaugcaguguugucaugauguaaugcaaaugagagaaggguggggcugcuccggaaguugggaucuaauucuuuuaccauugaggcuacaguagaauaaagcucaugaauuggugcugucaaaggagugguucuugauuaagcuucaucugaacaacacuugagcuuuuaucuccaagcuaucaccaaauagcuugguagggugcaucccaguuauuuuaauaccuuacacauucagauauauugucauguaucuggucaguuuaacagagacuuaguugagcccuuacuauguaccaaauacuaaaaaaaaaaaaaauggauugggggugggcacagaagacagggcuccuuucuucaaagugcaaaucaucuuuacaugauuuaacaggaaacuaccacagaucugucauggagcaaguaaauaaagagcuuauauauccaaaaguauccaaagacucuaugaagaacaacuguacaucauauaugguauccucacaauagucagaacacauccuuucacaaagaaaauaccuaaguguuuccauuucucaaaaagacuuagcaaugccuuaaagcucuaauugauaccuagccacaauaugugucuacuuggaaugcuuuagagcacaauguucaucaccaagcauggaaagaaccugguggauaauguacucugauagcuacuguuuuagugucuccagugucugaggugcaguuuccugcuucuuuaacuuugugucuccuuuuggucaccucugcaaagcagaugauacaguaauaacacuagcuuucacguggaaucgggcuugcagaauucaaauaaguucaugcaucaaccaccauagaauagaaacagacugacacuuagugagugccauuaggagucaugcuggccauaacaguaaaacaaaacuacacacacacacacacacucuaacuccuuuaaauuuaaauauuuauagccgcgagacccauaagauugcaguguuuuacauugcugaagggcaagaagacaaguguuccauucuagccaaugaaagaggaagccaagcauaugaagacuuuguugcuggucuuggaugggagguaauuaacuucauuaugugguugcugacuaucaguauuuaaagcagauaugaauuguguauguucuuaguuguaucuucacauucaaauguagcauucauagaauucuucaagacugcacugaccuuaaaguccguuugcuucauuuuacuauucuauguguggauguuugcuuccccuuaauagcuuuucauuaacuuuguuuaagaacuguauagucauaaaggcucagagcugcaguuugugacaaaggaagacaagaauggccacuggggcaggguggucgugggguacugagaaaauaugcaauggcuugcuaaaagaaacuugaaggaaggccuggauaaagugagggacuggaacuagaaugucuuuggcugucacugcaguuuucuauugcacaaguccagaaugaaugacaagaauccagguuuucuuacugaaaggucgacuaacggauauauacacagaggcacauaccugccuccagugaauguaaacccaaaggaaagcaaaucccuagaaucugaaaagugaugugggugggagagguguaugggguguguguguguguguguguguguguguguguuggguuuugugucuuuggucuguauaugcuguagcacauccugggaucacagccagguccuugcaugugccaggcaagcauugaacugcugaggcaggcccuccuuacauuuuuauaguggcuuucacauagcaugguugcagaccuguuuuuguuuuuauguucauuucuuucuuuaaaaguuaauuucgucuaucuuauauuuguuuguaaucagaaugaaauauauuuaaaugaaaauuguccauucucucagcucccacuccugcuuaaugaauaagguuagcucacuuuugacccucaccuuuugcucugugaccuucgucagguggaucucucaacccacuguggguuuauggguggucuucagcgcaauggcagcacgggacagacagccccuuacuaugcuaccucgaccguggaaguaauuuuccacguuuccacucggaugccaucagauucagaugauucucucaccaaaaagguaagggggcuucucagggacaacagcucacugcacucguguguaagugaggcucucugggucuggauggugaccaagcccugaagcugcuuucccaggguuccaagucagugcccucuuccucuggcuacaguuguagugaaucuaaaccacuaacuuagcacaacuuuaaggccuaagguuaaagacuaggaagaaaaugggucuuuagcauggauacuuuuggaucuucuuucauguuaauuacaugagagacaauaauuuuaccucauguuuggcaaaggccauaacacauaauagccauuuuugaccaaaaaaaaaaaaaaaaaagaaagaaaauaaaaagugcugauaaggcucuagaaaagcauucccacacacacacacacacacacacacacacacacguacacacaccacccccaagguugcuaggaugaacugccaguguuugucacagugacccuaccugcagauacguuguugcccaaaugucccaccucaaaugcuaucccuuugcucucccugaugcucccaaaggaacuccaccaaagaagcagggccuugaacuccacagccuauagaauguuuacuugaaaaaauccuuguuuuggaugaggaacacauuaaugggagaaaaauguaguauaguaagaaaaccacuccuguaaguuucuagaugaacagagcauccuaaagcaacugugcuuucccuguuggcuaaugggggacagccuacauuccaauuugacacucagucuccucuaacagcacagauguaaggaacugagggcaguaucucaaguaugaagacuguacauugggagugugguggcaugguuagagagcuagggccagucaaggcucaaguguaugucuuaauuguuuuaccagcuuauaccucugguuuuccuguauuaaauaagauugaaaauggagcccauagcacaguacuguugagucgaguaaguaagacaaugccagaaaaauugcuuagcccaauaccugguaggaacucucuggccaucagcccucgucauuguccacugaugugauugauucuuuuucccuugccccauuagccagaugauugaucuuagcucaugggcccuacuguaucugcuucauuucuuuugucucccguuuugccuuuucacuacuguagccacagaugucuggacugcauacaugaugaacaacagugcaugugagacaucaucagaacucgggucacagacaauuuccauagugaucaagugucucagaugcauaaagcacaauuugcauucagaaauucagcagccuuucaccagcauagcccugcauacugccuuggccucccugggcugggaaccucacagcuagugggagugcuagccaugugcugguucccacaggugugaaggagccgccugccugccagcuuggguucugauggcugcagugcuuauagaaaggagguuucugcuaugugguagcucacugguauucuagaaucuggaguugcuuuaccaagaccccaggcuguauucacauguuuuauaaacaugggguaccuuguaaaugucuucauguuucucugcauauuauuccuauauucuauaauuuuucaugauuaacaauuacguguuaaagacagauuuacauauaaacuguuuugaaggauuacuuaaguagaaaggcuuuuuauuuuguuuuuauacuauuuucuugacauaaugcugcuauaaauaaugucccaaggcuuggucuguaugggagauuucccacuguaauauucaaaaagcagcugaaaccuuuugcagcucuaagauuuagcaucauuaacgauaaacccucuuuaccaggaugucucacagucaggcaaaaaaaucagucacguaacagcagcccccgguuccuugacuuacuccagcuaaauugucccuaacagcuuaaaaaugagcugcagaauucuaaagugauucaugcucuguucugccccugucauggggggacuuuuucaauccagcaaugcgguugcaaccccauacugaacucuugauccuucacugcagaaauuuguuagcucuagcuagauuagauuuuucacagcuaaucuaacugcuguagggguuugcagaguggggacagagcugugcuauuggauuuguccaauucauuugacuccaggacuauaauugcacuuaugucuuacaaggcuuuuauagccucaggcuggccagccacaugaaaaacaaauuggcagugauacaguagagugaaaggggaugaaaggcccacauuaucagucucuaagcagcucuguucuggcaggaaguuucuugguuaauuuacaaauaaaacuuagauuuuaggaugggcacacugucagcugaacaauggggaugucaggccugacuguuacuuaguaaaaguagcagccgggcccgcugaggagcccagauucuucaaucaaacagacgacuccuucuggagccagcuggcgauguaaugcaauuagucgggaaaggaggucagccuauuagguguggaccaugaccagugucaccaguggcgugcaggcgugcagccuggcagcagcaggcagcacagcucaggcagaagggcuuuauaacucugucugucaggacgggggauagcaggacauaggauugauuucuugaggcucaagagccuguuuguucuaagcaggguaagccuugaggccuucuggacccuacugcauaguggaaguaggagcuaaugugaaugcagcucccuucuagggaggcaucaucuccuccugaagucacauaccuccagucaaguuggcuugucccugagcaaaccugugggugggcuuuuaacuuacaggccuauaaucaaaguucuguaaaacucacaaagugacaucucuuuauugaaauccccuuugaauugaguaccauuuuagguuuccagaauauccucuuguacucugauuuggguaacuaugcuauguucuguuguggguaguuuguccacaucaguuucauuuguuugauguccuuggguucauaucauagguacaagaggguguaaguuuuguacuuuuccagcuguaucagccaaugguucccguggccuuugcucuugguuuugugguuuaguuaauuaaacuguaacauguccaaaaaucuaaggugcaugacacugaaagcagcucugaaugaauauuacaaaaauaguucuuccauaauugcagaauugccacagagggagaaagggucaauuaguguggauugcucuccuaaugcuggaguuuucuuagaaugcugaugcaaauaaaauuaggagagguuuacuuggguuauguaauugaauaacacaauuuagaaagggacagagcaacugcaaaauuucagcaaucaguguaucaucucagaauaagugcuguacucugcccuugugguugaaaaggagagacuguugguauuagguguggcauugugugguagcugcaaggucgaacagugucugguaaguggauugucuccauuauguugcuucugccaacagcauaacaagaagaguauagggucaacucucuuuggaggaugaagacuguaagcugaacuugaggguagcccuacuucuuacaguuagcuccuauugcuguaaucccaaaguuucaauuagcucuaauccccauuuaccauagaaacccauccaucuugacucauugcugucacugcagaaggacuaaguagcaaaacacugcuccaaggucuuuggccguugaguuagaaaugagaaaggcaggcaggcaggagucaguagugucucagagaauagggcuaggcuguagcucagaguagcaguguagagcacugugcgugcauaagacucuagguccuaugucaguacugcugaaagaacaaaggagagaaaagugggacuugagggcccccucagcucugagagcuuggcaccuucgaaagaaagcaaaaccuuuguguuagagcuaaguugacuguauuucguuuuucuuuuuugccagcuaucuuuugaaccuuuaauacuuguguugggguauaacaagugaggaggaaaagaaagaugcacuggguaauguuugcauuuacgaaaguuguugacuccauuguggcuuguguugggcucccacggcugcaucuuucuggagccccucuucagaccaguuaacuccuguuccuuacuccauauaagcacaaaaguacaggugcaggucucuguacauaauugauguguucagucacuucuagaagucuagagaguguaaaauaagcaagcacugcaacaaacagcugccuuugaaacuugaugacuagaaaagaggccauguuggguucaucuuggguagucucugugaucaaaucacaucuaaaaauuaauaucuaugccaacauguuucagauguacucgauuccagaguguauuuuuacuguuuuuuuuuuuuaagauaaaacuagaacauaagcucugccauaacaucaguuuuauuagagggcuuuaaagguuggucccuuguuccuugauggcacucccugcucugaggcaggcaccucaucccucaagacuucuaagaccuugccucugccauacaucauaacuuuagaacuuuaauucaggccaauauucucaucacugugucuguuccuuuuaguuaugcuuuaggcuuucucaaaugauuucuuuacagcuauggccagauucuguuggcaggcucuccacgugagcaguuuaucagugauguucuugcaucuagcaaagguuugcccuagaagagcuuguaaagggucucugaggccuucccagggccuucuugaagacaccaagaaucugugguuuuuuggaguucauagucucuuuauaaaaugucaaaauaagugagcuaaaccacuugagauauaucacuaaaauagcuuuugaugugagcugagaucaggaauguccaacugaaugcagcagaacauaaaauuguaaauuuacucauagcagugagagagagagagagauuuuguuuauuauaaauugauuguauaucuuaguguguacauacugugccauugaaaugcuacauacuauuauguauaaguugaaugucccuggcuuagaucaucaugaguagaggccacugucucuggcccucucuccggugcuguucugugcacuugccagauagagcauuccugagcagaauuccuuacuucuuguaagaugagguaaagcuggaguuacuuaaagucuguaggaaggguagacaucauuugugagcacuuuggacaucuuuaaaugcuagaugcuaguaugcccaccaaaguuaaguuuuaauuuaaauuaaauauauuuauuuccuuaaaauauaauuucuuaccaucuuuaucucaaaaauuuaucucagcaccaguuucuuagagauugucaacaguuguguuggaguagcuugacuuaucucacuuuguuauuucuuaauaaccacuggauucaaaagcuuaaaguuuucaagcaauaaugacuagaaaaagugaugucuuuuuuguuguuguuguugagaaacauucucagcacuauagguuaggacugguuuagaaacagaauucuggguaaaagagaccuuaaagacaucuuccuccaucccacuguaaugugccuuggagcuucugugugugauauuagaaccaaacuggcauccuagcagguaggccaagguuucacagaauagcacauucugaaauccugaguaucaucaguguaguagccugauuuggacuaaaauauuuuuggccucugaguuuucuaauucaauuuguaagccacagccccucauaaacuguuguuagcaccucaguuaauaaagagccaauuugcuguugcagcuccgucaccuggggaaugaugagguccacaucgucuggucugaacacuccagggacuaccgcagggguauuaucccaacagccuuuggagacguuuccaucauuauuuacccaaugaagaaucauauguucuuuaucacgauaacgaagaagccugagguacgcuuucuccauugucacccagaccccuucauuugcuauuggaaucacaguccucaaaaacccugauaaauguuacagauaacuguaugugcuaaaugggaauuuaauacaaacugugauauucaaaaaaacucuaaucauaagcacaaaauuccauuuuguauuauuugaaaauuauguuagaaaaauauauggauuuuuaaguaauuuuaauguuuuaaaguauuauaauuuuaaggauauuauaauuuuuaacuggggcacauuauuaauaauaguaagaauugauggaacuccauuuucacuuaguauuuggggaaaaccaugggucuacaauccagcuuugucugacagaugagcauuggucacugagcccugacuggugcugauugcagucaauccugaaggauucuggacauguccacaaagacacuggugcccugaagcaaagcacacaugaugaguauuaacaaucaaagcaccuugcuagagaaucaauucagccaugucaauugguauugaccauggggcuggcuggaacaauccaauggucuguguccuguguacuaaucagcugcagcuugcguccucaucaugccucuacugguauuuuaauccugcugcucuguauugacauauuguguuuuuaacucauuaagaagagucuucuuagcuuugaaauuaaauauauuaagcauauaggccuuucuuuaagggaaaaaaaaaaaagacuuguuuccagccugauaguaaauauaauauuucuguacaucucagaaucacucucccggaggagcucaguguuauucugcugauuguucuuaagcuuuaaaaagcaggucaugagguuugcuguucuaauucggauuuguaaccuaaaguguuacauucgcauuaaacgugcuaauaaguggaaaagugcuucagauauugccuggcaccuggguaaaagcuguuuccauguuagccauuguugcaguuaugguugcuaucaggauuuuuuauauauaguuacgaucauaguaaaaucaguagaguucuaaguuuaauguauauauuaacucuccaauauauaggcucucucaaucuaggaaaaccucauaaaauaaaagacaaaagaugucagaauuuauauuagauauuguguuccuuugauucagacuccuguguauggcauguuuucagcuuugugcuguaaguuaauggcucagugcuaacaucugcguuugucuaugaagacagaauuauguauaagaauuaaagugauaauuuuaaucuuaaagaguaauaguuuuaguacuuuuagcuuucaaauuuuuuuuaaaaaaauucguuuauaaguaguguggagcuaguuuuacuaggucaucuucaggauaguccucuaaaaugucagaauguccuuuaaguguccccuuuacuuuuaaagugaaugaagaccaugaaaagcauuucauuucacucugcugugucaaaagugacauuucucaacauagcaugagaugcauaaaauguuauuuauauacuuuuaaauuuuuccuacaaaaauguuuaaacuugaauaaacuugguaauuaauuuugacaagaugaauucggaaaauugguuucuuaauauuuuaacucaaaaaaagccuaaagugaaaagagaauaaugggaaacugaaaacuuaguguugucccuacauuuaaaguuacaaaccauuacaauguaauaaaauuaauccagacauuuccagggcaaguguagcugaccuuuuguucaccaaccacugaccccagggugaaugcaagaggcuuucggagggaaagucuguuuguuuggcuucagucccugguauuuaaauugcauucccuaaucaaaugaaaaggcuguccucucuaucagguuacagaauccauggcaacauuuggccuuuuauauccauaauguuagccuuuuuguuugcaucuaaguagagacaccuggagcaaugcuaacauuaaccgauuuagcauuaauagcuucauuauauaagaauuucugaucagauagcuguuacuuuuguuauauugcuucagcuuguauuguugucauuuuuuaucuccuugcuuggcaaccaggcaaugauuugcaaauuuuuuuugucuugauuaauuaagcaauauaauuaucaguaaccgugaugcagucuuugcucaacaaagcuucugagagaaaacaaugguaagucuguuaguaugaaugcauuccacgcgucccagaugcaugaggauauuauggacaaugaggggaaaggccgccugugagcgaggacaaagggugccacgcagacucgacacacugcacauaccgccagggacaugcugcgggcucccugggacacagacgccucguuagauuacagcuagucagcagagauuaauucucagccauuuggcgcaauaauuuacccauuucccagucuuuuaacuaguguuccuuaccguggaacugaaggcuuuguacucaaagguuuucuuaaccuuguccacuuuuaggaaucuccacaaaaaucauuauuuguccuuagagauuguaguaauacagcugcuugaguugaagacuguuccuuuagaagacagaagcugcguguauuucagagacugcagguggaaucagcagcaggcuuuucccaccuguguauuucauaugaauagagugggacucuguggccaaauacauuuaucuuacucauuucuggguagccauacuccucuaagaaucauuuuaaucccuuuuaggagagggaaaaaacucaucagaacacaaaaguccugcucauuggauggagucaugcauauucaaauuguacuuucauucacuuggccucauuaauagccuaugugauaauguggggcuauuuguaauacaagcucacaggcagcauuacuuccaaguccuuugaaauuuaacauauuucgcuuuuucauuccauacaccccccccuaaauauacaaauuaugugacuggcaaaguccgccccuucuuaauaaugccccacauuuguaaaaugcuacauuggagaagcauggugugcuuguugugagggcacaaaauccucauggcugagagagucugcucacuucacaaacauuguauugaaccucugccuuuuucuuuaaaaagcagugugcuuugcagcauuauuucauuguuaaagugauuuccaaauaaguccauucccaucuccauaaauauugacacaauaaaguuaugaucauagaaaagagaugcauaauuaucagacuuaaauuuuuuuugccuacuuuuaucuguuagccauucaugaaagacuugucacaagacaguaaagugagugaccuaaaggguaugcagagcccauugucuugccuuuucuuaaguuauccugaccauccggagggugcuguuaagccagugucuggcucacauguagcuggugugcgggauggagaugcaugagugcauacagauguguaggaauggauccuucuucugggugaugccucgcucaggaccucugucuggagcaagcaccucgaaaaugccagucaaaaguuuaaugugccagaagucacaggagcauuuaagcucauaagacuaagaagaggccagcuuggacaucuaugcuuuugcaaggaaguguuuuaacccugcuggaguucccccauuauacaggaagcguguuugccuuugcugugugguuuuguaaauuuaucuugguuucacauuauaauuuucuuuaauauuuaucccagcuaaacaacccuuuggcgauucagucauguaccuuaaauauucuggagaauucucaaugaagcaaauuaacuuuagaaaauacugagucauuuacuuagaaaagaucauugaaaauaccaaagaaauagauuuuauuaaacuaacuuauguggauugcugcaauguguucugcuuguguuauuaacauugauuuuagaacuaugucaagaggcagcugcuugcagguauuguuuugaaaucaaacuugcuaauacacaggcacugcuaaauagaggaauuuccuagauacuauggauuuauauuaucacuuuuguucaguuuuugaaagauugagucacccacaagcagaugucaaagaauaaagaacauuuguuuuacaaaaggaccuugagaacagacagaagaaaaccugaagcagcacuguauacuauuaggaacuuagcuccuaccucacaggaacuuggcuuuugagaucugcuuuucaacagaauuucuuuaaaaguuggcaccauuucccugcuucugucuuaguccuccacacaucugucuuccuccuguggauuugucuucucuccuuugcugaauauauaccagauagcaaacugcaggccaggcuuugugcccggaagcaagguggcucucauucucuacucuugaguagacacaacaggaaggaaacaggccacacuccaggcuccucaggcagcuuccuaaggcccugcacucgagugcacaucugcuggccaguuugcccaauguuggagugugcuggguuccacuguggaaggaaacacagcccacugccaaagagguguauuuccugggccaaacugaaaguuuaggaccuugcuuuuuguuuuguuuuguuuuguuuuuauuucucuuccuuuuguauaaagcauguaagaaagaacacuucuauuuuuuuuuuucuuuuugaggcagaaucucacagaaucuuccugccucugccuccuaagugcugaauggaagguauaugcuaccacaccuggccaauaacacuuacuuauuuuaaaaaaguaaguuauagaugaacuuucaaagcauauuacuaaagauaguaggaaauuguuccuacagcucuuuuucuuacuuugcuuguuuuuuuauuuuuauuuuucuucugaugucuggucuagcaauguggaaauagguaguaaggacauaaauaaguggcuggguaaauaaguuucccaguaggaaugggugucauaaagcagaggagacagugaagggaugagggguaccgcaguuucuuuaguucacauaaauaccaaaguacaccuggguagaggccaaaaaacaaacaggaagucuugaaagaagccucagagaaacagggaacuacagagacacagacaguaauaucacauaggauuucucuucagaaaccauguuaucaagaagagacaaguugugcacucagagugaugaaagaaaauacuacccagaauucuccaccuauggaaauaacccuucaaaaguagagaguuccucaaccaaauggcaacaguguuugagagaauucguggcccauagcuuaucuugcauuuaauguuaaauccuuccaauagaaggggaaaauagggggcacuuugucaguagagugcuuguuacauaaacauggggaccuaaguucagcaugauagagacaggaggcucucuggagcucccuggguaaccagcauggcugagucaucgagcugcagggucugugagagacucuguuucaaaacaaaacugugagagagaaagugagugcugacggcauacauuggccucuggccuucauacccaaacaccacugcauacacaagaagauacauggcgucucgauaaaaacaagagcuuuaaagaaggaaucagugaagguaaaaugaaaugcacacuauguuccucauaauaauagcaacaauaauucuaagagauagauagcaacaguaauguaaggauugagcccagggauugggaauggucccuguacuaccuaagaaggggacauuuuggcuaguuauaaaagcauuuaaaacuuggggcaaccucuaaaaaguguuuaaaauaugaauuguaauugauaugauaaaugagaagaaaaauagaaucauaaaaauagucagauaaaaucauagaagacaaaaguagaaaaccaaaaaaugaaaaauaaaauaaaaugacuuauauuaauauaacacuugauaauuuucuuucauaauuaguguucuaaauauaugaguuaaaaaguaagacagccccgccaggcagugguagcacacaccuucgaucccagcacuugggaggcagaggcagccggauuucugaguuugaggccagccugguauacagagugaguucuaggacagccaagagaaacccugucucaaaaacaaacaaacaaacaaaaaaaguaagacaggcuggaaguguagaucagucauagaguacaaugcccuagguucaucuucgcaauagaaacaaaauacaggcacugucaaagugcauaaaaaaagaaggaaauaaugcccacaagucaccuaccaaccuaccaaaaaccuugaaauaaaggcaaaugaaggauagaccacucaucagaagaaagguaagcuaacaaugucagucaacuucagagcaauaaaagugaucagguguaaagggaauauugcauagugauuccuguggauggagaggcucucucuguuaucauaguuaagcugagacccaguggagcagguguuucagcccaucaaguaggaagcagagagggcaaaguccugagucagaccugacuuuugagagcaaggaaagaaagauaaccuauauggccaucgucaaagaagcaagaagagugcuggcagccgugcagaaccuccugggucacaauugagucuagaccaauauucugauuuugaugaccuugagaaaagcagcaauccgcuccaggcuucacugaguucuguaaaaauggggcuauagaauaguuggggaaaugacauccucuccauuacagcuccaagcuuagaacucagccacaaccauuuaacuccuuaucgauucagauguuccuaagcuauuagaacccaucgacuaauuauguauguggaacaaaucaaguaaucagcuuauuucuaagacauucauugaguagccauguuguuucccaacagggcuuagucauuggaaauuauuuacucugucuaagacccuuggggucugcaaaauaguuuaaaucagcuuuuccucaccuuucaggaaacuagcacaaauucagugagcuguuuccugagcagcccaguccuuaagaguguuucccuuaaagagaacuguguacuccugaagacaccccuguuuucccuugccauacccugaaccacagagcacaugaaaagugcuucaaauguaaugcguuuacauuucacaaauuaucucauuggguuuuuuuuuuccaagcagaaaaagccucuucuaauacuaaauuuuaauugauuuaccuaucucucacuugaguaucucagacuuaaaagcagaaguguaaauauucccuuucuguucauaauuccuguggaauucccccaaaagaaaacccugaccagacauuguagcucucagagauagagagguaguuauggguuccaaccuuaccaggaaaccucagacaguguccuacccuugggcaucccuggaguaggagcagccucugguuuguauggacucugcuuuaccuagaaguugcuucauccuuucuggccuuucauauugaugcuucuuuauucccaaaauuguauaugauucuuucaucauucaucauuacuacuuuuugcuuuagguuugcucagaaggcugguaagagauauggaaaagcacguuauccguaguucuaaucaaccccugaaacgauuuguuuaaguccagaugaagcaauucucccuuagagcagcugugaaaccuccuuugggggaaguagagaguuauccuugacaaagcgauuacagggaaagcuguuuugauuuucuccaaccacugacaacucucuuacccccccaugcgcccccccccccgugcagaugcuuuucauaguuucucuacuuaagcucgaaaucuaaaguuaccuccuaauucacaguugugcugauccuugccauacaguuaccucuuucguggugauugugcuuguuaaggccauggcucuuagccucucagaccucuucuuuacaaccaucguucugugcuggaagcagauauucuuuuacugugaaagcauggguucucuaucugacuuugccauuuuggucucuagccaucugacuuucaaggaccaccuaaaaauuauaucuguauucucucuauauagaugcauacuauugaaggucucuucauauuugugugcuuccaaauauuuauccuguauccacuggaaagacaaaacaugagaggcucagcagaaacucaaauccuauaccuuugcaugacauuacugucuucuugcaugauaaagucagugccaaacagccagacacaagaucauggccauuaauuuguuaugagcgcaauaccuaacuggccaaccauuguucagcauggaauagauuuuaguaggcucaugcauagcaauagucugauucuaaaacccaagguugucugugaaguauuugcccaccucugcuugggaacaucaaaauguuucaacggaguccuugggagauuaguucuuauguaucaaaaugaauuuugucccaaauauuguccuugcccuagcagcuagauacacccauaggcugguguuguuuacagugguaacagguacuaugaacuuugggaucacuacuucgcaacaaaagccccuuuguguuucugcuggccaaauagguguaaaucuguccuguucugcacugcagccugaugagguugauuuccuuugggcuguacuuucuaggugugugcuucuccucagccagagauggguuucauuuagucaugaaaggcauggcaggaacucgauggguauuuucuaacgugcagcuagcugguaaggaaagccaguuuguuaacagucauggcuuuggucaacauacuaggauaaggcacucaggaauuguucagaauguuuagaugaauaaaagauuugaauccagguucugaaauaaagacuaacaucagaggaacaggagaacaauaguaaagcgagaggcccugcccaccuccuuagaucuagagcuagacuucaguuuucuacuaaccaaaccaaacaaagacaccacgagugcccgggauaugccacaucucacaaaucagcaucaccccuuucagggucauaugucucaaggagcuccauaaaugaguugucagugaucaucauccagcaucggagggugggacuccucccuugguucuguggcuccugugugacgggcucugguaucuaucucaucuuaugcuguagcuuagaacacacuucccuacaacuaaagcaaaccccugcccuacuuuuucuaagcacaucuucauuuuccuuagccuauuucaacucuguauagcuguuuuugguugccagcuguucaagcuaaaccaugcacugcauugaauccggauucugagaugaaagaacaauacuguugagucuucucuucauauauaguagaggauauacgggagaaagagagccucacauuuacuuagacuacuucucugaagguuuuguguggguuuugcucuguuuuuccuuauaagacccauuccucuggauuucauauuuugugauuuuaauaauaauaauguaugcucuuguuuucuuuucuggacaguuguugcugaagauagaaaaguaaguuagugaguucauucucucucuauugacuucuaguucugaccauuuccauggacucuuuauuauaauuauauuauaugauagaauaguugaaauaaggacuuuuugcuucuguccuuccaacuuaaacacacacacacacacacacacacacaaacacacacacgccuuccuuucuuucuuauccuggcaaaacucauuaauggacauguccucucauucacucugauguaucaagcuugcaguguuucacuauugccauaguuuacuaaaugaggguugcuuguuuuguuuuguguuuuuuguuuguccuacaaaguaucacagaaacuuuauucagagcacaacuauaggacagggagcaauacaauggcaguaagauuugagcaaagauacucaaaugcccaacaaauacauuaaugaaguucucucuuuuuuuuuuuuaaagauuuauuuauuuauuauauguaaguacacuguaguugucuucagacaccccagaagagggcaucagaucucauuacagaugguugugagccaccauguguuugcugggauuugaacucuggaccuuuggaagaacaaucaguucucuuaacugcugagccaucucuccagccccaugaaguucucuuuuauucgauagcuaagaauuuuuuauaaauagauuuugaaugucaugaaacacuuauuuuaaagccaucuucugaaaugagcagcuuaccuuccucauuucauacauuaauuuuuaauggacacucacugguaucuuccugggauguauuuagcauggucaugaugcuuuaugauucuagcgcauggcauggcacacucauggaggucagggggagcuuguaaagaucaguucacccuucugcagugugcuguggaaaucaacgcuggccaucagucagggcagcaagugcccuucccuacugagccaucucguccgcuccuuuuuaguacuaguauuaauguuucuguuuacaauccagcucagauuuuugugugugaugaaauagagaucagguuucauuuuuucuuaccccucucccuuuguuccagagucuuuaucggaacaaacuuccuuuccccagaaauguccugccuuacuguggaacaguugccauaauaugugcuucuauucuugggcuguauauuuucaucugucaauuuaucuauccugauauuaauguuuuaauaucuuaauuacuguaauuuuauauuuauuccucaaacucaguauaaaucaucucauaauugucauagcuaauuucugucuuuccauuucuguaugaauuuagaguuuguguuagaaucuaaauuuugauuucagaagaauugacaucuuaacaaguauaaaaacuuccagcccaugaagauuguacuuugaauuuauucaggucuucaugaauuuauguuaccacuauuggguacuuuuaaguauauuugucaugcauagagcaagacaaccaguguuguucucuggucuccucuaccugcauauauauacauacauauacauaugugccuacauccacaagcauaccauauacacacaaauguagguuagacguauucuccacuucccuaaagcucuuuugaaggcgucuaucuuccuuagaguaaaaacugagaauucuuacaguuuccuacgaggcucuucuucccuaacugacuucucucccucccggucuuccuucuacugacuuggcuguaggagcuaugacucuucugccuuugcucaaacacaugaaucccauuccugucacaaucuggaucgcuguuguuaugcuuccuggacuguucuccuccacuguccucaugguuuguuguucauucuucuaucuccuguagacuuuucaugaaacaucuagcuuaaagccaucccucccauuuuuauuccccaaaagauauguauucuccaaaaguucuuuguucuucucuguauuaucuucuguuuuauacaucauauacuguauacuguauauuugaguuagguuauaggagagauuuuuuauguguauguucuucacaagccccuuuagagaauagauuagaauaaaaggccuaucauguauuaaauauuguauaaauuugugaaaaaucaagagaaauuguagauguauaugagaguuacuaaccagcuccagucccaaaucucacagaguuuacaaucuccaugguagagaugaaacucuaauaaagaggaaaggaggagaaaugaaaaaaaaaaauccaaaggacauccaugaacacuaugguagaaauggauccagcaaaagaaagccaagcuucucuuaaaaguagaaaggaaggaagauaaauaauguaggaucuuggaagcagaggaugggugauucaagaaaaugaagacgauauguaggagaguggagugaaggaaguuuguguaccaggcacucuaccauggcacaggcauguggaaagaauaaugccacgucugugaauggcagcagagguaauguggaggcacuggaucauuuaccauuuacaaggccuugcagaaaguucucauggaggaaccuggugggacaauacugugcucuuugacuugaaagcccucaacuugcucugaaaaaguuugucugucuggaagacagccuguguauucauccccagucuucugcugcaagugcauucucuuaucucugccuuuacuccugcugaguuugagcauaggcuuuuuuucuguuuugaauccucagguuccauucuuugggccccuguucgauggagcgaucgugagugggaagcugcugccaagccuuaucugugccacaugcaucaaugccagcagagcggugaagugccucaucccacucuaucagagcuuguaucuuuuugcuguaaauguguaacuuauuaacccuccccagggugagauuccuggcaagcuuucaggagagguaagugggcuucaggcccaggcugcaguacuguuuguugauuucuaugaaauacagugauauugugcugcaucgaauauagaguuuguuuuccuaguugguucacuagucugugucugaaaggcugcaacugccgugauguucaagcucauggcuucucgggauuuuucccagguucagucucuucuaucuagagucacauuucacuguguggaaagagggauguguagcaaguuguugaaaucuuauucggagcgucagaaagcagaagcaaaggaaaugacuaauaaaucagaaacugcacacagcaccugacaacugcagaggguucggaaguauggaggaaggagcaguuauaccugacucaggagagggagucguuucacguuuauaaguguucucucaagcacuaauuggcaaguacaaucuuuaaauccacagaucucuaacuauaagaaaagaaaaagaaacuaucaugagugacuuuauaaaacugcuaccaaaaccaucuaacuugcuaauaaagcuuagagucucuuuguuucuaauugguauugauaaugauuaaaaacacauuccauuugaacuuucuccauagucuucuccugccugauuauauaugaugcauuacuggguaaagaaugaauaacaaauaacauguagagagauauaguuugugagaaauaccuuucauuaaaagaguggccauuucuugacaaauauccugccuuuggauuuaaaaaaaauauauaugccauguggcaacuuaaaauuaucauagaaauuaguaguagaaaggagcuauuaagucccaucuggucccucccccggggccagacugcauccuucccuccuguacacucuccugcuuuguccaggcuggugguuuuuggggggggggugugggggguuggaggcagccuucucugcggaggcuuccagaacacuccaaacgaaaucuauagcugcugugguucugccuccagcacggacuucuuauuuuacauaaacugcaacuuagaggagcuuuauagcaaaaaugagaaagaccuguccagcaauuggucugucaguuagcauaugggcugagacaagcuacacaccugucagucaaggauccuggaucaaggcaacaaaaguccuuugaaacaagaaaauucuacuuuguagcaguccacugugauuuuuuuuuaaucaugucacccucucacuuaucaaucauaucacaaaauaaaagcuuugucauuuuacugaucaauaaugagguaccauuggagcagucauaaaaaaaaacaguauuuuuaaaaguugaaaagguaaugaucagaaucuccuuaaaagccucaaggaagucauaucaggauuguaggugccagaacccuaaaauagcucauaaaauggaugauuuuucaucuuaaaggaugacuuaguauaaaaaggagaaaaaauaauaacaaagccuauuauacucaucauuaucaagcuuuaaauauuuuucuuuuauauuuaauuuauuuaugcuaaucaaauaaaugaucuaaaacaguaaaccagauaauaugcucaguuuuuuuauccagauagaaaacuuguaaggaauaccucaugcucauuuagugacuauuucuauaugcaaacugccaauauucuggucagaaauaaagacucuaauaagaaugaggaaaugagagggagaaagggggagauuucuguacuuuaaacaucuucacuauguuuuuuaacuguauccaugugccugugccagcuauuaaugaccagcugcucccuucauguucacugggacacugaaguucacagugcacuuuggggaacaccugaacugcuucagugucauagcugaugucuggaacuugcugcuuuauugacauaagucugauauuugaauuuugaaaaacacuaaauacuguaaccaguccuaauuuugaguacuaauugcauuuauucauuuaccaaacaaacauuuccuguggacugucugccaaguucagugcuagacgcuggggcuacugcaucaccucagggacccaggagcccaguccuuguucacacauuucagagauaauacccaaggagugcacaggcuaacuaguccccuucucuucugugaacaagugaaacugaaaguuggggugaacaagagucaagacaagaggggccucuccaaggaggacauaccugggcagaaccuggagacuuagaaggaagcugucuuuaggagcaugggugcacaagccugagugcguuugggagguucacauuguuuuauguuaguccuguacaaguuuagguccaucagggugccugugaugaacccaaaagucagcuguggugggaauggcauucuaggugauccccaaaagaaguuucucagaguucucaucuuagaacagcaugcuaaaggacccagccagggcugccugguagacaguggauaggcaaggagugugggggccaacacauccuauaagcccgugcagaccccugggggcugaagagaucagcggugccuugcugugaagugccagugguuuaaucugagcacuggggaaugagcauguggcgagccuuuuaaaauagaagagaaaguuccuugaaagguccugaagaauaagcacucuccauuuuccugcugucuuccaauuuaaacuguucuuacauuugugcuuauuaucacucacaguaagggaguguuaaauauuguuugcaguaauuuuuucaucuaaauuauauaauacaaauuugauagcaaaucucuaagcuuucaacucaucaccuggaaucaauagaauuuugcauuucauauaccauaggucaugugugcauguauauuuuguucuuaguaaaaaaaaaaaacuguacaaaaacuucucaucuguauauauuuucuuguucauguauguguauuuuagcaccccucucuuuguuaguuuguuguuaagcaaggaauaagugauaguaagggaaaccugggucaccuguaaucucuuuccugcuguggcaguuugcagagcaacugauuggcuguuucaaggggguagcacaacucagagaggguaugauagggcccugugguuguccauggcucuguggccauucacugcugcuuucuuucugcauucagugcaaguuaggcuuugguagaagagaagaguguaaccucucggcuuuuaugaaaucuuggucggucacugaggacacaguucuccuggccagcuguucuggccauguggcccugaaagcccugccuguaacccauccugaaauccccagaacauguugaggaacuuuggcuccaaaugucaggcauugauagauguuguuugguuuuuuggguuuuuuccccccaaagccuggcaguauaucccuugacaaagcuguauugguaugaacccaggcuuguuaaggaaggaagcagccugggugugcugcccuagaagaaaacuucacuucaagaccaaauaucagagaaaaaaauuacugcucccugcuuccuugagauacaggucacugagcugaacaauaacaaaaaauuuccuugucauccagaccuuuuuauauaaccacccuacgucccuguuuugcuucuacuauuuagauuacaauugugaaauagaacauugacaagcuacucuguucuuaucggugucccacacuuucuaggccauucuaugaacaacagucauguuguucauaccuucguaaauccuuuaccuggggccacuugguuuuuuuuguguagugacuguaugcuggcccauguugagcugaugacacccgaagcagacagccagugaaauuacuuaguuaucucugccucuccaguccuuccccagguggccgauguuucacuuccuuagaauaaacuugauuaggauccaguuucauguaaauuuuaacuaaaaguaaaaaugugaacaguuaaguaucaaucugacucuguaauguuuuuuuuuuuuuaauucccuucugauuaacuggggauuggaaguacugccaaaaaaaaaaauugucuuuggggggcuuuuuguuuuguuuuguuuuuuagcaguagaucuagcuuugggucaaaagaguucuuguguacaguucucuuggcuaaugaucaaacaguuggaacuguguggcagaggcacauagaagacugaaaaauaucauugucucccauaacuuaaaaaacaaaaaaugugcccacaguaggacuguauauggaaagcgcccucuaauggcucagcccagcccuccugugccuuccuguaaccuccacagugagcugaaucagaucugucaagcaugcuuccgucccguggccacugcacggcugaauagugagagccaacacaccuaccaucugccucuuccaucgcucgcagggccugcuccucugccuagagcacaguaaaugggaagcuugccacauguuauguuuacaguucccaagccagcuaaacauuccaaaaugaaacugugggcugcugauagaaguuccuauaagcauuugagccaagggcuuucauucuccuccucagagaacuugucucagggaaaagguucccuugccauaugcaaugugcccauuaggaggaguucaccccaaaucaagcagaugguggcuuucuagaauaaauguccacuucaguagaacaauagucuccguuucauuugcuaucucuacucuggaacuauccauauuugauggagagagucagugugccuaagaaaaaguaguuuuaugccuuguucugucacaagugaaauuagcuuucauuguuagcuaacagguacaugaacauaugguaauacuagagccucucuuagauaugugagcuuaauagcauuccuagauucugcuccuaauguacacagcuucaaaaaugacccuucccuuuaaaguucuaacaacccaaguucuuucuucuccagugggauccugagcuuuucuuccaggacagaccuuugauuucuucugcccaucuccccucacuguaggaaggaaaucaagccauaccauguguucuguuucaccaugcacaaccaauuaugcaugugucagcauuugcagccuuccugccaugugccaggcaccauccuaaccacucagaauauaaaugugaauaagauauuccaagggagagaggacacuguuugcuuauggacuaggcuaugaaagcccauuacauuugagaaugacagaugcuuccauauggcagagcguaggauaggcacaugcagaaacaggcacacagcaaagacagaggcagcgagagccugcacagagcugugggaggaguucugucugggagagaacaggcagggccuggucuguagcaguggcaaggggacaaguuggaaccuaugcagggguugggcugauccaauguauacccauagacaaaguucugugaaacugugaaagaguagguuuugaaggaagagguagccauagagacauaagaaaagggaagcccaaggagagagagagaggaaacauugcuuucagcaaacuggccacacaagauguauacuaguaguuggcuucgucuaucacugaggccaauagucucaggucuaugcugaaggugguggguuuguacuagaguuuguauauagaaggagaaaacuggguguaagaggacugaaaacugaguuaccaaaaagggaaaaguuaagacauaucuccgaaaagaaggaagacacuugugggugggaucgagugcuuauggaugggaaauuaaugagagggaacuaaacugaaacagacugaauggcaggcacaaagcggcagcuggaaggcauggaugauacuugaggaauugggguccuaaacaguccuacaacaaaaacuuguaauggcuagcucuacugcgugguauggacucuacagcacauucuacuauaggcaacaaauaugugccacauucuugacuggcagcuagucucaucuuucagaaaacaagaagcaaaacgcaaaaugcaauacauaggauucauuucuuaacaguuugaaagaauauugugacucugaguauugcaggaaauaguggguuuguacuagaguauguauauggaugagagaaagcagaaauaggacuguccucuagacacgugcgaagcggugcaaaaacuaaaguugagagggccaagugcuacauuuucccaugggugaauagaagacuaaagaaagaaaaaaaaacaagaaguaagaaguggaaaauuccuaauaagugagaucuuuaaauuauaaaguuuaaaguaugugguaugugggggcucgcaccuauagucucagcacuccaaagguggaggagguagaaugucaugaguuuaagguuacuuucggcuucacaacaaauccaaggccagucuaggacacaugagaccugucucuaaacaaacaaauaaauagguagauaaaauuuaaauuauuucccugaagaagaaaacggaaaagcaugaaagagcagccaaaguacuugcccaggaaguugguuucugauaaauuuguguuuaaaaucuacacauuaagauuaaaggaggagacccaagugcuauaaagaucagcacucuaauaauguccccagaguccccagcuucuggagcugucauggcacagagaguacaauaaaaaggaugaugauuggccccuccaaguaaaguccuuauucagagccacucauuucugcccuuacagagagcaaauaugcaucagagcucacagccagaagagaagcuucuguguacaggugcucacgcucacacacacacacacacacuaguaaucgugcugaauaaaagauacaauaaaaacuauaaacaagaaagaaauuccccucauuugcgaauaggauuaaaggcugaguuuugauaugaugcuuagaucccauauaaaucuaaucuguaaagcuaaaucauuaaaugacccugaaacuucagaaaagagcauuuucucaaagaguaagagugucacaaacacauuuccccccagagguuagaagcuuacaaauacaaaucuuaacuuuaacaagacaucuugaucaccuagaagauaugaaugagcauucuaggacccugagagauggaugacuucccuguggccagaacuccagucuuuaauccugaaacugcacugcacugguuuccuuacaucuuccacucgucuuccacuuaacuguuuuacuaaugacuuagcagaguucuagaacuaucuaucauucgugaaucaggguugucucagcagauguuaccuugcgcccaaacaucaagacuggaaagggguggcauggaccuaaguugggugaccaacugugucagggcaggauggggguaauguaguggcuuguaauguggagguaaugugcuccucugggggccacauugaaagaagggccucucaucccagagccaaucuagauaaaguaugaucauucugcagccuuaggcaucuggaaguuguuaaagccaagaaggcgucaucuguaggcccugggaaguuagggauuggucugcaaaacugagacugguggguagaggcagccacugagcagcuucagugcagugucaggcaaacagucagagcccagaacuggcaaaccagcugccugcauuccgaauccagccuacagaugagcuuuguuugaacugcacuuggccucccuguguuaccaaaacacaaaacugaagguugucaucacaaugaaaaacgagacugcauuuuuuuuuuccuuagaaaaagguuuuauuuacacuguagugauucaucagcuucucacaggcagaguucagggaguagggccauaagcgacaguuuaacaguauacaggcauugaaccuguuuauugaaguauacccguaauucacugaguuacacugaaggcaacucugaaggggcauccacaagucuuuauucugaugagaauagcugguuguauuagagucuggccaggaguuuuggguuauguuuuuagccagcucacuggugcauggaaagaguauauaaagccaacaucucuaagaucuucaagcuuauugcuacaguuuaugaagucauagaagugggagcuaugaggucaaaauggccagaaugcaacugcacuauuacacuaaauaaaaccaagccaauagucuuguggaucccugaauauuucucauuccacacuucaucuuagccaaaaggccgagaagcgauauauuucucauuccaaaggccagaaacacugaaaaggaacccuuaugcugagagguaauuaucagaguaauuguauaucuuuguuccuguaucaaguauuagggcucauguccacaaucacuucuugcaauaagcuuacacaguaacucuuuacagacugcuuguugaagaugcugagcucuggaauucaagggugugggugggcuucaggccauccaggacugagccaacacugugaagagacaauccagauaccucuaagucuuaucuugguucugggcacguuucaguucggcuccaaguccacuuugcuccaacucagcgaugacagacauauauuugaacucauuuggucugaaguuaaaggucucuacuagcccauagaucuccuuccgaucgguggcguagaagagcugaaccugauuggcgaugcacugugccuccacaacauucagaaauguggaguccauuucugcugucaucagcacuaugcccuuuucuuccuuaaguucaggauagugauauaaaaucagcuggcuggcugcugcauccccucgggucugaauauuuauaagugcagugaaguggagcucuguaccuguccauuguccuacaaagaacucauaaccaucccuucuugguagugcacaaagaaauguugggcaggacugagcccuguuccagaucaaaucaaacuucucuuuaggaauaacugcguagacugugucuuuugcugaaaaauacugcugccaaaucuguuuuauuuccuccgcaguuuugucuuucaccaucucaacguugaagacugaacugagagucuuguccuuagugaauccuuugcucacaggcuguuuccccaaggcaucugucuucugcuccauacacuugauaaaaucacuuuguuuggagugccccacuggcugcuuucggaacucacugcgcuucuccaggcgggacucaaaggccgcugggucagaccugcgcagcugcuggaucuugucccgguagcggucguagaagggguucgcuuccagcucgcugaccccacugccgucugcucccucggggggcaggcccgagccccggcgcaccgggaacaccgagacugcauuuuuuuaauguaguuuuuuuuuuuuuaagaguauuuuaugugagugguucucaagcuuuggucaugacuucuucaaaggaugaaacaacccuuucacaggggucaccuaaaaccauugggaaacacggauauuuucauagcaguugcaaaauuauaguuaugaagcaucagcaaaaauaaugucaccauaacaugaggaacuguauuuaaagggucucagcauuaggaaggucuagaaccacuguuuuguguguauggguguuuucuguacguauguuauguguaccaggagccugcagaggucagaagaaagcauggaguuaggucuguaguuaguccucauguuaguacugggaaccaaaccuagguccucgguaaagcaguguguacuuuuaaccauugaacugucuucccaguuaaagauuauuuaugugugugugcaugugucuaugugaguauauaugcauauaugugaguaacucuacucucuuagaggcauugcaucccucagaacugggguucuaggcauugugggaugccuggcuuguaucaagugcuaagauaugaacucuccucaugaaugugcagcaagcacucuuacugcugaaccauccccuucagaauguagauuuaaaaaacaaaacaaaaacaaaaaccuuucuccuaaaaaauaagaaaaucugagccuauuagaucucccuccccuugagcuggaauacccaaucucuucacagggcaccuguccuuguagcuaccauaguccccaccucaugagacccaguacccucaccaccaucaugguucuucacggugaguuuuggccccaacaguaaagcaggacccuguucggcuagaagcccaguuagugguagcagcagcuugaucccuauaaguaagggcuuccaagccucaaguaugauagaccugaagaucccagcugggaguuacaugacaggaguguuuacuuuguaccuagucaaagggcaggaggugucuccuucaauggcuuacguagaaucccugucauaugauaacagucugcuucuuaggguugaagcuucccaaaaaggaacccuguaggaagcaggggaaguuuucaugaagacagaguaaccauuuugcuauuuuuggugugcagugacaguuaaaaagaccuaaucucaagaacauuaaacauucuaguagucuguaagaaaccaggcuggugcugugccuuaggaaacagccacaagagccaaagaguggcuuccucucuuggccacugucucaacugguucacccuggcucacugcagggugucaugggcagggguguugcuucccacucugcuggccucagggucacuuugcugcgccccaucccacaugcuccuugugggucucugcugugguguagauucucauccucccucaucaucugaccagcacagucuuuuguucccuugacucaugagucaagauccggucaccucugccuuggguauggagcuguacugugaaauucccagggcgagccuuguuuucuuuuccuuacuuacacucucccuguuacauccugcuacauuaugcuauguguguaaaggugguggggcugagggcagggcagugaaggaaacaagacauucauuugguaaacucauuuugggaaacaguaucaaaagauuaaaaaaaccaaaugcuuuauaacacuacauuuuuuuacagaguuaggagcauccauugucuccagugaaaaguggguccacauacagccuauguguacaucuacacauguguguaccuuguaagcccugcguuuccauuccagcucuguccuaaacacugcaccugcaaugccuggugccugguaggaggggcuggccacagaaucacauuuaaaaaaacagcauaaucaggcuuuugaaaaguuggaaaacuucuugaaaaacuagauguuauaugaaauuuucuuuuauuggaugauuauguuaauacaugcuuccuuuuauuguguucaaaacaauuuuauagcugggguuuuaguuaagugguugucuuaguuagggucuguugcugugaugaaacaccacuaccaaaauguaaguuggggagaaaggaguuuauuuggcucagauuuccauaucccuguucaucaccuaaggaagucaguacaagaacucacacagggcaggaacauggagguagaagcugaugcagaggccauggagggaugcugcuuacuggcuugccccuaaugacuugcucagccugcuuucuuacagaacccagccaaaggauggaaccaccuacaaugggcugggcccuccucaucaaucacuaguugagagaauggcuuacagcugaaucuuauggauucaucacaauugagauucccucccuucagauaauucuaguuuuugucaaguugacauagaacaagccaacacagugguagagcacuuucuuaacauguaaaguccuagguucagcccuuguacaugauuguuugauagauuucagauaucuccccuaaaaguuauugaggggcuuuauguuuugaaauuaauagacucuugagugaugugaaagcagcauaaagaucaguuuucauagagccaugaguauuuagggagaaagauugagcugaaagaugcuuaaagucugaaaacuuacaaggagagaccgaccuacugugaccacuacagcuuagaccuucaggaaggaaggacugacagccccaguuaaggcuuaaaggaaaauggccagaaagcacugcauuuuguuguuccagauccuagggcccuauguguagguugcuggggcggguuuuuuuuuuuaaauuauuaauguguguaaauuuuacgcacauaaauaaaaaugccugcaaugcccaaagaaaguucugagaccaguaggcaguaggcuggucuaggccaagcaugcaaauacugacagcugaaaucacuuguuggagagucugcacacuccggcuccagcugcauucgucaguugcuuuaagggaaguguaaucagccagagagaugcauuugcaucucaauuagaaaggaguugggaggaagcgcuagggucuguugcaggaagguuguggaagaaaucucacugagcacaaaagccucccggccuuguccuccagcugaguggaagacaauguccgagguuucguuuccauagggaccagaaaccugcugggccccagaagaaucucggguuugcaccguaaucauuuggucaugaugacauaaauuccacuguuguuccuaaauacauuuugcuauuaaaaagcuguuagaauaguggaaaugguugucauaccaaaggcaugcuagaggguguuugcugacccugcuuacuuuccucauaugcugugagcauaucuaggcuuuuggcauuuauugaugucuaaauauucaaagagcaaaaggucauuccauaaaugacagagucucagcauuuacaguuagggggaaugacauugcuucacagagagccaucauuucuaauucuuccacacuuuucagcaguagaacagcaugaacuuuaacacagggaauaauaaucugaccacugcucaugaaaauggucgucaucuagcuuuagauaacuccagcaaaccuacaagagggaagccccacccugaugguugaaagcacaaaguacuauaauuaaguguuuucauggaauauuauuuaaccgguuacuucagugacuggggucuauaccagacagacagaccuuuuguuuccagaguucuuuccuuucccaaaagucugcgcuggagccugcagagagcagaggcugucaaaacccugugugccaagugacccaccauaagcaggaaggucucacccugaacaagacuuguauuucuguuuuauuucgugcuuucuugaguaguucgugggcuccaacuucagagcgacaaagaaaagguuuaaaaauaggaggaaaaaaaggaagaaagaaaucugacuuauucagacugaauuuucuuuauuuaaaagacaagguuugaaguucaucuuuuuacucuggaagacagagggaaccauuuuccuaacgauagucucuuccagugaccacggacugaaacaacacaucucagggaagcaucagaaucuuaauccaacauuaaucaaauuucaguuuacuaauuaucuaucccauuuugaaaaguccggcaucaacagaaaacauuguagacucugggauuauaagcaguauuuugaaagugagacuuucuguuauucaaaucucuaaaaaggauaauacaugccuuauuauaauaagagauugugcaaagccaaaggaggacaaagcagcagguccaacuggugaucccuucugugcgucugcagugggcucccagcaggucuccugccacagccauuugcaacaugcucaaggaaauuuuuuaaucaaaaccgaauacuuuuuuuuuuuugauaaucugaguaaauacaauccaaaugccaucaugugagccuugaaggggccucuuuuuuuuuuaguuuucucuaguacugagaaacucagagcucugaaacaucuuguuuuucagguaugguucugugguucuauauauugaaagcuuuuugcuacagaccauugggaccuaguggagaaggcuggucaguaggaggaucagugcuggccuugcucccucaucuuccuacauccagugagcccacaugcacuaccaucuguguauuguguuugcucaugccuuagacacagccagcuuaaggaaggggcagcugcuuuaguuuugagcagaguagcaugcugccuaaaugccccaauauuuuagcauagaccacucucuaguuaugccuuguaauuccugacaagaccacaucugauagucuguguguccagacagucuuuuacuuauuguuucaccauagccacaaaaacaaaugggaccacauucaguggcuuacaguuuuuuaucuucagcuuauuucuucaguguuucauuucaggcuccuaucuccuguuugguccaaggauauaaaagaguacagaacggguaucccuuugccacguucacgccuuuaaaccuccaguacaaagcuuuggucuuucauccacccaugaucaaugaaggggcugccuccuaaaaaacucagucugcuugucagggaacaagccagcccuuaagaugccaagucccugugguuccccuucauuugccuaugaagugggauguaagucuaucagggcauccaggccuugaggcagauguaugccuggaagugcaaagucucauaccuccacaaaggguagggcaggcaggcuggcuggggggauucugaauuuauaagcagaguuccagaauucccccagggcccacuuuucaaaggcaaauuaguacguuugcaacuugaucccugggcaacuuuugacaguuguucuaagaauaauaaaacagauggacagaauagauuuugggguuuccauccaaacugccauccucuguggacuuuaaagaaggcggagagccgaugggggagcugcuaccacucuccauugugcugagccucucacacccaagacucauaacucucuccccaaagaagauggaaacugucaucacauuauauucuccugcugaguguucagcuuggcuaugagaaaacaaauaggauauguggaguuuuauucuuuuuaacacauuuaaaauuaaauuaauugaagucaggaaaaauaaauguauacucccaagacacugagguuacuauggcuaucagaggaaaaguaaaauuuguuuuaaauugaaguagcauguuuauaaaaucuuguacaucuuuaaagagcuuucaacuauuaugugcuuguuaauuuugaaaauagaauuuaugcccagcaggauaaacauauauggugacauuuacauacauuaaaaaaaaaacacagguguaucaggagagacuuuaaauuaccugaguugugcucuagacuugucagagacaugguuugugcuugacuuuggaugagagaaguauuuccuaccacccucuuuccugcggauuguccaccauuaggacuucacuuaccuacauuggaggugaguuucuguacucuuagccacucccuccuuucuggaauccuaugcccugcagucacugcuugggucagaaaggucauagaaggucaucuaggucuuagagcuccagggccauccuaggggugagagagagagagacagagacagagagacagagagagagacagaggggggugaggggggucagaaaggcagagagagcugaaccggcagguggaguaacuauucaaguagauugucaccagcaauggcacacuagaauaguacauuuucauuuaucugaaaacagacacgaaggaauguaaagccugcgucuacaacucauguucugcaguaucaucacuaauaucauagaacuggauccgaguguuuggucagguuuggggguuacuuuugcauuccuggggaaaucccacauuccacaugcaugcuauccauacucauucuuaccacugagcccucccgcuuuccucuugaggucaagugcucauucucagugacaauucuaguaggaaagagugcaaggcacugccuuucauccucggcaggcaucuccuacaaauaaaugcugggcacauuucaaagugucuuuguuauaguagccacauuuuucaggcauguaugagaacuggccuuagaaauuggguuucaguuuuagacugguaacuaguucuuugguuuugaacaaguaauuuaccucuacccauuuccuuauuuguaaagugaggaaaauaauuccccagacagauuauugcuaauuguuacggaaugaaguguaugcaaaaagcuuauccuuaaaauguaacugagguguaguuucuucccacucauacggcauggccccagcccagucuugucaugugucagccuccuccuaguuucacuacuucuguuauccuugaagaucuuucgagaaagcagaaacuuuuccuucaggcagaaaucaaaacaucuagcucaaaacccuccauaguauagaaaaauccagaaucuuucuaauaguccacaaacauggcagccuugagaacuacauucucugccuagaacucuugucugccccaucccuccaccuagaaucuucuuagcuccuucuguuuccuuagucucuguuuuuuaaacagagacuauuuauuacaaaguguuguaaauacuaagcucuguuccuugagcaguauuaccucauauuuuuucuuaguuccugccauuuaauuguugcaucuuucuccuaugaguacaucaacugcagaggacaaacuuaccugucaccauuugugacuguccucacccuagaggaaggaaaaggcuugauaaagugugcacaucauauaaacaucauauaagggcaugaacaagugagcagacauaugcugggcuucaggggacaucuggcuucuagcucauucucuuuaaucagaaguaguuguacccuacuggcuuccaaaacaccuuuguucccaggucccgccacgcaugccgugggagcuuugggaguuugcuucuaucuuucuccuccagcacgugucuguggcccuggcguuacuauagguugaggagaugaguggccuugcucuuguggggccuucuucaccacuagggcuuauucuaggguguaggaaaggccuuagucagcauccagugguucuucugggucuuucaaacacaaacuacaaaccagaaugagaggauggagggaguuccacuagggaagagugacuccgccuaagugugucucucauuaauauuuucaucaguuuauuuugcaagucucauuaggcuagacauuucacaagguuuuguugacuuuguuuuccaaaaauauauucagacacuaaucauaauugcuuacuuaaguacaucuagccuggaggaguuuuggugagcuugcauugggagaacagcauaucauuguggacauaaaguugcaccucuuguuuuuguucagaggaagaaaaggaaauuagacuguaagcaccccccccccccccaguaagcugggugcugcccuggacccacugacugccuccgaagucugucuggauucauauuaggaaguaugcucaguaauauggauuuugaaaggaugugaaguauuuuauagcauaaaauuguccugcuuuuacuaagauauaaauaguaucuuaaugcaaugggauuaaauagacuuguuauuuuuuaaccuuuuguuuaauaguucugugaaacagaaaguuccuccaagcuugacugauuuugacuuuguuuguugauaguaaaaaaaaaaaaaaacuuuguaaagagacaucuaugggcuggggaauauuagaauauuagccuuagcucauaagccccaacaacucauguucaguguucauuccugccaucuguucuauagagaucccugagaacauuugacuagagguuuccaucuucuuuaaugcuauacaagcuucauucguguguguguguguguguguguauguguguguguguggugugugugugugguguguguguguguguguggugugugugugugugugguguguguguguguguguggugugugugugugugugugugguguguguguguauguguauguguguguguggugugugugugugugugugugugugugugugugugugguguguguguguguguggugugugugugugugugugugugugugugugugugugugugugugugugugguguguguuucugagguuuaaaccuggaaccuuaagcaugcugguuucccaacccuacacugauacguuuuagcauauucaaaguguacuaaacucuauuugaggagguuagaacuagccuacaaaauucuguucaugguuuguuuggauauugcagagauuagagcuuugugaaaacacaaguuaauucccauaucaaaggcugugguuucccauguuccauuucaggucuucucuucgcauguuguauuuguacacagcuacccucaagaaguuaaaauguccuuuccuuuauaaugcaauagcaauuuuucaucuuaaggucaacuaaaggauuauugccagccagagccaccucacuucauuuccugccucuucagcacagcagcccagacaaauccacagacauugcccugugcauacugccaagauuagccagagcccuacagggaagcccuuugccuagauagcuccucuuccuaacccccccaccccacaguguccacagaacucuuucccugccacucugagaucucccccuccuucccauauaaagcuugcucacaccuacgcacaucugugcaucucuaguacugcuugugaccuuccugugugcucuuuacuaaucaucuaauuuacuguaaaauucacuuauuauuuuuaccuguguuguccccacuguaggaaaacagagauucuuaucugacuuuuucuuugacugauaucuuuaaagauaauaguaaauauaguuugcaaauugauaaaaacaagggcaucucaggauacagauaaugcauugugucuuccaggacagucccaacccugggugcagucucagcaccugccacaggauaaauauuuguucaggaaaugcuuguuagaugaguaaaugaagucagcccucugccauagcagaaaaggccaccaacuccacaacauuuccuguucuaaaaaaggaaaugaaaaauugguaauccaucuuucuguuugaugacucuuacaagaacuuuacugugagauaaagugcagaucucaugacagaaaagacuaccauggucugucaggcacaucuugccuugggccaguggauuguaaugaugcuguuuaugagaugaugaaauucagaaccugaguaagagacccagugugugugcagaaagugagcgagggucugcucucagcaucucccagugugugugcagaaagugaacgagggucugcucucagcaucucccagugugugugcagaaagugaacgagggucugcucucagcaucucccaagccuguccuggcacaggcucagggaugacugagcaagaaacagccagugaggccaugcauuaaaaucucagucaaguuuaauuuacuuccuccuuuuagauaaaaaguaagccugaguagaaucaucuuuccucagaagagcccaaggauuuccuagauagucuaaagacucuggcagagguauuucaaggagaacugaaggaggaugacuuacagaguucaguggguaucccaggcucagcuuuggguccugccaggucugucauggcugauaaccuuuguagugggaacagcuaggaacuguccaagggucucuugccuccggccccucccuguagcuagcuugggucuucuaaccucagucuaacuucugccuggcuauugggggcuucaagagacucagacggaagacacaagguuuugcagucucacauuggacaacucagaauuacuggcuacugcugaggugaggggaaauggcauccagaauagcagcacuucguauucuuaguuggauggaaagaaaaaugcaaacaccuuaaggaauucugagggcaaaguauucuaguaccauuuguuuaauuguacacaagauauguuuacugccuagaagaaaaucacuuaccaaaaggagagaacugauuuuaaauaauaaccuaaauccaaaggauacucauaaaagcaauacaguucaguuugcuucuaccgccauagaaacacacauauaaauaaaugggccuucugaauuccguauagauuucuugcuuucucaccuuaaaguuuuauuacauuuuuauuaaugaauugaugugaagggguagcauauggguuaugccacauaugugaaggucauaggacgacuuacuugcagaagucaguucucucccagcaugugaguucuagggaucagauucaggucuccggcuuggcagcaggcaccuuuacucacugcaccaucucucugaccccaccuucccaguuuaaucuguucccauccuauaauccauuuugcauagcuuucaggaaucaugaguuuugauguacuucagaauuucauugucuuuuuaggugaauuuauguuuuuacacuggaagaaguuuaaaaaaaaaaaaaagcuacuggaagccauauaguuuacauugcugcaguuuccuuaaggagaaugaaugguuuggaagguagucuuuaaauuuuggccuuuaaguuagaugagugaucuucuucuauaggaaaaagguuucugucuugaguaaugagagccagacuuguagcuuugggugacucuuggucauuggaaggauguuugaaaugcaucuacauugcuuccuuugcauuuagguugaccucuggcaacagucuuucagcacugcuguggauggcuauagaaugcccaaagcauauagaaaaaacaaaagcauuuuuuaaaagcuggauguuucaaauggcaacuuggcuucucugagaggucugugacccacugacaggagagggggcagcaauguuuggcccacacagcaucuuugucauguccccaugcguauuacaguaacccucguaggugcugcaaaggagugcugauuuucauuuggaagugcagcccuccaccagagcagaucaauacuugagcuguuugucucugcugcuuacuuuccuuucgcacagcgagagucuucugcagggagcgaucgauggcucuaaucuucagcagccugcagccagucaugugaggcagagcacuuagguggcauuacacggacuguggaaguggcagcuccauggcagagauucauagcacccucacuagggacacauuccaucugugacgggugguucugcucaacccugccguggaacaccguuccucuggaacuuaauacgaggaagaaggacucugucuggauucugugcauguuuguucaagcauacaugugugaaccagacagacaaaugugccaacauucucucuaugacucuacuaacugucacuguguccugggcaguggaaucuacucuugagccuugggcuagaaauaauuccauucugacuaauuuuuaaacacuaaagguguuuguuugugugugugugugugugugugugugugugugugugugugugugugugugugugugugcgugcgcgcgcgcgcgugcgcuuuugauuugguuucuguuguuuuuuguuuuuaguggauuuuuauuuuguuauuuaauaggacauugguaguacaugauuguaaaucuagcacuugggaaguggaggcaggaagaucaguaguuaauauuacaugaauuucugucucaaaaaaaaauaaaaccagguuguuuuguuuuguuuaaucuuugaaaguucagugccugaagagcucauuuaauuaaugugcuuuccacaaagcaugugaaggcaguaagcauuaguugucacaucugucuuuggauggcuuguggccacuguaagagucugggggaugaagaucuggcucucccuagacuacugggaugccucaggaaccucuaccugggaaugagcuguggaauagcccagguauccucugacaguguacuuuaguuccuuucuagccuuucuguuuucuucuaguggucccagcauuguccgugggauucaggcuacaauaaaaaguaagggcuagagguaaagaggguaaauaugacaggcagcaguggcaagcagugccccaggcuaacaccugcuacauguaagagccuugcagaaaagacucuggcuuccccugcuucuuuuuguuguuuuucuagaauugcuauuuguccaggcuggccucagaacuaguaauuuagcuuccuaugcagcugaggcuacagggguacgcaaccuuacuaggauucauuugcucuucccaacccaaggguagcucuucuagcaugucaucuugauuucacucuugaucaucccacuguuauggccauuuucacucgccuacacuugccagacaucugcauccuuuugguuuuucaaagugcagauaugucaccuucugagaugccucuguuugaacuuuccuggccuaaaaucuucacagagacaaguuucacccucggaagccagacccuucccucuuacguucagcuacauuucuuuagaugcuuaggauacuguguuggccaaaggauggucagcagacccuggcuucccagucucacucccaggugcuacuucucaacagaagucagaagcagggcugugguuuuuauuuuuauuaggguuuuuuuuuucuucacauucaauaagauauccauuggucuuggucuuugcugucuaccagacccugagggcaagcauauggaaggcauggcucugguccucaagggguauugcuggaaaacagccuguuagaucaaagaacaguacaguuuguuaauggcuacaauagcagguucaacucagaacagugucccaagucucuggccuggcugggaagaaugaacaggagucacaaguccuaagugaggcaaggacuguucagggagcacuuuucagccaagagccucccauauacccaaaccaucacagaucuuagcagucagggaacccuagaugcuucuaggaggcccacccaacccaugggcacuagcaacccugccuggaauugccagagcccccacaacucccuacacccucaucucccucccugcacuuaaaccuuucccuuaagagauaucugcuggcuuauguuaugggugagacacaaaggaggccaggaggucaagccucuuggugcuccgugcauugguccccaggaauagacaucaauuuacuuagguucaccaacuucugcucuguccaggcacuaagaauuucacauauguauucagucccuggguccuuccagcaacugaugaaggaaaggaacacauauccuaggaacacauuauauaaauguaggacugugucaucuagaaauauacauaagcagagcacagagagguuagauaaccugcuguaggucacacaggucugugaguguggaagcugggaccugaagccagcagcagcugcucugcugguacugcuaacuuacugcucaccauugccccuuaaaaugucccugcuacccagacagacccaugggcuucuccacacaguucagugccacuuuuuaaaacauguugaaacuguuggggagauuuauaacuuguaaguuacagcagcuuuugauaacuacuaacaccgguauguguuuuaaugagacugaaggcaugaacgagcagagucuccucucgaggcuuugugagaacacauagacauugggcuggcuccucugaaggccugcauugucgccaggcucauuagcaucgucgcuccuagcuagcccuugcugcuugcuagcuuaccagcuguuccugcugcucuguacaaugucggauguguucagcucacuggguuccuguccucgccaccgggaggagacagcccuuccacuggggauacccacguggcugccugucagcgguggcaccgaauaaaguaauaggccuucgcauggcauauggugucuggauucguacaagaugcaaaacuccucugcuucuaaugcagggugacucauagcauugcuaauuuuucaaacaaaagcugacuuccacacccacacuuuuaaccccucaggcuaaaaagucuuggggggcuccagaaagauguuuuuugagauguuguaggaaauguggucugcuuacuaaaagcucacuuagcauuuggucaggauguuuaaaauuucuauuaaaaaauguuuccucuccaaugugggggaggggguugcaagcuuuaauuuugaauuccuuccucauauuggaagaauguaacagacugucaggcuuccccccacacacacaaaauuaagcugggauagaacucaguggcggagaacacacuggugugugcaaggcucccaguccccaguagcacccaaaggggagacagaacgagaagaguaucagaagcguggcguggacgugccagagcgcugcccacaugcuuacucuucuucacuccaugggcuccacugucugccugccagcacagugaccuauuugucagucacuccaggcugcucauaccauaguuuuauaaaauuguaagagaauguucagaauucuguguuuuggggccauuuaugcaaauguauacauaaauuuaauauaagguuuuuguguacuaaaaagagauuauucacauuuauaguuagccuuccuuuuuagugaucaaaauauuggcuguuuuuuaugugaucccuuauugaacauuuuauuuaagcauuuuagagaugagaaucuccaacacuguuucugacuauguguuucuuagucacagucuggcacaggggucguuugauguuugaaucuggcaaauggacugacuccuuaaaggaacuucagccuaugaaauaauauagaauuauuaaaaaauauauaauuuacaaauuauuaagaaaaguuuaucuugugggaaagaaaauagagacugguauuaucaauaauuauauuuaauuuguguuccauuuuugaaagugguuuuacuuuuaucuguagauccaaguugaaaagugugcucagcuucaugggaauugucauaggguuucagaaaaaugaaacaaaaacacugcuuguuccugagugugccucccaucuuagauccuggcacuuguuuuccaaaggcauccuaauauccuugcccuuugucauuggaaaugaacugguguauuugaugagacaaaaauuucacuaagcacuuaagauccccauuuuuuacuguguguaaggauaucuaguuuugcuggaaacgccugagucgagagcuguagcuguuaacugccgugggcacuuggauucauccuguuuccagucacucuuacaaagugagacaaaauucgacagaagaaucacacaaaaguggaaacagcagcugguacuuggugcugacauaugauggauaaaaugcuaucuaaccagccuauggacccagagucaggcuuagcuccaaaagucacuuggcauggaugaauaaugugcaaaaauguagccucuucaaagacauacagaagaugagggccacugaaccauaauucacacucuuagacagccccacagaaugugauagccuuacuuugcaaauggagaaacugaagguguagcaagcagaacuuggccugggcccucauuaggaguagccuuaggcugaacacccaggcagcuuggcucuuaggaccugaugcucuuccucaccuguccccaggcgaaacagaaggucauuaaagguauaaagguuuacagacuccucuuaauucuagcauauuagcucaggacuguuacccagacuuucaacccuugggucacaaucccuuugggguuuaaauaucucuuucacagggguucuauaucagauauuuacauuaugauucaugacaguuaugaaguagaaacaaaauaauuuuauguuuggagucaccacagcaugaggagcuguggugaaagagucuuaucauagcauuaggaagguugagaaccacuacucuaaacucuaauuguguggaauaaagauaggacagcggaaugaaggaaaaguagaauggggagcauucuuguuuugaaauuauguacacaacccaaccuuuauuuauguaacuuccaaauuaaaauucaguagaaacauuaaaugcauauauucucccagaggcuagcccaaaauaagcauauuuguuccaaugugacuugcugugcgugucuuggugaagaguccaaacaugcuuccauuguagugauguuccugaguuuuugcagacauuuauuugucuguauugaauugacuuguauccugccucuuucuaaaacagauguaaaggccuugaagcauaagccagauguaaugugagagugagagccagagcugaagacacucacgaaagagcuucuuacaucauaacagggcacuggggccacuguagcaacaaguagugacagaacagugacucacaauuaacuauuguggacucccugagcuguacuguagggugugucacuaccauuugucccauuguuacuccaaaguuuucagaugcucccuggaauuguacugagucuuagcuugaaaaccuugaaggucauucuaaagauuguauguaguauguuccagaaagcagccaauuucuuggggaaauuuuuaguaucccaguaacuuuccguuccucuuccaugagucuguaagauacauucagaguuacuacacaagcucaugugcagcauagucuacgacaaaaaaagggagggacauagcaaaauaaguaaagauuagugauaaagaaaaaguaugacuaaagcuaaccuugaugcccucaucuucuggagagcuucccuugcgaguauauuuugcauguucuucucugaagauaaagggaagcuugagggugucuucaguuacauaccacauccauucauuuccacagcuaggcauucuuauguucuuguccaaugucaucuguagacuccucugcuuuucuaggccagcuugguaugggauugaaugaccucaaagguaugcauaugagaugcuuccaccauugguuuccuuguuaccguguugcaggacuuguugccugcaguccagcucuucccugguuuguuuacuugggaucacuauguaaucauucauuuuauggagucucauuaaggacugcaaaccucugucccaauuuagcuucguuggagcguagguagcauccaucugcuccgcccgcacuguuuaauuaaugaaccugguaaugugcucugugccugaaaaaaaagcuguccucacaggguauugaaugagacgccacauuccagguuuucauggggaaacucuuggaagcccucuguggugggugcuaauugaggacucagaacuuguguucagucuucucuugaagacugacuuaguuuucaugucacuguauauucauaaacccagggucauaucacuguaaauaagugaauuauugaccaggcucauaaucuuuguccuugcuaaaaguagagauucccuuuuugugaagcugcauuuuguuucaauuaagaaaaugucgacuuauuauuuugggauuucuuuuuuucugaaauuaaaguuacagaaacaguggaauuucagaaauguuacugguuuucaguaucucugcugugauccuguguagaaacuguguagcuaagauccuauucaaaguaaucagugcccacugaauuuccaguauagaaaauuguaagacucgugcaaaauacucuuuaaauuucaguauuugcuuagucuuuaguguauuguaaaacccauccuguguccagagguucauugauagaaacuuugauauauguacaaaugggacccaacuaaccuuguucauuucauuagacauauguuauacaccaaggcuggguacuuauuuuuuuuuauuuuuuuuuuccuccucaaaaaaccaaugcauaggauucacaagccuuuccuuaaaaacuaucuaucagauuaaguuccaauguccccuaucaagugcuuuuauauccuggaauuucuuucucccaugaaacauguuagagucacgaugauguuguauucagaucucuuaaucacauuagcaugugucccuauaaugaaagaaaaaguuccugaauacucauuuuucuauuguuugguuuuugguuugggguuugguuuuucaacacaguguuucucuguggaucuguggcuguccuggaaaucacucuguugaucaggcuggccacaaauucagauccaccuaccucugccucccaaaugcuaggauuaaaggugugcaccaccacacccagcucugaauacucauuuuucaaagagacuuuuacuuagccccaucagcaugaaguggaacagcugucaucauuaacucauuuaguagcagagcuaaagucacaguuaccaauguuacuguaaacauaaaagcagaggcuuggcugguaaacauaaaagcagaguuuggcugguaguaugcuugccuacaaugcaagaaacccuggguucaaucccuaucgaugcaucaacccuaccuacaggcaugauggcacaccucuaucauugcagcaggugagggggaaguaggaggaccauaaguucaagguuauuuucacuuucaugguaaacucaagccuaaccuaagauaaaagagacccugucucaaaacaaaaacaaauggagggaggaaagcagauaagaauuguaagacuaacuaaagacuggggcaggaggcagacacugucuucuugcauccuucucuggaguuuguagaacagacuacagccgaggcagaaacauacucuuaggucauugauauggagcaggaauccccaggcucuauuaauguaguccccugucuaaguaaaagacugucccacauauccccucaaaggugcucacagagaucauuucaugaugacagagaauuggaggacaguuacaggauggaccuugguauuuccuuucauacugaaauacauaaaauugcuagaugaaggucauuuuucugauucucuguggcuguuuccaauuauacaaaugggcaauaacuaugaacacccacuuccuguccuccccagagggcaguuugccugggaaacuguaaguagaggauccuacaaaguucaggguaccuuugugggucacugccuguugaacaggguuuuucuuuaaagcuguuagcccuuacccuguguuucuguuuauucuggguguugugcccccgugaauaucauuuuuguccauaauacaauguauuggaaauccugcuucugagaggaggacuuugaaauaauuacccagugaaauucaucuuuaccugggacguuagugaauucuuaagucugccuuuggcccagacagcugccaacucuggugcugggcaguggguagccugccuuauuuaccaguucacaagaagaaagagagagagagagaagaaagaagaaaaaaagaaaagaaaagacauaaaccauauugguuuuauuguaauaaaaauuauaacuggagaaaauuauccauauuuuaaauguaacuuuuauuaaaauauuaaaauuuaaaauguaaauuugaaugaagcucuuugcuccugagaagguauugcauguccccacuccaucauggauccuggcccauguggaaguggcacuggcuaguucagcccaauaauucacuuuauuaucaaaauagaaucuacagggauuauucacauuagucugagcaucaucccugcagcagcucagguuagaugguucucccugggguggagccaagaaaugccaagccaucucuuuggggggggggugucagaccacaggcuuuccacagugcuccuggaacacagggcacagucuucucucauggcauuagguucuacugcuucuucccaaccucuuguguuuuuauuucaaccgugugcgugugcaucugugugugugugugugugugugugugugugugugugugugugugugugugugagagagagagagagagagagagagagagagagagagagagagagagagagagagagauacagugauguuucaguauauaucuacaauguauacugauacugaucggucaggguaguuaguauucaucccccuuucacuucuguauguuucccuuccuuuccuccuucuccaccuucccucugcuuuccccuguuccuuuuccucugccucuccaccuuuuccuuacccuuuuccuccuucucuuaguccccuuaucugccuuaguuucagaaccuucuuugaaaauuuaccucuuauaaaaagaaagaaaauuaccucucuuuacuauaagaugugcuuuucaaaaaaaauuaugauugucacaauauucaacugaauuauaauuugucuagaauuauuuuuuugaguuuucuaaauguuuuuacuuauuuuuaaguuaaaccuucauaauagggaaauggagggagagaaaaaucuucauuuuuugcuacaccacugucacuuuuuaacaguuccuuccuauagcuagaaacauuaacaucugcuuaacaguucauggugcuauuugcuuuuuaugcagaacgugaaggcagggaguauaaaauguuacugaccuguuaaagggaggggggaggugccucagcaggagagugauuuuuggcauuaaagaaauggacuguagccagguaaugauggcacaugauuuuaauugaagcacucaagaggcugagacaagcagaucucugcguucaaggccagccugaucuacagagcaagauucaggacagccagggcuauacacagaagcccugucucaaaaaacgagagagagagagagagagagagagagagagagagagagagagagagagagagagaggacucuacucccaaauucagaucuauagagguucuuugagagaaauuguuuaaauuuugccagguuuucuuuuaaagaucauuuauugucaaccuaacacaaaauagagucaucuggaaagagagaaccucaguuaaggaauugccuccaucagacuggccgguggcuaauugacggaggaggguucagcugccugugagcagugucauccccugggcaggugggccugggcuguacgagaaagcuggcugaguaugaaagauagaguauacuaauaggcaggauuccucaaugaucucugcuucaguucuugccuuuaguuucugcuugauguagaaugaccaggaaguguaagcugaaauaaacccuuuccucugcaguugcuuuuggucaugguguuuaucacagcaccaggaaacaaacuaagacaguauucuuuguaugcugcuucauagaucugcuuaucauuaaaaaaaacuuacauaaaauccuguuuaaggguuaagccuaucuuacuuucuacugcugaguggaguggggcccugccuuguggccaucaggucagauuuuuauuaccaucacugacaagucuccacaacaaucuagcuaguugccuguuuauuuugaaacaagaguuugaagcagcauccuuuccauguaugauuggcuaauaaagccuauaugccaagcaaaccggggcagucucccaaacuuaagauuccaggagcugagcagacauuguccugugaccuucaugcucagcaccaacaacuagccaauacauuggucagaucauccacuuaucugcuguccuaauuguagccuuuaaguguuacaggcuccugugucuucagguacauacuuauuacauaccuggguuagucagcacucaagauggagcuucucaccugagggaaccaggugaugggcauaguguagcuaggucauguaccugcagauugcaugcuauauauaauucuaagcacugacauuuuuauaguaaaauaagucccagucuugaaguugcguuugccuuuaccgaacucuaacauguccugcugcuuaucucuggagagugccuucccaaucugagcccugugcagauaguggcauuguuuuaccaagcccaacugcacaauggcuccuuggggaagucacuacauugaccaacccugacccuaagcaggaauuggaggugccuaggucucaaaagaagaauuuuuuaugggagaugggggcaagaaaccauggucccuuucagaacugggaaugguuauguuagacagcccucccucccuaggccucaguuuguguugugcccuguacuaagugcuucauauaaguaucacaugucaccaucuagacuugaggaaaccacguccuacagagggaucugacuuccugaggugugcgcaggugcacgccuuuaaucccagcacuugggaggcagaggcaggcggauuucugaguucgaggccagccuggucuacagagugaguuccaggacauccagggcuacacagagaaacccugucucgaaaaaccaaaagaaauaaaauaaaauaaaauaaaauaaaauaaaauaaaauaaaauagacuuggaacuugagcugcacaaccaucaagacgcauuuguaagaaaagucacaagguuaaaaaucagacuagcagccuggcuagaaggaagaagcugaguccccuggaugggguugaacuagcugaaacaaggggaaaccaccaccaccagcagcagugcaauaggauaccuaaggcuuaaagggagcugggaugcaagaagaaaggagagcucaggagcccucgcagacaccauuccacagcccucccucccaaaccagugugcggaguuaccccaggccugagggcaauuuuccuguccuacccacaaggcauuugcucugcauccuuauuuaaggagugaguguggucucuccaaaucacagcccugggccucugugauuuuauaagccuucucuauuuagaccuuguuaauugaucaaaggguuaauaguauuaaaaagaauguagcuuuaagaaaaauguggauauuaaugccuuucuuuaaucuuuaauaaugacugguuuuagucagaaugcuuuaaaugcagcuauuguaaaaucccugcccuuguaucagugguuaaguaccuugguccauugauacagcuuucaaaaguucaaaggcuaugcuagcauaucuuugucuccuccucuuuuaacugcaaagaaaaagguguccuuguaucaagccuuaacauuuaucugaaaaauaaaauuggguucaguuugugcauagguuuucagagagauuaaagugggcaucauacaauuuuucccugugaaaggcugccuuugaugugccuucugucuauucauacagaagugucagccauuguuuuugagccauagaagaguguccgcuuugucaccggcacauucgacagucuuugugugggagccuuguucaagguggaucuuaucauucagagacaauguuacuggaaacgugcauugugagcagacaccagccugccugggaagauaaauggcaagaaaaagcccaagcgcuuaucggagaugaucaggaagcaagcuaggagcaugccuuucugaguauccaauuggagguugugcucuugguacuucacccaccaggaacagucauuucaggguguuggcucugcuguggcacuggguucuaguuugcuuuugaugucuuaaaucagaaaaacuuagugaggugauuauguucaagaccacauaaacucacaucuuggacgagauuagggugagagagagcaguuuaaagaaguuccugaaaucugagagcaugcucaggaauggucugcaggcuagcuuaaaaaucugagcucucagaccaugcaaggugcuaaauggcugcaaaaagagaagacaaagaaaaagugugacuugcccaaggccuccaagacaccaacuaggaguggugcauccugcagguucacacuccuagcccugcucccgccucccagcugcugugcugugccacugcuaagccugaaaaccccucuuccagacuccuuugcauuugcauaucaacugagguuugccuuucuugcuugauuuauucaaucuuuuucaucaccaaaaaaaaaaaaaaaaaaagcaagaucuuuucucccuuaagugaaaggaagauccaauagaauuuucccauugucuucucugcuuugugauaauuaauauguccuucguucgggugauggagcuguaggggagaagaaaacucucaggguuuuguuuuuuuuuuuuuccuccugcauccuguucuaaacuuaucuccuggucuugggguuuaucaguguugugugcuugcccaacauaugugaguuccugaauauagcacugugcaaagaaaugaauuaacuuuaaaaauuacuucccagccaacuaagacucaguuccuagaacagugguauuuguucuacccuguucuugucucucugcagauccucucacagcuuucccagaucggucuaucugggcaaccauggcucugaggcucaggcccaccccacaugccaagaggagggaguauuccuccuauacccacucucugauguguggggagagcagacaggaggaaaaccuugcaguucaugacuuuccugucccuguagucucugcugccaaugaucacagauaacagcucuccagaaggaugguggcagggagacacauucuagcuguccaucaaauucaguuaccaccaggucuccacagggccacuguguaccuaagcacugguaauagcccuggcucggagauuaacgaccggccagcacacugucuuccuuuuuguguguguggaaaaggcuucucaaaugaaacagcccacaaaagcgucuaugcaaauuuagaaguccuccugcaauagaaaauugggaggugaauucugagucaaaguacaauuuccuuuccccagcacuccauuacagcgugccuucauuuguuuuccauuugugagugagugucagccuguauuaaaacgaaggcaaagccacacagacccauuccaaagaagcauuuggccaccaaaugaaaaauagagccaggauccguguauaaauuauucagaaauucgguaaauaaacaugcaaacuucuagccggggcuaucgcuacugcauuauucagcccaauaaggagaauuuaauuuaauggauauucagcaacauuguucggcuaucaacaaaaggcauacugucuuuuaugaauaacugauuuucucggggcauucugaggagaguggguccucguuaacccuagaauggcuagcuaauguaauugaagcgcgaccaccuggcagcgagguugcccgucagcugccaaggaaggccggggccgggaggaccaggugcucagcucucgcugucugauuguuacagugggauaaacagcgugauugcacaguauggccgggggcgaggauccaagacugcugccaaccagagagcgcgcuuucuucccuggucuuugacaaggggggaggcaaaagugcuccuauucagagcagguagggcugacaaagccgaaaugcugucugcugcaauuaggacagaaaaaugagacuggcucaagcaugaagcagaggcgagccuugaguaccuguuucuguuaugccacaaagccgggcccuuuuuaguacaggcugggaaguuuaagcauaaaaauuuaaaagaaaugcaagcaaaggaaccuaacugcugagugaccuguguuuuuuguggcacaucggcuuuauuauuucaaggcacaaugcuaagucggcacagugugauaaacuuuauuuaggccugacuuccauggcaacccaaauucccugguucuuugauuauacuuaauaaaacccugggccaggucaucucucuuucugucuugcuuuauaaagaccuacgaguaucuauauuuaacaaauaaaaagauucuccugcucuguggcauuguuuauuuuuaguaauuuuuuaaagcaccacuacccauguggauacauaaaagaaaauuaguauuauucaguguuuuuuaaaaaaaaaauaagaaauaggcauuaugaccuuuccagggguuuagaaugugaaaugguucguuaagcuccuguuaguugaagaguaaagagcacuucccccaaacagcaaggggaaaaaggcucucucauaacacauugauuuauuucauuugcuaagcacaggaaccaugaaaugcuucauccccagcaacacauuaaauaugugcagaaguaaaauugcagcugaagagugcccuggacuuuguccucaugguguguacauuucaauaggcugagagggggaaaaacaaacgguagaaagaucccuuuaugaaauuaaauuaccuguuuuguguggcuuuggagcccuguguguagcuguugguucagaugacucacuacuacucccugucgcuuuuccauugguucaucccaccagccuccccagcccaggccggggucagaaucugucccugagaauagaaaggaggaaagcgguuccagcuggcucuccagccucucacgagguaccuaacuggaaagagauacaggguugcuuuuuuuauuagaaccuaaggggacucugggcuguuucucaaccuaucaucagaggccacuuggugauaacuugagacagugacuugagacaagagggccaguucccuggccucaguuuccaugucugaaaaaggggcuugcaaaggcaaugauacaugcuucaccaaugugaguucccuccuacucaccucuaauggcuguguagcagggacagaucugaaaaagaaaaggaacacaguuucugcaaguuuuuucuugaaggauuucuguccccaguccccuuugacauugaguacucuguaaugacaaaguuaaaaaaaaaauuauuuauuuauuuauuuauuuugcuuuuccgagacagggcuucucuguguagcccuggcuguccuggaacucacuccguagaccaggcuggccucaaacucagaaaucugcuggcaucugccucccaagugcugggauuaaaggugugugccuccacugcccagcguuguugaaauuuuaauagacuuuuauuuuccuaucuugaaauuacuuuuucucucucucuuuuauuagagcuucacaucucacaggcaagucugccuugaccuucauggaacuguacacugguccaaaaucccccuccucacaguggauauggggcugugcccagccucucuaggacugcccccucagcugucagauauggcuggagucgaugauguggcauagggaaaagaggcagaauuccacaauuaggcuguguguugcaccaugaccaguggccacaccccugugaaucugcagucuuagggccacuggugguccugucauucuuuuuuuuuuuuuaaccugauuuuuuuuauuuuuuuuauuagauacuuucguuauuuacauuucaaauguuauccccuuuccuaguuuccccucugaaaauccccuaucuccuccccccucccccuacucuccaacccacccacacccauuccuggcccuggcauuccccuauauuggggcauagaaccuucacaggaccuagggccucuccucccauugaugaccgacuaggccauccucuguuacauaugaagcuagagccacaagucccaccauguguuuucuuugauuggugguuuagucccaaggagcucuagggguacugguuaguucauauuguuguuccuccuauggggugcaaaccccuucagcuccuuagguacuuuuucuagcuccuucauuggggacccugugcucaguccaaugguaggcugugagcauccaccucuguauuugucaggcacuggcagagccucucaggagacagcuauaucaagcuccuaucugcaagcucuuguuggcaucugccuuagugucuggguuaggugguuguuuaugggauggauccccaagaggggcagucucuggaugguuguuccuucagucucugcucugaacuuugucucuguaacuccuuccauggguauuuuguucccucuucuaaaagagauucugagcuucugggcuaauauccacuuaucagugagugaauaucauguguguucuuuugugauuggguuaccucacuuaggaugauauccuccagauccauccauuugucuaagaauuucauaaauucauuauuuuugauagcugcauaguacuccauuguguaaauguaccauauauucuguguccauuccucuguugagggacaucuggguucuuuccagcuucuggcuauuauaaauaaggcugcuauaaacauaguggaacauguguccuuauuacaaguuggagcaucuucuggguauaugcccaggagugguauugcuggaucuuccaguagaacuauguccaauuuccugaggaacugccaaacugauuuccagagugguuguaccagacuacaaucccaccaacaauggaguguuccucuuucuccacauccuugccagcaucugcugucaccugaguuuuuuaucuuaaccauucugacuggugugagauggaaucucaggguuguuuugauuugcauuucccugaugauuaaagauguugaacauuuuuuuagguucuucucagccauccaguauuccucaguugaaaauucuuuguuuagccccguuuuuuauuuuuauuuauuuuuuauuuuuuuuaaagauuuauuuauuuauuauauuuaaguacacuguagcuguccucagacacuccagaagagggaggcagauuucauuacagaugguugugagccaccaugugguugcugggauuugaacuccugaccuucagaagagcagucgggugcucuuacccacugagccaucucaccagcccuagccccguuuuuuaauaggguuauuugguuuucuggaguccaacuucuugaguucuuuguauauauuggauauuagcccccuauuggauuuaggauugguaaagaucuuuucccaaucugucaguugccguuuugucuuauugacaguguccuuugccuuacagaagcuuuauaauuuugugaggucccauucuuaaccauccuagagaacaccuaaacaaaauggaguacucagccuccuuugugcugacggccuucugcccuucucaaaauguuuguagacguggaaaauaaagcauauaguguuacaaaggaagucgguuucaguggauugcuuuuuauuuuaagaauacauuuuuaauuaagauagaacuauaucacuuuccuccuucccucuccucccuccagcccucucagguacccuuccccagcuccucccaugccccccacucucaaauugauagccuuuuucuuugauuauuuuauauauauguauguauguauguauguauaugaauguguguauacacacacacacuugcauaacuguagacaaguaguaacugcugggaaagggacaguuagucugaguuaggauggccuccuguauugguuguccaauacagaguguucucccuggaaccauaucuacacaaacaacaaaauggacucagcagcuucuauuuauguuuguggaauuuuuuuauaacaaacuugcuuacucauggcuagcuauauauaacaacaaugaaguugugcacugcuucuauaauugugaggcuuuaguaagaauuaguguacugugaaagggucugugauuuccauaaauauugccauugugguuugaugucuauauuuauaauggaaggaaauauaucauuucagaggguauacagaaaguaaagcuguacaguuuaucacccaaguuaauagaccccucagagucugaugaugacgccaucugagaccucugggcugcaggaacucagccugugaccugccuaugagggauucccacaaaccuccgagucagagcagaggacuaggaaagcagcgagugaguaaggggaaccaucagucaaagccuucugcaaggugcagaggcccacaugccaggaaggagggacggacacacacacaccacugggauuuguccuuuccauuugucccagauugcaugggcacucacugcauugucaagauguuuuaucacuuaccuguuagauggugaacagagaaagccucagaucuaagguccuguggccauugccuucauucccaaacaacaccuagacauuuuuuuuaauuagauauuuucuucauuuacauuuccaaugcuaucccaaaagcccccccauacccucccucccacuacccucccuccccccacucccacuucuuggcccuggcguuccccuguacugaggcauauaaaguuugcaagaccgaugggccucuuuuuccaaugaugaccgacuaggccaucuuuugauacauaugcagcuagagacaagagcucgggggugggggggggguacugguuaguucauauuguuggguggaacaccuaaugggugauuucacuucccauucuccaugugcacauugcugacuagacuugguagagcgcaaauuaauugaaauaaauaaacaagagcuugguuucaauacacugcauauauugacuugagaacaauuacaguuauguucgccuaaaaauauuucagcuuuauaagucagcuuacuggugcuauuuguauagaaaagcacuuguuaaaaaucaacuuuuguguacaaaugucccgugcucaacugcagaaagauuagcauugucacagagcccgagguuguggugauugcuaacuuuugaccuuuucaccaguuacuuaauccauggugaucaccuggcuuguggcaccagacagcuaauuauaaucaccaaaggagagcccugguagucacuuaucaacaaguacaaugagacaaucacauucagagacccaucucugcagaaaaugacccagguauuauguucuguagugguuccgucaucacagaaaguagcuuguucugcuggauccugacagggagaggcuuugaucccuccugcucaaagguguuucuuuucacagccccuagggguucucuugccaccuuuaaaaaauaauagcaauaaagauguauauuuuccuaccuuauacagacccuagauucaauacucaccagcacaugugggggugggugcuuucaaugaccuuguauuaauaaucagaaaucaaaagaugggaaaucuauuuaucauuccuauuaagucugugcaagaaaaguuagcagaaauagcucauuaacuauacagccuucacuugaauuucaaagaggggaagcccccaaaacacaagccaugcucuggaaaguucuauuguauccacagauucauguguucucucuaucccccucuccugcuccugaucuugcucugcucuuccugacacaguaacaugccuuuacuucaagaaucccagacacaaacuaaugcuuguuuuauuuacucauuuucuuuugaaucuugucuuaucgccaagcuggccucagauuuuugauuccuccuauuuuuaauuuuccuuuuaacugacaaucauaaccccaugcgauuaugagguuaaugugaaguuaaucgagguaguuaacauagccauuaccauucaugcuugcugguugcuuaugagaacuuuuuuuuuuuaaucugcucuuugggaaauuuugaaaccaugcuuaaaauuuuuuucacccuucuagcucaaaaauaacuauauaguaaacuauauguaaaauuauuuaaauuauggagugaggcacaccauuagguuuucauggccucuuuucuauuuguugaaauuaacccaccuggcuaagagccugucugccuccucgaggcgacuacuaaagcuguuucuagggcuuucugugcacacccuuauaugauauuuuguccccuugcucuccgacauggugccuagcugccagaccuaucuuccuguuuugccuguguuggcagucuaaccuacaagcuuccugaauaugugcuggucccgaguccugggcuucccaaggcagccuguguuucuccuuucuuugagcauggcuucuuggaauaucuuccauuccaguucuucccucuagccuccuccaucacucuugcccugccuguguggaguccauucagucucagaacccuguucuacauguccccucccacaccaagugcuguagccagcuccuuuuucuccuguuugucagcacagcgaagugagcuguaucagcuacaggcugagaggagguagagcccaugaauggcaugucuuuauguucuccaugagcucacaucuaaucacccuugaguaggagucauccccauggucuucuucaccaccaggguccacauagcuguguuccacugaguauucccagugaccugcauauggaauguuuaaggaaaacaaugagaaccaucuguguuaucugcauggcuguggggaagucuggagaaauacaaaggggauucccaaaguaccauuucuaaguuucaucagaggugggugcgggcaguaagaaacauuagucuaaaaugugagucaccaacaguuuagaaucugccagagaggggacucaggcuucuauagcuaaaacugagucuugucccucacucuuauguucugcuuuuaggugacaaaacauuugcccugccaucuuucucacccauuaagaggaaguucuggugccugaagcaagaaauugaugugacucuucccacuaaggaaagaucuuccuccucuuguuagggaugcugauucugacccaaggccuagccaacaagccagacaaccagggauugaugggcacuugggcccaagccuggccucuuggccucugcuguguugugcuggggcuccaaacacaucuuuuuuucucuugccaguugucuuccuguucggcuuugccaauuaaccuggagugccacaaaguucaaggaccauugcaacuucucagcccucuucuagguccugauuucuauuguagccaacugguucaguagggugggcgugggugagguggcuguacccuguugacaugauaccacacuuagaagcagguguaugcgugggucuggaaucuggcuuugaugcucuuugcaaugacacguggauucucaaccugaauguuuaguucauuugcccagacgcauuucacaaaugauuguaccuuccucgauauauuuuaaugacaucaagugacaccugauuaaaaguaaucauuugccagaagccccguuacuccagaagacagcagcuguaccaugccaauccauucuuaauagcgcccagcauucaguguggcucagaggccuaguggaucucacaagggaaagcugugcuguucuccagugguguagguguugggacuuaauaacccauaucugaugguucuaacucauuuucacugaagaugucuaccaaaauaaucaauuaauaaaacuguagaauuccccccuaguuuucuucaaaaugugaccagaaauaagcaagcuaacuuuaucuuuaaugaguauauuaaauccccaaaaccuuguugcaugaaggaaagcauugaauuaauauaguuuauuacuguaaaugcuggcuucuccuaacaaauaugcaaauaauaaugcagcuaggaggucaccauuuaugccagauuagcuauaaaaauugccaauuuacuuugugcuacuuugguucuagagaggguggagauagagcugccuauucucauccccuugucagcaucaaacaucacgguuggagaauuaacuuugcacauugcaaauuuccaaacuaaaaaaaauaaaggaaaauaaaagaaugaaagauaaaacugaaacagcacaauagaaaggaagcggccagccuuugagaguucuuuggagcaagcuacuugccccauggcuauaaggccauccaagcauccaugccucugucuacugaauuggcuuaugcccaagacuuugggcucucaucauuauucauggggugugcucaggacuguuugggcucuaaucuugauuuuucuguaguuugagguuuucagaacuguucaauagguucaugacuacaaagguaguagaacacugugccaacacuacauuuuuauuuuauaaauauuguaccuuuuauuucuucuuugugagauaucaccuuguacagaacucagcauaauuauaagguaaucauacuauaauaugcuuuagaaugcuccagcauacuuuaguccuuggugugaaaguuggggauuauaagagccaaaacugagaggaggacuaaggagcaaggaaaugcuuuccucacuaauccagggguagguggggggauaggggacauacaggaagcauucaguaaauaccagauggacguguguaugugugugugugugugugugugugugugugugugugcgcgcgcgcacgcgugaagaauggaagaauaagaagagaggagauaugcuugggaugaggcaccaguguggguacacgucuggcuuugcagccuggggacgugggauccagcccugcuuuccaugugagcugcgggaaacauguccauccccguuacacgagugcagaauggcuccaaaggguauuuuguucaucuaggccaugucuccugccauuaauauaaaacugcugauuuaauggagccacuuuugaucuaucaagaaaagacacaccuaauucaauuuggcuauuuuucuaagaguaagugucuuaaucugcaagagaaugauuugauuagaauuuaaaguaguaauauugcagucacauuuuuagucacgaagaugauaucgaaugacucuacgaggcuuaaguggaaagucccagggaacagugagagcugggacuuuagcagcguccaggccguuucuguuauacuuucagaguauauuuuuguugggauggaugggacuuuggacagagaauuugguaugcaaaaugugaaaacagacaaucuucaucaaagugcagaauagacuaaacccagaacauaaugacauagaaacccaagauguaaacaccugccuuuuaaaaaaaaaaaaauuaagacauccuucuugagguucauggcaucaguagaaaaugucuuuuccaccuuuggucccacuggggcaagcucauuucuguauugcccucuggauuacagagaaaaaguucaaauguuuaggugcccagaagccacuacugaaaugagaggaaaugcugagcuaguguguggaccacacuuacugacaccaucuuccaaggacaaaggacaaaaaaacaacugaaaaaccuccuuagcucccucuguaacccacuguaagccaggucuacuuagaguucacucagaaaauugcuuucuuguaccuaacaaccuguggggucacuggagugcagggcagggguacuaggccuaggguucagcaagaugacagaacaugacaagccaggcuggagggcucuacggaagaaaagauugagagagaauaggguugcaugauuucauccuguggaagagcccagugugcugcccugcuacaggaguucccacccugcagagagagccacacaccauuguaccaugccuguucuaguacugaaauacaguuagccacuuuauuuugcauuuguuucuucucugagugggagagcugaaaaaggagaccgauuuccugugcaucuccauuuuauaaauggcuguguggaucuggcccucuguccgcagggauuuuacacauaaaggaacauucugaacucaagaggcaggcuguagcugagaaccaggcgagaaaggcaagcugcuggcugcaucuuugaggucuggaacaaaacacccuacuuggccuucagucuccaccaugaaaagaucccgagcauagaagcuccaagaagggauggccugguugggaauaaugagauagaaccuaccaaacucagagagaaaagcaccagcucaguccagcucauacuggugcacacuauacccaugacugauacagccacagcugaggugcgccuacuagggccucacugcugcucagcauguagcauggcucgugccacagaaagcagaauccuugccauuagggugggcugcugcaaugcacccugaaauguaguugccuuuagagaaggcuguaacucauuugagcauacuugccucauauauagcggccuuggguuccauccucugcacaggaggaaaagaaggagaaggagaaagaagauaaggagaggaggaauccuguacacugucugucuccagaauacuccaucaauuauaucugagcuucgugcuggacucugccucauauuguccuucuagaaucccucuaguaucaagagagagaaugucccuucuucagcaccaagaagugucacaggaaagcacaaccaccaucgucuucagcccagugagcuucacuugaggauugggaaauacguggugucuccucaggagucaccaggaaaucauccacuccacucacaauauuccuucuucaggucaugcucuguuuaaaagaagucccugcacagccuccagccaagaucagcagaggguguggaacaguaccauugagucuguuguaaaaucaacaccauuucagcagccucugggaauuuuugugaucuaguucaaaagcaaagcauugauguuuuaccagggaagcugugauaugggguuagagugguagagccuuugguugccaugugugagacccuggguuucauucucaguguucccucuucuucaaaauuccuaucaaaguaucugagcagcucgauuaaauuuccuaggucacccccccccaaccccucucaaacauuggaucaaaugcaaagaugugaaggaagagcuuuucucucccagcugccucaaaccacugucccaacaagaugaaaugccaccccacccuccucuggcauuuugguauugcccaagccagccaugcccacaggacaguagcugguccuagggcuacagaugaagauguacuuugcacucugccaugguguucaguucucucugcccaguguggcuccugccuuagugaacauuucccacacauucuguuuuggauagcaucaauuccuuuaauaucaagugacagcaguuuugcugcuuugaaacaccaaggaccucugugauauuagaauucccccagcuuuccagcugggguuccacagcuucaauguuacugucuugcucugguaagucuguggugcauuuugguuucagguacagaucagcagcucuguuuaucgaucagguguuaggacaccccugcacacugccagugcucuaaccacugagucaucucuccagccuccaccuuuauuauuauuauuauuuuauuuuuuuauuuugguuuuucgagacaaggguuucucuguauagcccuggcuguccuagaacucacucuguaaaccaggcuggccucgagcucagaaauccgccugccucugccucccaagugcugggacuaaaggcgugcaccaccaucgucccaccuuuauuauuuuuuaaguguauagaaggaagaggaaaaauuuuaacuaaagcucagaguuuguaaacaucacaaaaaagcugccauuuccuuaaaguugcuuucagaaaugaaguuaagaaagucauuggagaacuuaugaucaugauaaugauuucuguagagucugagggccaaucauaggcagcagcucaaauucacucuacaacccaggcuggccuugaacuuucagccuccugccuccauccuccuguaugcaucugaaaagugccacuaccccugguguucauuuuauucuuagaaucaaccuagauauaaacuaauuuguagacuaaauggaaauagcuuuuaguccucaauaucagaguacuuguccaauaauuauuaaauaauucaguccaauugcauuguacuagauaauacuuagaguguauuuuauuuaauaauuuuucacguagcaagcugaugauagagcuagaaguccacauguauuccuauuuaaucaucuccucuuugaggcuuugccauaaacuggacucaaggcauuuucaggugcugaacaucucuaauugucuuccucuuagucaacacuucaugaauaugaaaugucaacagaugagucccaguggucacugcugugauuacagucuaaaguacauguuuagcuucuaccauagaucuuugggaugagugaagccugugaaagggaaaccauccaaaugucgcugacuccuuccucccagaaaucaagccauuggcaggaacacccagaacucucagacaucaaucauuccaacugaucccuuuuuucuccgauggguuucaucagccaaguagccuguugagucauuucucaccugauuugacagcacuuucucaagaacugaaauuugcagaaugacuaauuuucuugucaguuacacuuuuacugcagugagacuuugauggaugggucuugggcauuuucucacguguuggugguaaggugcuccaggagaacuggagaagacagaaaugggaaaggcagugauuaaagaugugcucucacccgccagaccccagggaagagcagagcugaccacuucuuauggaucaaauccauggcauccuuggagugccucagauccugagaggaagccuccgauuccuuugcugaugaccuagggaugugagagcagaccuccuccaaaagucuaauuuaauaguccaggaaaaucugcuuucccccguuuccauuuguucuuaucauuuccucagaauuacucuuaaacuuaguuauaugggcguuuucuucuuuuugagccaucgugggcuaaccccuccaggaguguaucauuagggcuggagaccuaaucuaauaucucauaccuccauguguuucauuuccucucccagagcaucuacuucaugcaauugcauuauucagucaagucuccucuucaugucaccaggcugugacauuuacauugaaugauucauguauuugcaaucuuaaauaguccuaacauugaaauuugcauucugcugaaagacaaacagacucucuguggaaaggauguauggcuuuagaguauaauugcaucugcucccaugcuggucauuuuggaauuuaacuuauuuauuuagagugaggcauggcuaccugaacccaccuaugguguauccugccuaguggcagguaccuacaagugucagggaucagaggugcaucagaucagggccucugauuccaacugugacccucuaccaggcuguucuguccccaacuccucccaccuuuucugcuuuuucaucuucucucaaaauguauguaugccacaugcccccaaaauguaucgccuacuuccucaggugugcaaagaauaaguguuuuauacuagcccaauaaccauuguguagaagacuuaguagcagcaacugugauauagggaugaaugcaguuguaucagaaucacugggaccuaugagugaguuaaggucuugagauaggaguucuccuggguucuccggguaggcacuaaauucccugacaaguguccugcugaucaacacacaaagaagaggaagucgugugcccauacaagcaugagugcaaacauguuucuggcaucuaaaggaaagagaacagaacuucccagagcuccucaggggacagaugggaguacagcucuguuguuuggggauccagaacuaguaagagagaaaaucuguaagcccuugacucugugguccuuuucagcaaaccagaaagcuaacuaauucgggagcuagcugugugauggcauggugguuacccgugauagacuaaggggggaccaaacagugucagcacugggacaggugccagaauucuucaggggagcaugugacaccucucugacaguucugaaucaugacuuccucuccuucgcagguggcuacuagagagucagaaggcugguagccguggggacagcuagcuuugggcuuguuuaugucacuaauaaguuucugcaaauguuaugcagcuucaggauaaggacaugaacugacugguauggcacucaccccaauaucaagaggcagucuuccccucaggccagcgugaauaucaugcauguccagacuuggagaauguagaaauggguugagcaacacagguuccaaauauuaaaaaaaaaaaaaaaagcaaccagcacaggacagaugauggaaaugcugaacagucaaccaccacagaaccugagguaggagagaagaggcagaaggaaaugggagagggaagagggagauuacaauggagggauuguguuuucuguauuucaugcagucagcaugcucucuguguacucagguuuacauuguaggcuguuuauugugcucauauacauguaaguuggguaguuuguccuuauugggaguuuagcucccaaccuugcaugaaauccugaaccuaacccauguauucuggaauccaugaucuuuacgaagaauagugaaaguuagaaauacuagauucucaucccagcucuaauguaggguaacugugauaccagaaagcaccugaugguuuugagcuaacauuuuccaaucaguaauguaguuuaguggcugcagagucuaaccagagguucucccagcucauccauugcaguguucccagagcaggccaugcauccuuaccugccucuuuuacauaggauccuuagcagagggcuuccagguaggacuccguuaaucugcccacuuuaccucuauggcaacugaagcugcaaguuggagcagcuuaucccuuaucccaucucgugaggaaaagugcccaaacuaaaaccuaggccuuucaccagaagcaagcgccuuccuuaucaaccugcuguugcuguucuaaaguaucaaauaagaaugacuuaaguuggaagucuagguuuggauucccagcagagucugcaagguaucuauugauuauaaccacuggagacagcccagcagaauauuaauaacuugugcaaccuguaugaaaaaaauguaggaguaguuugcuaaggaagcucaaauacagccaggcauagcagcuccuaucuguaaucccaagcaguugucaaguagaggcaggaggauggcguauuccaggccaacugggcuauucaguagaaccccacugagaggguaagagaugacaaauacaggauggguuucugcuuaguaguuugaaaguccucugaguugagugaucaagaaacaaacugcuccuuugaaaguauuuauaccauauuaaugagguagucauucagaacagaauuaaaaguuguguuuuuggguacuuucaggagaggagaaagcaguaucuaguguuaaaaugggcgucagauaccuggcuuagugccucaucagcuaccugcauaugccuggggagggucuuauagucauuuugauguauacuggcauaucuuguuuuccuuuuuugaaguucuguggauaguaagugucagacaauauugcucccauucaccuuugcucauaguuucaauacaguuaguuaagauccuugggguauaguauuuauugugaaaacaugaggaccuuaguucagguccccaguugccaccuaaaagcugagcucagcagcaugaguuuguaaccccaguguguuaugggagcauagagacuaacugaccugauggcucacucaccagccacuguagccaaagcagcaaguuucaugucucaaaaauuaaaccagggcuauauuuauaagauuacuaaacaaauuauuuggggcauucauguguucuugucugcucaaagcacuguucaagcuagaaugauacuugcuuucucuuuguugugguauuuaacaugcacuggcuucaacccaagugaguggcauuugaugucuuuuagucuugcucaacccaccauggauauuugucucaaugacagcacaugcuaguuaacacugcugagagagcaguggggaaugggugugacauguaacagucuagggcuugaauggcaauccuccuaugaaagaucauuuccuccuuugguauccaauucuggaagcaguuuugguucucucuguugucuauagagacaagagucagaccauaaacauucagggugggagaaucccaaaacuugaugccugcuuccugugacugcagugcuggacuuccuccuaagaguccagaccucucagucgugacaaggaccggccccuugacaguuggguggugucauucaggaugaggaugauggacagccaucugagaucugugugcaccaguccuuguguauguuugauugugaguuugauuaagaaggcuacuuuccagagaagucuuccauagaaaaucuaucaaagggcacauacauuucuguguuggucaccauuguccccagcucuguauggggauguguuagaugcagaggggccuuucaggaaacagcaggacaauacuagguagaguguggcaagucuuuagaaggccaugcuugcucuaacccaggcccacaagcagacuguacugaagggggguuguggggggagccaugaauugagcguugacagugggccacagcagucugaaggcucaggugguugucaaccauaaguuuagcucagcucuuugaguaauuugucacgccuggcucagccccugcugggccagcacgugccagcuuagugucagagggccuguucgccagacggccacucaggccuaacauccugcuguuccccggaccagcggcuugcuggggccauacacggagggccgcucuguggugacagccaagugcuguacagaaugagcaugcucauaaugagaugugaauggcauuagugggucccucuagaauugggccugagcaggcgccucucacugaggaaguuuggcagccuguucauuaaggcaagucaccaggaguucagccugcagcccaggagccagcucuagcucacacugcccaggccugggacuguugugaccauccaaagaaaaaaaucauguaucuucagaggggccacuuuugaaagcuuccagugcauagucuccauuuuuucuaagaguuucuaagggaaauucuagcaugaagcauaucccaacauuacguucuacauuugugccugcaccagauccuguaucugcaguuugacuugauaacuauuugaaauauacagauggggcagggaagcauagcuguuccuuuugcaccucaguuaauaaacauugaaauugugguagucauguagcucccagguagucagcauugcuccagagagcuucagguccccuccuggugugacuccaucccugaagauacaggaguggggagagaaccugcaucuggagaucaguaucaagacucuaccaaaagaaaauaggaaagcggcuccaguuuuaaaacaagcucuagagaaacuccuuggaagggcauaaucacucccaacuuaucgugaaaggauuguuuuaagacacacagagugugagacauacagaaucauguuucuuugcagcccaagauaaaaaucuaaggggaaucuacauucucuggguuuuguguucaugaagaaaucgcacaauuuuucaaaauaaucaaaacacauccuuuaacuuuugcaucaguaaugaggaagggaaaaugagacaucaugcuggcuucccccagugcuaauuccuaaaguuauauguguagcgccuccauucauugucagaucauucugacugcuccucuuauuggaagugcaugauucaccuucagaggaaacagaagccucacacaaaggggaagauuugcuuucugcccugugaaaggcugccacaagcagggguccuauuaagacagcuggaaaguugcuucagcguguuacgcuuguaaguuuuauuggugacugguuuuugauuacacauuugaauguuguguguuccagacugcagcuuuaauuagacggcaaugguuucucucuuuuuauuuuuuugcaguugcacuguauaccauuugcuacaaucuccguccaucuccauuuucauuuucuaaugcucaucacuuacccugcuuagaggcucugcugcccuugcagaauauaacuccuagccuccuccucccacuagguuauguuuucuuaccuuuguugaaagugcucaccacuacaucaccagcucuuacuugaaguaucaguuccuuguguccuuagauugagaugagaauccuuguuaccuagauccggagugaagaggaaggcugucacgccauaccauuccaauguuggucuacucgaccaccucucuccuggcuugagccagccuucgagaugguauaauaaucagcacuuugcuauaauuuuguaacauuuuauauuuauauauguguguguguguguaauauuauauaugauguuaccugaaagaaaccuagguuuuaagaacuagcaucucacuauuauaugugacaaauauuuaauuuucuggcaaaaugcugaagaguuuccaaggguaagugaugagcauuagaacgggaaagcugaguaacugcauuuaaaacaaaucacccacugcucugcaugcaaaauugcacguguguuugucuccuuaacuaauuaccgaagcuacgaagagcgagcucuguaucuggaagcaauaauucaaaaccaccgggaagucaugacauuugaggauuucgcugcucaagucuuuucucccucucccagcuacucugucaguggaacgggugagugucuacaugauucuccucccucccgcuuaagacguauugaguagcagauguacaccuguuuuucacagauaaaugcuugcaaauuuaagaagaacguucccccucugaaucaacuaaugaauuucaaaaggaaugaugacauucauuuuaauuuguuuuguauccgagcuguucgcuguguuccuuucuucugcuauccuguuaacccucgaaucuagcaagguuaaugaacuuuuucucaauaaugugcuccgguucauucaggagugugaguuucuugcugagcugggaauaugguguuuaaaagcgaugcccaaaucacugcauacuuaucagaaaagaguuccucacaguugaagccgucgcucuaaugcuaaauggggauuaugcugcugagauaccagggucagggauuacugccagagacagggaaggacaguguccccaggccugucauuacagagggccucguacaccagugucauguggacaagccacugaccacagcagcaccugguguggagccuuuagaaaguaaauuauaauggcuuucauuuaguaggucaguggaauuuuccauggauucccuuauuuuuagauacauacuauuucuauauaauacuaucaauuugaaaaaaguauguccugccacuuaaauuguugguaugauuauuacagguuuuuuuaaagaauaaaauuauuacugguaaauuauuuucaugugcuguuacagauuaauugccugucagacaguaaguggaauauuuaguguacagcauguugaaaaucucaaugaggggcuucccucaccuucccugguuucagcauagcuauaaggaugcuuaauagauuucuagccuguguuaauugcuucugaaccaggcuugcuucuccugugcugacuuguuaacaaauaucuuacacacaaagugaaaaaaauuaaauucagugaaauaaaucacuuacaaauaaaaucagccaugcgucauuguuuaacaucgcuggcuucaggccgugccucuuggagcuuuguugggagauaagagagagaggcaggcacuugcuugggaagccaggagcagcaggcagaaggcuugggagauaagcaagcuggcagaggugcagagcuccauuuacauaaucacgccucugcuuccuggugaggcgagagaaacacagggauggccucuauugaucuuuguugaacugggauacugagcaacaugagaaaagcuuauaacuuaaagcuuugauuaauguuucuuacauuaaaaaaaguagaacagcugugaauugaauucuuuuauacgcucugccagcauucuaucuaagacaagaaaaaaaucuguuucaagggaaaugaagauuucauacccagucuggcuagcgguuuaaaauugugucuaauuuuucagugaaagaacaggaggaauccacagcaagcuaaugcuuuccagcuccauucagucucuucccauccuuuggagacgcugggacucggcguuucucagcagaggcuuugguuuuggguuuguuucuugguuuuuuuuuuuuuuguuuuuuuuuguuuuugguuuuguuuuuguuguuuuuuuuuuuuuuuaacuucuaagaaaacauuucauuucuuaaaaauaaaagaaaaaaaugaaaugauaaauguuuauauuuccuaacuuuuuauuuuuaaaguugaugaugaucaauguuauugaaauaaugauggcuguuauuuucuauguauauuuuagccucuguauaaauaaaguucaaccaauucaguucuuaggacuguaggagcauuuugauuugugugaccacuuuggagaaggguagauuuuguuuuuuuguuuuuuguuuuguuuuguuuuagagaauguccuguuuuuuuuuucuuuaauuauuuaguaaaaauuccaacagcuugucaggacagacauuagaacuuuuauauauggggcaagaaaccaaauauagaacaccaaagcaaauggauuuuauccuucagaucaacaucagcaccgcaucccgucauguucacaacuucugcuugcccuucacagugauaaggaaagagauagaaaugcaaucuauuugaacugcagugugagggcagugcagugagaaugggguucacagccucaucugugcaggggcaccucucagagcuguauucuuccugguguaugugcagcuucaccccuauuuucacagaggaaaagacuuuucacuuauucauagugguuuuuuuauuuucuuaggacaaacacagucaaaaccagaugagcccagcccagccaacuuacacucagagacugaggugaagucuguucuuccagaccaccuggaaaaauggacccugaacuucuuacacacaggguccagucaaacugucuguggccauuuacaucaucaaagcagggacgugggcgcccaagcgcuuuacauacauaugacaggcuucccuaggauacagucuuuaaggaagguacugcacuguauaauacagcacagccagagagcagcacagccccacuguagagagaugugcagcugagcuugaccauagacucuguugaugggaaaagccugugccugccacacucccugaccacagaggccuaggagccagagcacccaaaugagugaguguacuucuauccaagguacaccaugagcucugaauagggacaugggacucaaauauaagaguucaucuucugucaacuccuuuaaaaggagaauucaucucccaaccagaaaugcuauuuuaaagcagcccuugguaucuguugcaucuauuguuagaauuaauaauacucuguaugaaagguauuuggauagcuuuuuuaccuagcccugccugcaguuugcaauuugaucccuucccauauuggcaaguaauaaauaaucgaaaaggaagcugauauuaacauuuauauguuuuaugcaugcauauuuguauauucuuaacccacagagcuaugggaguagagugcuaaguuuguguuuucauguuaucacggaaggggagcagcagagaggacuauaaaggguuaacuggaaugggcacccucgagugcuggggagggacugauguaaucacugcagcucacagccaagugcaucuguucaccaugaggucauucuucugcaugcuaaugaccuggagaauccagucugguguuugacauuauccaaagggauauaguguaaaucuuuaccuuugggagcggcucuuacugaacaaaaagagggaaagaaacuuguuuggacuugcauggggguuuccuuauugcugggguuuuugggugguuuugguuugguuuuuuuuuuuuuucacccccugaagcugcucuaaagauugugucuggaccuuacuuggaguaguccauuugugucuguugauaagugaaucccaaaauuucuguuauggucacagcugucaauuuggcaauugagaacaguagguuugucucauguaaaaucuaacuuucagcauuuaaaauuaucauggucagaaguuggugagaauguuuuuaucccaaggaauguauaaaaccaaguucaaggagauuuguucucagugucccuggauuggcugguguuuguuugagaugccaacacugguuauggcuacugcccacuucaauacugcugaggagggccagcagagggagcacaggucuuuguuuauuuguuagucucaaaaacacagcccuugauuucuccaauacagagucagcaguacuuucuccuuccuuugugacaggcgagguggaaaggcuccaggauaacagagcaagugggagaaaaugugucaccccgacuuugauccccuaucugcugcuugaauauaggucauauuugaggcuuaaaccagauuagucugggucagucuuaagaugcugccacugcccaaagcugcacacuuuccucuuucucagaugugugccuggauggugucuuggaaaggaggauuguggucaucugucucguagaauagacuugucauucuuuccugcuuuucacuacaauagcuuuugacacuguaccagaaauccuaaccuuguccaaugaaugaauucacaaagccacagacauccugcuauaccuuggacaucccaaagggaaucuagguuauagaugcugcacuaguucuguaguucacuggccuuuuccccaagggaugaagaaguuccaccagcuuccccuuguugaggccaccaugcaugggugcucacuauaccagcaucuuacaccaugcaugggugcucacuauaccagcaucuuacagacuuaugauuuuguauacagauccuggaaggaauauuuuacugggcaauuaauaagcaaguuagcccccagaaacagacagguaaagcccaaccuuggcccaacaagcuuuucaugcagguugaaaggguaauccccugcauaucacucaguugguauccacucuuucucauucucccuuccuccaucccuguuaaaguggucuuaagaaggcuuagauugauagcacagcuuauacuuaugcuucuuauguauuuagcuuuaucauagcuuagggaaaccagcaaagaacaucagagaauguggagguagaagggacuucauagaauagcaagucuagccucuucuuaguaguuuugacuaagcuaaagcauaaaccaugaaugaacaacugcagguugcagacaagcuugacaacuaucccucaccuuccaucccacauauagacaugccaaaccagugccuacgcuaugaugaugguccuauaaaucaacaauauggcugguuuguuguugauauuaaagcccagaauuaaauuugaaaauuacauguagagaacccagaaguuuucuguaaacauaaguucucuuaugucacugucuacuuaagagcucacaaccagcccaacuuaaacccucagcauacuuggcuaucccuggccaauauguugccauguguucuguagauagauaacuaccuccaccccaacaaugccaucuggccccagccuagaucuuuuccacacagccaguucaauucugccccuuuuuguuuuugucuuguaacuuauacauguauucuuggaaagguaagaagcuauugauagaaaguucuuaaccacucuuaauucuaucaccuagacccagcuugcacaacauuguauuuuagugugaucaacuuacaauggauuuauaugacucuuacaagugcaggaacaucugcacuucugucuuauuuuuuuuuaaagaacauguaacucuguagugcauguguuuaucuaagggagcuauaaauucuuuaaagaacaaugccugccaucuccuuuuuacaauacaugcaauaggagaaaaauaggaaagcaggacagaaagaagucaggcuguugcuuuaagugguacaggugugucuccagaccacagauguguugggucugaugcaagaugcagaacaaacaccuauaauuacauuucaucugccuucucccuucucuuaggaaaagugggucagugacaagcaauauggucaaagccugguguggggagacgggggggggggggggggagagccaggagccagguuaauccccaggcuggguagugcagcucugaguaacugaaacuugauucugggugcuuuuguaagugauguucaggguuucagagagaacucuccauggcccucuuugucaccacaguuuugugcuuauucauaccuguauccuuuuaacacuccguuacuccucuccuguugcucugggagacaggcagaggugagacauauuuuuccauuuggucagcuagaaagugauacugcagccugucagaugugacaucucugagacagcucugccuuccuuaggcugcugccacugagcagaccucuaaaggguaccuaaggauacacacaaaguucuggaacccuugagaagaccugagucucuacuuuugugguaaugagucuuaagagagaaaaaaagauauacaugaaugcuuugugucuuaaaagaaaaaaaaaaguccuagauacuucacagcaaaaugugacuacaagugaaaguaagccugcuggccaugacuuagacucuccugaggucggcugugccaucugucuugugauccuggagcuugggaacaggagcuccuguguccuucaccauccacugaucguucagcuuuuaccuuugcaacacugccaaaaaccuaggaugccugagaacuaaaaagcccuuccgcaagaccaggauagacugaguagauuggggaagagccucaugggccguccagacccugaccagugcugggacuugaguccauagcuucugaggauggaaagggagcuggcauauuagaguuguuuagaaugugugucuguggaagcaccucagagcaucugcuucuuaugagauauuguagccauucaaucccgcuuccuuccaggauguuaugugcagguggcauaucuuucccgccuaacugcuaauuauggcucaggggacacugaagcaguuaccaagggauggcaagcagguaccaagaaucuuucucagacagaguuuuggaaaugaaccucaauuaaagcuuauucaaaauaaccuuuacaguuuuucugagacaagcccaggguuugggacagcccaggcucacauucuuugucaauggcaguuguggccuucaugucaaucuguccuugcaggugguccaugugcagccuuagcagcuggggcuuccuggaagacucaaugauuuugcucggauuuccacuuagcaaagagcaaacuaaagcaaagccaaaugaagcucuugugcuggcauuagaguaugcaguuggauagacggaauguuuugugcuauccuuuccagggacauucagggugacacccagggggaaaaaaaacuguaaauuugcucuuaaaaccccacagaaugcugaguggaaaaaauguuuugaaaauggggaaacaugccagucaauauugcaagaggacagguagguggaaggggagggaauucacagcauuaauauggccaauguugaauucuuggcauauaagaaaguucacagcauuauggaagagaaagaauaaccaaaagccuguuuguuuguuuuuuucaccacuuaaagaauauagaaugauaaaaucccagaugaacuucaccuaccuguguucccccaaccugcuggaggccacaaugagguauugaagaucuggccagcuuagaauccuggugguacccacaccucuccugcagcucaaucagaccacaggacagcagcuucauuccucacaucucacaaaccuacagggcaggguuuuagacggucacuccacccucagaagaguauccuaggacuuaauaggagaggcauagaagugggcgaagcagaaaggugcccugccuuccuugaggcuaccucccaggcaggagagaaggaaucagccaucaggagcuccuuggugcuaagcaagaaaagacaaugggggaugagucugagugacccgaggaacaggaagugguucuuugagugaguccugucucacucaaaaagccucauguggugguacaagccugcaggcccagcuccaugagagacugaaaugagaggauuccuugagcccuuggcacuuaggucuuucugucccagacaagacuccuucucgacccauucagggucccugccuuuggguacccauuguguuggaacaaauccacaggagugagcagacaugugaccaaggggaauccuuuuauuguccccucaaaggcagaaaggacuaauuuguuggguuuauggccugggcaacuuuugguaccaguagcaaaugcucuccuccuuugacccacacaccugagaaauguaacuaaugugaauugaguuauugucugcucccaacuucagcagagugcauggcaggagcuccaguagacaaugccuugaucccaggcccacacugccuccugacugucuaaagacagcacgaccguccuguuugcucgugugucugguucauacacuuugcauaaguagcccauuauagacuauauccccagucccaccccagcuccaagggggcugcuucuaucaauaaaacugcuacggaguuccaucacugcucugauguuuccuuggauccuucugaacauauuaggaugcacagugcuaucccagaaauguccacacaccuaacugcuacuuuuuuuaaaagcuguuguuugucagggaauuaaaaaauacagucaugagugacagacaccaaacccagggagcacagagggagaacacuccuagccccucucucaacaggccacucuugaguuguauuaagaaagcugaagucaaguuacaggacaucuuagagacagccuugggcacuagaaguagugucaccugaaggaaguguucuugcuuugagggugcugugaagucaguagaguggcucagcucagaggcuguuggugacauccacgugaccucaucgcuacgcugccccccucuuccugggcccacagguggguuuucucccuaaaucuugaagucauucugguguuguuuuggaauggagaguacagaauaguucacagaccacuuucuguccuguucugccuuguguuuuaaacugggagggaaguauaauucagugguaaauacuuaaccaccaugcacacuggcuucaaucuccaccauacaaaggaaaaaaagaaagcuuuaaaaagggaggggggaguuguacugagauauaauuugcauaucauacaaauuauauaguuaaaguaaacaauugauacuuuuaguauuuucauagauuguacaacugucuccauagacuaauucuagaauguuucauuuccccuagaaauaaaauaaaacacauucauagucuucauucuuuccacaaaccuuacccucgauccugugaaaccacuaaucccccuucauuucucugccucuaccuauuugagacauauaaaugcaaccaggugauaugaugacuugacgucauuuauauaacauguuuucaaaguuccuucaugcuguaacauuuaucguguuuuuuaaaagauuuauuuacuuauuuuauuuauaugaguacacugucgcugucuucagacacaccagaauagggcaucagaucccauuacagauauugugagccaccaugugguugcugggaauugacucaggaccucugaaugagcagucagugcucuuaacuacugagccaccucuccagcuuugcauuuauuguguuuuuaaaaauuauuuuauuagcaugaguauacuuggauaauuucauucauguguacguugaguuccuaaacucacauaauauugggcaagaagaaaauugccagcaguuucucuuaaugucccaacuguuugcuaagucccuaacacaagugugccugcacacagugcacaguucaggugcuuucuucucuccccaugcuuguugguccagcuguccuggcuuucugguucagaaccaaaguugaugggcaagaccaacaaccaagcaggggaagccaacccuagugccaggacuggagccaggacauagccacugcugcuggauugggaauacuggaagccauccuuggccauuuggagauguuaauuaggcuggcaaauccccgccggucuuggucugccaguguugaguugcaugugcaggcuuccccauccacugccugcaccuguucccuuccuccgagccauuccaaggggucugaauaacccagucagggcucugauccuccucugccugccuuccugcugggagaauaguuagcacuugccuaaagcuggaaccugguucagucuuucucccucacccaugccaacucucaaaaucauucuuuuuccuaauuaucuugaaccaguuaaucauuuccacacugacuguucaguaacaaggauguagggagaggcagccaugcaucuugucugcccggggcccacauuuaccccaggggucaaugcuggaugcuggacaguaggcuuuccucaaaagaagcuugcuucaaacuguacuccuuugcggcugagaaaaacacgcccuacaaaaacugacaagcucucaaauagcaacccaggcugaacugcagagaauacaaaucuccaaccauacuugguuauuucugaauuaaagaaagauaacccuuguugauaucuagaauaauaaagucacacaacacaaguccaaaaagcaaaacacuucucuggaaauggccucuggauucuucuccaggcucagguucuuguguaugagcccccagcuggcuccaccugugcugguuagugucugagguagacugugaaggguucucuccaggaaucccucuccuacaugcaaaggaacuggcugcugaugugccagcaccacugauguccaggcaugucuucucauccaagacacacuguaacccugccauacagugucucucaagucaccauggagccucucaagacucuccuuuccuaacuugacucuccuuuagauaccacagacauacaugugcccacuuauuuguguguucuaccuccccuacuauccgcuauagcccccaaagcaaggcuuuuguuuguuguauccauuacuacggccuauaaugcuacucagaacguaucaacuggacacaguugaugaaaagaaagauggaaaagaucauaauuugugccucuuuccucccaggcaucaugugccccccuccccagucucuucucauuuuuuaucuucaggcucagugcucucucuucuagaucuuccagcaguaugugugcuaaccccugggauuguuuaguguacuaagaagcuacagccuauucccuggucccagcaacugggagcucacccuucaagaguccugccugcaugucaagagcaggugacaucugagcccuauggaauaaucaaggcagccuucaacugccucggccuaugcauugccuuaauucaaccauggauuggcaguuacugagauagucuuugugggccagcacaccacacuaggcugugucuggggacccucaggagaggagcaaaccaguccucaucagcaauuacaaacaagucuuccauuguuagugcaccaucugcuuucuggguuuccaccaaucgagggccuguaugcauagcauaaccagggccgggguggggguagggguggggguggcgggcugcaggaaagugagaucaaggauccccguuauaaagagccucuucucacuugggagggcaucaggggcguggcucugaaaaccugaggcgcuccacucaagguagacccaugcacacaggcacucucugcuugccgucuuccauuagaugaaguggagcccugcaguauggcacacuggaaaaauaagaaaucuagaaaauugcauuaaugucaaaggaccuacuagguccuuagcccagacagagcugcucacgccucacacggagaagaagccaagucauaguaggacaaggaacugccauuuggucauccagggcugguuaaggaucauggcuucccagcccaaguacucaaaacuuggggccugaguguucuuuaauagaaaaucaaacuucauagaaguacauacauacuuccuucagagaggcguaaaagaaagaaugcccaaaugguguuagaaaaaaaaauguccaauugcugugccaaccuuggcagaugagaucagcagaaagucugaguuuacaguuauagcagugugcacaauguuuugugucucugcuaauguccagccucaauaggggccuagcuaaucuagaauucaggagaguuagggaagagagggcgggguagagaacugcuuucugaaagcaaaagcagggugcauguggauaguauagggaguaagaugguguggagcgggugguagggaccugucauaaggaaucaaaagccgagaucuucccucaaguccacaugcuucugagggcucagcuauaagcacagcgccaacuggcuuuggaucccaucgagugaguauugaagugaacguucaggaaugaugcacgaggcuuuaggacuagugcgacccggggaucagccgugugugucauuaugaagcugcagcugggggcgugccacccucucauucaugggauuuuugucuuuucucccuucagauuaaaauacauacuggucucauugcaaugcuugagcaagguaagacugccuuuggugggucccccaccccugccaaacccuuaguugacuuuuacauacccgcucuccuccuucuuuggccucagccuugccugcuuccugucuccucccgaggggcccugcccacucuccugccucugcaugucuugcugccuguggagcccagcucugccugucuuucuucugcaaguacacucuggguggaaucugacaccaacaccugccaucguggaaaaugucuuugucaccuccccuuuguguggggggcugccgggagccaugggcacagggcuuuuuuuuguuggccaagccuggagaagcaggauguugagaugagccgauaagaugaggcacgugcuggccuaaccuuugacugcuugccuuagcagaggcguccaaaggccaaggccuccacacagggagggcaggucaucaaggaaggcugcugaauagagcagcuggaggaagaagcagacaaaaagcugggcgagagaagaggguggcaaaccccuggauccacagucuaggacccugagaacaagcugagguggcaggugugaccucacagcaugaccuuucuguccuggcuccaggauccugacccagcacagauagcucagauggaugacagccaccacugcagaacuggguagcaacucuuccaguauggccuggcucuacugguucucugguucucaggcaggagaugcuuggauagcaccuaugauaaauccacucaaaagagaaaacugucauuuauuaaucauguauguuccuaugguggucucaacacaaauagaaguaguuuacccaggacaccuccguaacccagcagccugccaugauuccuuuagcccagcuacccuuucucuucuucuuaaccauagcuuuagacuggucccaguggcuaacuuacaucagccccaaaggugauaggaucuacagaauacaaguucucuagucagaaagggguaaaacagaauuguaaggacccuucccaguaggaauuuagcggcaaagauuucuauuuagaggccccucucccgcuuugaguaagccacggcuuccaucuccagcagagaccaagcuggggcaguacuaucuacagcuugcaaguauaggcacuguaucaggaaggcaauccuuauccuuugagauucaccaaugcauucugcagcuacugccucugcauccaucauggggagcaucagugggcacaggggagccacugcaggaugaaggugugccagcagaaagucaaaggcugaaggaaugcaugagucaugggugcacuggaaucugguguacucucugccuuuagguguacaagccucuuguuugcagagcuuugaaaugcuggcuuagguuugcucaguggggcagcugacacuacccuguccaucuguaggagcucaaacugugacccaacuauccuagucugccuugguagagggggcucaggaugcggacuaaaguguuugguucugaccaagcaugagcaagugauucaucccuuugccuacuaucuuuaagcauuuacugacaugcuuuuuuuuuucuuuuuuuggcuucuaauucuaacugauguaaucagaguggguggcauuucaaaccagaauccucugugagguucaaucagguuucccccaccaccuuuugccccucaaacagcugcuccugcucacucacaacaacuaggagagggagagacguccuuaaaaaccugauccuugccggcggcugcagagaugcucagcagugaagagcacuaacugcucuuucagaucaggccuuaauucucagcccccacauggcaacuuacaacugccuuuaguugugggcaccaggcagcacagacauguauguaagcaaaaccaaugcacauuuaaaaacaacacugaucuuuggauggccacaucuagcugcauucuguugccauuguguaaggcaaccuggguuuuguauuuuugcaaugcugggacucagggcuucaugcaugcuaagcaaguguucuacagcugagcuaaccacccuuaguagccuguuucugaugaggaaaccaauaggaaaagguccuggaccucucuguccaccagccccacggagccuagaugggaaggagagggaaagucugucuguggaaucugaaagugaaaacccauagugugcaugggauagagugucuccaugggucaagagaauuuuaaguauuaacuucagaagcucuucccagaaagcauaggacaaggccagaaaacguauaaacaaaugaacaaaauaaccuaaauaaauuuccaacacuagcaaugacaguuucaaaggccguaguucaagaagagaagcccauagggaggagacugcaggaguccugcuuuugagguuuguucuaggcaggggccacucagggaagcuuagagcauuuaaaaauauauuacaagggggagggugacgaaaggauccucucauucgcagagaggcccucgggaggccagugacaccgcaacaguggcugaguguugcagcagacauucuuguauuccucagagcucccagacagccacccuggggaugggaagagugcagagcugcgaguuuuaauuuuauuccuuguucccucuagugccaaauagcugcaugcucaucuggacucauucagacaagcaauuuagccgugaccucuagucuuaggcccuuuagggaauaagugaguaguagcucgugugaaauaucaaaauguaaacaugcuaggaucccagaaacacagcauugccauugacucugcccagggcuccuucauggccuucacuccaguguacugcaauccgaggccuuucucuucauuccuuacuucugcacuagccagaaaggcugauuuuuauaccaaagauccacaaucuguaguuucuuuuaucuuguagaagaaccuaggacaaacacuaagaggaguagcauaucuuuuuugauacauucaacaaacauccuugcccagcacacuguuggcagggaggacuucgaacccauuucccagugaucaaguucccugucuucugagcacuguauguacuuccuggaguguguggccagagauucucacuggccucugugauguggccuuucucugcuuccuuugcaggggucuugaccuccagccugaguauggaccccaagaaaauccuccauguggaagaaagaggcacagauucccccugauuucugcagaacccucaaaaucuagacuucgggaaccugccacugugccagcacauguagcaagccucccugugguuuggcucccaaggucagaggcagucuaguuuguguggaaccuucaagcaaggcugugucccucuugucuuggaaucucaccaaccaagccuuggguaucagaagaagaaaagaaagucaccaucaaccaggaacaaaccuguugucauaugggcaauggagacgccugaagucucuaggcagaauacaguagcaaaagguuuggggcccacagggaaggggcaaagggcacuugucuguaucgccgaaucauuuuccuuucauuuauacucccaagcuugauucccaaaagggcugacaaaauaacuguguaauuguuggaggaauuuccuccauacugauuuugcuaauccucauguuaggauuuauaguuuacucaaaauuucaucauuauggaagcuggcuguccccagagucuuuucccacaggaaguuucaccuucaccauugaaccuuuuccaccuggagcugaggccccacugacuuaagauucuccugacaacuagaguucuuucaggugauguuccgacacagagcgagcagagggcagggggcagggggagugaccaugcaugaaaauaugggaguauccacaugagagcacuaagcagauggcuagcacccuugcccaacacugccuagcccagcaccacacacaucaauacacaagauuagugccugcuccagcuccagggcugacccaacacccccacuguguccaguacuccugaaagcucaucugcaguccucuuccugacugcuguucagaguccaagacaggccucagaaacaguacuugucacaugaguuuuaggguacagauuccaggcaauagauuugauccuuacacacacacacacacauaucaaauuuuauauauuggcucuaagaaaggcauguugugccuuuuagggaugggaaggaaggaaggaguuaaaugugccccuuacuggacaugaccaucuuggaccuuagaaucuggcaacuaagcauucccagggaagacuucuguguggucacucacacacccaugcuucuguccuggcccuggugcugucuccgagcuccaguuuugcuuccuuuccugcucuacuucagagcaaaacagaagaugcagcagagaccuucccuugcugccugguccugcuacaugacgccauucccagggcacauaucuagaugagcccuucacucaaagcuggaaagcagccauagaggauagacucaaggggcucaggcaugggagaguguccuggcuguggccaccucucuaccuuccucugccuucugaucucacaccuagccugcuuucacuucucucagccugcuuacccaccucaucaguguccauucccagagaagccagccuuuuauaucuacuacagagcugauuuggcugcuacuaaucuuggaagaaaaaagaauggagccagaagccauauucagucuuguauagugagugagaauucugagagugagauguucuaggagcaccuucccacugcagggagaccccguccuccugcugugaagggaauacagcagccucucaugccaggcccacagacagaagcaccacggucagagagagcagggcauugcaaagcagaaaaggggcccugugugcugucuucuuaggguccaggauguucacuuauuggagguugauggugauagaagggaaaucggcugucaugacauuucccauugugucagugaaaccuugauucuuaucugugugucugugugucugucugucugucugucugucugucucucucucucucucuguguguguguguguguguguguguguguguguguguguguguguguguguguguguguguguguguguggccaauauugcucagacuucuauuauugauuuguuacuuaccuggcuccugcagaaagcgcuucccaaguccugggcacuaaaggcccccgcagcacaggucauaaaguaccuucugcaggaacacuuaucuucaggccccauaaaccccuguggugaaauuccugccauuuuggaagucuuucauuuucuucuuuuucagucguaacagaacccagggccacaacccaggucccagagguccuguuuaacucacagaugucucuucauaauuucauuugcuuccacaagcccucagacuuggagugagaaauucaauuggagguagcaaauaauuugaacuucuuguaaccuaaugauuuuaccaaccccauacccagguugacagcaacaguuuaugccuguuuauguuuuaguuauuuauuuaguccaugggucuuggguugguaauaacucugguuagagaccuaagagcuggagaguagggauucuggcaaccaucuuugauugcauucagcagcucuuguuauuuaggguagaaaauugaaaugaucaaguuugguguuuccuuuugucaguuagaaaagcaaauauuguguuuucauaauaaaugucuuuuagcaaaauugcuaagggucacucaucuggugagacccuccagagagccacuugucacauuaguauuaguaggucagccaucugugauaaaagugucccuaauuaccacaaagugugguaagacucucugggcuccugcagggccuggccagaacccacccuucucuacaugcugaccucccaaugucuauaaagagggaaacugauguuuauagucuuguugauuagacuuucaugcuguaaaaauuaaaaaaauaaaaauaaaaaaguaaccccacaaaacuuggauguuuuaaaaauagccagaccuucagcagacugaagaaaagaaauguagccuggugagugacucccagaguccucagcagccacacuggcagaucuugagagccccaggaaugaacccugacucugccaaaugcuguuuaguaggacccuuagccuuauaaggagaucacacagcuccagagagccaugcaaacccugucuuccugacuguccucaggugucccuuccuuuucuccacugaccugugguggagguuugaugaacucacuaaaccuuccugugugucuuacauguagcuguaucacuccauacuuccugaaggggaugucacaucuaagggaaacucacccagagacacccauacuuguauuugcacccaguucuauguauaugacguacucgguaagcaaacauuuccuuaguuucaggucuacaauauuuaguauguguaaauagggagacauuugaucgagaugauaaauuaaguuauagcaugucauuugauuguucugaggucucuuguuauuuaacuucccagagcugcauaacuaaguuguucugaggggcgugugguugggugaaccuccaaaccugcucccccuugucaggaguguacaugugcacuagggacacacuccauaaaggcagccaugcugggaaaacacuuagcuccauaauggugccacucaacuccagcucgcucuuuuucguucugauugaccgugaugaguugaagggugagaaacacggcaccuaggugcugcauguuucugacauucucauagucuguagaaaauaaaaguuuaucacaccaucuaauaaaaau

SEQ ID NO: 1137 - RNA, 114858 nt, Mus musculus
gcggugcauguuggggcggucuccuugggcaacgcuggcccgccagcugcccuguggcaaugccgcgagggcgcgguggcgguggugguggccugcgccaggccuccgccaccucugcgcccuuggcgagccccagcuacuacgaaagggugggccagcuccagcaggcucugcgggacagguacggccgcgggacggggcagggagucagcggcgccacugagagcaucgggguacgguguccggcccacuucccgccagugguucacuaguguuggaacucgccugcgacccccaacuagccccagaagggguuaggagcacaacuuuaccacggaugccccuuguuugaaagcgcagagagacuguaaucucucaugacaaccaaagccaggucccucagccugcggaugcggccggaagugagagugggaguuuuuuugccugccagucuugaucaaaccuugugaauuucuuuaguccucucuaguccuacaugcccccuccucacucucucuucaaguugucauccuacuuugacagccgcacugcaucaaagaugacagguccaggaacgcaggcuggaaugguguguguguguguguguguguguguguguguguguguguguguguguguguguguguguuugcgcgcgcgcuguagucuuuuagaagugucuggggcugacuaaauuucuaguaaaaggaugaaauuuucaacggguucagcuucgaggguugggauugccuuugauuaagacaugaaagaugagaaccauuggaaaaagcuagaucuaagaaugcauaaauagaaaaaaguacaaagcaauugacuauaaauaaccacauggaaagauaaguuguuggaacacuuauuuagcugccaaauuaauuggacuuagaaaucucauuaguugacaagaaaggaaauagauuuuuggaucuuuugauaaacaaaacauuuaguggguguuaaaguuacagaaucauucagaaggaacaggagggcuguaacaauucuaagaucauaacaguaauugcaggugagguaaaguaagugauuuuucaaaggaauugcaucuuacacuagacuuaauuuuugccaauuacuuguuaaguaacucccacgggcccuaacucuucuuuccguguuuuaucuucuuucuacauccguuuuuuuuuuuuuuuuuuccuucugacacaguccugcucaccuacucuagggaucucuuaaucucccacuuaagaaaaaaaaaauuaaccauuuaggcguauguuggugguggucuaugcugaagagacagaaauaggaggaccacagguucaaggccagccugggauacaagccagccagggcagcauagugagaaccuaucuccaacacacacacacacacacacacacacacacacacacacacacacaccuuuauuuuuccuacagagcuuuucuuuucucaauacuuucuaauguuugcaccuucagugugcuuagugagaucucagagagaauacaauagagagagagagaaugugugugugugcaugcacaagcacgugugcacaugcgagcucaagugugccuacauugagaauuuuaggugagaagcaacaccuuuugcucacuguguaguacaaugguggaggagguguuuuuguaaaauguuugaauuuauggguuaaauccaaaagucaauuagccagcgucuagguguuacaaaugccuuauguggaaugccaucaccucauugucacugaauaaugaucuuuuuuccaguuacccaagguggugguauuagaucucugcauauauauauguguacacauauauauaugcaucagcuaauuuaaaagcaagaacuuuaguuuuagugccuuuaucucauugucuguuguaguucaagagugguauaguuaccuuuggccuuuacuuauuuguguuuuguaggcaaagaucugcucuuaaaaugugacugauuuaaaugacauucuuuuugaacuagguuagugguaaguuauuuuugccuccuaugcuggaagcaccugguucuuuaugguccuuauggcacaauaacuguaaugauuauccacuuuauguuuagcacuuuuugcuuuaauuaggaagcaagguaagguuguugaaguuacauaagaaacuggagucagauuuuauggccuguucaugguccugcauuugaagauuuguuuuauuuuuaagucaguguaaaucuauugcucugugugaucauuuuucauuuuaagaaucuguaagugacucuaauuaaugcaugcuacacacaagauagaagcaaauaacucuagagagggagcuauaguaaaugaguaggaacaugaguucugcccaugacaagucaugagacuucaccaagggucacacacacacacacacacacacacacacacacacacacacuaaauguaauaacauuuuaaaaauuaaagccagucucaucauagggaccacuauuuccugaaaguccauguucaucuucaauauugugaauuucacagcaguuggaaaugcuuuuaucacuuuggaaacuuuggggaaucaggagauuaacagcaacaacaaguacaguucagccuucuuggcccuuuuagaggcagucauugaaauguuagcugaucugauaacugagcuuguucaucgaaacuguuguauuuuaaacuccagucauuuuccuguguauucccacauagguguaauuuuauagcuugaauguuuuucuauguguguguagugcuuucucuccauuguugugaaaguccguaauugaaucugaaagagucuaauggagugacauguugcaguguguauagugcccacaagugugguagaaacauauaagugcagcugauacuuaacaacuacuguauauaaaaacauccuuugaaagguccauuaaccagccccaguuauuuucaauggugauaccgauucagggcaacauaucauaaugguucagaauugacgcugagauauuagcugaguacaguugagggugauggaaaaccgugguauugagacacaaauugacuaaguuccuuaaaauguagaaaauucagcuuuguaagaacaggccagcugugaaaacccagaugaggguacaagugacugaaacaaagacucuguaaguaucucagguuugggcauuucagagauucugaaauagagauuugauauguaggcauuauuugauauguaaggauuauuaugguggucccaccaauaagccuucccucugacuuuuuacugagguaaauauccaguguuuagaccuuauguuaaaacucauaugaaggauuaccauuuggagaugcagcagcauggaggagggaguuagaugaggaguugacaaaaucagcaccauuuuuucguggaauagagagccacaaugugucugugguugcuaagauaugaaguguucagagagagaccagcagugugaccagcagguaucugcauccacaagagaaggaacugagaacagagaucuuuccaacauuauuaaaaagaauuugcaguuucggaggugauggaauuuaaaaacaaaacaaaacaaaaaacaaacaaacaaaacccaacauggcccuuuuucccuagauugcagaaucauuuaaaaaauauuuuaaaauagacucaaauuuauugaaaaguugcaaacaugggacaaagacccagcauuucccucaucaagauucuccugaagucccaacaauauuauauuuuuauuuucuuuucccauacacuuaccuaaaaucagugcucuucuguuaaauacuucaaacugugaugugaguaugugaugguccacgucauuaaaaccuucaauguacuauuaaaaaaaacaaaagaaagaaagaugcucuucuauauaaccaugguacagcucucacaguuacccuucagccuugcugugugucccuccacacacucaaugccagacauaaguugucuuagaaaccaauuugucuuaguaaggguaucuauuccuguacaaacaugaugaccaagaaguaaguuggggaggaaaggguuuauucagcuuacacuuccacauugcuguuuaucacuaaaggaagucaggacuggcaagcaggucaggaagcaggagcugaugcagaggccauggaggaauguuacuuacuggcuugcuuccccuggcuugcucagccugcucucuuagagaaccaagacuaccaguccagggauggcacccacaaggggcccucaccccuugaucccuaauugagaaaaauaccccacagcuggaucucauggaggcacuucuccaacugaagcuccuuucucugugauaacuccagcugugucaaguugacauacaaaaccagccaauacaauugaccccuugucaacuugacacacauacacaucacuauuaagccuuucuuucugguccuuucuggucuaggguuuaauugagaaacauggcuuacauuuggugugccauguugcuucugaccucuugggaugauuguuuagucugaccccaucugucauguuccuggcaauuucuuaaguauaacaugucuucuagaaggugaccccagguuagauccuuuagaugauucuucuugaucagacuucagucauucagcaguaauaccauggcgguauagagcccuagauguauuuaaagaucuuccuguccuuguaauuuaagcacaaauucccuauaccaucuaaccauuuguuuuucacaagucagacacacaauugguuauaaaacccuugaagguuuaauaaucaagaugucaguaaagauuucuaauguggaaauacauauaugauguccuugucauuuguauucugaguucaguuuguuuacuuccuuuuugaaacaaggucucauguaucucuggccucaaacauuuuuccuuaauuugagaaucccagucaauuuuuguuuuccagguagguuuucccuauguagcccaggcuggccucagaguacugauccucuucccauagccucugaagugugggucuacaugcauguacuacagugcuucacugaugcugagggucuugaguuuuugcuucauacuguuguuaccuuuguuucuucuacuugcuuguugauaggucuuucagccacccacgacauuuucuccuuuuuuaaauagauggaugugguuucagaggacaccauggucuaaauccacuaguuaauuaauacaauacagugacauacauuuucuguauuacagugaaaagaagagauuggaccuggaagacaagcuuuaugaauacaauaaaucugauaagugcagguaagagaugacagugaugguugucuagcuuuuuugcagcugucagccaaaauauaaucuguaccacagaggcaggcagaucucugugaguucgagggcagccuggacuacauagggagucccaggccaucuaugacuacauagagagacucuauuuaaaaagaaaaccaaacaacccuacuauuaugucauaguuuuuauagauggaauauuuuuaucauucuuuuauuuuuaaugcauaauaauuugaaguaaauccuauaguuuuauauaauuuauuaauaaacauuuuauuuuuauuuuguuuuuguauuaguucaggaaugugguuuugcuuaaauauuuuaaaauaaggcaguguagucuuuuuuccuuucuuuuugggguuuuugagacaguguuucuuuguggagcccuagaccuugaucuauagaccaggcugaccuugaauucagagauccaccugauucgccucuaggugcagaauuaaaggcacacacaccaccaccaaggcugucucuuuuauucuuauuucaacauguuuagcuucugcagagaguaaggcaugugauuuuuauagcugaucuguuagcuuuuaucauccuuuggcccuuuccugaaaaaaaggaggccccuugcugccccugggagggccuccuugcuucuucagcuagggaaggcaaguuguuuugaaaggcuccuuucacuuucccucggagcauucaccgagggaaauaugcugcaaucgccuguuuuccuguuaacuguagguagacaguuuucauacuugcacggcagaauuuaucaaugauugcuuagacggauggaugccagcuuuagcaagaauagcaagaaugagggcaugcuauugaaacauacaguaguauguuugggugagaagacaugguuacuaagcaccuagauaagaguaugucagggucuuccuccauuacugucauuugggucaaaaaugaagauaugggcaucaggggaaacagugguagauuguauuauccagaaggaaaacugaagucagccaaccacagcuaaagcacagugucauuagcaugauaaaaaccuucugggcuggggagaugucuuagugaguaaguccuggccaugcaagccuaagguauuaaguccagauccuuagagugcacauaaauccagacaugguggugcaugucuggaaucccacauggagacgguaggcagaaagcagaccauuucaggaauuugugagccaacuagucugguauaugcagugguggacagcuagagucccugucucaaacaagauggaaggugaggaacuggcaccugaggcugcccucugacuuacacuggaaaacacacucacacauaacucccuccccagagauagggggggauuucuuaaaacuuguuagccuagaguuagauauuuaaggucuauuguugauuaauuuuagaaauuucucucaucuccaaaaauuugcugggaagguaaauauauaugugagugagagaauauaaaauaucuuacuguaccaauacuauaaaugcuccauaauagguguccuuuaggguucagguaguuaugaagaaggacgaaaauuagcauauuggucuaagaagagaagguuguguacuuugagcucucuaguaugccuuuuaguauuacaacuggauaagaaucuccaaagauuuucucagaguugauauauuauuacaaaauauuucaguaguauguuuguugcagugucuacuacauuuuuacauuauuuaaaugauaguuuuuuguauuuuagauuuucaauuuucuuaauuuuuuggacuaccaguuuauaguuucauuuuauauaaacaauuaauuuaaaaauugguugucauauaaaaacugcccauaggcuauguaugccucugaauauggccaaagagacacuacucuuuaguccauauuucaguuuaagaaauacauuuagaacugggcauggugcuucacaccuucaaucccagcauucccaggaggcagagacagauggccaggcuggucuauagagagaguucugggacagcuagggggcuucacagagaagucuuguguaaaagaacaaaguaaagcagacaaaauaagaaagaaaggaauccaacccaugugucugggaaugcugcaguggggcaggguacugcacaccuguaaucuguacacuggggaagccaaggaaggaggguugcaaguuccagcccaucccaggcuguacagugagacuugucucaacaguacaugaaucucuacuguguuaccaaaugguauuguaugcauuucucaggggagguaugggaaucugugaccaaugcuauacaauagugagaacuauuugaauuuucuuucucuaaacuacauaugcauucuauuuauuggacuuugaguaaauuucuuagauuuuuaaucgucucauuaacacuuuuguuaaagaaaacuguucuuaaguuuguuugaauucuguuauuaaggcucuacuuuuuuuuuuuuuuuuuaaagagcuaagcugaaaugugcaaaacuaaagaaauaccugaaggaaguaugugagucugagaggagggcucagguucgaaaccaaggauauuuaaagaaguuugaauguguccagacguauguugaacacuugaccacaaauacagagaagcuucaaaaacugaagguaacauuuuguuuucugcucuguguuuugaaaagcuuuuccagaugaguggcaggcaccacuuccaguugucugaauaggguuauuuguugguagaaugugugaauuuaagcaucauuaaguuccuuuuugaaaccaauucccucuuuauagugaguccuuggguuuguuuguucucuuuggucugggcugcucucuucagggcaggaguccauuagggguggggagcacugagggaagacaugucccugggauaucaccuuccugcuucugggcucuggggugcaaugacugcuguuggagacucccuuucauucugguccuuaguccuuuccacgcaugcuugugugaccuuugcagcuuacuccaucuggagggccagaugcugggacuucuugcuugcugucuguaaugauaagggucauaguucagguuaacccaacagagcacucaaaaaaggugguuugagugggauuuucuuugugcuuuaucaguuuuucccuagccuaacuguauugcaaaauauucaaauuuauagaaaaaugaaaggacuuauucuaauggacacugucuccacucgauacagcaguuauaaguaugugucaguauuugcuuuguguacacaugugggguuuucuuucuaaguaguuuccuguuccuaucaugacacuucucuccuaagcucuuaagcacaaggguagugucuuuuauaauuagacucauguuaucauccuuaaaauuaacuaaucuacagugucauuuaauauuuagcucauacucagauuuuuccaguuccccuaaaaagccaacccacuagaguuuauauauuauuugagauauauauuguuaucaucaugauccuuuaaagucuauuuuagucuaauuucaaauuuuugaaaaacuauaagauguuuauuuguggauuuagaaaagaacauaauagacaagcauaaaaaucaugauaggacaucaguaaaucacuucuacacagugaaguaagaaacauacgugcacauuuuacuagcaugaacaauuguauuaaugaccaucacacacagguauggcaacuaccaauagacaaaccaauucauaauggaauuagaucaaaaaaaguagaaaaaaauaacuguggcuugugacugcuuugagcucuuuuuacuuucuuaauacugauuuuuaauuagguauaugugggacuuggucuguguguggguuugugcauggagguggaggagacaagagacauuggaucuccagggcuggagucacagcuacuugugauucucucaaaguagguugugggaaucuguguccucugcagggacaguacccacugcuaaccacugagccaucucucuagccuugugacugaucuucuaggugacugugauagucagucuaagcacugggaagagaucccuuaggaaucauugugggugaccuugaacagagaguguucagaaagcaagaaucucaaggaacugggcucuucacagacgcccguguacagaaggcugucccuuccuuuauuaagaggaucucaguguuucugugugugcagaaggcugucccuuccuuuauuaagaggaucuguguuucugugugugcagaaugccugugcacaugguagggcucugacaaugcauuugaggagucaggcuuuucucauaaaguggagaaaaauauacaggggcauuguucauaugcugauguacaggaauccugauggcagacccugagaaaagagaauugaguauaagccagcugcuccagaaguuagccauaauguaagaaauaagggcgggggagacugccuagugaaagaaaacauauucuagcaauuuuguaguuuacaaaacacaacuauagaauucuccuugcuuggguuuuguuuuaucauaucauacauuuaccacaauuuagguugaagucccuggaauauauuuuguuucacuaaucucagauguuuuguuuucuuuuuuucaaugacauuaguuauuuugaggaagucagccaauugcuugucacuuagaauuugaguuaucguuuccugguccagaauuugcccucaccucugacccuauccccugugaacugaaaaugugcuuuggacuagcacugccuggcagaaccuucugugucuaugcaauguucucugacaaagcaccaacuuagccagccauacaaaucugucaaauccugaugguguagcuugcacuccgcugcaguuuuaauugauuuguguuaauagucacagguagcucaugcuuccuguaguguccauuaaaagagugccuggcgucaugguucuguaggcgugaggcagucuucugaguuguuaguuaagaugguaaucucuggagaucuguuuuaagguaccuuagaacauaguaacuacucuguggagugauggcuuggcaucacuggaagaucauguuuucacuagauuuuuacccacugguuuggggaucugugacugagccuuccugagagaguuacuguaauggaggaagccagaguggcgguuuucaguuauaucuuccauuaacugacuuucuucuauaacaaaaagaaauuaccuccuugccccucccuccuuuucaauagcaugaugaacaugugaguuuuuauuuaaucagcauguuaucaguaguuacuuuuguuccuauuguucuauacauagccaguggaacucuguuuuuggacccuggggauugaagccagugccuuaaaugugcuuagguggcucccuuccugugugaccauuuggauucugagccuucuuuucuuuggggcauagcaagaugcuguuaagugugccucgugucuucucuacuaaagacaaacagccuuuucccaaugaguuguagugucuuuaaguggggaacaagaguuuagaaaccaacuucugggauuagcuguguuuaagcuugaacaaguuuugccucuuaguacuccaggcaaaugcuuaagguuaagaagcaguugccauuauccauauuguaaacuacucagagauuucauguagaaaauaaagcagugggcaaaacaggaauaaaggaaguaaaagaaaauuaccucuuauuuuuauaucauggucuuauccgauuauugauuucuucuuauaaucaaauguaggaggaaagauuuggaauaaucuuuuguaaauauuuuuaaauugagagcauuaguuauauaugacagauaugucuuagaaacuuguauaaugagcuaggaaagaguaucagcccaggggaccauuuuucagaagauaacaauaaacuguauaaaaauauggaaaguuuuguuuacacaaugcuucaaaaaucacuuagauuauguugcuuugaauuuuggguaagcaguucuuuuuugaaacaauucuguuggugagauuaaaaaaaaaauagaccauuuagcuauagauggaaggacuugguacccuugcagcacuaggaucuagcagucacugggaauccaaagcugcgugccugccauguguccguggaccccaacacuaaugucagaaaucgagguuugacaugggagaugcugaucuuuuaggccaguccccagcauuagccguagguacagcagagccaucugcacccucuuaaugcuuuucuacuuugaugucagaucuuuaccuccuuugcugaggaccuuagguaaguugcuuaaagagaaagcuauucagagugcauugcccacaccucuaaugcuauagaguuugucccugaauaaaggacaguuagugcacaugaggcauuuauguuuaauagugagucacucugaagauacagucucauuguuuagagaugugauuuuccuagacaguugucaggagguuauaugcucaagagggauaacauuugaggacaaaccuuuuaagagauuuaguuccugacuaagcauguaacaaauacugugggcaagcuaugaucuacccccgcuuuuuuuuuuuuuuagauuuauuuuuuauuagauguuuucuucauuuacauuucaaaugcuauccccuuuccuaguuuccucuccaaaaauccccuauaccaugcccccucucccuacuccccaacccacccagucccacuuccuggcccuggcauuccccuauacuggggccuagaaucuucgcaagaccaagggucucucuuuccacugauggccgacuaggccauccuaugcuacauaugcagcuagagacacaaacaagcuaugaucuuaaggguccuaaaaggaaaaauauguagcaaaucucauuuucagcaaccagaaugucuuucuugcuaguguauuaguugaauaaaaaagcauguucucucguaucuucuagugagauuccacuauccaggaaaaagcauguauacuggaagaaauagggggagagaaagccaaagauucaucugagaaucaaacugaacaauuugccacugugcccaucuugaguuauaauuuggaagugggggcacugaucuuaaauaucuuaaguguaguucaacuguccccucucaccuccagucuguaacuugagaaucagcugugcaauuucagaaaucagagagagaaauaagggaaaagggcagugagcauggagggauaucccagaaaccugaaauaccgguaaaaaugccugucucuuuccccaaggcccauccugucguuaacagcuccuagugauucagcugaaaucaauugcuugugcauaugcggaagcgaacggagagguccucuuaaauuaugagcagcauccccggugccaugaagcaguacagucccugauggaaugcacauggcuuaacucagugcuguucguuuauuaaaacggguuucccagacuggggagaaaugauaagggggucauccuagggauucuggacuagacgauucuacuagccaugaguuucccugccugucaaaucaauaagucuaaccauaaaauguccaugugucagaaagaaaauaaaagcugaaggggucuccauuaggaaagauacauucuaagcucugauguuuuaaggaaacagaaaaaaugcauaaggccugaugagagaagaaguuaggaaugaaacaagagaguggcaguugaaggagaagauacaaacaagggcauguccucugaugcuauuagacacuuugucacauuauauauuuuuagcaagaacaguuuugggaaaauuaaucuguauaauauuuuaggaccaaccuuaauaauaaauaaaaaacaaaacuuguuaagaccuguccugugaagccuagacacacuugaauccuccgucuccugccucugccuuccccugagugcgaggaugcgcugggguguguccauccuuaaauggacuuuuaaaaagaguagaacccuucgcuuaauugcagugggagagaagguggagcuagggagcauaguauagccugcaguuggaaacuuuuuagcauucagaagaucugguaauuacuaaauguccuauaaagggcaaaggaaaagaacagaauauucuagguggugauuuuucuaaaggguacagagauauauuuacuaucaauuuaugguagcaucacucugguuucaaaauuuacuaaacauuuuuugauccauaauuuagaaagaguucaguucaauuuucaaauguguugagaacaaucuagaucaggcucuugauucguuucuuacuguucuuuugaacucuuaugcaguuaucauuuacguuuugcuauaacauaauaaaucaaauaacccuugugagauaaacuuugcugugagaaaguugucuguguuugggagguggcucugaaaugacucccugaugaccagacuggucuaauucucacugaucagaaccgucuuauuccaccaucucuguuuacuucaucauccuacugugucauugcccggauccuuuaaacuguagcuacauaucuaugugaucacuacugaccucugguauguuaauggcaccuguuagaagaagacgucccuacaugcuauuaaaaaugcagaaaugaauaauaccuuuuaaaauguuaagguucaguuuggguuauuguugcuuaugcauuuuuuuucccguuaaaacacauuucagaccuauuuucuguucagucugaaagcuaaggaaccagccuuuaauuuauuaucugauagguauguuucagauuguuugucuaacugcuuaacucagaagcauccugauacuuagcugugaugggcugcaaucaguggcuuuuuaaagcuuugaguacuaaucuguugaaucaaaguacuuuucaugcugugcguuuuagagaaagacauuuuauuuuuugagucauuuucaucaguuauagugagguaaugaugcagaccucuugaaguuacuagugccagagcaaacuugauucagaugauaguagugacuacuuacacuauaaucuuauuccuagaaaauaaaacugauuuacugugaguuuggcgaucaugauaauguaagauguaauauguaauaacaaaugguaggacuuguuucuuuuuuaggcuuugaaaauagauaccuaauaucuaauuuuuauaaucauguaacuggauuuucaugauagcuuaaagaaaauaucaagcuguuuguauguguauauugaggauugagguuuuacuccauaaacagacagaagacuaaguaaaaauccaugaagccuuguuuuauuuuaaaauguauguaacauuuuauagaguucagcucuugguauauaugcuugugaaauugccugauugccuguuuuccaagguaaggugaauuucuuggcaaugucaguuuuuguuuuuuuuuuucucccuugaaccuuuuauguggcaaggaaggcaagauauaggugauuuuacuugcaauagcaucuaucacaaaacucgacuuuuuuauauuuagacugaauaugaggcugaagugaagaggaugcgccuccugucaaaggauagccugggaaugagugacgaagacggagcaaagguagcucagggaagcgggggauuuuauguuuccagaaaauucuuagaaugcuuauauguugaaauuuuaaauaaaaucaucuuauuauagagauuuuuugauagaacuaagauuaucuaaagaauuuuacuuacaagauauugucuuaaugucuaauuuaauuaaauuugccaaaagacaguuacuuggacuuaugauuucaaagaaaaccucaggguugcagaagguaaaauuguauuuucaugauuguuucauagcugcuuuuuauuggauugagaaauguuuuaaaugaaaauaaacuaagugugguuucuuuuguaugcauaauuuuguacauuugaaccuuuucacagacaaaguggaaagaaaagauugcauaucuaagcaauagacaaaaagaccagcaaggaauacuuaaauaaauucugccauauaucugcuguaauacaggcuucuaauccuucugccuaucuccauauaaaugauucugcucaagaccauagauguuuucuucacuaaaagcaguaaagcucuuuuagaugaaaugucuaaaaacaucuuguaauaacuuggagcaugcuggcaagaguagucacuugugacuaugugugaaacccccucagccagucgauauuguaauaagcagaaaugguagcaucacuccauuauucagagaagccaacagcgugcuuguuccuuaggcugcagcauucauuaagaaaagcuuacugggcugaaagcuggaaacagaugauaacgggauaugauuuucauauuuaaugcuuuccuuggaagaguaugugugcuacagauugauagaagaaucaacugcuacuuuacuaaaagacuuucagguuugcccuauagcuaccgauggaaucauucagccaagaaauuaacuuuuucuccuuuuaccugcuuuauauaucugcuaagcaggcugccuggcugccaguaaauguuauuaugcaguuaacuguuugguauuuaagacucuuaucagaaaagaaacagaggccacacuauuuuguuuuaugguagaaggaagguuuaguuuuccuuucuuccuugcauuagcaggcauuaaucugaguuuacaggaaguuuucguuuucuuuucccauagauuaaaaaguuaaaaagcuagaauuuagagcauucuuuaaacaguaagauacaaaacaccaagccccacaaccuugaccuauauaaaaaggccuuuaaugauaagugauucauacaccauuagauguagggcaaauguggugugaugugauagacuuccaaaccagaccgauggaaacuguuugacguuuggucaggaaauaauugacauacuuuuaaucuacaaaccaguuuguucuuucucugcuguucuugauagacauauuccuguuuauucuuucuccgcuguuccugauagacacauucuuaguguggcaguaucaaugacacuuaaguaaaaugggagagagccuccucacacacacacacacacacacacacacacccauuugcacuacugacuccuugccuugccuauaguuauggggucuccacuugauaauuagaacaggauauuuucuuuguacugaaagcugucguguccucaaaaacauugacuauuggcugcaauaagaaucaauuagauaacauuucgaggaacuuguaucuugccuuuucuaauuuucccuugauaucuaaucaauuaaaaaagguaaaugcacugcagcaaaacauggcuugguuaauccucauuaaaugcuaauuccugaaugagcccuuaucuuaugaauuagguuguacuuuuuauuggaauccaagcuccuccccuuuacgcagucagaggaauuugucucugugcccagucacugguacuuucuaaugcauagcauaguugugcaacuguucucuugagaagccacgguaggcaucuucaaggaugucuuaauucuugcuuucaagauguuucucacaaagcauuguucucucugaggcacggaguagugugaaggaaaugccacuuaguuauggggaugaacuugagcuguaggaggaagcugaggcugcuuccucugcagugaguaacacaagccuuacuagagggcguggugcuuugcaggcccuggaggagucacagaauguuggucuuugguauguguggccacuauugguagugauagcacuaccaguaaaagaguagaaacagggaagcccagaggucauuggcuaaucaggcugaaaucuaaagaggcugugggacacacuagcaaaugagcuuggacagggguaccaugaaauucaggcacccauuacuaaggcuuuauguuuaagaacugagcuuucuuccuagaacgauacugugugucuguguguaccuguauguguugggacagauaaagaagcauaggcagaacgaaccuggggaagucagggucaaaugagaagaaugaucugagagguauuaggguagccauugcagaggaagucucugauggaggagagagguuagaucaaagcuauaagacucuaucauaaaacaaugguuuuagggaugcagcucaauugugcuucccagcagcaaaagcccuugcuuucagucuaccaguacuccauaaaucaggugugguacacaucaguaaucccuguacuugggagguagagguagaaacauccaaaguucaggaugguacagaugguguucuccagggcuggagaacugcagagaaccaaagaagcucaucacaggacugaagguuacgugggcugucagcucugcucccguagggcugugggaggacagcucugcagguugcuaccccaguucuaauagcaguguuugcucuuccuccaugcugggugcuacaguggcacuuucucagcaucaguucauuuaauccuuuugacagcccugaucuuagaugugauugcuguuccauuuuauagcaaggguaagaaagguuaguuaacauacucagggcuauagaguuggauccaaaauucagacccaggccauuuugcuauaauuccuuccaacaaaguuuagggaaaugcucaucaaguuagggcagauucgcagcgagaugaaggaagcuuuuggugcuguauuuuuaccuuaggaaugaauuggucugacuuggugcucuaaguucagcugaauaagaugaacuguagugggcccaccuccaaacuguucauguuucaauaauaggaucaucuguucuaguuggcuugguucacagaagaaagaauuugaauggagaaaccuugcacugacaccagcgucaaggugagccugcuggucaucaugguagagcauugcagcagcuuuagccacugccuugagcuccuuagcaaaggcgaccuacccacuauuagagccagcccaacuguaggagaggcagcacccuaguguuagauggugaggaugauucuuccuugcucgaggagagaggcuacuguugugagcaucugagcaguguucauaaaaucaggacaggcucugcagugccagguuccucaccgagagguaagggagcguguggaaggaaaacugguauaaauacccuuggaagagggaaaggaauccuaaagcugacaugccccuaucgaaagagcaaauaacuugggaauccucugaaagcaaagcccaagacaaggauuuauugcaagugguuauuuaagaggugcucccaauggagggaggguagugaccgagaagggaaagcagccaguggguguaugaucgacuaggcuaucacugugagcaccuggcacugagccccacuggggacccuggaaagacuauacaaaacauguuccagaaguuuccugccuuaggggaaggaagagaaggcauuucuccuccagcuuagccacugagcuaugugucugacuccacuucugguugcuacauaucuaucaacagaagcucacuggccaagaagcauagguauagcauaggauaauaguaggcacguaccuaggauaaugagagcccaggacuuugggacuggcccucuucuagcugcugagaaauaagcggagaagguuacuaucaagagauaucuagaaaggccagcuucuuaccuuaccaguucacagugcuacccucaucauggcuuccugaguagucacugcucaaaaggaaacauacagacucuuucuagaguaagucugagcaguuggccuuugggggcuggugaccuucccucuggccuucucaaaguuaggaugguguuugacucugagccaugaugaauaaagacagucauucuguguucagcuuggugucuuuucuauuaauauuuuuucagugcuagggcugaacacagcccuuagaaaugcuuugugagcacaauaccacugaggcacaccccagcccuuuacauagccuuuuaauuuauaugcuaguaguucagaaaaauaaugagagacuaagcugaaucauaguaguuucucaagaggauugaguuauuuaaacaaauccaaagccuucuacaaacuaaguacacagacccauuuuuuucaggguuguguaggaaaugcuuuucucucagcacaccgacagagagggugcuaauagucugcuuggagcaaaggagaaagcucugagggccauucucuccaugugaaauauguguccuauuucaucugagcaacaggccagauggagccugcacuauugguacccugcuuccuuuugggugugucuacugggaagugugguucuaguuagagcuaacauuugcauuggucuugcuguauuucuacucucauuguagggauuuguguguggguauguaucaguguguguguguguguguguguguguguguguguguguacauacaacccuauaaacagccuuauaaacccacuauuuacuuuacagauuaggaaaugagugcucaaagaaguuaaguaucuuguccccaggucccagguccuaggucccaggugcuagagccugaaugaauccagaucacaauagaacagacugauuuguagucuuaaaaaaaagaagaagaaaagguaagaaagaggggggggagggagagagaggggaccucuuauuuuuguaaaguuuauuuuggucaagaaucugaauauguccaucuacauacuuuuuaguuacuguauaaaauaauuagcuugagaaaaugaugggaaagggccauucuuuuuuuuuuuaaguuuuauuuauuuauuauauguaaguacacuauagcugucuucagacacaccagaagagggcgucagaucucacugcagaugguugugagccaccaugugguugcugggauuuaaacuuuggaagagcagucagugcuccuaaccacugagccaucucuccagccccggggaagggccauucuuuuuuuuuuuuuuuccuucuuuuuuuuuuuaaauuggguauuuauuucauuuacauuuccaaugcuaucccaaaauccgccacacguccccccacccacucucccacccacccacucccacuucuuggcccuggcauucccuuguacugaggcauauaaaguuugcacgaccaaugggccucucuuuccagugauggccgacuaggccaucuucugauucauaugcagcuagagacaugagcuccgggggguacuggguaguucauauuguuguuccaccuguaggauuacagaucccuucagcuccuuggguacuuucucuagcuccuccauuggggaccccgugauccauccaauagcugacugugagcauccacuucuguguuugccaggccccggcauagucucacaagagacuuaaaggaacuucuuucucauaguauagacacccuuugugggaacuuucugcuagauaguuaucuuccuuugcucaauucuguggugagagugugugaaagcacgugaaguugcaaagguucaugcaagugggacacuuacacuuauauauagggcguguccuauggagcaaggaggaggugaaaagagugugggagggcaaugggaugcaggaaccagccuagcuaagacagcugugugcugugggaaaccgucuguuccucuucugacauaguauaagggaagcucuagaggaaaacauacauugauuuuguuguucuuauagggucugcuacaaaucucaguguacuuauagucaguaaaauacuauaucauuaggaaagccauucugugugcagaugaaagcuugcugugacagcuccuuuucuguucugcauucaacuuacugcuucucauuccccuggauguaggggaacaaaaagguaaaaaaaaauuaaaauguuccuagcaauuuucaaaacacugauguaaacaaauacaucacuuccuaguagaauaaggacaaagacuuaccuacuuugaaauuguaguuucuaaguacaccaguucuaaacuuguugauaucugugugccuguccccuuucucuccccuaguaaaaguagcuauuagagagccuucuggucaucaguaaguauuuucagcuauguucauuugcuuugcucuuacucuucccaguuccacaaaauuuuaggaggugggaagauggaucacuggggcaggaaaaggaagaacaaaguagaaaucucagauggugaauuugcugccagguuauaauauaacuacagcauaauagaaaggcauagucaaacuagacauuaugccagguccuuaaacacuuacugaucaagugccuucuuuuggcugugucucugagaagccuuugaguuccuuaugcuggugcagugucaacaagaaugaagaguugggaauucucccagggucagaaacugcucugagaagacucagaacuuaaaaggcuuauccuguugugaagauuaauuuuaaaagaaaagaaaagucuuagaaccugauuauagcaaaugggaaagcugccaaucaguagaagcccauuuuguccuucaccagaguguuuuauuuuucaaauguuaagucaguucaaguaugaaauaaccccauagcaaguggaaguuacuuacaagugucucauacaacuuuugauaacaaacuguuaacaauuaacaauugugaaagaauuuguuaaacacuugcuggcugggguguaaacagugcagccacuuuaggaaacaguugaacaacuccuagccacaaacuccauaccuauuuacuggaaaacauaucuuccuuaaaucuugaaccgaagugcacagcaggagcuuuuucaauagccacaauaggaaugauucaaauguguaucauuugaugaaaggacaaacaaaaagauuacauacuguguaauuucauguguacaaauugcucaguauaggcaaaucuauaaaguuagaaaaguuagcuguuuccaaggcggggaucuggcugaagaucauugaggaagauugcuaaaacaugugggguuucuucuuggagugauccaaaagguucuaaaauucuaacacuaguuauauaauucugugaagacacuaaauauuauagacuacccaguugugugcuuugaaaagguagauuuuaugauguguaaguuauauuuugauaaagcuaguuuuaaaaguucaaaucaaguugaauuuauuaaacugaaagaacaagacaauaacuauauuuacauuccugacauagucuuacaugagcacauuuuauuacucuuuaacaugaucuuuacuuagguacagcuuuguuucuuuguugguuuucauucaccacgucugagcauuccccucauuauuucauuaacuuucacggcucucauuuugaugaugucauaaugcuuccugaucauguauuuauagguugcgucuaaguucucuugauuacaaaugaucuagacgugaauuaguaggucucuacagugguuuuguuguuguuguuuuguuugguugggguuuuuuguuuguuugauuuuucuguuagauuuauuuucuuaagaauuuccacaccaacuuacugaaucaaaaagacucgcaaugcuagauuuuuuuucaaauauaaaugcaugugggcaguccucaaauuuacagucuuucugccucuaccuuccaagugcuugaauuacaaaacaugcaugauuguggucaucuuaaaaguuuuaagauuugcagaaaaguuacagaacuaguaugaggagagccucuguuccccucacucuguucucaccaccgucagcaucucauguuacagugucagaaguugauuauccaagaaagaaacacaagaacaugguuugcuagcaaguaaacuucugacuucaguuagauuuuuacuagguuuucuguuaauaucgcugggcccagucuaguacuuaauguuauaaucuuauuucuacuacauuauuuauuuauuuuguauauguauguguuuauguguaaaggcaugcauacaccauggugcacguguaggaauuagaggacagcuuaugggaguugguucucuccuacacagugagucucaggaauugaacucaggccaucaaguuugguggcagauacuuuuuuucaauaugauuuuugaaauuuuaauuuaacacauauaaaaugguuuuacauuguuuucagucuuguuuuaaagaaaccacacuuuaggagaguauuccuaauuauuuuguuuacuaggaagaacacuaggaaucaaucuuucugucucucuuucuuucauccuucuuucuuacaaaguagaaacacuucuuugugauuauacuacagaaaaugaauaauaugaauguaaccuuaaggaaacaucagucaaauacacugagagacaauaugcagucagauaaccuauauucuuaagcaaugucaaggucaagaaugagaaagaaaggcuagccaucuacugcagauuaauugagacucaggagacacgagccuaaacugaaucuucaaccuagaacaaagguaacuaguuauaaaggacauuacuugggcaauugacaaaaacuaugaacugcgaaauaggaacaaaauuauaucugcauuaaauuuuccaauuguaguaaugaagcucacucacugggacagagugcccuugggcucaaggaaaugcagaacuaguguacacauguaaguauacacacgcauauguauagagcauggaagaauggccaauagggaaaaugcaaacaauuggucagucuuguuaaagaguguuaggcuauuuuuuucuaugacuguuguaacucuucugugaguuuaaaauuguaucaaaucucaaauucccagacauagaugugcucacacacauuacuucaaauagacaaugacagcuagacauucaacagaccaaauuaaaaacuuaggaacucccucuugaguugucauagauccucaagaguuuccugguugaaugaugucccacugugggccuucguuuuuuaugugcaguuagggccaucuuacuguaacuccuaacuuaccacaggccucuaaacucugauaaccucauucauuaguauauugcuagaguuugugaggaauuagaauccaguauucugggaauucuggucauuuugggugaaucagagagcacugaacuacugcuucggugagcugugguuucccuuugcugggagcaaacuuguguuaacagagcaaucagagcaaucauugcuuucccuugccuugggucggaaccuucaugugcuacuuucccucauuguacaauggacaucuugucugaauuuggauugguucucuggguuuuguccagugggaauggaccugaagucuuuuguuucucuuagugggucagagagguuugagaauuacugguuguggggaauuacucagugauacuucaauuggucuuugcuuuguggcuuuuuacaccugagguauaauuggccuuuuguuagugucuugaucugucuuagaacaaaaaaagugagagaccauuagaacugcugaauccucugugcccugggguuaguagacaaucugguaacucccaaaauuggucuuaaaagcgaaaaaccaaaggacucugagacuuagauuugucaucuuugauuuaccucagaucacuauuaauagcuacugcuaugcuuccaaucaaggccuuggcacaguugguuagagcauuccauaguaguagccuauuccuuggaaccaucuauaugaacaguuuguuuguuugcuugcuuguuuguuuguuuguuuguuuauaauauggaaagaauuugagcuagaguaauaguaacagauaauuuuuacuuaggaugaaaacugaagaacugaaauucaaguaggucuugucugucccacauuuucauauucuuccacaucaucauuuggcacaagcauacuuuuccuauuuuuuuuuuaagaguuauguaugaaugcucuuucugcauguacaguugcgugccagaagagggcaucagaucccauuacagauaguugugagcaaccaugugguugcuagggguugaacucaagaccucuggaaggggcagacaguacccuuaacugcugagccaucucuccagcugcccccccuuuaauuuauauauuauguauacaguguucugccugcauauagaccugcaggccagaagaggacaccauaucucauuauuuaugguugagccaccaucuaguuacugggaauugaacucuggaccucuggaagagcagccauugcucuuaaccucugagacaucucuccaguugccucuuuuucuaaucuuaaauuagacauaugaaucaguucucgguaagaucauguuuguucacuccucccuaacguuuuaccuaagguggcuguaacuuuuuauauucuuugcagugauaacucugcuguccuuacauccuuagcuacacuuguuauugcuuuaauucuaacuguagcaguuaguguggucugauucuuuguguccuaauaccagugcauaugcugagaaccuuacccggagaccgagguauuggaggugugguuaaguuaggagugcagagccuucauacuugguucuagugcucucuugaaaagaccucucaagaguuuuugagccuugcaccacaugaggacacagugaaaaggcacaguucaugaaaaagaagccaugagccugugaaggaagcaguaguaacacaaaucuucccacuguugcugucagggcugcauuugagcacacaaccccggccugagguggugguaggaagcccaccaccguauuugcugcgaugucauggagggugguggaggaaguggcaacaaauccuccaguggguuaguuggcuucuuuggagcaugaggaguggguuacuaauacacugacugguauaaacccccugucuccauauuuaaauguggauccaugcuuucucguucaggauacugaugaauuuugccaacuggagcuaauaaaacccgaagcagauuuggauuagcuuucuuuaacauuggaggauauugcaugacagggacugcauuggggcagugaacggucuuugauucaaauugaaggaaacccagagcauggccugguccaaaccaagaaauguacagaucuugaauauggugucuaggcaggggacacugugggcuaauacucuggguucccuggcuuugcucuguaguguuuugggugcuaucauugagaaaacacggggugcagaagaugaccucaacauaguagcagcuggaaccaugacaggaauguuguauaaauggccagguggucuccgaggaauagcacgcagccaccuggcaggacugacacucaccagucccugugcauuguaaaacaacugggagcacaugaaagguucccugcuccagcagucacucugaagauuucugccaccucagaaauaggggacacuucauagucauccagauuaauuaauaugucagucuggcguugcuuucucucuuguaccuaccauuacuuugaacaauuagagagucugauuugcugugacaaagaucauggaugguuagccuggacugcacugcuugcccucagugaggggaagccaaacccuugguggcccacugaguauguguucucuucuccuuuggagaugaucuugcaucuccuauccccaaacuggaaaaccacuuacucuccaaauucaggucauacuuuuauuaccauguuaauucauuaaaaaaaucuaaaacuuaauguugcccuguuuuccaaauaaagggugaaaauagaaccacaaagaaaggaaaagaaaagaaaagaaagaaagaggagaaagaaagagaagagaaagagagagagagagggagagagagagagaaagagaaagaggaagagaaagagaaagagaaaaaaaggaaaagaaaaagagaagccuuauuggacccuaaaucugccacuacuuuugaucuugcucuuugcagccucuaugacugugggaaagauaucugauauucugagcucucuacucuuuuuuuuuuuuuuuuuuaauguguuccguuugcucuguuccacugggaauuucucaccuacaagcaugguagugaucuuuaguuucuugugaguccuugccucguuuuagugugaagaaucaguuucagagagugaauauuucuuccuugccuguuuuuacaaaaucuuggaaaugacuggcauaaauccuccuuuaaacacgugguaaaauccacuguucccagacuugucuuggugagaaauuacgaucacugagugaaucacuugaccuauaagucuguucagauucugugcuucuuuuugguaauaccuuucuaagaauuuauugaauuugaggcaguguuucuguuuauuaguauaaacuuacuccuggauuucuccuagauuuuuuaaugaaagauuaguagcaaauuaccuauccacuuacauuucugauuguagugaauugagucauugcucuuuucucuugacgagagcauucaaaagguuuuuaacugguugaucuuuucaaagaauugcaguuuggcuggcugcuucacugugaguggcucuguucucugaauggcaaguuugcuguuaucuuuagccuugcuuuggauuuaguuuuccuuuggaagcuaaugaguauagauauguuuugguuuauucuuuacuguguugaacucuguuauguagggucaugucuuucaucuaauuugggaaguuuucuucuuauuucuucagaacucuauuguuggaaagccuugugugaaaccgugcugcuuaaccaccuucagaaugaugggguuuccuggccaagcuaagccaagucuuuuccugagucugcacagaagacugacucaguuucagagggagaugaaacagauuugccaacauucaacaaagcagaaaucucaagaaaaacauuacaggggcugcagagauggcucagucagaauacuuggcuguucagaucccuagcaucuaauguaaaaaagcccgcacugugcuauacaugugcgaucccagccuagugaacagagacaauggagaucccuggaauuuacuggucagacagccccagguucagacagacuuugucucaaaaaaagaaaaagaaaaaaauugaggaagacaucugacaucaaucuccggccuccuugugcauacauacauaugcacaaacauggacacauaugcacgugacucccccauuuccuaagcaagcuggagcaccucccuccagcacuuuuuuaaagcuagauccgugcauauuucucccaguuuggcacuacuacaagacucagacugaccaaaaguaaaaggauuuggaaauagcuguagcucuuccuuuguggggugggagucugacgauguugccaagaugguuguggaaacaaugaacaacuaccguuuuggugaaagacuucagcuguguuguuuuaugccaacagaaaaaguacauguagagcuuuuaaaagaguagaaugugccauuuccuucgccaucauauccagcagugaaacgggauaaucagaauuggaaaugugggccaaaaauagaagagugauuuaaaaggaaacaaaaguuacuccggaagagauuagcugaagaaagaauucauuauagcguuccccauccgcuuuaccuuauaugaaagaggagguuucaggcuucuagaaggaaaaagagaaaagggcuucacggggcgcuccugacccuucugugaagccccauaccagccagggccuagccaguuuguaugccauuuuuagaaagacaaaucagaaguggcugaaacaaaugaugauaaagauaaugggauuguuuuuaaacagauuguguccauuguaaaagaaaauauccaaaagccuccacaccucuccacucagagacagaaagacaaagaggcaaacccgucagcgaugcugagugcgugcauauagcauguauucugaaaaacugugaugcucccauuaugggggcugacuguuuucuacaguaaaagacaagcacugaccagacuuuugaggaaaacaacuguuuguucuugugaggaaggagaguagagagugguuuggcugcugcaccccuccugaagucuagggccguguuccagugcagucacuuguucuguccucaucugguaucuucuaguuuucagauguuaugguuccccuuaaacuauaaaaggaucaccaauaacuguaaccuuucaugaccagcaaagaacgauucccaguccccuuugacuaucucuguacugguugugacuauuuaacccaaaaccuauugagauuucagcaucugguggcugaagccguaaguuauaugggagugagaagacaguccagguguuaguacaguuuguauuuguagucaaauacuaauucugauucagaaaaucuucuuucaauaaaaacguuacauugguuuuuggugaacuaaccugauuugguaacuaucaucuuauguuaguaucauuaguauggaauuguguuucagauucaaaccaugacugaaaaauagauauuuuuauaagauucauauaugagucaugcuuaggguuuuuagagaauaauaccuuuucauuuguauuuaaguuucugguacccuugaaaugugcuuauuccaaaguuguaaagauuauugcugccuucuucccccauagccuuucuuuucaucuaggcuuuaauguauuugauauuguaaaugguguucugaggcugaaagcuuucuucauucuuuuuugucucaaaugacacaauuucagucuaccuguuucagcauugcuaauucuguuaggucugcugccgagccccgagucuucauuucaaugaugguuuaaaugaucuaugucucuugcgcuguguuuuaaaccucaguuuuacucacuuuugcucacuuagcaagugagcuacaucucuagcccuauaauuuguuuugagacaguaccucacuguguagacagugucucacuauguagguugggcuggccuggaauucuccuugaauuccaugaggcuguccuugaaaccagggaucugccugucucugccagagugccaggauaaaggcauguccuaccauccacaugcuagcccuaaaauauuuucaaauucuuuugagaucguaucucauguaccucagucugacuucguaucucauguaucucuguguggcuaggcuggccuugaacuccuuauccuccuuccucuaccuccucacuucugggauugcaaguauaccuggcuucagccuauaauucauacaucuuuauaauguuuucuauuugagaacauugcauucucauauuuaaaaucccuuucugucucugucucugucucugucucugucucccccucucccuuguucaucccccuuuugagguuggucucaguaagcauaucuauuggcuucaaggucauucauucaucugugugccucuagagucagccucuggaugcuaggauacuuuuaauucuauggacaugguuuccuuuaacuguuuaggcuuauuuagcuaguuauagauaauuuaauaucuuuaucuaguaaguuuaacacuuggacuuucucagagauaguuucuacugaucagaaaugccuacugcaauagacagugugguuuuuuuuuuccauuuuguuuucaaguaauuaaauguggcaauugugaaaguucuacccucucaguaucuguuguuaauugccauuuguuuugugaccuagauauguggaauguguguguguguuuuauuuuguuuugcuuuguuugguguuuuuuguuuuguuuuuaguuuguuuguuuguuuuuggguuuuuugagacaggguuucucuguauagcccuggcuguccuggaacucacuuuguagaccaggcugguguugaacucagaaaucugccugucucugcccccaaguucugggauuaaaggugugcaccaccacugccuggcauguguuguuuuccauauguggucaaugagguuucuguuaaauuuacuuaauaaccauuagcuuucuuuggugccugagacuagaauugucgucaccuuugcuaagaguuucuagauauacauugcacauacccacacuccgcugagcaguucauagcuccaccuuggccuuuacuucuugcuuagagccucagagugagcuagaggugagagcucaggcaguuacuucauggaaacuuuuuuucuugaccauuuccuauagcuggggcauguggguggucaucuagauagagucucacgaguauacuagaaccuucuggaguucuucaacccaguaggccguacuuuguaugguacugccuugggcagcuuucacauuaaaaaacugguucugauuauuuucaacaaacuuggcuugggaucaaagcuauuugcacuggguuaguucaaagcugguucaagucaaaacagucuuuugcauggaguuccccaaggaacuaccagauagccaaaugaugacuguugucaggaaauggggccucgaaagaauucugccuccauuuuuuuuuuuuuuccaauggcugcuuggcuggguuuucucugugagcacaguggucaaguuggccagcaccugagaacccagaagcuuacuguguuuucaaggucuaacugguucucuuaaauaaaugcuccccagauuucuagaaagcuggucaaguuccagaguuccaaagagcuuuucaggguuccucagcucugcuacaaagcagagacuguuuagcacucuugauuucguuaccuugcucuggcauccuugaucugugugugugugggugggguggggggaaguggaggagugauuuuaguuuuguuauaccaagauuagaagagacaauguuugaagagacauauggccuggauucuguuguuguucucucuugacacuucuugucuugcaguuugguuguucguauuuccaucuguggaggaaaggugccugguccauuuugcaucuccccaccugcagugugggccugugggaaggaguacuccgccuguaggagugcucugcuccuucugaaagaaaagcacuuaacuucuaaagacuuguaguucagcuugucaccauguucucugucccagccauguuuucggcucagcuugccucugucuucucuccuuuuuccuacccuucaaagaccaggcucagaguuucccauaaacauacuaguaaauuuaaauuacuuaaaaauuucuuaaagauguucaggaaauuuugauuuugauauuaauauucuauauauguuguuauaugccuuaaugucauuaugaaggucaccacuggugguuuuuauuuucuacauagcacuagaaauagaguuugaacccuacuacucucuguccuauguauuccccugguuugcuuuuuuuuuuuuuuccugucacauuucuuuauagcaguguugaaugagcucuguguagagugcauucaaaacucaccacuuuuuagggauuggcacugggguacuauaugcauagccaaaaauuuacuaaugccauuuccuuucagccauguacuucagcugggcuaaacacaugcuuuuguucuucagaaaugaauuccauaguucauuggcaauaguugcugugugcagcaacauuguauuacaguaauaaucuggacuguagcggagcuggcuaauucauuaagugggagugcauguuuaucagugguaggaguugacauccauguuuaugcuuccuuucccuccuucccucucaacuuuauuacucauaugcaacaugucuaacucacaccucuucugcaggaugcagugcaggcaggaauuaacucggggacagcuaugucaagaggauuguaucaaccagcaacaaucuuuaugggccgccaaaugucagccaucucaagcauugaagauuucaguacagagcugaaaucuaaccaacccacaaagaacuuuucaaucucugacccacauucacaccaacagacagcccagagcagcugugugacagacagcuguguagugcagacuaauggugacacacagugcuuaaauaagucugacaaaauacauggaaagacaucucuucagacuggugagaaggcgccagucacaagcuauguauugucugcagaagaacaaacucauugcuuggagauaggaagcagcacacagcacagcaagaguaauuuaucugaaggcagaaagucugcugaacuccauuccucguuacaggaaagauuaaguccagagaacagcaucacugauuuaaagugugacaguuccagcagaucagagggaucagacagagaaauacugacacaagaacauauugaagucagggaagaaagagccggcccgcugguccccaugauggcagcuucagaacacuguacaucugcaaagaagugggcuggagagaagcauucugcuugggaagcuuccucaggugagaugacagaccgaguuuguuuauugauuuucauagugccuccuuuucucacugugaucuauaaauuucucauugaacaaagaagugacuuaaugaguuucauccuaaugacuucuuauauguguuuauagaaauguuucaaaagaugaauucacuaauuuuuaaaaucauguuuuaaaagcauuuaaaauauuuuugaggguugauaguguucaguccucaaaauagauggggugucaacuuuugaaaggaaggcuaccuaguuccuuuugaagaauaaaaauuuuuacugaacucuucuucaccccaaaacuccucacccuacauuuuugagauaaaggccuccuggaacaaccucaaaaugaaccggguacauugccaaaugauaggacaugauuccuuaguuacguagauuccuugauaggacaugacuccuuaguuacguagaauccuuuggcagaaccccuuguccuuuggcagaacucccuagugauguaaacuuguacuuucccugcccaguucucccccuuugaguuuuacuauauaagccugugaaaauuuuuggcugacggucgagacuccucuacccugugcaaagguguaugaguuucgaccccagagcucugugugcuuucauguugcugcuuuauuucgaccccagagcucuggucugugugcuuucauguugcuacuuuauuaaaucuugccuucuacauuuuauguauggucucagugucuucuuggguacgcggcugucccgggacuugaguggucugagugagggucucccuucgggggucuuucacuuugagacagggcuucucacugaccuggaguucaccaauuagucuaugcugaauggccagugaagcagagucucccugucucagccucagcagcccuggaauuauaagcauaccauggagccugcaucuuuaugugcaugcagggcauugaacucauggcuucaugcuucugaggcagacgcuuuguugacugagcuaucucccaguucugugcuucugugugguuuguugcuuugcgguuuguuuagguuugguuugguuuuuuguuucuguuuuugucuuuuucuucuccagucucauuguguagcccugggaggccuugagcucucuauguagaccauguugaccuugaacucaagagcuccuccuaccucugcugagaucaaaggugugcaucacaacaccacagcauucuauauauuuuuaaagggaugaaauucuguucuguguuccuuggacucucagaauuuugugaccagcaaugcccacauuucuccucucacagaugaucuugaccacggggacucaaagucacagaaggccguccugaaacaugaggaagagcaggaggagggaagcucaugcagcagcagcgaccucacaguuucugucagugaagaugaucugauucuagagagucuggccgcacugucgaauccaggagccaagauggcgggcaaagauggaaugcaggccuugcgagcggcccacacugaaccaagacaagauucgcucuucacggaauauguuuuacagacccaaagcuuuccugauucaaaaagggaacccuccccagauucaccaagacaguaagccauucuuuuuuucauaaucauucuauuuucaguuguacaugucuuuuagaguucaucccacuuggaaaauauucuugaauacucagcaaagauuguuuagguugccuaaucuuauaaguaggcuuuuggauaaacucucauuucuuuccuucuuucuuccuuuccuuuuugcaaauuuuaagguagcuuuuaaaaguuuaagugucacugaacaguggugauugaccauuuauaauuauacccaggcaauccuaguaaauguacaagucgcuugaccuaacucuuacccugauuuuuuucaaccccccuaccauucuucuuuuuuuuuuuuuuuaaaaugauguugauauuuuguccccaauaaaagaaaaauguaacugaacuuacuaggaaauucaacuuuaggaacucaaaacuuuuuaucuaaauauacacuuaaucuuuguauugcuuuccaugcuaucuuuuuuccccaugccauuaaaugagguaauacuuggcugaagauacagcucagugguuaagagcacugacuacuuuuccagaggagacccagguucaauucucagcacccacauggcagcucacaacugucugugacuccgcccucacacauauauuaggcaaaauaccagugcacauaaaauaaaaacaaauuaucaaaaaaauuagguaauacuuauccuugcuucucuaagucagacuuccuuuucuggguguaaauaugagaaucccugguguucaauuagagcuucagugugguacauuuugggcauuuaacaauguccaacucauaaaaggugagguauguguuuuuacaauuaauuggaaauuuuggaccaaaugaaaguuuuucuguauucucugaguacuagguauugaauacuucuuacuagguauugaagacaaauucugugauuaaaacaaaccaaucaaaucucuuuuaggaggagaaagagccuaaauaaauaguuuaagaaggccuuccuggccgggcgugguggcgcacgccuuuaaucccagcacucgggaggcagaggcaggcggauuucuaaguucaaggccagccugcucuacaaagugaguuccagaacagccaagacuauacagagaaacccuguuucaaaaaaccaaaaaaaaaaaaaaaaggccuucccuuuuauaagugaguaaacugagacugagaccaggaauguagcagugucacaaaaaccugggggcagaucaugggggugggggggaagcgagcuugccucccuaacuccugaugccccccagagagagagagagaggagagagagagagcgaaagagcgagcgggagcgcuugccucccuaacuccuaacccccagcuuucaguugcaccaacaugcugauugcguccauccuagcaguguggggcagugaaugucaaaguggauguucuuuucagcgcagaugcagaguauaaacccugugcacagaacuggcuggucgcucucauugagaaauuggauguguuucuuacauuaaagaacuuguacagaagcacaucggagacuuuaugacuagggaucgaauguguucuucuacuuuguguuugcaggcuuguuccucuggugaugugcugagcaggguuguaccuaggcuaacuuaggacuguugggguaaccuuuuucacauugugugaaggugugccucuguguuuucaguuguaaauucuaaaugcuaaaugucggcaggauuuuggugcuguuauuucuaugccccaauucuaugccagauuuuccauauauuuuguauauauuuguucuuccucaccugccuaaggcaaucuagaccugcauuagauugucucgauacugauugguuguaauaaagagcugacggucaauagcuggacaggaaggaggugaacagaacuucccagacagagagagggacacaggggaagaauacauaguuggagauucaaaagcagacacagagaggaacaggcagcaacugcagcagagcagagaaagauauagaccuagccacaagacagguuguagacuagaauaguuuaaguuaaacacuagcuggagacaucucagcugaagaccuaaguuuuaaauuuuacuaauagccucugcgucacuauuuauaccaccaguggcuugcagaaagucccacuauauaggacuugaugauuuucugagguaaaaaaguuggaagaugcugaaauuaagaauauucuuugucccaaucuccugcaugagugacuuuuuccuauaauccuaaaucuaagugccugaguuuuucaauauaguuuucaaacagucacuggaaaauaugggcacuuggugaauuuuucaauauucauauugauaacuccccuccucaaaauaaagagaugagucaacagucguucauugcugucagugcuguuaaauuuggguggcuaauucacucucuagaaaugagguauuagguugaaggggguuuucuuuuuauuacauuuuuuuuauuuaguauguauauggcaguggcuuggacaugcuauggcauaaauauaggucaaaggacaacuuguaggagucaguucuuuccuucuaucauguggguacuggaggugaacucaggccauuagguuuggcugcaagcaccuuuacccucaggccugaugugcugauguuuaugcuuuuaauuaaaaaaauaguuuuauuaagauauaauucauaugcgauucaagucucuguuuagaguacacaguucaauggauuugaguauauuaugccauuaauuuuaaguccuauaauaaauauauaacaugaaauuugcaauuguaaaauacacaauucagugacacuaauuacauucaugguguauaauuaaaauugguacucuaaauaagucuuguaaauaaacucauucuugccccuguuauguguaccuaauuccaguuagcauaugguuuugagguucaucccuguuaugucauguaucaaaaucucauuucuuuuucugguugaauaauauuuccauauauggacauaccacaaauaauuuguguauuuaagagucuggagagauggcucaggaguuaggagcauacaacccucuuguagagaaccugaauugaguuucuagccccuguuuuagguagcucacaaccuccuguaacuccaguuccaggggauccaauacccucuucuggccuuuguaggccagaagaaaccuacacaacaggcccacauauacauauaaguagaaaaauaaaauuuugcugaguaugguguugccuuacuuacauaccuuuaaauucaauacuuucgagacagagacagauagaucucuuugaguuagaggcuguccuguucuauguagugaguucaguaggaacuacauagugaaacccugucucacaauaaauaauaugcaagcaaauaaaaucucucuuuuuuaagccaagugucuggguaaguuuccagacccagucccauagaugcuuucagauauugaaaaccaguucauacaguuucuccagcaaaaguguaaugaagaaauucuucuucaaagaaaacaugccaagggcuggacacacauagcucagcauuuaaaggugcuugcucuacaagacugacuaucaaaguucaauccuugaaacccacuuaaaguuggaaggaaagaaucaacuccaaaguuuuccucugacguguacaugcacuuugugacaugccaccuuucacaccacacaugugugcaaguaugcauaaacacacacacacacacacacacacacacacacaaacaguaaauacauuuuaaaaaacaaaauauauacuaaaaugaaacaguaaagcaauuguuacuaaaaaaggugacuuugaaucuccuuauuuuaaagaauaaauaaauugaaguacaaguugguauguagccccaugguuugaagcauuaccuuuguuauauuccaugugacagguccauggucacuugggggccauaggagugacuuggccugucucucaucauuuggaaggucaguauggccugucauuaguggugguauagccccacgacagcaugaaggaaagcccaauuuccccagugcuuggcuuuggcuuuguucugugcuuuuagcuagaaucugggcuccucauguuaagcaaguguucugcuacagagcugacucagcccugcauggguggugugcaggggucuucuugcaucauguuugcugacauuacauuggauaaagagucacaugacccaguccaucucuuaggcucucaaaguugcauugcagucauguguacauggguugggaaguauaugguuuucuuuuucaguguguucuaaaacuucagaacaaguuuuagauuguucaagaaaagcucaacgaggauucagagagucaggaaagcuuuuguaggaggcucagugaaacuucuuggagucugaacaggcuuuaaguuaggaggggaagggcagguauacagacacgaaggacacugaagguaugggcuugguccauaccuucuuauccccugugagaacucacuaaggaggaauucuggaagugaaggguucuagcaucuacuagggcaagugcagauggaccuugaauaaugaguuugaaguucaauuuccaugucaugugggacaguugaagauuguuuuaagaggacggugugaggaguggcuugcuuuauaaggguuagacagcacugacuuccucaggauuaacucuacaugguaggcagaauucugagauggcuccaaguuucucgccucuuacugcacaucugcauaaucccccagccucaaaugucagagaguuugguagauuucauucuugacuauucuauauuauaugacacauaaaggguucugcagauuuccugaagguccugaaucaauugacuuuggguuagucaugauuagucaggugggccugaccuaaucagaugaggcuuucuaaaagagauuggauuuugagcaggugagauagacucagagaagcaaaaugccaucuuguaguagggaauaguuuucaugcuuuccaggcacggagcauuucaguucuccagagguaagaaaaggaauucauggauguggaccuugggugagauugcagccccagcagacaacuuaauuucaggcuggugagucuugagcaaagggccucagucacccauaucaagauccugaucuguagaaacugugagcuaauaaauuugccuuaggugccagaguugugauuugcuacacagcaguauacgguaaauauaagaauuggaagcgagauuugcaucucugcaaggauuguaugagcagaagcaccuguccauaauggcagugagaagguugagucguacguguaggcuucagugugagagcacauagagacaaugaauauaguugaggggagcccaguagccaagauaagccaagcuuucccucaccucucacccccguggucagaccaugguggguagagacaagaaaaguaguuguguagaucugugccaacagcagguuuucuccuguagugcuuuucugguuugccuccaggagguguagcauguaucgagcuucuuugucuuuuguuguucuuacaaacacauauauccacaucacaguaguaugcagaaugggauagaauggguuucauugucuagaaucuccgugcuccaucuacacagcucucuccuccuccuugaacuguugguaagcacuauccauucuuaaauauuaaauuuuuugaaaaaaaguuuugagauuauaauauaauuacacuauuuccuucuuccuuuccugcaccucccauguaccccuccccuugcucucucucucuuucaaauucaugguguguguguguguguguguuauauuccuaaacacauaaauacaacuuagucuguauaauguuaguucuauguauguuuccugggaugaccauuugguguugaauaagcaauugaucugggcuucccuggggaagacugucucucucuuuaagcauuucuuaguugccuguaguucuuggucuagugaugaggcuuuguggacuuuucccugucuacuuuggcauaucuauuauuguucuuguucaggucauauucugacagccauguugaugagacauuguagguauagcgucuaacauuccuaagagacaccaucucauagaaaacucccauucuugaagcccuuagagucuuccuaccccccuucaacaacaaccccugagccguaggugcaguuucuguguuguagauauaaccaucacaccaggcugcacaacugugcuuucugacuggugugguuuucaggcacuguucuuaccaucucuauagcuuuggauauugaguguaccagaggugaaagcacguggcaugcagccuuucagaauggcuuuuugaacaguauucaucuuagguuuccucuugucauucuguggcuugcuggguuauuuuuuuuucuaacaaugaauuauaguauagggauaugucacaauuuauauauucacuugcuuauuacuggguagcuuacagguuuuaucaguuauaaagaaaacuauuguaaaaguccauguacagguuuuuuguuuuuuguuuuuuuguuuuuuguguuaugggggacacacacacacacuuucaacuuaauuggauaaucaagagagcggccacugggccauugagcccagcuaagucucaguuuagcuuuaaaagaaacuuccuaauuacuguuccaguuuacauuaucaccaucagugauugagaauucagaucacuccuguuuguaucagcauuugcauuuuguuuucuuguauuuuguuuuguugguucuguuuuuaauuuuaguuauuaaguagauguguaguaucucauuaauuugcaguuuauuaaugugaaaagauaaugggauucuuuucauauacuuacuuuguaccuauauaucuuuaaugaaucuauauagaucucuuauccauuuaauuuuuuuauuuuaaaaaacauauguaugggcauucugccuacaugugugucucuauauuacgugcauccacacagaaacuagaagagugcauuggaucuguaacuggacuuacagaagauuuugagcuaccguguaaccacagagaauugaaccugaguccucuuaaagagcagcaacuacccuuaacuacugccaucucuucagccuucucuuuuccauuuuuaauccugacugcuuauuuuucuuauuguugaauuuuaauuaaaauuucucuauuuugaguacuagcuuuaauuuuaaguucuaguucuuuaugaaaugggagugugucuucucuugggcucuagccuuuuuuauuuguuguuguuuguuuguuuguuuuuuauuuuuauuuuccaggaagagauugcagagacuugguaaaauucauucucuguuugcuagcauuuaccaaugaagcaguuggaagguuaaacauugauuaagcuuauuuuauugcuguaggccuauuuaagugacguauuucuuucuauauugugauagauucuguccuuuaagucaucuguccauuuccucuaauuaucauauuugacagauauuuguucauauucuguucuuuuauucuccauuugauauuuguaacaucaguaauggagaccugucauuuaugaauuuugugacuucugauauuuguucccuauccucugcuagccagcuauaaauaaauauuuaucuucacaccacucccauacacacaccaauucuuuuguugaaacucuuaacuaccaauauaugaaauaaggccugugagaaggucccaaagguuaccugaggucauaaagguggcaccuuaaucucagagggcuggugccuuuaaagaacaccagacucuccucugcacauaaggauacauagaagguggccaccugcaggccuucucaggaacugaauuggucacccugaucuuggacuucucacccccccaaaacuaugaaaaauacaauugaguuauacccaccaagucuauaguaucucucacauauggccuacaaucauacuucuuaaucauaauauuuauuuuauuauuuuaaauuugucaagacaugugauauucucaguauaugcucucugaguuugaaauuagaucuugguggcauuggauguagugguccacacauuucaguuauaugucgcugaugcugcuguuuaguuugcccacuucaugacugacugacuguacacugggucagugaguacugauagagguggguucaagucuuaaacuguaauugugguuuuaucucuuuaagauucugccaguuuuaaucuaugcauucugauuucauugagcauggacauacuucuguauauagaauuuuuuuggcauuuaucuugauauucuaugacuuuuccagauucugguuugagguguacuaguuauuuuggacuucuuagucauuguugcuuuaaguauuuucucuguuucucuacuuguuugcuuuccuccugcuuucuccacagugggcaugcauaucauuugugguaguucauaguuccuuguuccuucuuucucuuuacaugucaguucuggauuauuuuaacuuuaucuucaaguuugcugaaucucaugcuuuuccuccccaucuucuccaucuugcccauguugacuccaaacuccggugcucaaggaagaaagaagcagugaccuuugucuugauaucucacuuggccacugauuccuugcuugcuuucuaacuauuuuugcaaugcuaggaaugaaaccuaggcugugugcauucuaagcaaacugccacugagcuacauccuuagccucuuggauguuuuucucuuuuuaaaaaaacauguuaaaauuucuauucucccaccaccaccccaugugugugugcaggugugugcuagugcuagugcauaccugugaagcucagaggacaacguuugggugucagcuuucucccccauugucagaugcgaggauugaacucaggcaaucagcuuuguacagugcauaugcaccuuugccugcuagagcagcuugcugcuccucuccuccaauuuguuuuuuccuuucuacuaguaagcucagcacagacuuuuuuuuaaggcagaguugggguuuuucacaaagauuuauuuuauuuuauuauuagauauuuucuucauuuacauuacaaaugcuauauugaaaguccccuauacccucccccugcccugcucuccuacccacccacucccacgucuuggcccuggcauuccccuguacuggggcauauaaaguuuucaagaccaaggggccucuccucccaaugauggcugacuagaccaucuucugcuacauaugcagcuugagacacgagcucuggggguacugguuacuucauauuguuguuccaccuauaggguugcagaccccuucagcuccuugggugcuuucucuagcuucuccauuggggguccugugauccauccaauagaugacugugagcauccacuucuguauuugccaggcacugacaugaccucacaagagacagcuauaucaugguccuuucagcaaaaucuugcuggcauauguaauagugucuggguuuggugguuguauaugggauggauucccggguggggcaguaucuggaugguccuuucuuccaucucagcuccaaacuuugucucuguaacuccucccaugagaauuuuguuccccauucuaaggaggaacgaaguauccacacuuuggucuuccuucuucuugaguuucauguguuuugcaaauuguaucuuggguagucuaaguuucugggcuaauauccacuuaucagggaguacauaucauguguguucuuuugugauuggguuaccucacucaggaugauauccuccagauccauccauuugccuaagaauuucauaaaguaauuguuuuuaauagcugaguaguacuccauuguguaaauguaccacauuuucagcauccauuccucuguugaggggcaucuggguucuuucuagcuucuggcuauuauaaauaaggcuguuaugaacauaguggaacauguguccuuauuacaaguuggaacauuuucuggguauaugcccaggagagguauugcuggaucuuccaguaguacuauguccaauuuucugaggagccgccagacugauuuccagagugguuguaccagcuugcaaucccagcagcauauuaaaguuaaauuauucucuuuucuaguuacacugucauaauuaagaauuuauuuucuuaaguuuucacuuuaaccaaaauuucuugaucauuugcuuaagcucaaugcucuguacugugagauaugggguuuugugacuguucaagcuggcuucagauucuucaguguucuuuugauucuaggugugcuuaugucuucuuuagacaaguaaagcaugaugggauagcugauauauggcuuauaacagccauguuauaacaggcagcuaaauuauaaugggcuauacaccuuucuaccauguuugccaguacacucaguuuugagcugugauccauccuauuagaaaucugacuucugaggcugcugugcuaaaggaaugauguguagaugcucuguuuucccagcugagccuucccauuucagcuguucccaccaaggugccagauacauaggagaagccuucugggacuugguuaacaagucauucuacaauaucaucaaaugaucucucaugauaauguaauacagaaguucauucaccaagcucugccugguuccuaacuuacgaaauugugagauacacuaaguuguaguuuuaaccuacugaguuuuggguguagcugguuauggaccuauaaauaacugacaaggcaguauguuaauugaacaguaagccugaaccucugauauauaccaggauugauuguuuuuacccuugugaugguauugaucaagcauguguagaagugggaagaaaaaaauauaaacugaugaacauuaugauuaaaaaguauuaugaaaaagaauaagaauguugaguagcuagaaaagacauggguaccuuuaauagaagguaggaagaaaaaguccuucuguuaagguggaauuugaggagagaccugaaguauauugggaagccauguuacuuguguucauauauucucuauccacuuaaucugcucugugcuuuaucuuuuauuuuugcccuguuauaauuuuuccuuuauuuauaaucccuuuuucugcuaucucugagaaagggaaggaagaacauaccaaguaaagggaaccacaccgaauagaggcugugaagaguguauuugggguuuccaagaagaguagaagccaguauagcugguccagaaaaggugagcucacaagaagccaagcaggagccagcgccaucaugaagggucuuauugugcaugcgcagaauuuuggauuauacuucagugaaaaugaagggccacuguugaagaacccaaauaacucuacucaaacuguucugguggugguggcacuguccucaccacccuacacacacacacacacacacacacacacacacacacacacacacggcuggacuacuuccaaaccucaaugugucuaacacucuccccucugauauuccugaguuauuacuuacuaaaaccuguauuccaucuuaacugcccagacccagacccagacccagaccugcagcccuccugggcugaauuccccaacacucacaacuguguuuucuguccuccauaucucuacuccuuucccggcauggaggcucacucucucccccugcuccuuccucaguccacugccuggggauccuaaguccugccucugucuccuugcccagccauuggccacuggcaacuuuauuuaccaaucaaaaccaacugguggggauagggucccucaguuucucucucucucucucucucucucucucucucucucucucucucucucucucucucucuuucuuucuuuauuuuuucuuuuuuucuuuuuguuuuuuuuuuguuuguuuguuuauuuuuguuuuugagacaggguuucucuguguagcuccagcuguccuugaacucacucuguacaccaggcuggccuugaacucagaaauccuccugccuuugccucccaagugcugggauuagaggcaugcaccaccacugcccggugauuuauuuauuauauguaaguacacuguagcugucuuuagacacaccagaagagggcgucagaucucauuacagaugguugugguugcuggaauuugaacuuaggaccugcagaagagcauucagugcucuuacccacugagccaucucaccagcccucaguuucuuauguguggauucucaugcauuuggggaaccaaauuaacuuaauauguguagcauuaaaccaaauccgcaacuuacuacuguguuagaaacugaagaaaaggguacaagcagcgagcccugugauccaggaagagagacugauaucuuggacuaggguggcagugguagaaugcugucccagcacugugauggcaagugcuuuuuauuaccagugcuggggauaggacccaaguccuuaggcuugucagacaguuuacucauugagcuguugcccccagcuucuucgccccauugcucgauuguuguauguugauguauguuuaauccuugcauaaguuccaccuaauacugguguguaaucuuuuugauguugacagugugcuugacaguugggaggaggcuuuguuuuguuuuaguuuugggguguuguguuguguuguguuuuguuuuugguguuuugagacaagguuucucaguagagucugcacuagcuuggaauucacuaguagaccaggcuuaccuugaaaucauaagauucacuugcuucucccucuguccccugagugcuaggauuaaaggcaugcaacuccacacccgacuaucaacaguuuugcauuaggaauaucaguuuguacuuuucuuuuuuguuguaucuuugucuggcuuuggcaucaggguaaugcuggcuuaaugaaaugaauuucaaacuuuccauuuuauaagaguuugagaaggauugauguuaaaauauuuugcagaaacuaccagugagggaggcaucagguccugagcucacacuuuaguggguagcugugagugauggauauauccagcuagacuuuuugucguucaugauuugaucuugguagguugucacacucccuccuuuauuacuaauuuuucuugagacuuuuuuucaauguguuuuauuuaaaauauuuuaauaaaguuaacaucuaaaguguuaguaauaaucuagcacuucuguucaugauuguagagaggaucucacuguauaucacaggcuagaguuaaacuuccucaucuucccuccucagccuccugaguaccaguuuacaggcguacaccacuacaccugauuuucaauucuuuuauuuuuggugugugaauaauuguaaauguuuuaauggguacagugugauauuugaauauauguaaguuaugauacuaucaagguaauugacauguuauauuaaacauccccuuuucuuaauuuaccuaguaauuuguaaguuuguauguauguauguggguguguauguguauguauuaugugugugccucuaaguauguaaauguacuguguguguagggugccuaugaggggcagaaaagguugucagaucccuugaaacuggagcuauggauaaugugaaugcuggaaacugaacuagguccucuacaagauuagcaaauguuaacugcuaaacuaucucucuagccucucagagagauuuuauaaaaaagacauuacuguggugcuacugaaguacuccaugcuagcaugcuagaagggaguggagagaaaaggaagagaggaggcuuaaggugacuaaggaacagagcuuagugagcaaacaaggcugauuucugucuagcugugagcuaaccaucaggccagauccucuuagagcuacagcaaaaguaggcuuuuuccaaaacaaauuugaguuucagaguaguuuauucugaguggaacaauuagagagaagacccugugagucagacccaaauaagguaggagagaacagaacaugggcagguuuccaagaaauuuaacaaguagucuucagagaaagacuggauaagucuagucauaucucaauagagcuuaaagucgucccugcuuagaccacagauaaaaguauaggaggguccaaauacuucuuuuuuuuuuccauuuuuuauuagguauuuagcucauuuacauuuccaaugcuauaccaaaagucccccauacccacccacccccacuccccuacccacccacuuccccuuuuuggcccuggcuuuccccuguacuggggcaaauaaauuugcguguccaaugggccucucuuuccagugauggccgacuaggccaucuuuugauacauaugcagcuagagucaagaucuccaggguacugguuaguucauaauguuguuccaccuauaggguugcagaucccuuuagcuccuuggguacuuucucuagcuccuccauugggagcccugugauccauccauuagcugauugugagcauccacuucuguguuugcuaggccccggcauagucucacaagagacagcuacaucuggguccuuucgauaaaaucuugcuaguguaugcaauggugucagcauuuggaugcugauuaugggguggaucccuggauauggcagucucuacaugguccauccuuucaucucagcuccaaacuuugucucuguaacuccuuccauggguguuuuguucccacuucuaaggaggggcauaguguccacacuucagucuucauuuuucuugaguuucauguguuuaggaaauuguaucuuauaucuuggguaucuuagguuuugggcuaauauccacuuaucagugaguacauauuguguuaccucacucaggaugaugcccuccagguccauccauuuggcuaggaauuucauaaauucauucuuuuuaauagcugaguaguacuccauuguauagauguaccacauuuucuguauccauuccuuuguugaggggcaucuagguucuuuccagcuucuggcuauuauaaauaaggcugcuaugaacauaguggagcauguguccuucuuaccaguuggggcaucuucuggauauaugcccaggagagguauugcuggauccuccgguaguacuauguccaauuuucugaggaaccgccagacugauuuccagagugguuguacaagccugcaaucccaccaacaauggaggaguguuccucuuucuccacauccacgccagcaucugcugucaccugaauuuuugaucuuagccauucugacuggugugagguggaaucucaggguuguuuugauuugcccaaauacuucuuauucuuccauuaaaugucacuuugagaugucaaaucugugcaucauacauuguagagcaagggauagguccaaccuauauugugcccuacucauuuccaaauuccugauccacagaaaccaugagcaucauaaaaaguaguugguuguuuccaccacuaaguuucaguuguuuuauggcaucauagaccaugauagguuaguuugguuacugaaagagguuggccauucugaauugcagggaagggcugcuauggcaacaaaggcauggagauagccaguaaggcucuugucugagaaaaugcuagcuacuucagcucaccagugcccagcagcacuaaaaggaugucuucaggagcagcacagcucuucccuguccuuccagccccaucauaugagcacucacacaguccuaacucaugauggccaggacaugccaagggcaaggaugcugcuguuaguucguuaacauuaaaacacaauuuuuguuuaauuuuuaaauuuuauauguauggacaguuugccugcauguaugccuguauaccacauguggauaguguccaaggaggucagaagacagcaucauaucccccugagacuagagucaaacauaguuaugagccaccauguggguacugggaauagaaccugaguccucuggaaaaacaaucagaucuuaaccacuaagcuauuuaucucuucagcccuggcucacauuugggggggaaaaaaacaucaaaagaagacuugacagggcagaggcaggucauagauuugucauuuugcauacuucuuaaauauguuuuaaacaaaaauaaucugaauuguugacaagccuccauaaagggucuuuuuccaguuagcuuucuaagcuuguacauucagcucuuagcuacacugaugugucagaacauuauuggagucacauaacaggaguaccgugucagaaugucuuaaaaagcagacacauuuguucugccagauguauagugucccuugguucuuuauucacuucuguccacagacacacagguacuuucauuuuucugucuagucguuuucuguuggccucaucaugaggccacgagcaaaauggcaauagcaguuuuauuguggauggaaucuuuaaucucuugugugaugguauguggaggugaggccuuugagaaguaauugggauuagcugaggucacaagaguaggguccucacgauagaauuaagugcucuuaagagacaaggacauaggaaagcucuuuccuccauucugggagaccauaggaagaagguauccauuugcaaauaaaucuagaagugguuccucuccaggcugccccuugauuuuaggcuucccagccucuggaagugagagguguugauuugggucacugaagcucuuugucuacagcacuuuauuguauuucucugagaagucuaauuuacuagaugagccaacgauuucaucuagacucuucagcuuucaaagauaagaagaccccccuccuuuuuucguuugugaagaacagggaaauccuucagcugaacugacaucucuucauaucauauuuggucacagguccauuaugaaaauauccuuggcaguguauuacaauugacuuaaaguagaaaagaccuuuuuuuuuuuuuuuuuuuuuuuuuuuuuuuuuuuugguagaagacuaaauaucuucuacacuaauaguuuccugacccuuggcuuagacuuuuuaggaucuauaccugacucagcauggagcucuuucccucugaguauuauaugagaagauguugauuacuaaccaaagaugagguuccaugaaaaggaagauggggaagggacauugaguugucauuugcacugucacugaaguuacucaaaagaggagcuuguagggcaaggauguaguugaguggcaggguguguauuagcauacaugagguccuggggaagaaaaaagagauuguggcugcaagaaagagccagacagagaacuugcaauaaugaugugauauaaagacagaacucuacucagggaguuuuauuuuguuuuugguacuggagauugaaccuugagccugcucuuacacuaagucauuuaggccagccuuaaacucaccuagcccagacagcccuggaacuauggcccuguugucuuagccugguuuacagggacccugauuacagcucugugccaccaggcuuaguucuaaaaaaauucuugacaugugacugugguggcuuuauaguaagaaugccacauuuaacaauguuauaauaaaagaauaccacuuuuauaaucaaagggaaaaagugaaguagaauuagccuucaaaaucauguuuuguagauguucuagacugaaauuguaugguagcuguacaaccuaggaaguuauugauaaaaauuacugacauaguuacuuuagauuuguuaauuuuauaguaugugaauuauaucuuaauaaaacuguuuaauaaaaauagugucuccuggcacuagagagguggcucagcaguuaagagcgcuuguugcucuugaucucugcaagagguucaguucuaagaacccauauauacagcucacaaccaucuguaacaucuguaacuccaagagauccagugucuccuucugaccuucauaggcaugaggcacacacaugauaugcuuacauagauauaugcaggcaaaaaacauugauacacauaaaacuaauauguuuuaaagauuuaucuacuuauuaauuugauauauauauauauauauauauauauauauauauauauauauauaugcuuuguuuucaugaauaccagaagaaagaaucagauuccauuacauaggguugugagccaccaugugguuguugggaauugaacucaggaccucuagaagaacucuuaacugcuaagccaucucuccagccccacaaacaaauauuuuuuuuaacauuaaacaaaacaaaaaacugucucuugaaccuaaaacuuaaauacauagaccauagcuauuagguguuugcucauggaggcaaaagcaucuuuggcucuguugguaacacgcaucacagcuuuuaucuguggccaugaaaaucaucauauagugggaaugcucccuggguggggcagucucuggaugguucuuccuucugucucagcuccaaacuuugucucuguaaauccuuccaugaguauuuuguuccccauucuaaggaggaaugaaguauccacauuuuagucuuccuucuucuugaguuucauguguuuugcaaauuguaucuuggauagucugaguuucuaggcuaauauccauuuaucauugagugcauaucaugugaguucuuuugugauuggguuaccccacucaggaugauacccuccagguccauccauuugucuaagaauuucauaaauucauucuuuuuaauagcugaguaguacuccauuguguaaauguaccacauuuucuguauccauuccucuuuugagggacaucuggguucuuucuagcuucuggcuuuuauaaauaaggcugcuaugaacauaguggaacauguguccuuauuacaaguuggaacaucuggguauaugcccaggagagguauugcuagaucuucugguaguacuaugucccauuuucugaggaaccaucagacugauuuccagagugguuguacaagccugcaaucccaccagcaguggaggaguguuccucuuucuccacauccacgccagcaucugcugucaccugaauuuuugaucuuagccauucugacuggugugagguggaaucucaggguuguuuugauucccauuuuucugaugauuaaggauguugaacauuuuuucaggugcuucucaguccuucgguauuccucaguugagaauucuuuguuuaguucuguaccccauuuuuuaauggaguuauuugaauuucuggauuccagcuucuugagcuguuuguauauauuagauauuaguccccuaucagauuuaggauugguaaagauccuuucccacucuguugguggccuuuuugucuuauuggcggugucuuuugccuuacagaagcuuugcaauuguaugaggucccauuugucgauucucaaucuuucaacauaagccauugcuguucuguucaggaauuuuuccccugugcccauaucuucaaggcuuuuccccacuuucuccucuauaaauuucagugucucugguuuuacguggaguucuugauccacuuaucccgucccgcgggauucaguuauucgugggugcgagggggaccgcaaaccuggaaggaaaugggaguaaaagaaagaagagucggaggaccaaguagauugaaccuaucaaggucucguuuauuaggcugaggugccuucuuuuuaaagcauacaucgcgggggaauaugggaggggucgagggagaauuauacaaagaacaaagaagugggcaucugcugacaugggggcccgaagucaggcgccaggcagcaggcacuuugcaucuuaucuccggaaccuugauccuccucaaaagccuugggagucaagcugggcucaggcuuagcucacguccuuggaugucaugggaacucaggaagagauaggggagaggggacuguuauucaaaucuagcagccuuagguguuaggaagagaacaaggaggaaagggggguggcaaccagcucuuaguacaaggcccuuugauuuguuaaggagauugugaagggcucauuuucucacgggauggucucugacacacuuagacuugagcuuuguacaaggagauaagaauguaucaauuugcauucuuucuacaugauaaccaccaguugugcuagcaccauuuguugaaaaugcugucuuuuuuccacuggaugguuucagcucccuuaucaaagaucaagugacuauagguguaugggcucauuucugggucuucaauucuauuccauugauuuaccugucuguugcuauacuaguaccaugcaguuuuuaucacaacugcucucuguaguacaguuugaggucaggcaugguaauuccaacagagauucuuuuauuguugagaauaguuuuugcuauccgagguuuuuuguuauuccagaugaauuugcaaauugcccuuucuaacucagugaagaauugaguuggaauuuugauggggauugcauugaaucuguagauugcuuucggcaggauaaccauuuugacuauauuaauccugccaauccaugagcaugggagauuuuuccaucuucugagaucuucuuugauuucuuucuucagagacuugaaguucuuaucauacagauauuucacuuccuuaguuagggucacaccaagauauuuuauauuuuugugacuauugugaaggguguugucuccuuaauuucuuucucagccuguuuauccuuugaguagagaaaggccacugauuugaguuaauuuuauauccagcuacuacacugcaaauagugauauuuugacuucuuccuuuccaguuuguauccccuugaucucuuuuuguugucucauugcucuggcuaggacuucaaguacuauauuggauagguagugugaaugugggcagccuuaucuagucccugauuuuagugggauugcuucaaguuucucuccauuuaguuugauguuggcuacugguuugcuguauauugcuuuuauuuuuuauuuuauuuuauuuuuauuauuucuuuuuuuuuggugguggggguggggguugagacagcauuucucuguauagcccugucuguccuggaacucacucuguagaccaggcuggccuugaacucagaaauccaccugccucugccucccaagugcugagauuaaaggcaugcaccacuuauguuuagguaugggccuugaauucuugaucuuuccaagacuuuuaucaugaauggauguuggauuuugucaaaugcuuucucagcaucuaacgagaugaucauguguuuuuuaucuuugaguuuguuuauauaguggauuauguuaauggauuuccguauauuaaaccaucccugcaucccugggaugaagccuacuugaucaugauggaugaucguuuugauguguucuuggauucaguuuucgagaauuuuauugaguauuuuugcaucgauauucauaagggaaauuggucugaaguucucuuucuuuguugggucuuuaugugguuuagguaucagaguaauuguggcuucauagauugaauuggguagaguaccuucuguuccuauuuuguguaauaguuugaggagaauuggaauuaggucuucuuuaaaggucugauagaacucugcccuaaacccaucugguccugggcuuuuuuuggucgggagacuauugaugacugcuucuguuucuuuaggggagaugggacuguuaaaaucguuaaucugauccugauuuaacuuugguaccugguaucugucuaggaaguuguccauuucauccagguuuuuccaguuuuguugaguauagccuuuuguaguagaaucugaugauguuuuggauuuccucggguucuguuguuauuucuccuuuuucauuucugacuuuguuaauuagaauacuguuccugugcccucuagcuagucuggcuaaggguuuaucuauuuuguugauuuucucaaagaaccagcuccugguuugguugauucuuugcauaguucuuuuuguuuccauuugguugauuucagcccuaaguuuauuuccugcugucuacuccucuugggugaauuugcuuccuuuuguucuagugcuuuuaggugugcugucaagcugcuagugugugcucucucuaguuucuuuuuggaggcacucagaacuaugaguuuuccucuuaggaaugcuuuuacugugucccauaaguuugaguauguuguggcuucauuuucauugaacucuaaaacgucuuuaauuucuuucuuucuuucuuccuugaccaaguuaucauugaguagaguguuguucagcuuccauaugauuguuggcuuucuucuauuuauauuguuauugaagaucagccaugguccuuggugaucugauaggaugcaugggauaauuucaauauuuuuauaucuguuaaggccuguuuugugaccaauuauauggucaguuuuggagaagguaccaugaggugcugagaagaagguauauccuuuuguuuuaggauaaaauguucuguagcuaucuguuaaaucuauuuguuucauaacuucuguuaguuucacugugucucuguuuaguuucuguuuccaggaucuguccauuggugagagugggguguuaaagucucccacuauuauuguguacggugcagugugugcuuuaagcuuuacuaaaguuucuuuaaugaauguggcugcccuugcauuuggagcauagguauucagaguugagaguucaucuuggaagauuuuaacuuugaugaguaugaagugccccuccuugucuuuuuugauaacuuuggguuggcacuugauuuuauuugauauuagaauggcuacuccagcuuguuucuuuggaccauuugcuuggaaaaauuguuuuccagccuuuuacucugagguagugucugucuuugucccugagguggauuuccuguaugcagcaaaauguugggucuuguuuauguagccagucuguuagucuaugucuuuuuaauggggaauugaguccauugauauuaagaaauauuaaggaaaaguaauuguuacuuccuguuauuuuuguuguuauaguugggauuuuguucuuguggcuaucuucuuuuagguuuauugaaggauuacuuucuugcuuuuucuagggcauaauucuaauaggucuaccuuuacauguuacuugaccuuuuucccuuacugcuuuuaauauucuaucuuuguuuagugcguuugcuguucugauuacuaugugucaggaggaauuucuuuucugguccagucuauuuggaguucuguaggcuucuuguauguucaugggcaucucuuucuuuauguuagggaaguuuucuucuauaauucuguugaagauauuuacuggcccuuuaaguugaaagucuucauucucaucuauacauauuauccuuagguuuggaucucagauccaccuccugguugaagaugaaggcccaaaggagcccucuucaaaaaucucuguugcuucuucagcccacacccucuccugugcggacuggucucugagggacccuggguacaaaauagcgaucucaccugagucccugggucagagcccuccuuggaggccaacuuuccucugguggggaaggugcccagaggucugugucuuagcuccaucucuuggcagagggugaaggccccaaagggacccucuccaagaagcucuguugcuucuguggcccgcaugcuguccugugaggacuggucucugagagaccugggauacaagaugaugcucuggaggccaacucuccucaaugauccuaagauccugggugugcuagggugccugcggucuagagaguccucugggguccuugggaccgucugcugaguuugcccccaugguagcaugaggccgaacucaagaagucuuauggaagagugggggauagaaugagcaagccagaggggucaaggacaccacaagaaaaccuacagaaucaacuaaucugagcccaugggggcucacagagacugaaccaccaaccaaagagcaugcaggagcuggaccuagccucucuccucuuuuguagcagaugucacaauuuuuuuuuaagggauuugaaaguaauauugaaacuugauagcuggaaugggagaucuacccuucagugcgaggcaaguguaaaaggcagauaggccaaauggacagagugaggccuauugcguuucugcacuuuuauacugaacguuacuacuuugauucuuggaaaggacagagaauugcccacauaggauauaugaugagcaguucugaagcccugucuuucuugacuuuaaaagauugucuaauuuuuuucuuuuucuuuucccaauguaaauuuguaaauuuggcuaucuuuuuaaaaauaagcuguaugauugaauaugguaagagugauuuuagauuugaacuuguuuccucuuuuucauggugaauuuuaaauaaaguccuaaauuauaaaggaaaugaaucuuuguaauuuaggaaauuuugucaaaaucauccuacuagaguuggaacaauuggucaguugcucuuggcauggcauucugaggaguugugaacaaauaucuauaaaccccagauagguaccaauauagaccaaaggaauuauuccauccauguccagcuuggugaaccagugagguuauguggcuucguuacaggaauaugagugacccccccccccaaacagcugcaccacuggaaagaaacaugggugaaaguguccauuucacagccccauaagugaagugcagaggcccucuacaguaagccuaucuacugugcacuccagcacuucccagaggcuucgugcaucugggagggaguggcugugauccagauagaugagugucuaaugacuucccugaucuucuccaggggaguguuaauagaccacauuuugcaugacugaacauugccacuccaauugcaagaugggaacagcauugugaugcccugaggaucaugaggauagugacccacaacugugguagaagagugcuugccuagccugggaaaggccccgcacuucacucaccugaaaaaaaaaaucccuuuacuaaaauaucggucccugcuagaguuugcuuacuagaagauaacaaaauaaaugaaaaagaaaaugaaaaagaauagcauuuuggaaauagaugauuuuguuagcauggauuuuuuuuuaauuuuuaauuuuuuuuuagaaaucauggccauaugugccagugguuugauucuuauaacacacacacacacacacacacacacacacuaccuacuaguaaauguuuuaccaauuuauguauucagugauauuuugaaaaaaaaaauugggagcugagacaaaaggauggaccaucuagugacugccauauccagagauucaucccauaaucagccuccaaacgcugacaccauugcauacacuagcaagauuuugcugauaggacccagauauagcugucucuugugagacuaugccagggccuagcaaacacagaagugcaugcucacagucagcuaauggauggaucacagggcccccaauggaggagcuagagaaaauacccaaggagcuaaagggaacugcaacccuauagguggaacaacauuaugaacuaaccaguacccgggagcucuugacucuagcugcauauguaucaaaagauggccuagucggccaucacuggaaagagaggcccauuggacuugcaaacuuuauaugccucaguacaggggaacgccagggccaaaaagggggaguggguggguaggggaguggggggcagggucuggggaaauguaaaugaggaaaauaccuaauaaaaaagaaaaaagggaaaaaaaaagaaaaaaauugugaauuugagucuucugcaucucagugauugaaaaccacugcuuuccagacaaugguuggguccggggccuugauauucuuuacuggaaagcugguuaugugcuggucaccgcugcuucaguaacaucaucccgucuuuaguuggggcugcaugugaaauugguaucugccauuuugaaaaaugaaaacauuugaucaacuaaccuggcccauaaggguucacagagacugagcuaccaaccacagagccugcauaggacuggccuaggcccucugcacauaugauacaguuauguggcuuggucuucauguggaauauugggaguaagggauaucucugacucugucgccugccuuugggacccuuuccccuaacugggcugccucgucuagccucaauaggaaaaguugugccuaguccuacugcaacuggauaugucaaagcagacugauauccauggggggacuccuguuuucugaagagaaagggaggaggaauagaugggggaggaggugggaggagaggagggaggggaaccaguggucagaauguaaaguuaauuacuuaauuaauuaaacaauaaaaaagaaaaauggaaacauuuggacugugcgcacauucccugaacucuaauaacugaguuuggagcacuguguucaucuggcucucagagagccaguagcuucuguuguuuucuuacugcauuggccugcugccuuuuacaauucguccaucuguuuauucacgacaauguggguuuuuccacuuguuccuuaucucaucuuuuuguugguggcuccuuucagcagcuucuuaagugaaugaguauuugaaucauaaauugauccagcacuuuccuuuaagcacagugcugacugacucugaaggguucagcuauagcccagcacagucugucagcaguccucucuugcaucaacuguacucagcagaggaggcuaauguuacuggcauuggguccuuuggaggguaccugcccuggcugcuuucacuuccuugguacccuaaaggugggccuagcgcagagucagaacacugggaaggacuugcuccacuccucuuaucaccuccccaccccccacccccgagcuagcagaagaugaggcucuauggugaacucauucccaguccuuagaguuauuuggccuacuuagagacucauuuauccugggaaaaugauguauuucaaggaugugugcauuuuaauuuuguaucuucauuuugucuuguuugagauagugucacuuauaacccagacuggucuuaaacuuacuaucugccgcagaccuuuugggucccuaugucugcguggaacggguucucucgacgcgggugggcaaagcguggaugaugacagacagacacacacgcaggagaguuuguguggaaucugaauguaauuuuacaacucgagcaucagacuuuuuaugcagaggacaauaaggaaguugggugacauauucgcaagguacaauugagguaaccagaaucuuacauaaaacagaggaaugcaaacacaaaaggucuaacgggaaccacccaggauagaauacauugauaucagcugggaucaacgaaggcuccaccuaaaauucacuaaucuuagaagccagggucaagggcuucgcgaccuugccauaguuccuauuuuagucucuuguauaguccaccuuccccuuaggccauuguaaauauguguauggguguaacucugcuauaguaucuauucugguuucuccuuuggucugaaacuuccuucuuccuaagcgaugguaaauuccuguguaagggagugacuuagcuuuuacaaucuugcugaauucuaaacccuugaucuuggucaaggaugcccuuggacuguuggaacacuggcggaaggcuuuagccaugucagagcacuuauaggaaaauacugaaagagagcacguggauccauacucuagacuagcguaguacuggaacucgggaaugaaaaauuaauguauggguagagaacacuagccuccaggaggagagcuuccuugaaacucuuuugccucaugagugacuuuuaagccuuacggcuuguccaguugacucgaccagagagcguagcaacuauccuccuaccuccaccucugaaauggugggauuaugggcgugcaccacuauguccaucuucuuuaagaguugugaauggugccugaggcuccagcaagccuaacugcaauuccccuuuccuacuuagagagcauaaccuucacaugugcucugaguacccugucuuccuuccugugugcacacggguguguaugcagaguguaacagcacagcggggaugguugcuuuacuuucugcugcuguaugagucauuaggccccagcaaagaugauucuaccuugaccauaugaggugguuuuuuucccacaaggaccuuauagaacagugguuuuuaaacugugggucaugaccccuuuggagguugaaugaccuuuuuacaggagcccccuaaaaccacuggaaaacacaguuguuuauagaaugauucacacaguaguaaaauuacaguuauguagccacaccaaaaauaauguuacaguuaggaaucaccauagcaugaagaacuguauuaaagggucacagcauuauaaaggaugagaaccacugccucuagaugagcuuacagaacuacuuaaaauaguaucuaauauauacuuaaaaguaauaugacucuaguacuuuuaagacuuuuccaaaauacaggauuugauuauguuggauuuugaagagguaugaaguucgaugauuauaagacauuuacccuagacacuguuuuuacuaaagcaagguaagaugagccucugcaugucccagagaucuguuucuucuucccuggugaaaaacucaacuaacacccuuuaauuaaaccccacugccagucagugcuguuuuaaaagagacccacagaaguaagaauacucuuuucccaucuucacuugcaaccaucugcagcuaggguuuugucaaccugcauauuaaguguggaauccauaguuaucaaagagaauggccugaaaacacuuaucuguuccuuaaaagacaucuacagcugucacuaaugauucuuggcuacuagaaacagugacagguucaggcugcuuaucucugcucaaggguggagggaaacauucauuauaaauucucccaggccuuccagcuccucauuaagaaacuuugggggugggggggauguaguacaggaggggccuggaucugaggaugggaguggaacagaaugaugaggccuauugggaggcugaaggcggggaaggccaggguguuacuugugcaguuuuggugacaaugaaggggaccuuagcacagccggauggcacccuacaaaagguagcccauaauucgagcugucagcuuaaucacagugcuuccagguaaagagaaggagcccuuguuuccuggguaaagagaagcagccauguuugcugaccccugcucuucagccugcagcagaccgcccugcucuguuggccuuuguguugcuguccccuccuucucuccuucugggcauugugcucccuucaaguggcccccuggaagggaccacccagggggcuguacaauaaggaugagguagcuaccaaaacauagguuuuguaagagagccugucaaaagaaaaauacuguuuaacuauguauguguuuguccuuucuacaaucguuuuuuuuguguagcaaacaaaaccggguauacaaacuucacaguggcuucacauacagcaguuccaccgucgggugucaggcuugagauagucacaaccaguuuauuuucccagggcacugauuuuugcugugguuuuauuuacauucuuggauuuauggccaggaaauuugauaucaaaacaagcaaguugcguuggcuucauuuaacuauuuuaucaggaguucucagagcugguggcucucuccaguaaaauuugucugugauacuacucaacaaaagccaguagucuggaauucaauucucaauggccauuuacaccucuguaaaaggauuagcucuaaccaauuguuccacugcuuaaaucuuaauuugcauccuaacguuacagaccucuuggcccuguuguauuuguguaccugugggugggaggucaggagaccucucucugacucaugaaggugcuaaacagcuuugggugacaguaugccacacagauaggauuaguguuucagacuugcuuuggcuuaguuaguuguauguuauagcaggugggccccuuguguauaaauacauucuucuauaaauauuuaaaccuaagaaacuucauggucuuuagaggaucuuaaauguugugaauuguagucagauuucuuuggaacugaaacguaagaaaaaaaaagaacuugagggaaugguaguuuuaaaaaguaauccuuucuguccauaccauauaguuucaauuuaaagguaucccuugcuuagcuugcccuguaggcagcagaugaaauugucuucuuaccaacacaaagcacugaguggcucugugagucuuggcaacccagcacugaccugcagugaaucugaauacagaagggcuacaaaggaagcuaggucauguguauaaaggagaaaaaacaguuaugauucagcuggauuuaguaaaagauacuuggugggaauggaaauagaaaacuugggauauuuuaauggcuacuucaucaccaaugccacaauuucuccaucauaaaacaauuggucauuuauucacaaaacauguaauugugccucuaggagaccauguucuagccacugaaaucauugaggcaaaaagaauugcauggauuguugauuauuacaguauccaggaucggaaauacaguguaaagggcccugcagucuccagguucuccaugcaacgcacgccagacagaaggaagaaaggcagaguuauuuaccaagugcuaagagaacugugagacaugguggcgcuugcccaucaccccaacacuaggugagaugaggcaggggcaguacuagucccaggaugcucuggaguugaaugcaugaagugaaaggauauuggagagcuuaggguauuuggaagagacagcagugucuuggugcacugagccuuggagaaucgacuuuggacauuccaggagagcugagccaggcaaagagccuuuggagacuccaaggaaacaacuauaauuagauuacuuuucauuuuuuuuuaacauucagaguuuaugagacaaugacuggaucuguuuauucagccucacaaaggcaagagaugauguuuuaggagugaaauaauuauaaaggaauaauaccuguucuuuuuacuuuuguaaaucugugcauauaggccaaauaagaacagaacauccacaaaagaauccaucuuuaauuuguacuuuaaaaggaacuucuauuaugaguuuguccagaaaguguuuuaaauuuuuuauuuauuuauuuauuuauuuauuuauuuauuuauuuauuuauuuauuuauuuauuaaaaaucaaagacagaaaguauggacacacagaccgcaguuuuucaaccuuuggucuuuuugugccugugaggcugaaugaagguuagugcagaaagcaaacaagcuacccagagcucuuacaggaauuauccugauuuucuacuccgaccugaccuuucccuauuccugcugggaacucuuggugcuuacuguuccucucacagagacagcucaagagaggaaaugcugacuugggcucauaauuuuuaguuuaucauggcagagucuguagcugcaggaaaauguggcugagcuccuuauauggugaacaggaaagcagaaauaagaucagcuucuaacucuuaacuaccccccaccccauucugccccaccuccaccacugccuuuaauggccuaaguccccuagcuagguccaaaagcagcaccaccuuggggacauuucacauucaaacugcaacaggaaccauuugaccccagcuccaaccaaagcagagcuuuuccuguuaauggcugugguagcuguggcagguagagaaaaacagggauuggaggaggggaggccgggucuccuagaaccugaacuaggaagaaagauggggcuaaacucaugagugguggaaauucucaccagacacuggaauuggaaggugcucuuguucuuuucuuaccucuggguguggguuguuccugaguuaaucacucaucauucaggacauucucuuuaaaaggugaugucuucuguuguuguucauuuagaaauugaguuuccuuccugugguggucugauuaagaguggcccccauaggcucauagauuugaaugcuugguuuccagggaacagcacucuuugagaaggauuaggggguauggccuuguuggagcagguguggccuuguggaggaauugagucacugaggaugacacaugagacccaggaucgaucuuucuuucuuucuuucuuucuuucuuucuuucuuucuuucuuucuuucuuucuuucuuucuuucuuucuuucuuucuuucuuucuuucuuucuuucuuucuuucuuucuuucuuucuuucuuucuuucuuucuuucuuccuuccuuccuuccuuccuuccuuccuuccuucccucccucccucccuucuuucuuucuuucuuucuuucuuucuuucuuucuuucuuucuuucuuugggauaggauguugcucucaacuaguuuuuaaguaccacuucugccugcugccaggcucccugcuaugaugaugauaauagacuaagacucugaaacuguaaccaagcccucaauuaaaagcuuccuucaugagaguuguguugcuucugguguuucuucacaguggaacagugacaaagacacuuccuuaaaaguuuacucuagguaugaacaaaugcaauguuuuaugauuauuuugucuuauuuaaaauauuauuuaaagcuuuaaacaguaacauuaugugacugagcucaacaauaugagcauuugaaacugcuuuuacccguggaaaauaaagucaccaggucaagcauacuucacagcaacugaaagacaaaacugaagucuuccaaaagauagcaugcacagaagcaggaugucaucaguucaaagaugaggagcuuuacuucuguagcccuucacacagaaauuuaauauauucucuaccaaguaauccucaguuugcaguacugaaauuuaaaaaaaaaaaaagccacacacaaucuuuuuucugugauuaaaaaauuauucuuuuuucauguguuucaaauagccugacuuggcauugcuuucuuuccaguugucuccaggguucuuuauuuuaccucacagcuccagauagucuguucaccugccuggugacacucaccauugacucuggaaucuccuuaccgcucuaaaacuggcuuacuucugggggacccuaauccucuucuucgggacagguauuccucuggaaugaaguagcuacucgaugaagcccuuccaagaagauccaggauucagauuggccuggggucuggaagguuuaaggcaguagaccucagugcugaaggacccaauacaggacuuaggccagagaccgaaaaacccagguauaggcuuggaacuuggcugcgguuggggcaccaagaucacagaugacagucaagaacgggcuugacuccaguagcucacuuauguuuuuuuuucucuaaagaccugcuucagaauuggagagaacaagucugcaugguccucacccugucguagccagccugcauucuuuaucuuugugauaucagacacacauuaguucaacaauaugccuaaauauuaccaacgcagguuagcauauugcuuuaauaaguaguuuuauaaauaaccaucauuuucuuuucuguauaugugugcuggauauuccaaacuuacaaugugguuagcuacuucaaaauagaaacacuguuuuggcuuuaauauuuucuccuauaguaguucagaaucaugcuuccuaccaauggacguuguuugaggcaauaauuacccagccuucugauaggcuucuugguacagugacagaguaaucuaaaguaguggccauguugauuuucccagugaguaaaauaggcaucuuuauccuuccauaccuucuaguucuuacuaaaauuaaagaaacuuacagcagaggaaucugaauggaaaauaauagucauuucugcacucaggagugcaagauguaagccacacuucagccagaaauuuccauuucuuagugguaacaauuuaaguaaauuucauaggcuguggaaaucuaacuucauaaugauugacaauauaaaauuagccuuuucugcuguuaagcuuaucagcauucccaucauuuauauagaauauggaaugagauugcccagcuguggauuugaaccucauuaaagucaucaaagaguuaaaaguugcuuccuccagugcauguaaaacugucacaaacacacaagcaaguuuuucaaauugccucauuuuacaucuuuguggagagacguauaguugcugcauuuuuuaugucuagauuauauugcagauauauuucaauaaaccacaaagaaccaccggagccucuagaaacaggcagucugugcuuaaauaaacaucucgggcagcaccuguuuuauuuuauaggcucuguaaucacagugaccuucuaaaggaaggccuugaagccuucagaacagcuguccuucacaacuucccagacucaaagcuggggcaacagcagugaagaagaacacagcacuuggcaugaaauggcugcuguagcgagacaucccuccugcccuggugcuucaagaucagaacauugacaaguggugaaacuagucuacacugccagcgcuuguagccaucuguuuagccuuuugauggacagccucaucuauuugucuauaaaugcauuuguuucuuauuagugaacuuacauacucagcaccuccuuguagcaguguuucugagauuuguccauaaguauaagaacauuugcuuuagugggcaggggaaaggagguguagccuuaaguacaaucaggugagcaacuguggggagccgcccucacauucgccguugcaagauggcgcugacauccuguguucuaagugguaaacaaauaaucugcgcaugugccaaggguaguucuccacuccaugugcucugccuucccugugacgacaacucagccgaugggcugcagccaaucagggagugacacguccuaggcggaggauaauucuccuuaaaaagggaugggguuucgccauucucucucuugcucucuugcgcucuggcuccuaaagauguaagcaauagagcucuugcucucuugcuuucuugcucuugcucucuugcucucuugcucucuggcuccugaagauguaagcaauagagcucuugcucucuugcucuggcucuugcacucuugcuccugaagauguaagcaauaaagcuuugccgcagaagauuccgguuuguugugucuuuccuggccagucgcgaacgcguguaagaagcaacccuggauuuauccaccauagcuaccaacaaggagguccucagcaaguggguucccagauuuccaugucacucuagauuuagacccguuaguccaaagcuggucuuugaaaugugguuucuuuuuaaaaagcgcauuguccaguccuaccuuagaugcagugacuuaggaacuugaggguggggccuaauugagcucuuauuauuuaaagcccuucaguuuaagaacuuuaaacgaauguacagcugggaugagagaaagugagagggcuacugguuucgagagugaguacaacuugaaccaagauucauauaccuccuugcugugacagaaaucuauuccuaguuauuuuucuauagcaauaauagaaauguuaugaaauaccaaauacaagggcaacuuaaauaaggaaggguuuauuuacaaagggauaggagccaucauggcagagagcauggcagcaggcagagaggcaggcauggcacuggagcagcaccuacaucuagauccacaaagcagaaacaggcacuagaaaugauaaucuuuuaacaccucaaagccagccccaagugacacaccucauccaauaaggccacaccuccuaauccuucccaaauaguuccauuaucugggaucauucucauucaaaccaccacaguuggaugcuaugagcuaagaaacagagcaguuuuguauugguuugccuuccaucuaacauugucuucucugucuuucaggggcugcuuaggccgaagugauguaaauagggaagagaaguacauuucuuuuuuuuaagaguagagguuaccuuaaaucuagauacauaguucuaucaugggcuggguacaagucaggauaauuugcucuggagagaucuugacacagaaaacuucaguggauuagguggccccaauuuacaauacuucuguauuuccauuuaugaucucugaacuggagcaggguagaagugaccuuccuggucaguaacuuuucauuuccuaucacuuuuuuuaucaugcagaauaaaaccugcugucuuaaaauccugcuucacaaggugaugaaagaagcuaacuugggaggggucuuucugagcuuuguggguugcuuggugauuacagguuacaaggcucucuaaccacucuuauggcuuuuuacugcugccuuuuauaucucuauauacaauuuggcauaacccacaguuguaauauggaaagugcauuugaauuuauaauaaaugaugcaccucgugacucuuaaaccugagaauauggugaugauaggucuacauugacuaaacuaggauugcucauccauaauaaggcacugauuuccauuauaaaugauuucaagcuacacuuacguauacaucagccuuccauaagaugugauucuuuaugaucaauacaaauucuaaaauuaauagucuuuaagacuuuucuuuacugugauaauuuuuuaaagacagauggaagucagaaaugucugaugucaacauuaugcucuguuacaguguauguugucaccaaaggugcuguuuauaaaacacucuagccuugggaaaauauuguuuguguccuauggaagacaaguagucagauuuugggacacaaacucucucuggggaauuugaaucaccaggcuuuccucugccuucuuugcaacaaccuugcugcacccccuaguucccaggaguuguagcagagaccgucucuaaacaaaauccuccugugaucuucccagggcccaaaaagucagcaagccaucuugaugagcaauuccagagaugcagacuuggggagaaugguuuacucuguugucuaauagguaaugacucaaaugucacagauauaaggcaggaaaggcaaaaaggcuuagcagguuauaaauccuuaaagucuuugaauauaugaauguugguaugaccguggcccugccuggcuccuggcaaaacauggcacucauaaaugucuuacccauaaaguaggacaccuacccuagaacauauuccagaagagaaugugaagauuuugaauuccuacucacauaaagaagcaaauuaauaauaagaaaaaauauaaaacuacugcuuucaucauuauugguuuacgcuaagccaaggauuaauuuuguguuaugccaagagcuucauauacaaagcuuacuauuacuagguagauggccaaguucuuuuagacaauuaugaauuaauaugauucacaucauuuggauauugaauuauuuaaauucacuuuuuuucucaacaaaaacauuuaaauaguuuuaucauaugagaaauguaguacgaugcucaucauuuguuguaguuuguccaggugcagcuaauucuuuuagaucuacuuucaaauauaauuauucucuuaagcucauggaguaagcuuuacauuauuugcaaagaauacaacauuuucuuuguuuuauucuaccuacguucagaauaaaucucgugaccuuuaaaacauuggucagauuaucaaugugucauaagucaguuguaguuaaagcugaacacuugucuggauuauaguuagaaaaguaucuaaauuaugugauaucuaacuuaauucuuuacauuguaaaguaaauaaaauuccuuucaauucuuuguacuacuuuguaaguuuuuacauuuaguguauuuauguagagacaugggaaagauuccauuaaaggacaguuguagacuccuugacccagguguccugaaacaaaucugcaagaaagcuugauauuagcuugacuuucugaagucacaagcucaggggcucugagugagaacugcaccaugcuccacauacuagaaaucuggucugaaucagucaaacuacagugaaacucauuaggucucuagaaaagggacaagcaguccucgguuuaagacucaggcuuaaaccugaggaucuaaggaaggccagcagaaggcuugcugacaaccuuuucaacaccucuagauggaaaggcaccucuaguuaugguauccucugcccugcccauauacccuaugauuucaaggccaacaacacaaacagccaggaauguaaguaccacagagguucugacccaaauagccagagaaagaaaagcaagguagcuauagauaguccaugucugcacucaagugagugaccacauagagacagauaccacuuaauauccaauaugagauguuaguuccaccuuaauauuucucugucuacaaaucuuuaaagauaggcuucugcaaagggcacgugcugcccuggagcugagggcucccugcuucuuagcacuuagguuacaugacugcacugcuuuacuccuuuuagggacuguguuagucaggggcucuagagucauagaacuuacggaaugucucuauguguccagggaauuuauugugaugaccuacaguuaguccaacuaacccagcaaugggcaguuguggaugggaagucuaagaaucuaguaguugcucaguuccacaaggcuaguuguuucagcuggucuucuguagaaguagguuccaacagauaugcuggcaaguaagugcaaggaguugaaaaagagugagucuuccuucuuccagugucuauguaggccuucagcagaagguguggcccagauuaaagguaugcuaccaccauaccuggauccucuugccucagucuccugggguuaaagacauguacuaccugcccugggccuaagcuuuucauggccacuaugccucaagaucucaaugccaagauccaggucaggaaacuugggucuuccagacucaagaucuggaucacaggugugcccuccaauucuagauucuaguucauuucagauauagucaaguugacaaccaggaauagccauuacagggaacuagaaaacaaacauguucaauuaucuauguuugaguaucugauaaaauagacuucaaaccaaaauuggucagaagagauagggugauuucauauugauuaaagaaauaaucuuucggcugaagagaugacuuagcaguuaagaacacuggcuacucuuccagagguccugaguucaauucccagcaaccacaugguggcucacacccaucuguuaugggauccaguucccccuucugguacaaagguguacaugcaaauagagcacucauauacauaaaauagauuuuuaaaaagccuuaaaaaagccuuuuuuaaaaaaaaaugaaaaagaaauaguccuuaugcggcuauuauucuaaacauauaugugcugaauauugguauacccaguuucauaaaacaauaguacuggauguagucguauaguguccucaacacaauaauuacaggcacuucaguuucccacucuuaccaauagacaggucagaaagaccagaaaaauuaacaaagacaugauucagugauuaagugucuuugcuguauuccagacuaauuuagguucucaguacacacaugguggcucauacaaucuguaacuccaguuacaggggaaucugauaccccuggccuccacaggaaccugcauguacucacauauacagauguauauacacacacaucauacacacacauacacacacacacacaauuaaaauauuuuuaaaucuuaaaguuuagcaaauagcauagcuaaaugacauaggucacaugauuuaaugaaacucuuuauagucucccauucaaacccuauagaauacagcagcucauggaacugaagacauuggugaacacaaagcaauuccuaacuaguuucaaguagucuguuugaccccaguagaaugaauuagaaauccgcagcaagagcagcuacggaaacacacaaguuuauggagacugaacagcauaccgaugcaugaggaaugagccguugaugaaaucagggaggaauuaagaaugucuagaaucaaaugagaauggaaauaggauguuccagaaccgauggauuuuaaugaaaggaguucuaacaaagaaggcuagagcuauaaugccuacauuaaaaaaaaaaaaaaacucaaauaauuuaaugaugcaccuuaaggucuuagaaaaacaagaacaaaacaaaccucaaaccaguagauuaaaagaaaucaucaagaucaaagagaaaauaaugaaaugaaaaucaaaauagcaauaccaagaauuaaugaaacaagaaauuaguucuuuaaaagauaagauugcuaagcccuuaaccaaacuaagaguaagagacagacaguuaacagucauguugucuauaaucccagugugcaagaggacgaagcaggaggauugcaguaagucugagggcagccaggguuauauaguuauaagccagggguguuaguggggaggccaaauaaaauuaguaaaaugugagaugaaaaguuagacauuaaaacaaauacucgugauaagucaggggcuauuuaaagcauacuuugaaaaucuguauucaaaugaacuaaaaaauggacaccuaugaucuagaagaggacacauaugauacacaagaauuaaaucaaggggauauaaacagcuuaagucuuaggguuucuguuacugugguaaaacaccaugaccaaaaccaaguuggggaugaaaggguuuauuucaucuuacagcuuauaguccaucauccaggaaagucagggcaggaacucaaggcagaauccugaagacacaaaugaaguauggaggugccgggcgugguggcgcacgccuuuaaucccagaacuugggaggcagaggcagguggauuucugaguucaaggccagccuagucuacaaagugaguuccaggacagccagggcuacacagagaaacccugucucgaaaaaccaaaauaaauuaaaaaauaaauaaaugaaguaugggccacagagggucuacuuacuggcuugcucuuccugcuuucuaauacacccaguaccaaucagacuguacauuuuuguggaugauaugauccuguaacuagcacacucuagagacuucaccaggaaacagaacugagaaacacuuagaacaaaguaacagaaugaaaaaucaacauacaaaugccagaaguuuucauauauaccaauaacaaacaugguagaaagaagaaggaaauauucuauuaacaauauuauuaaaaaaaauaccuaggaauaaacauaaccaaagaagcaaaggaguuuuauaauaaaaauuuuaauggaaaaaaaaagaaagacaagugaagaagucgucagaagauggaaagaccuuccauggcuacagagcagcagaauuaauauacugaaaauguguguuacuaaaagccaucuacagauccagugcaagucccuucaaagucccagagaaauuuuucaaacaaauaggagcacaucuaaaauucauaugaaaguauagaagaccuugaauacucaaaacaauccugagcaaagagaagaaugcuagugugucaaaaucucaaguguacugcaaagccauggaacaaaacagcuaggacaaaaacagacacauggaucccuggaguagaauagaaaacccacauuaaacccaugccaccacagucacaugauuuuaacagaguguccaaaaaugcacauuggagaaaagacagcugucucaacaaauagugcuagaaaacuggaugucuacacauagaagagugacacuugagcccugucucucacccuugggugggggggggcaauguaaauguuuuagugugauguuugaaagucagaaauugauauaggaaacuauauggugggggaccucaagacacaggcaaaagcaaggauuuucugaaaagggcuccagugacuugguaauguuauugcaugaaccaaaaaagcuuccuacuaaagggaaaugcucaagucaagcagcagccugcauaauggggaaaacugagcuagcuauccccugacaguugcauuuaaaauauauaacuauggaacauauaauauauggcuacuaaaacaaaacaaaacaccugugguggggcuuggcccugggaguggcacuauuaggagguguggccuuguugaaggagguguguugcuguggaggugggcuuugagacuuugagaagucagucuguuucuggcuuccuucugaugaagacguagaacuccugcaugcugccaugcuccugccuugaugaaaauggauggaaccucugaaccuguaagccagccccaauuaaauguuauccuuuguaagaguuggcuuggucacggugucucuucguagcaaugaaaucccgaacuaagcaagacccaaacagucaauaaacaaaugaaauacaggguucucaaaagaugaaguauaaagggccaguacacauaugaaaaacuguugaguauccuuagccacgagggaaauguaauuaaaacuacacuaagugcaucuuacccaaugagauaggcugucacuaagcagacaaaugcaaggauggagggcgugggaagguuggagggaggaacucuuuuauucuggugguggaaauaaaaguuagucuagccacuguagaaaccaguauggaaguuccuuuaaaaaacuaaagauagaacuaugauagaguccuguuuuaccuucccuaguauguauccagaggacuguucaagucagcaugccauggagaaacuugugcauaggcguucacuguagcacuucaaaguagcuguuaugaaaucagcugucugacaacaacagauaauggauaaaccaaguauaauacuguguaacauuccaccauaaagaaugaaaauauuauguucuuagaugggaaauaaaugcaggugguaaucauguuauuaaacaaaauaagccagacucagacaugaguugauguacaugcuuuuuuucaugucuggauccacgucugcauccuagauaauauggaacuacauuaaaucauuaaauaauacuccccauauucccguguguguguguguguguguguguguguguguguguguaugugugaauauuugcuauucaaauucucuugccagccugugggagccccuucaacacaggcugagucuuuauuguugggaucauccuuaguuucuaguauugaaugauguuuggguacaucugaugaguuucccgcaacuaagcuggaagggagccucucguuaguuaaagugcugccuuuuaguauuaauguguggcucgcacuuccuucuucacucuuccguaauaacgccuuacuuguuuucaauguaaaucauaauaaaaaugucacaaaagguguaguugugauggugauaugauugaugucgcuuacugacauguaggagaccgaccauaccaugcuuucagaguacaugucugcgcuuuaggaugauacugugaguccuaaaauauacugugucugggucacaguauagacuguuuuuuaagacucagugugaguggcauuagguaucuagacuuuagaaaacuuguuggcuauuucuaugugcagucaaaguugagaaugcuuguuagcaauaauaucacaacaaaauaaguuuaaaaacaaaaagaggagcuugggaaaaacagcuuaaugggucaggucaagagguauguggauccugggaacacaucagagagccagucuagcuagaacagcaaauuccagauucauugaaauacccucucaaaacuuaagguagagaguaacagaagacccaauggccucugaccgccacaugugcauauacaagcaaaugcaaccagacauccaugcacacacauaugcacacacgcauggauacauauacacggacauacacauacucaaccucuggaagggauucgaacacaguuuuguaauuuuaaauguuaaguuccagauuuuuuuauuuugauaaauguuguucuagcaacuuggcuauaagacuuuuaaaaauguaagaaucuucuaauccaugcauuuaaacauauauuuacagauuuauagugucucuacuauuucuguuuuacagaccugaaaaaguaccagauugucacuuauugaagacacgagggcaauguaugaaggaacaugauaauucucuuaaagaggagguauaugcugagguuauuuucuuuuaaaaacaagggcugggguuaguaguaacuuuuauuuaaguucuaagauuauaaaaacuguuuguuuggggaaauaauauauucugaaugauaaacauuugaaaaaguguuaacagugguaagugagguaucauagcuggcugaugauauuuuuaacuuuauggucuuagaucuuuuauagguuuuauggaaggaucuaacuucugacuuaauauuaauuugguucccagagguagcuuaaauauauuuaccacaaaaaucuucagaguuuagaagcaucuauaacauugugguuuucugucugucugccauucuuuauuuauaaagucauugauguuaagccaacaaauacauuuuuggccauuauuguacauuaaacacagguacuaacccagauacauuagaaggaaagaaauacaugaaaugugucucucuccuucugagggcugguuaccaggaugcacauaacaaaauggcaaagaaugugugcucucagaaagggagcccagcuacgugcagaagcacuggggagagcuuaggagggaaggaguaucuggacaugcaaggggacccuuuagaaauaggcuuuugacaaagugagacuggagaagauguuuggggugacagggaaggacuguaggaaccaaagaacagacuaggaaaccugacacacgaggcaguagaaccauuuuuuccuuguuuauuuuauuuuuaauuauauguguggguaucugcaugucuauuuguagguaugagcaagugaauguaggugccuguggaagccaaaagaaggguauauauugccuagaguuuaggacguugcugcagacuuuugagcauagauagaauaguuucuccuuaaaaaugggagugaauaggcaguuucugaaacauggagguguggcugaagaaauguacaauuccaaagaacaauguuaucaccaaaaugaugaaaugcccuguaaaguucaggacaaaaugcuuuuguaauuucugaagcuguuuugguuuauguagugcacccguguaaauaaauaccuucaugagaagggcgaggaaggagggcggcugggaauugaucagagucuuguucauguuaagcacauuuuugccauuacucuuuguauauucccaguccuaucauccuuccaugauuaccuaacugggauaucuugaguguuucuguguauugaaaaaggauagauauuuaguagaaaccauagguuaaauagcucucucuuuagagaaaaccuuaaaaguaagugauuuugaaaauuuaagaaagcuccguuagaaaaaucaaagucuaacgaagccuagaaguauuugcuuugaucucuuggguaaauggcuaauuaaacagccgcauguaaauuauguuuaccugcgggccucugcgcugucaucucuagucaaucccuucucuugaguaaacacaugaccaaagccauagaaaugcauugcccccuggagaccagauaagaucugucagcaccgcauaaccuguuaggcaauuacauaacugagcuacgugcuuuuaauucauaaaaauuuguaauuacuuugugugggaacaaaaugaguugagauugucauugaaauacaaaguggcuuagcacuccuuuauucucaugagguguguuuccacaugggagaacuuugacacagaaaaacaacuuucugauaucacucagaauggaucuggucuuacccccacacagauuuuauuuaccagaagacauaguuccuaaaugauagauuauuuucugauaucucauauauauucauauucuggcucuugugauuauuuuuccaucuuuuaguugcuacauaaauaaaaucccuuccuuuaacuuaaauauaaucaauacuaguacauguguuuuuccuuaaacacuggaauauauuucucuguaacuaagaggaaggauuucgaggagaugguacuuaaaucugggaacugucauccguugccauugugcggcaguggugugugagugguacuguccacauaaagaugagaauuaguucugcuuagugagcucacacuuaguuucucuuuggaguuguguugcccuuauacaaaucagauuucuuuagaauuagauguaacuucuuugaagaaacaagcagaaaaauaaaaacaaaacuuugaaaugucaaacagaaacaugcuacuguccauaugcagucuuaccgaaaugagggaugccuuuaauguucagguguuuacagauuggguaggagcagagcucagcggcagagcgcuugcuuggcacacacaagggugggccuggguucugcacugccuugcuaggaaccucccuuuccuguuugccacaaagugaauuuccuuuaauaggaucccacagccuccuguuucguuuggaaugacuguauguagucccugucuacuuugcacaguccucuaacuacuuuucuuuugccuguugaacauuuaaauuuguuauuuccccccacuaagagaggcucauagaauauauauacaauucagauuuuuaaguauucauauuuccuuacaaugaacucauagguauaaaauauaaaauuaucagguguagaauuacuuugcauuacuggaucuuacucuagucacagaguuaaaaauaaugggugaauaaagcguuuauucgaguucuuucuaaaauuaaauaaucgacuccuuuuggauccguuuugagaggugaaaauggcagugcauuucuuuguguucaugugaccguugugcucgaugagcucagccccuuuccuacuuguucauuguucauugcucuacuauugacuuauaagaacuuuuaaaucuagauuuacacauuuuguugcaguauuuuuuuuugacaacuugauuuuuguguuucaucagaggguguuguggauaugauaucuuuuuuacuaguaguuucauuuaucuacuuauacauuuuuagguacuugaauauaguaauugacaaacuuugggauauacauuaaaggucaucccacaugacucuugcaguuccaaacauagcaggguccauauuuaaacugaacugaugaaauuccagaagaauugagcuaguaaguuuaggaauacuacuuagugaaacucggaaaaguuuagacaucauuaacucugaaagacggaagugucagcaccagucguuuuacagaagcugugugcccaggcauuucauucucaaacccuggcuccuggcuccaggcagacaaggcaccugcuugugguagagacuaaggcuucaggcugcugagagcagugggguacccccaguuuccuucccagacuccaaagguaccuaguuaaaagcgagccugucuuaguagcagaggagcuaaagcccuugugugcaugggcuguuuauaaguaugagccaugggaaacaaagggguuaagucugcagucugcagagcccauucaguucuguaaggggugcaaaacagcugguuauucuaacgccaccucucugggccuauguuccuuugcggguaugagggagguaugcggguaugcucuguaauggauaagcuccuuugaauugggaguuccucagaaaaugcacauuucuggaacaucugcaaaagacaugccuuaacuuuauaugccccaguacaggggaacgccagggccaaaaagggggaguggguggguaggggauuggggguggguggguaugggggacuuuugguauagcauuggaaauguaaaugagcuaaauaccuaauaaaaauggaaaaaaaaaagaauaaauggcaaaaaaaaaagaauaauuaccacgcugggagauggcucagucaguaaagacaaccuaguuuucaucuccagaacccauguuuuagaaauaaucugagaauggggcugcacaguuagcaaucuuguuuuuuaaauguauacuaugacaguguuauuaagaggcuaagaaauuauuaccucugggaugggcgguggcacaucuuuaaucccagcacucaggaggcaaugaagguggaucucuguaaagucaaggccagccuggucgacaaaguaaguuccaggguagccaaguauauaaaaagaaacaucuuaaaaagaacaacaauaaaaagaauaaaaagaaaaauuauuaccaauuacaucacaaauuauaauuuagaaguacacacucaaaguuguaucaaauguauagauuguuuuaaacugaagaaaguaaaaagcuauagauuuaacugcaaauuuucuaaaggugagguuuuguuuuaauucauauuuuaagaugcuuuauuaauauauaugauuuuggggcauuggcaaauauguucagguugggucuaaaaagcaccuugggcaguaugaggauacaauccaaggauguuugcuugcuucugcgcagaccugaggagcauacacagaauaauagcugauaggagccagcuugggccuagcuucaggggcaaggaaccaugucuguagccagucugccaaaacagaaguccugagcaguucacccacauggacuugucggagcagagguaaaauccagggacagcugauacaaguaaaggcaaagagcccggucaucagcacugcaguccagguccuagcuacagaacuaacaacuccagggccuuugggcaagaacuacagcucucucacacaccaccccagaccaguuucucuagcuccugucauaagcccuacguccaugagaucuaccuaagugauguuagaggcaaggacaguggccuuaaaggaucuucugagcuaaaugcucagggcugcaccuuccauccucugcuucugugacccucagaucagagcaucuuuuccuucugcugugcuaaucacaaagaauuggucauucccuccuagauuacugaacaauugcuuguuacacagucaacugcauagaaccugaggugcuuuguucuguucuaccagucauauuggcuugugaugucuugggcccauuucuugcagauuggguggacacuacccauauuuucuauacucaucaaccaaaaggucgccaccacuaucacuaggaguagucagucacuacucucuaauagagaguguguacucuggcagucagacacugugguagagguugucugcuagauagucaccucuuguucuuaagaaauuaacaucagaucguguucauugccauuuuuccucacauugcuucucagcuaggcugugauuaaauuugacuucccuguacaguuagauaguuaauguacuuugaaaaaagauuuucaguaggaagugaguuucuccagcuccucaggggacucaaaggcaagcauagacuuucauccuuggcuaaagauuaagacucacgaacagaucaguuaucauuugcuuaguauauuucuuuaauucauuuuuauuuaggcauaugugccuauauguaugucuauauguacaguacaugcaaguagcaucugcaguggucugaagagggcaucagauccccaggaacugaaauuauaggcugccugauguaggugagggaacuaaacccaaguccucagcaagaacagcaagugcuuuuaacugcugagcccuaucgccagucccuaaacugacucuguuacaagucuagaaaucaaaauuugugcaaugagagacucaaucuuucauucagagaggaggucugaggucugcuuuuauguauaccaaagggagacuaggcuagcccagauaagcaggggugaccucgucucacagacccuuguguaguauauaaggguaagucuucaaaaacauuauuguaaaugaaaauuguuguauugaauuaaauugugcuagaaaauaaccaguuguuauuuuuaauuaaaauguuuuucauauauuuugaucaugaacucuuuccagaccccccuaccuccuuacccacccaacuucauguugguucucucucccucugcccuccucugcuguuuugaucuugagaacauuuuaaugucaggaaagaaauuaaauucuaaguaaagcuuaaccuaaaauugaauuuugaaucugagucuuugagagcaagaggaacaggguuccaguuuguuuucauuuuguuugugugugugcuuucuuugaaacacuguaggcaacaacauuauugaaaaaaguccuuacagaagaaugugaccauaggucagcuauucacaguaaugaaucaucuugcagcaugccaucuauucugaaugacaauaauggaauaaaggaagcaaaacccgcucugcggcucaacaguguucuuacaagggaacaagguaacuauuguuugcaguguccacagcaaaaaggcauucagagucaaugcaacauccuuucucaaggcguacauauaaaauacuguuaaccaaagccuaucucagguuuuaugugcauaguauguugcuuguuuuaugguaccuuccaguuaauguguauguucuuaguacacauuacuguacuaagaacauacacauuuguucuuaguacaguaagaaauguacuaaauuuaguucucuugaacuucuaguaaaauaaaguuaagaaaucuuaaccuagucacuuaacgcuaacaguacccuuuagacaagaaauaaauuaacaaaaacuguaagugaagagauagugaaaaaauaaaagaauuauauuaaaacucuacaugcagggggcaggagagauggcuuaguauggcuaagagcacuggccacuccuggggaggacucagguugggcucccaguacucacauggcccuucacagcugucuguuuacucuugcucucuucuggccuccagcaggcaccagacacagcauacacauggugcacauacauacauacauacaggcaaaacauucuugcacauaaaauaaaucuuaaaacaaaacauauuggucuaggaguguagcucagugguugagagcuuaccuaacaugugugaggcccugaguuccacgccccagugcuaaagaacaaauauuucauaguuuugaaacauauuuauuaugcuuuuaauuuuuuagaaguuucaaguggcuguggagaugagagcaaggaagaaagcauagcugcggccccaggcacagguaaagcuaccaguaccuaacaguuucagucacagaacgcagucucgcugcguguucagaagacuuaggguggucauugcugggucuagugacuucucgauggggagagagaaugcagucgacuucugcaugcaagcugugcuagcguaacccaagcugguaaaugacugugcccacugagcugcucaucucgauguuaaguauucagucuguaagcaucccccaacagacagccuuucagcacuuguaaccaugagaggaugucaguuggccaggguaagagacuagaugacaaacuguaggugcuucuaauuuuacuuuuuucuuuccuguagaaauugaacuuaaaaaugauauuauaaaaaaugcacuagauagggaguuugcuugugccucugguacagaagccugucuggcaauuuaaaauucuuacuaaucauguuucauccaucaagaccuauuaagacuugugcacauguauuagauguguuuauagguggaaucugaauugugucauuacaauuuuuuuggcuuggaauaucagcaagcagcaauuaguauucugaacagaaccuuguuuguuguacaucuaaauuuacuagauccuucuuuuguaaagugguauguugcuucauuauaaauucaaaggucugacuuuaaauauuuauacacauagacacuauugcugagguacugaggcaugaaucuucauaugagguuguuuuguucuuguuuacaagcaaaagggaauggcuugcuuuaugguaauauaauucaugacgugaugauuaauuuuuaaacuuaaguuucuguaaugaacuuauucugaaaauagaguuuacagcagagcaguuguuauguauguauaauauuucacuccaguauacaaauauauucuuuacuuuuaaguauuuuucccaauaauguucauuguguuuugauugucauuuugaggaaaugcugauaggguucccucucaauuuuguuuguuuguuuguuuguuuguuuguuuuguuguuaaaggaagaaauauauauaugaucccuaaguugcagauauccuuaaagucauuuggcuaucuuuuuauuauauuuacuuuugagugcagaaguauuuaauguccucugacguucaauuaggacuguaagccugugaucacaaagggucaucuguaaacuuauuuaaaauaggugguaauucuaacagcccaaccuccaacuaucaauaguuagcagagaauaauaugccuuaagcauucuaaagcauuggccauuauaaaauaccgcaggagagucaggccuggugguagugcacaccuugaaucacagcacucagaagacagaggcaaggagaucucagaguuggaggccagucuggucuacagagcgaguucuaggacagccagagugacauagaaaaacccugucucuaaacaaacaaacaaacauagcuugggagucuuggaaacuuuaagauauucuugcuacagcauugcuguucuguccucaccuuguccuucuaagcacccuggggccucccaugagcuucaugucugagugccuuaaacaccuugcagaacugucaucugaggcauagucgcugaagggaucuugguacaagaacuggagaccuacagccugaucaguaaggucccaggagcuagccugcaguucaucacuaaacccaccuuaugaacuuccuggaauauccaaacauauucagaauccuucaagacuuucugcugggcagugggugucgagggauaaagggagugugagaaaaccugugucccgccagaguuccagugcucugggcgggcagacgcaggaggacugccacaugcuuuccacacagccccagauggguuucuggcugggggaagccacggaacccagcccaccaguggguggacaaggggcaguccgaggucucugaaccucacugaggccagagauaccagguucuagucuugggcaucccagacgcagcuggauaccauggaagagaugagaacaaaaugggggccauggggacagcucagucauccccagggccaaagggaggagagggccaggggagagggggugcugggugguucccacuggaugagaguccuuggccugaucuagagugcaggaaggccuucugguaggagguuagaugccgcucuuuaggggaaagccuaucucauuguucaagcacugugagccuuaaugagcagagacagucuaugguuuuagagcuuuauuguagaaaggcagagagaaagagaaagagaaagaaaaagaaagagagaggccggccaugaccacguggagagaagggggaagggagggagagcuagagaugagaguaagaaaggugagagcuuaaagagagugaggaggggccaagcagccccuuuuauagugggcuaggcuaccuugcuguugccagguaacuguggggaggagcauaccuggccauagucagguaacugugggaguagagucucaccagaaugcuagaagcuugggacauugucugugugacuuauagucacagaauuaggaaguugggggcucugugguaucaggcaccugucucugggaauguggcucacuguucugucccuuguagaguuuucuacuaggucucuacugggucuccagagcaagccucauucaaccaaaacaggcugccuuucacagucccacaacuuucuucugaugaguuaaaaauaucuuucuggagucaaaucauuagcuguguucucaagugacaauuucuugaaagagcuagcugagcacuacugcuggaggugccaacaccaaggaaucacagcagcacuguccucguuuaccuuaugacucggggacaaagugacaggauaauacacugaaggcaccuagauucucuggaggcuacaugauggcugugcagcaggcuuuuccugaugugcugucucauaaauguugauggagagugcagcauuauccaaaauguacccuguuuagaaaauacuuggagaaauaacauuuugaggccaaccccuggauggucucuuauuuucugcagugugcauaauauguaggaucaugauggaggcucucaaaagaaugugaaggaaacugaaaauugugugcugcuauuucacaauguaucauguagcugaaaauagcccuucuuuguuuguuuguugaggcagggauuuucucuguaucccuggauguccuagaacucgauguauagaccaggcuggaugaaguucuucuuaaugaccaacaacgugugugugugugugugugugugugugugugugugugugugugugugugugaaacaugcuauggaaaaauauaggcucauauauguaugggaccuuuuaaaagaaaauagcagguccaauugggauaucagcuuucucuuaaccucugagcuaucucuccagccccuauaucagcuuucucaauacauuaaaguuauccuuguuguuucucuacaucucauuuggggguggggggaaccucccuaguagaugaaacugcuuucuaauuagacuggggcaacucugaucaaaucacauuggaguguuaagauugaaagcuacugauaaaacucucccuuggguugaccagaauaacuauggugaccagaaaugcucuucaauguggcucuuucucuauguaccuguuuguuuugcauucauuuuagaaggacauaggaaagcaagagggcaagguaaaauccagggcagguuccaggcugcguccucaagacucuuauuaacaggaggagggaaauuagcucucucuguauacuugaggagaaacugcaaaugcacaccauucacugugcguaauggugggguguagcucuguagcaagggcacucucuagcucuuuauuuaauaaaacaaagcuaagagucuucuagguaugagauucugggcagagaaccugaaccacagcaaggccuagagaaggaguguuuguuuauagaauaugucacucguucaugcugaagcugcggcucucucucuacacuaaaagaaucagugaaccaacauucuaauguccucacuucuccuucuuauuuguuuauguccucccaaacuuaagccaccuuagcagagacguucacccuuaaagauucauuagcccuucaaaggcaucugcuuccuaagucaucauagaaaaaguguuuucuccuauauggacugucccuuguacagcacauauuucccagucgacaaaaucgaguauucccgcacucgccuucuauuaacagucuuccccuuuuuauuugucucguguucuuacuaaagaauugagauaaaacaaagauuaauguuaaaucuauaaaugugucucugucuguauaugauaaguaauacaccauuuauauauuuaauauauuuagcccauuacuuggacugaaucuugggauaccaaggacagaaaagacagucccugcccucaauaagccucaaccauuucuaacuuucuuuucuucuuccuuuuuuuuuuuuuuuuuuuagacagaauuucucuguguaucccuggcuguccuggaacucacucuguagaccaggcugaccucaaacucagaaauccaccugccucugccucccaagugcugggguuaaaggugugcaccaccacugccuggcucuaacuuucauaauaauccauuaggacucaauuugaguaacucauccugcuggucaaauagaaacuuagaaugguugggaccagcucgguggauguagaauccaacucaaacuugaggauucaguguuuccauuccuccacccugacucuuguguuaguagcagaaaggcaguaguaucagggcaucugggucaaguagaccucaguguauaucauggcaaaagcugaguuuaacaaggauguucuggggagcagugauaagcagccaugcauuucuuuucucuuucgcuacaccuagagaagugaacaacuugcaaaaaaagaggcuugcuuuuuauaaaguaggacaggccugagcacagcuggcccucugaaaccaugugaaggaugcaggauggucuggucaguuucccugggaacaugcaagcaaggaagaaaguaaugcuuaguaagauuaugggagaacaucuuccuccgaaguacgcacauccacaguggugacauuuuacuugcauucacaccaaugucccuuucaguaccaagcuuucauuuaagcaagugauagaacuuauauuaaaccauaaaagcccagcaccauacauaguaugugccacagagugaacccucaauuugucaaacaaaugaauuaaaguggggaauuaaggaguuuccuuaaaugcuuguugauucagaccagaacaguaucucuuucagucacucacuccaccaccacuuuucccaccccacgugcccauccuggcaaaacucaucuccuuaagcugcaugugaaaagggcugucgcuuuuaucucaagaggauuacgccucuaagaauguccauucagccucucauucuuuucacaccgauucugauggucaagcuguguuaaaguguugcuccgcagugcccuuccuccuccauauucuuuggccagcugaaauacucuaagucgucacacggaagcaucaguggagaggcugugcaggucagcaucuacuugcagggugcugcuuggguuccggguucuggcacuacuuccccaaacauuacagcuucuguuuuauaccaagcugaaagggagcugaaaagauacaaugaccagguugucacuggugacuggauuuaccccaggaggaaagaaugcagugacaaguuugggccacccaaguguaauggcauauaaccuccaggacggcaaguucacgaaaaaugcuucugucuugccuugucccagcagugcuuuacccggaagaauuagcagacauguuaucuucucugcaggccagggaacuugcaacaaugugaaacuaggauauccucuguuguauuguuauccacgguagucagcaccucugccucuaggcaggagucagccugccaguaccucugccucucggccauuggaccuauuugccugcugcuuccaggugcgggacagaggauuuuaggacagaugugaaagaauacaaagaccuuucugaggagggcuguugguugguguccugcauuugaggacaugaacuccuaacuaaggagagauucucccagugaauacacaguaaaauuccaugugggcuuuuugugcugugcugcaucagaacugaccaguguaagucccaggcauaggcaucuuauuacauauccaagucaguuucuagguugagaauuguggagaaggagucuaaagcugggagaagcucugugggucaguuuguaaaaggaccuuuagcaggcaauucaaauugagagacgagguaaggguuuagacagcuugguaaaaucgggagucagggagagcauuguuuuuccuccagcugccccgauggaugguaccauaagcuugcuggcugcaacgcccugaacuuguagucccagauccucaacaggcugcagcagaaacagcauugacauuaaugugaagcuccccugagcagcaaaauuucaaaaaugaaaacaaaaguuauuaugucaccguucaggauacaaaaaaccaagguaccaucagcccucacuccagggaagauuucuucccagugguucugguucaugagagcaugcaucucuggaguguuucuguuugccuuugcuuucacugccuucuuucugugucuuugugucugcugcuccuauggaaaagacauuagucuuugggcguagggaccagugaaagugcagggugaucucucuagccuuccggaacuaaugcaucuacaauaauuuauuaccaaauaagaucauauucuuauuugagguuugaguggauuugauuuuggaggugagaaaggcaguauucagcccacuauaggguuugagaaggauuuucuugacauuuuacauugcuagcauuugggucaccucauauucauuauuccuggcuauucuauaaguaagaaagauaauguuaauauuucugauuccucccaucauauaaauuauugaguaucaauugcuagaaauguuuuuuacaaaacauuuagaaugagagugugacucaguaguagagcuccugcuuagcuugcaugagcccaugggaaauaaugaaaagcacuggacuagaccacuaaacccagcuuuuaacagaggucacucacguuuuucaaaaguuaaauguuuccugagucugagaacugaaaauuaaccucuuaugauuaaacagugguaagcagcaagcaguugugagaucuaacggcuuuguauuuccauauuguacauacaucuuccacauacuuuauagauuacuuuuaauacauuauaugauguaaaugcuguaugugugugucauuuaugauauaaugaugagggaaaacauuuguauauauccaauacuaacauuuuuccccaaauauuuuuaauucauguuuggucuuggauugguggauguggaacugaaggacacagagaggcggaucuaguacccucagaacuguuucaguucagcuugggagcagccaugaaaggucaguuacaagccucaaauugauuuucagguuuaauuguugaguugauucacagagauuaaaacuagaauguaaaugucuuuucugacacugccccggcagccccugugaauuaggaguguuucuugugucuuagcagcacucaugggaaggcagauagagaagccucacaguggauuugcugacccaaggcuccuuccugguggacaaguuuagcacuggaaguccagaugugaagaguccccuguguagaccugugcugaaucugcccgcaaucagagacauguggccuucuuucucugaaauuuaaauaugcaagcaucuucuauuauauuuccuaaguuguaaaagcacccauauucaauuuuuucauuuuauuagauaacugauuuaugggcuuaaagugauaacgugucuuuugaauuaauuuuagaaauaccauuuugcuuuuaguguuauuuuugcaaaaguaacugaguuuguuucgucagugcaucuaauauaauaugaaaaaacauuuuaacauguguagaaauacaugaaagguaauaaauagaaccauagcauucuuucuacugaaagcauuuuucaauuuuaauuuuagaauuucugcccacuucauaugggaacaguacuuaaacauccucaguugaacgcccugguucuuuguggguucaaggucugguucccuugcugcggugauaguauugucugugucucccuuuguuauuccuuuccagacccaacucuuuuuuuuuuuuuuuuuuuuuuuuuuuuuauuaaggauuucugcaaaagcaaugggcagauuccuugccuccauacacuccuuagaggcuggggaaacacauguguaucuuguaaugggcuguuaaaagcacuuguucaucagauauuuucuuuuuauuuguagauuuaggaguauuuuagcagguguacauuugcauauaaaagagaauaaaagauaagaaguugaggcuuucucuuucuccucuccucagcauccucucuguccuacccccuuuauucagcacguuuucaccuuuuuuuuucucuagcugcuucuauuuucuagacccaaaaugcauaucaaaaaggaaaaaaaaaaacccucuuagugaucccucagcuucgcaggaagauagaugagugggcucuggcagcuuagguagcaaaguaaaggaaauauauuuaccucauugugucaucagcaugcaauuaauaaaaagaauaggucuuaaucuuugggcuggauacuacaugggauguagaccccuugccuuguauguuuuaaacugcgauauuuucuauuucuuaagcuaaaauuugacauaaaguugaauauauaauagugcuugacuacaggauucagaaucaaaaacuugaggguguguguguguguguaugcauauauacaugcuucuguauaugaaaagaauuggcuucuuuuaaaauguuggauucaucuaaucauuuauuucugcaugugacuuuuucuccuuuauucacguguuguaacuggauuggcaaggcagcagcacacggcagcuuuaacuuccuugcucuccuuuuuuccuuccagaagagccugggccaaaguuacucaaaaaagucauaugcauuguuuggcccuuuugcacugugaaguuggcuuccugacuaagccuucuagacuguucuaggagggaacuguuuaagaaccucuagcaaacaauacacucuugccugcagagucugaggcuggcccaccaucacuuaacaucuuacggcucacagacaguguucagguccucacccuuucaaugagcccuuucccuaguaucuaauuuguaccuguggcugcagcuuugcugaucccucugugcaccuagcuuugcuuucuguaggcagccacccucuccuuagcccuugagauuagauuuuucacugaauccgaccaguaggucugccucuaacccuccugagauuuuugcauucucucuccccucucucagagccugagaaucaggaccuggagcccagagaccuuccugccaggaugcugcuucugcaagcucagaauagugaauuuuguuugauuuugauagugaaucuauacacagauucacugaaaugacaaauuuguagccucaaaugaacucuuaaaguuugucccugagucuuaaaauuuaggugcaacucaauuuuuauuugaaacauacacuugugaggaagagguaggaaauuacaaauuugaagauaaguuggauuccacagggaaaccgugcauuucagaaauguuuaccuuuuauagagauccuaauuagggggaccaugcaucugagaaauguuagccucauaaaggaauuuaagaaauacuaaugaacaguuugcuuuucuucaucuauagaaacaaaagccuaccaguuacugaagaagucuacccuucaggacaauucaaaucaagcugaagagagauuugaaagucaguuuucagguaaguugggauagauucagcacuugaauccuguggcuaggggcugagggcagcggccaggaugaugcuuagagaaucaugguuuuagaguuuucuuuacaaugaguauuacugagucuugagugagcaagaacuuuucauccuuaacagacaagcauuuggaggggcccucuggcuacaugcagccaagcauggcaauagcucucauagacccuaugauucuauuugguguuucaugaagguuucuuuucaccaacuccugcagaagauacucaaaacugcuccuuacuauaucaccuuauuucguaaggacagcucugugcugcauguccacucuugugggagugcugggagauucuccgcuguuauaaugaaaggacuguagacgccaagaaagcuaacguuuaggcuuaaacauaguuucuuuagucuaggguuucauuucaauuuaaauuuucuuacauucucccacuguacaugugguuuucauuuuauuauauguucuuuuuauauauucaauuuaacacccauuauagaaggaacauaauauagaagaaaguauauaugcauuuuuuuaaauuuuagacuuacauguuuuauuuuauguguguucuuguucuugccaaugugaauauguaccaugugcaugugugguacugauggaugucagaagagaauguuggagucucuagaaccauaguugcaguugauuaugaaccaccauggggguacugggaauugaacccuagguccucuggaagaaccaguacucaaccaccaacugagccaucuuuccagcucagaguggcuuuaauuuucuaugaucaccauacucuauuucucauaucagaguugcacagugaguucuuaugauucauauaauucaugaaccauauucagguuuccaguuaucucaaacaugucuuccucugacagauacuuuuucaaggcaugugcuaucugucuguauuuagagaauacauguuaguaagagcuguggcacugucauuuauuuugguugcuuuaaugauucagugugccacuuaaggcuaaagacccagcccaggccuggaagugaaaagcucccagggagagccagccguuuuggugacuaugauuuagcuccaaaaaucauagucucuuaagguauaaagcaaggccucuguccugaaggagauccuauuucuauugcuucagaaagaucuuagugcaggucacauuugggacauacagucugaauugaggcguuuguccaacccccucauuuuauaaaugaggucucaggagagcaaugccuugcucagagcagaacugcucagcaggcauguagagcugagaagguggcgcugcagguaguuugggcaaguguauuuugauucuuuguuuuuuuuguuuuuuguuguuguuguuuuuuucaagaugguguuucucccuguagcucuggcugguagaacucucuuaguagaccaggcuggccuugaauucagagauccaccugccucugccucccaagugcuaagauuaaaguugugugcaagauggcaaguguauuuugauaccuaauuggcagguacaaaagacaaguauuuggcauaaauugucaucucuugguuaucuauaaaaauuaugcuacuauuaaauauauuaauagcuuauuucaaauaauauuuauccuuugagcaguucauauacuaauacaauguauuuugauccuauucuguuaaacuuuucauacaugaaauggcacuugacagguggucuggcugagcacaggcagguucaguuuccucggucuaucucaugaugauaccuuaaagggucccagaagucugguguaguauugacaggagcuucuggugcuguuggcugcucuuagcguugacagugcccugcauucacucuccccugccuuccacugcccuguaguccccugagcugcagagagcagaugacuaucugacagggugaagggaaacuugccaccccaccucccucuaaaaaccagaggguggggaucucagccucaccucucacucggaaaggagcacuccuaucucgguuacuuucugaguuauauguuuuaggccucugucuccagagcuguuacugagaaaacccacuuaaguucugagccccacuuuucauaacccaaaguccugucguauacaaguguggagacucuguuugaguugagcgugggcauggcgcugacagagauuauaugcaggcaaaccauucacaggugagcaacucagcaagccuguggcaaagcugccuguguagucucugggaucuggggugacugcucauuaaagacaagcgucucagaaauaucuaaggcugaggacagugggcacuguccagccuucguccccagggaaaagaguguguuguguauccacauccucaacacaggccgagaguggccuugguagcuuuuagugcaaauuuauucuuggugggauaaaaaacaggaucuagcaaagggcuuaagaguagauaguguagaagccugucaucccagagugucaguuuaugucugagaccugguucccuguaccuguugucuuggugagccauccaucccugccuguguccuaacaaagugaauugaucaaccuugcucuuauuugcacauccuggccguuuaaagcaaagcuugcugaggacuuagcugugggucaugugcuugccuagcacauuugaggaggucucagguucagucccagacuacagcaagggacagagugguuaaagugagaaauaaagcugagcgcugugggugguuauagcuuuguuuuccauuucauuucauuuauuuuuaguguuauaaagaaaauucccgcgccacaguccucuaccccugcgugguguaugaccgugggcccgagagcacucuugaauaaaaauccucuugcaguuugcagcaaaaaaaagaaaaaaagaaaaagaaaauuccccguuucuuuucaguguucuaugaguaguuugucucugggccuagaagccccaacaccuucuguggcaugaacaggaucuuccucuugaguuuccagaauuucugggagacugugugugcaugugucucagacugugguggcuaacucucacuccccuuggcugugguugucacaggucuggauauugguggcagcauguucacaacaaagacagcccacaaaaucgccucggaagcuaguuuuucaucuagugaaggaaguccuuugucaagguaaagucgugaaacccuuucugaauagcaguaacaagaugagaaaugucacuacgcaaugaguucagcccuggcuguguguuauuuugugugugacuugauggaggguuaugguuuggguuuuuuguuuauauaaaauaacagccgaaacuuuagucuaccuuugaaaauauuugccccagagccaaguauuguuuugcagcuguuguuuccucgguuuaagacucaauugacaccucagugaaccacaaauuagcgucuacagcugcucgcaguaggacugcuuagagaccacacaaaggaggcugucaggaaaagggcagggagaagacaucaggccuuaagagaaauaaaguggcauguuucuucuuucugagacaauugauagacgaccgacuggcaauugcucuguauuauuuuuuauguauggauuuuuuuuuuaagcaagucuuccagccacauuacucacuccuuucuuauguguccuugcuuacuccccuuaaaggacagaauguaucuuuucacacuugcuaaaauguaacacuuuuugcaaguuuugugagcuauaauaaguucugugcugaauuugccaucagcaucgauagugaucaugcggugacuucaagucacuuaggaaacauucauaaugugaagcuaaacaauugccugaugcagcgccuacucuuuuacuuuggacuaaauacuauuucaaacagccuggcaggucuccuuugcaguagcauugcucguuaaaaaaaguguccuuuagaugacugcauaccuuugaauuuacuacuugacccugcuaaaauguuaaaacaugaccuuuacaucgcuucugccuuguguaauguccaaauaacaaaaugaucuaauccagaaaugucauauuaaaaggaaaugaaaaugggggaaaaaaaucuguucauuuguauuuuacagaagcauggcaguauuuuaggaccugggcuacuuggauggguuaaguuucucaaaacuugaugaguauccaaaaugcguucuuguuuauaagaaauuaccuuuaauaccagguuuuuguuuguauuuuugagaaaguaggaacuuacuggguuugggagaguguugaauacuauaucgguggguuauacaauaaauucaaguugugugucuuuuaagaggauuuuuaaaggucaguaaauucuacagauaguuuccaguuuuaauguuaccauuuggcuuaaaaaauguaucccuuuaguuuuuaagacugucagaaguauuuguccccauuauguuuuaaaaacauuaaaacaaguccccaucccacacacugagacaggguuucucuguauagcccugacuguccuggaacucagucuguagaccaggcuggccucaaauucacagagauccguauuaaaggcaagcaccacuagugccuagcauuaagacaaguucuuuauguagguccuuugagaaguucuuaaacacacuuagaaaauaauaggaucagauaggacacuuucucagccuggucauuuauaccuggccccaguucgacagaggaaaaauagaaauuguuuuucuacaaauuaaaguauggagccucuuguuauuauauuucuguaugaaauuaauuuucaaauaaaucauaaguaaucucaucaggccccuuuaagaaaaagaaacccacuaaaaggucuuccaggaacccucaguucuggacacuugauaguaaucuagcaugaaaggcuuugaacggugaguguggcuuggugugcuguucugcacaguuugguucuugugcugggucucuuauuguuaauaccccacccugggcuuuggagagcucagguuuugcuguuugugccuggcuuugcugaaauuucuuagaggcuuacauuuaaggaucccacuuacugcagucacuccuugugcuuuauugcuuuuacaaguggucucgaaacccaguacuugagaauaaacauaacagugcuacgcugcuguagcacuuuuaaaaauucuucuuugcucuguuuugucagugagcugaugagcaaucucaaaaaaaaaaaaaaaaaaaaaaaagacccuguuggaccuuuaaaaaaaauggcuuccucugauguccuagagacaauaauuaugaugugcuaguuaagcccaaacuacagcugagggauuuuacuuuaaagcaggggcuugggcgcaaaaaugcauuuauagcucuuugucugcaccucauuaugugugggccugauucauuaaguaauugguuugcaguuguuuacaugaguauuaaggccuucuuuucagccgccuuugagagauacauuguguaaauguugccugugaugaaugcagaaugagggccagagggucccuccuauuggcuaaacagugcacucuguugaaaagccagagaaagggauugggugcugcuuugcauagcaaugacuuucuuaauaagcguuacagauuaauacacacaagcuauaaaagaugcaaagagauacucuuagcacauuuauacaugcucauuucauugugacgguggcggcguccccgcgcuuuuagauuccguuuugcagagcagaggcuucagugugugagccguaauagaauccgauguuuauuguauuauaaaucacgggcaaguaggccgaucggcaacaguuuauuauuaaagauucuuucaguguaaaucuuuuucuaccauuguauuugcuucaguaaaaucauuuugugguugaguggggaugaaaggcaugauguacgaaggagugaguccuaauaggaagcuguucuccgaguaaagaccacuuguucccuuuuguuccggggugcaugccagagcuuccucuccucugcaaacauugucucucuuuaccuuccccaggaagcggcuucacucuccaggauccauuuauucaauggagaguguauccucacagcucccuuguaaguucagcuuacggguucccuuguaacuccggccuucugguugaaucaagauaagauuuuugcugaaagaaaagagugugugcuugcagcauaauugccuaggggaaagguacuaaaagucaccggaccacccgcaccccuuaacagggccaccguggguggcauuucuugccagcccugcagccaugggaucggccagcggagggcgccagcgugcagcugauaaucaguugguggccgcagcuuuucuuucuugucuggucauuuauuuucccuggagcgguauaaagauacuuagauacuaauuguccauugaaguaaaaacgaaaauuuucuggcaguccuucauguaccuuuauaaagugcacaucuccaucuccagcuuaggaaaucugcauugaccuuacaguuaagaaaagucacuuuauuugacgggaagaaguaaacuagcuggcccaaggacagcaaaaauuacagcacgugcuguaggagcuccaacuggccaucagggggcgcucagacuuugucaauuuaaacagccucggacuuuggcgaccuuuaaaauuuaagauugguauuuguggagauuuguugguaugguuauuauuuauacuuucguuucuuucuggauuacuuuuucuccuacauuuuucccagaaaaaaaugucuauuuuugaaggaaagaaaauccagccaaagaugcuauuugaaaaauuuuaauacugauuacaaauccacagaaauuuuugugguucacagccaagauaauacaucuucucauagguggacuugccucucuuuucaugugugugugugugugugugucggugugugugugugucggugugugugugugucugugugugugugugugucugugugugugugugucugugugugugugugucugugugugugugugugugucugugugugugucugugugugugucugugugugugugcgucugugugugugugugugugugucugugugugagugugugugugugugugugucugugugugugugugucugugugugugugucugugugugugugugucugugugugugugugugugucugugugugugugugugucucugugugugugugucugugugugugugugugugucugugugugugugugucugugugugugugugugugugugucugugugugugugagugugucuguguguguguguguaggccagagguuaaugcuggauguucuucuugauagcucuauaccguauuuuucaauacaaguucucucaguguacuugaagcucauccauuugccuagaugcagccacugaguuccaagaagcugccugauuccaucccacccugaccccagcacuagaguuacagacacacauccaguuuugacaugggcacuggggauccaaacucgggucuucauguuucacaguaggcauguacugacagagccauaucaguggcccuccagucuuacaauuaggcccuagaacaggaugaugcgucccacugagggccauuucuuaauuguccucaacgucacaaguuguauucuuggcaggauccucagaguuaauugccaaauucgaguggaccccaaauccaguaauucagguguguuuguuagugggauguggauuccccccccccccgguauaagggagggaauggcagucaguauguugcuaacauuaccauaguccccaagucuucuagucucuaaauuuguccaccuuucaggaccagaagugaguaccaagccccaucccaacucuucugcuguugcugucuugagaaggcuuauugcaugcacccccuccagauagaacagccacauucuagugcucuugcuggccugcuauguagacuuaaaggguguccuucaugguaccaggucagaugccaugcccuaaugcaacaugcuauuccaugccuuuggccuuucuguuguuuggcugggauacaccuacucaaaugcuuccugggcagaggguggcugugccauauaccauucuaguggccccauggucccauuucugucaccaccuagcuagguauaggagcuuguuuccccuccccaugugagcuucucauuggucuggcagguuuaucagcagagcuggguaacugcuggacuuucugagagugcucagcaguucacucaagccuucuucgugaugcaaagccacuugcaaagugccucaccucugucugguucaccuuccuggccugugggacaauguguauucuauccaguuaucuacaagugguauguguaggagaggcguaugcauuuucaaauggaaaucuuagcucacuucaaauuagauugccuucccaaacuguuccaaagccaucugcagucacaguuucaaggaacaggaaggaggugggcgugcuuacaggaagccuucauggggucuuuccuggcucuguccuguaugcugaggagacuugucuuggucuugaccuucaugaggauguggaggcucuuggcauaugucagggaccugaaacagcauucccagcugugcccuccuucgggugcccuugucuucagugaguacuuuugaaggcagaacuggaguguguucuacuuuuuuuuuuucuuacaaagugccaaguuuccugugguauuuucauuuacacuuaguuugcugguuaguuuuugucaacuugauacaaacuagagucacuuggaagaaggaaucucaauuggaaaacacccacaucagauuggccugugaggcauuuucuugauugaugauuaauaugggagggcccaacccaacacauuguaggcaauccugagccuggucccaggauguaaaagaaagcaggcugaguaagccucggagagcaaggccuguaagaaauguaaguaguaagaaguguuucucuccauggccucugcugcaguuccugccuccagguuucugucuugaguuuauuuuuaggccccgaaaucuuauagcuguagcuguuaaucuaugugucuguucauuaccauguuguucuuguugaucuguaagauaccuugaaauuagguaugauaaugccucuaaaccaaugccucuaaaccuccccccacccccaggauuguuuuggcuaucagaagucucuugugcuuucaaauaaguuuuaagauugguuuuucuauuuccauagaaaacagcacgagaauuuugauaaggauugcacugaaucuguggauuuuggcaaaauagcaaguuucauaauauugaccccacugauccaugagcauugaaacuuuuuccaucuucugauaucuucuucaauuucucuaaaguauuuuaaaguuuuccuuagaaaggucuuuaacuuccuugccuagguuuaucccaagguuauauaugguuggagggcaauugugaaugggauugcuucccccauuucucaauaugcuuguuagugauauauaggaggagcugcugauuuuuauaaauuaacuuuguauccugccacuuugcugaaagugcuuaucaguucuaagaguuuucugguggaguuaguagggucucuuuuuuauagaaucugcaagcacagauaauuugacuuuuucuuuuccuauuugguucucugguguuucugcucuagcuuagaccuucaguacauuuaguagacguggagaaagaagacugccuugucuuucuuuugaucucacuggaacugcuuuaacguuucccuguguacugaaacaguguuggcuguagguugugaguguuuuuguuuuuguuuugaugucuuacugaauuugguuugcaagcguuguguagugaacuuuuucgccuaugaccggggagauugguuugucauuugucuuguuuuuguaccuuuauugacacaggaaaauccuggcauuacagaaggacuuuggaaaugcuccuuuccuguuuuauggaauaguuuaagaagcauugguauuaguucuccuuugaaagucggguaaaauucaccagugaauccauccaggccuggacuaguaaaucagaccuuuuuuuaaugcauuuauuguauuuguguaugauguuugcuugcauauauaugugugccacaugagugccuguugucuucagaggucagaagagggugcuggguccccuggaaguagaauuauccauguuugugagugccaugcaggugcuaagagccauacccuaguccucugugagagcaacauguguucucauaacugauggacgucucucccauuccuccaggauuuuuuuuguuuuguuuuguuuuuuuaaaucagucucacaguuacugagccacuggcuuagucacuauucuauugcuaugaugagacacagugaccaaggcaacuccuaugaaagaaagcauuuacuugagugcuuaaucaauuaugaucauggcagaaagcacggugucaggcaggcuuugugcuggaaaaguagcugagagccauacccugaucugaaagcagagcaagagagaccggaccuggcaugggcuuuugauaucuuaaagcccacucccagugacacacuccuuccaacaaggccacaccuccuaauccuucuaauccuuucaaaccauucaacuuccuggugacuaagcauuccaauauaugagucugugggggcaauucuuauuuaaaccaccacuuuccacuuccugaccccauuauuauauaggcuuguagcuauauaauaaugcaaaaauguauucaguucaauuucaaaaauuccuguagucuaucacaguccuagaacugcuuaaaugucucuauugagacucauggcaaucucuuaacuguaauuccuauaaaauaaaauuaaaauuaaaaauaaagcagaucauauacgcuggcacagaaaauacuuuaccauuucaaaagacuggaaagagagcauggugaggaaauccuggaccaaagcaagaacaaaagccagcaggacaaacuccaaguccugcaucucaucucugaguaugaugucaaagcauucgucagcucuccaacuccuuucagcuuuguugauugcaacacauuucuuucucuuagacuggucccacaccaaucugcagcucucauuggcagguaucccacaaaucuggcaucuccaacacaaccuaggcuucaccuucacagcuucaugcaguggccucgaucagcccccaugcagggacucccccuccccccgacacacgcagcuuucuuuagcuaaggagggagauuccacaacccuuuuuuguauccuugacuaagccagaacuacauggccaaagcugccaaguucugcuuguuggggcuggaacuuggcccccucucucaauaacagugcaccagcuuucuguuguggaugggucccuucaagacuuuaguguuccuuugauuccuuuuuacaaguugggagcucaguaagccauaucuugcccugagggcaccacuccuucauuccauuuaguggcaggcaagcuuuucuuuagccggcucaucuccuggaguugaggucuuggcucugcacccucuucccuggugcuccuuuucuccucacacuguacauuuguauuucuccuggccccacuugcuccuuuucauuggagaucugcauaagagugaccccuaguaaccacaaccgcaugccauagucaauacuaggcugucuugaaaccucugccaacacuauuaguuuugguaggccacguguauguagacaugcaucuguuucuuuuaggcuuuccaacuuagugaguguuguaguuugcuuggauaaauaccaugaccaaaagcaacuuagggaggaaagaauguauuugauuacacaucccaggccacagucuguuacuuaaggaaaucagggcagaagcucacagcaggaacccagagacaggacuaaagcagagaccauggaggaaugcagcuuagagaccucccuugacuugcccugcuuucucauccaaucuguacuaggagugaaagaaccuaguggggaaacccccacucaauucccgauucagggugcacccaaagaaucacgaacagaccgucuugauguaaauacacgagguaguuuaauggcagagcuccaggucgaaacguaucucacacaggagacaguagauuugaccacgaggcuugaaagcuagggguuuuuauagaaaagggucugggguugggggaggaauuggcgcaguuucacaugauugguucauuuaaacaucagcauacuguacaugcagauugagguaauagcagagcaucugguuaacauuuuacauaggucagaagggcgggagauagggaggcaccuggucaguccagacauucuuguaugucuucucuaucuucauggcuaguugguuccugggaugacuuuacagccuuuguucuuugcucuaagcccaaaaagcccuccuaacaacaagccgcaugaaucauggaccuugaauuaacuuuuuggcuagggcuuugaagucuugaauuuaguuuucuuucuuuuaggagcaccuguccaaggguggcaccacccacagggggcugggccuucccacagcagucaguccuuaaugaagaugcaccacagacuugucuacaggcucuugaacucaccaccuguuuucacacccacuccccagucucugcagcuccugguguuagacuucugaggcagcagaaagaggcagaaggcagaaagagaccagucucacuuucaacagaacuauguuuauuggcacacacagcaagggaaccugcggggccugggagcagggaggcugcagcccuuuauacaagugaggggcuuggaaaggaggggaguguuguagccauagggcuguagguauucaguagguguucauagacucuuuccagaaacugucugccucuagaaggacagauuguuuuugggagacaggcuaucucugcaaaccuuccuuucuggauugaccaauaguggcugaucgaggucaucuguaaucuagugggaauccuguaggcgccucacuaccaugaguuacucuaucaccuggucucucagucaccguaugcuuaacacuuucauugcuucugguuuugacaugucuucuauagauugcaugcuuccuagcugcaggaguuuccagccuccugcauuuuugacaucuuacagugucgaggguuuauaaaauucaggugguaauaggaagugcugggugagauuuugccuguguggauccucagaaggccacguugcuucugccuucucuccugccuuagcauugcaguuuacaccuuacucaaugaaaccaucugcuucuccauuacaguaaugccagggcugcucucucugaauccucaacagugcaacaaacaacaaaauaacaacaaaacuguggucuuuguuauuccuuugugagcuaguucccagggaauccucuucucuucuuggaaggugccuggaauuuuguauccugcugucccagcucaaaaugugacucaugucuuccacaccauucuauuuuauguucuuuuguagagaaugauugaaugagcaaacgaacucaaacuagaugccgugcucaccacuggaggaaggcagccagagcaguuuuccaccucucggagucugacaugucaccuucagugcaccuaccuauugggcuacuuagaaagaaaauguguauuaauccugucuccucucaguccagcccaaaccuuaguuuuccuuugcucugugccugauuugucauuucuacuuggaauucauaccugcaugccacaaugaccagggacuuuuguucauccagauguguccaaaaugucauggcacuacuugcuaaaguccaccucauacagacugucaugugggaucaucuguaaacuuaccagaacacuagaaggaaggcauugcugaucuauuuuauaggcaaccagacuggugcucagagaccaauggaacuggcccaagguacaugguaaacagaguuggguauuggaagcucuaugcugcuaugucccagaucuguaaaaggcucuguaaaugacacucaggagggauucuguacuaugagcugagugguuuuuauacuucuaccuuuugcuuguugucuauccuucuuugagacaggauuucuccauauagcccuggcuguccuagaacuaacuauguagaccaggcuggucuugaacucaagagaucugccugauucugccuuccuccagugcugggauuaaccacccugccuggcagcuuuuauacuucuaaaugguuguaaaacuagcccaaagaaaaguucuguuccaugacaugugaaaguacaugaaauucaagugccauugucccuaaauguaguuucauugagguacaaccacaucaauucauuugcaugcaucugugaucacagaccugagaaaauguaagguuucuguauccaguaucucacucuugcugccaguggaagguggauaacagagggacagacuagauguggugucaucagugaagccauugcaagcauccauguuggaguuucuuagugugccugccaaugugauaaacauauguaaggaauugcuaaggaggccaaguugacuauguuuggcaagggauauuggggggaccagaaaguuggggauaccacaugcugagauaugagagaaaggaaagcccuggugggguagagaccacaugagaaggauggugaguuugacuacaauuuguuuuggaagaaggcaagggggucuaccagauguucacuggauuuguuuauggaacucaaaguaggaacucugaaacucaccgaaucuguagggaccuggccugggccugcuugucccugucuuuuugcuccugcaucaagacauucagcuguuacaucccguuccacaguccaggccuacagugucuucuuucucaacuagaagcaccuugccuucuggggacccugcagcucucagcccucucuuguccccaggcucuuuguccucucagucccagcugacaacagguuugaccuucuuccugugcgucuccuuaugcagaccacagcugucugaagacuaccugucucccagcauuuuaauaaucugucucugccuuccggcacccaguccagcuaccuagcacaaggguaguggaaguagguaaauagucucccagcccacguggguucauuauguguuuacagacuuuacauaaaaaggauucuuugaggcucacuuuguugaugcccgccccagugguagcuugacuauugccuaucuguuggccccuuucagauggucacagggguguugugcuguuuguagagaaugaccaugggcacuacugcuggacccuggucagcagcagguacuaagugccaagagaauauggcagggcacaguagagcauggaaaauggacccccaggagaaccugguuuccugugaugaguguauuagaggguauaugcauaagcuggagguugaccauacuuggacgaagggggaggggggcaugaauuugcaagguuucccucucacaaugagcaggguccuggccaugagagggcagcgacuuguuuagaaaaguaaugucuucauugaccacuuaucucucagcaugagacuuggagaauuuagguauaaugcaaaguguaagugauucuuccagaagggcucuuuuaaacccucuaaauugcacaaagcccugaaaaggcacacugagaaauuccacucggaagagccagucuuguccucuuacauucagcagaggaggcuagguaccaaaaguuauagacucuagcaucugugucaauggauaugaagaaagcaauggauacguugggugccugcagcacuuggcuauuucccauaaugugucuggggcgccugccuuuguuaaacuguuagcauuguugcugauuuggcugagguacuuuaacuuccuccucaacgccuagaauucucuucagguuuuccacuuugaguuugcgcgaaagcaccgacacuucguauacaguguuuuccagaggacuguuggacagacaccacccccugccuacugcugucaugauggcccuccaacggagcccacaguacgccaggcuccccucagggcaggggcugccgagaggagugcacuggaggcuggugaggccauggaaggccagggcuucuucagcagaugccucuagccaccuggagccuagacacuuuuaugcucuaaaagccuaggaaggacauaugaaacuucucuccuuaccauaaacgccaccgcuucuuccccaacagcucccuguaaaaacucucagaccagcugucaauuuucacuuucuuaucuuauaggcacgaaagcaaaagggacccagugaccaccauaaagucaaaugguaagaaauagacacaaauuuucauuucucaucuugaccaaaagaguuguguuggcuauuugucuucugugucuuugugugaggacucugccauguccugucagccuagggacagccugcauagcugcccgugaacaggaccuucagggaaaggaccaugaaggugcagguugcuuggcauugacugucagaaucggugcacucugccuacugaacacugugaagaauauagcaugaaguauguaaauuugugcaggugacacagugcugcuagacuguucaguacucugaccaaauauuugcuuugcuguuuugaaaauccuacauaugaauguaaaaguuaacaagccauguucuuuucucuuccagccuucuggggggagucugaugacaguaacucugaaaucgaagcugcccuacguccuagagaccaugacaugcccgaugauuuugaugauuuuuaugacacaugagcuguugcaugcuuagaaauaaagucuuuaaaacaaagcgucacuguaauuagguguaauucccaacauaaacauauccuucuaaguuugcuaguugucaaaggggaaaacagacuacaacacuugccuagcaugagggggucgggguguugaucccuagcaccagggagcccugugaggagccagugugaugcacauggcagcaguaggauggugaguuccaggccauccugagcuauuuagccagagucugucagcccaacacuugggagguagagcaggaggagcagaaguuccaggccagugucaacuacggaagacccucugguaaguugagugagaauggcucccauaggcauacauauuugaaugcucagucacgaguugguggagcugucugggaaaggcugagagguguggucuuguuggaggaggugugucacuccgggugccauuugaguuuucacaagcccaugccuuucccaguuagcuuggucucuuucucuguuucaugguuguuaucucaacagguaagcuuucagcuacugcuccagcaccgugucugccaguuggcuuccaugcugccaggcaugauggucauaaacucuauuacccuuuggaaccacgagcaccaaauuaaaugcuuucuuuuacaaguug

SEQ ID NO: 1138 - RNA, 65828 nt, Mus musculus
cguaacuuccggccgcugaacgcacgugggaggaagugcuggugcccgcggcugccgcuccugcuagucucguugguuacacucucccgcuggcccggcugcuguuucgagcugcccgcuggucaugggagucccggcguucuuccgcuggcucagccgcaaguacccguccaucauugucaacugcguggaggagaaggugaggaggcggccaguacgccggaguggggacccggcguggcaggucuaggccgaggcccucggggaugggcgcccgccccaagcugccucacgggccgcuucgcggguucgcgguuccggaggcggucugggcggagcgagggcgaguagggggcuuugggggcuugggcggcuccucccccgccugcgaagcggggcaccccaggcuccgcccacggcuuuguucccuccgcgccgcucacugagcuccaaagggcgcccaggcuagucagccccccuagcgcgggcagcaagguuggcaggguagggaccgcugguugguccacugucuugagcccggaguucccguuggcuggaucgcuuguuuuccacccgagccuggccauuuguugcaguuaagcgugcgcgggcagcagcuaguuacgaaggacuaggcuaggggagcgcucuuucucccuggcgggcuuugcuguacgaaugccgggcagcucgcuguguuucacuuccugccuccguuaguuugcuaguuuacaggcagacuuuuaagucguuccgauucgugaguguugcuuuugucguucgcguaauucugucgaguucgacuuuguacucuaaguuagaauuucuggauuggaaaaguuccgggcacauguguccccucccacuuucggcuuuagaaccgccucucuccaagaaccuauuucucccgcugaaguuauuuacuuucucacuuccugucuuagaagaaaccaaaagcuuuguuuuggugacaauccuaguauauuuuuguguucuccaaagacaaauugcuaagcugaaccauuauuucuuuauaaacauuguguucuccuggggggggggggucuuccaaagggagagccacuuuuucguaacagacacuuugaacuguuuugguugugucucuuaauaugguuaaguuugauuuaucgguuuuaggucuaucuaauuuuggguagaagaggaauuagcuauuuauucaccaccaccccaguuuuucuaaugcuaauccauaaaucugacgguaaaauuuguaauuuaacggagaacucguuuaaacguauaucgggccaaggcguggcacauacuuuuacucccagcacuugggagagagguaggcuugaguuuuggaggucagccagauauacacagaguucaaagcaaaccaaggcuuacguaaugagacccucuugcaaaacaaacaaaaauucuaucgccuauacaaaguaucauuucuauuucuaagauugauguuauuuccccgcacccccccccccagcuguuuaacuuuuugguuccccuguacauuuuaguucucauucaagauugucaaaccuuugaccauacaagcuucgauagaagcaguguuguuggcuguuuuuaauugugauuguaguuuaggcuguuuaucuuuuauucgcgcuagcuccucccuuacccccucccuuucaccccuaguuggguacacuuuauaccuuuccccauccaaauucuuuuaucaggcauuccgucaaguccuuuuuuuuuuuuuuuuuuuuuuuuuuugguccauugcgccucuuuuuuuuauuagguauuuuccucauuuacauuuccaaugcuaucccaaaagucccccauacccuccuccccacuccccuacccacccacucccacuuuuuggcccuggcguuccccuguacuggggccauugcgccucuuuuaaguauuaauuuuuuaauuuuuuaaguaggaucucccuacuuagccacaaacuccagacccucagacacaggcaagcugggauugccuguauacugccacucccagccuggaguugucuuuaugucuguuuucuucacagcacuuuuuucaguaugcuuccuggaaaggugcuucuugagaauuacucuuugcuaaauagcucaucuuucuuggcuuaaaucuauccuugguuuuuacguuugaauugacuuuuuagaaaaugccacugugugaucugaguuuucugucauuguaggucccaaaauuuauuuucuccaugaguaugaguccaagcuggaaaaccauuucccaugaagauguuggaaacacucuuuccagcuguuauuguugaugaaaagucacauauuuucuuuuaagacaaggucucacuguguugcucugguuggccucaaauuugacugucucuaauuucccaagugcugggauuaaaggugcuggccccuaggccugccaguuuugugacauuuauuuagccagguuuuugguagcauuugccauguaucagacccuguucugggcacuguauugauauuaugguguuagguacuuauuucggaaaagaaaguuguuuuucaagcuuuugaaaauuuucaauauuuuugauaaccuauucagcuaacgucaguaccagugugaaaacugggaaggucaugugccuaacuuaugacccuccccuuuuauuguucagaauugaucaguuuuuugagugcuuguauuaguuauuuucaguguuuucauugugccauuugcacacauuuacaugauauauuuagaucccauccacucuucuuuuacaucuuucuuuucuaggucaacuaacuaccuuucuacauugacuuuuucugugugugagcuggcaguuaguguuauuuagaagaauaugggugagagcgagcuuucuugcucacacucuccccuuccccuuuuuucucuucuauaugguuucucuccuggaacuugcucuguagaccaggauggccuggucuccaaucucagaguucuaccugccccuaccuacugagcucuaggacuaaaggugugcaccaccaccuggugaaaguuuuuaaggauguacauaugugcacagacgcaaguucccaggacaggaguggagggacagugacaugccuuggcguguguauuggaggucagagaacaacuuugaagucaguucuuuuuucuaaguaagcaccugcugguuggccucuaugcuacuuauucuuccugguucauugacuucuauguuacauaguuaaauuuugagauuaguugauauugguucauguauuaaccaucucuuucauuuuugaaacauugucauuuucuaugcgcagcuuuaaaaguuaaaauacauuuauuuguugaauauaguguggcuguacuauauauaauuauauauaaugaauuucauuaucauauucucaugugcauauguugcacacuuuauucuuuacuccuucccauugccuuauuuuggcagaagucaaaaauccucuugagacugugucuuacuuugaauuuuauugcugugaagagagagcacgaucaaggcaacucuuaaaaaggcaaacauauaauuggggcuggcuuacaguuugagaggcucagcacauuaucaucauggugggaagcauggcagcuuacaggcagauauggugcauggaacugagaguuguacaucuugauccaaaggcagccaggaagagacggucuuucuuccccaggcagucaggaggagagucucuuccacguugggaggagcuugaacacuagaagcccucaaagccugccaguacagugacacacuuccuccaacaaggccacaccuaauagugccaucuacuugguccaaccauauucaaaucaccacagaauguacacauuauuugucgcagucugguuguuuagcauaaugauuuccaguuccauccauuuuccugcaaauggcauaauauccaucaccucuguggcuuaauaauacuccaguguauguauucacacaucuuccuucaguguucaugaaauucuuaagcuguuuuuauaaacuggacacugguacuuuauagucucaauaaauaugaauguacagcuauuucuguuuuaugcuggcuuggauuccuuuuagucuauauucuagagugguauaauagcuagaucguagcauaugcuaauucugucuuucuaccuuuuucuuuuuuuuuuuucuuuuucauaauggcugcugucuagcagugugugugucagcacuccccaguaucuuugccagcauaugaugcuugauuucuuuaugauaaucauuuccacuggggugaaaucucauuguaguuuugauuugcauuucuugauaacuaaggauuauuuuucauauuauuggcaacuuuaucuuuuaaaagguuauuucacuuauuuauuaauuagauugugugugugugugugucaggugaauaacugucagggaugguuuucauucuguaugcucucacuaccaguugcuugcuuuuuuaugcagagacuuaguuucaugauaucucauuuguuaauuuuuuuucauuuauuuuuauucaugucuguguaagagugccacaagagagcauuggaguucccccuagagguggaguuuuuggcaaaugugacccacccauguuggugcugggacccaaacuuggguccucuagaagagcaacaaguggucucaaccaacugagccaucucuucagccucucauuugucuuuuuuuccuagaaauuuccuugacaacuagaguccuugcuuguguuuuuaucuuaguguuuuccauauauuuucuucugguaguugcguaguuucuggucugauauuuaaaaucuuugaucuauuuugaauuuauguuguaaugaacaagagauagagcucuuuugaauguaaauacucagucugcagcauuguguuuugaaaaaacugggauuuuuuagcacuuuugccaaauccaugauggcuauuguuauuuauuucuggguccucuuuucuuuuuuacacaucuguuuuuguagugcauaacuuugcugauuuuauuaccuuggcucuguuguguaauuugagauggaguguagugacaucucuaguguuguucuuuaugcucaggauugcuuuggcuuuuuguacucccaugugaauuuuuucuuucuguggagaaugucauugcaacuuugauagggauuacauggaaucuguagauugcuuuugggcugguccaaagcaugggggauuuucaucaucuagugucugcaucaguuucuucaguguucuaucaucacuuauuuugggauuauaugcacagugcaugcacagaggugguucuugugcuaguguaugaaguggacauaggaggacugaguaucuuacucucuuauuuuccaccauauucuuuuaagagaggauuuuccacugaacuggaagcucacuuuuuaggcgaggcuaacuggcuauuuauuauuauuauuaucguuguugucguuauuauugcauagucuagcuauguaagcaaagcuaacuucaaacucucaggauccuguuucaacuguuggaacacagaugcuuaccauauugucugguuugacuugaauuuuuuuuuuuaagacuuguuuuuauuuuauguauaucaguguuugccugugucuauguauaugcaccauauacauagucaaugcccaaaggcuagacaagguuguucuuugcuuuguuuuguucuuacaguuuuucaagacaggguuucucuuauaucccuugauguccuugaacucauucuguaaaccagacuggccuugcccuugccucccaaguucugggaucauguaccugguggccagaggacaauuuuuugggucuuuuguccaccuuuaugugaccucugaggauugaauucaugugaccagguuagccauuucacuggccuaaguguuuuaaauuacauuuauuugguggcaguggguaaguggccaugguaugcauaugaaggucaguuccuucuaccauauggauuccagggguugaacucaagucauuaggcuugguagcaagggcuuccccccccccccccugagccaucuugcuggacuucaucuuuacuguuuaaugauaauuuuccuagauaaaaguuuuccuugguuaacacuuucugcuuuuaugcuauccuucucaguaagauguuagucuuacugagguuuucuagaaaguuacuaagcauuuacuauuacauuauauaaaaauuuuagacuuauuacgugugugagugguuugccugcauggauguguguggugcucuuuguaguucagaagagggcaucagauucacugagacuaggguuacagauacuugugagcuguauccuuggaaucaaaucugggucccccacaaaagcaacaagcacucuuuuuuuuuucaacuuuuauucucauauauuauauccugucugcaguuucuccucucucuauuccuccaagucuucccccugccuuccucccacccucaauuccccagaucaguuucccuucagaaaaaaaggccuuccagggauguccgccaaaauuacccuaauaagauaaauaauugggaacaaacccucacagcaagacuggauaaagcaaaccaguaggagggaaggggucccgaagcacaggcaaaaaagucggagauuucccccagucguacaagaacauccagcuaugcaaccauaaggcauaugcagaggaccuagcucagucagacccacuuagagguccuaugagcucugcuuuaguugauucugugggccauguucucaugguguccuugaauccccgacucuuacaucuuuccucccccucuucugugggguuucccaggcuucacuuaguguuuggcuguguggcucugcauuuguucucacgccccucugaugacaguugggcuaaguauggaucuauaaguauagcagaauaucauuaggaauuauuuuauugacuuuuuuuuuccuuuucuggguuaguguguuugguucuauucugagucucugggcucuccugccuuugguuccuagccauccaggcagugucaggucuggauuuccucucauggcauaggcccaaaguuggaccagucauggauuggccacuugcacaaguucugugccacugucacuauugccccagcaugucuugcagucaggauaguguguuggucgaagguuuuguggcuagguugaugucccaguccugcugagagccuugccugguuacaguagagaggccaauuugggcacuguaucccccauuacuaggagacuucccuagggucacucuccuagauuccaggaaguuuccaucucauuagguuucuaccucgccuuccaaaugccccacucuacccuaauuccagucauuucuccuaguacccaccuccuuaucccucccacauuguguauuuguaccacacuuuauccauucuucaguugagggacaccuaagucaucuccaguuucuggcuuuuaugaauaaaggugugaugaacaugguugagcaagugucuuugugguaggauggaauguccuuugggaauaugcccaggagugguauagcugggucuagagguagauugacucccagauuucuaagaaaccaccauauugauuuucaauguggcuguacccaccaauuaauuauauucccaccaauaaugaaggagugcucccuuugcuccacauucuggccggcaugugcugucacuuguguuuuugaucuuagccauuuugacuguuguaagauggaaucucagaguuuugaucugcauuucccugauggcuaaggauguaacacauuucuucaagugcuucuuggccauuugagauucuuuuguugagaauuugugguuuagaucuguaucccauuuuuaaauuggauuauuugcuuuguugaugccuaguuccucgaguucauuuuguauauuagcccucugucagauauguaauugguaaagaucuuuuccuaguguuaguguccuuugucuuauagaagcuuuucaguuucaugaggucccauuuaguaauuguugaucuuagugcuuguguuaaugguguucaggaaguugucuuuugccaauguguucuauucccuacuuucuccucuaucagguucagugugucugguuuuaugguagggucuuugaucuauuuggacuuguuuuguacaaguaauagagauggaucuauuuguauuuuucuacaugcagacauguaccagcaccauuuguugaagaugcuuucuuuuuccacuguguaauucuagcuucuuuauaaaaaucagauguucauagguuuguggacuuaugucuggaucguugauuugauuccauugaucaaccugucuguuuuuaugcuauuaccgugccacuuuuauuucuauaguucuagaguauggcuuaaaaucagggaugcugauaccucugggucuucuuuuauuguucaggaugcaaaaagugcucuuuaagugcugagccaacucucuaaccugucugaacugccuccuccaccccuuuguucuucaguguauucucucucucucucuuuuuuuuuuggauauuucagcauuuuacugugauguguguauuuuagaguucauagagcuucuguuauauuuuuuauuuggauuaauuucaaucuuucuuugaauuuucugcucuuuccuuguauuuuuuuuuaauaugguaaaguuacuguuuguucuuagaaccauuuccaaggauugcagauauauacauauauuuguuguuuguuugugucuuagucaggguuucuauuccugcacaaacaucaugaccaagaagcaaguuggggaggaaaggguuuauucagcuuacacuuccauacuguuguucaucaccaaggaagucaggacuggaacucaagcaggucaggaagcaggagcugaugcagaggccauggagggauguucuuuacuggcuugcuucccuuggcuugcucagccugcuuucuuauagaaccaagacuaccagcccagagauggucccacccacaaggggccuuucccccuugaucacuaauugagaaaaugccuuacagcuggaucucauggaggcauuuccucaacugaagcucuguucucugugauaacuccagcugugucaaguugacacaaaacuagccaguacaguuuguuuuuggagacacuguucuggaaagaacucugagcccucuugcuugauucagcauauuuuauagaaccuucuaaagguuccucuuuccauaucccucacugucaauuacaauacauauugaagcuugcuuucaugccugucccucccucugaguaaacacuuuuucugaaauaguuuuuuucauuauuccauugcuauucucugugcauuugcugcauauguauucagcccuaaacgauaucuaauuaauguguauuuucugccucuuaaauuuuuuguucagugguguguucauaacuauccaguugcuuuuuagaucuuacuuggccuggcaguccaguacauggauacaugguacucuauguuagcuucugaguuuuauucuuuaaacagcuuuaugagauauuugcauacuagguacacauacuaauaauaauuuucauacauauaaaauuauuuuaaucauguucaugucccauuacccuugagguauaaauucuauaucaugaaauucacuugccuaaaauaccaggguuuuuuuuuuuuuuuuuuuuuuuccuuuugucuguuuuggguuauuugcucuuuaaacaguuccacugcagucuugacuguccggaaacucacuucauagaccagucugucuucacaugaauagagaucugccugucucugccucccacauguugagaucaaaagcaugcaccauuaugccuauugguguuaguagguuuuuuuuuuuuuuuuuuuuuuuugguuuuucgagacaggguuucucuguguagcccuggcuguccuggaacucacuuuguagaccaggcuggccucgaacucagaaauccgccugccucugccucccgagugcugggauuaaaggcguggccaccacacccggcugguguuaguaguuuuuaguguauuugcagaguugugugaucauuacuguuauauaauuuuagauuuccuuccuaccuaaaacaguagauacucauuaauagucacuuuucauuucucucccucuuuuuucgcauucggcuugacacagccuuaucugccuuuuauuucuauagacuucuccaugauagacuuuuuucauauaguuauacaggauguggucuuucauacaaucacacaggauaggugacugcuaucuuuuagcacaauuuuuuuuuuuuaaauuaccugugauuuagcauguacaugauggaugggcuuuuaaugugcuuuuucccgccgguugcuuuguauguguuuaaggacucguacuauuaguaagacaaaaauugggucuuguuaacacaagaugucuuccauugacguucuggaagaaaaagacaaaaguacugucauuauaaaaguauaauugagagccuuugagaguacaccccuacuuuuugaagaacucacaauguaauuagguagaaaugacaaacuauucauaaaacuaugacgaucuuacaagaguguaagcaaaauccucagaagugcaggaaggaaacaguucauugcuuggggagugauauguuacagauggacugugaaguuagugacguuugauuugagucugggcucugaaaaauuauugagguuuuaggaagugaguguugguagagaggaagaagacggucuaccaagaggugcgacagaaggaaguagugagaggacagcauuuucuuggaacuuguguuuugcuguuuuguuuuguuuuuagacuuucuuuugagaugaggucuuacucuaacucugaaacuuacuguauagccuguuagccuuaaacucaggacaauuccuuucucagcuuccugagugcuguguuuaggugccaauuacuacacaccuggcuuguaggagcuuuugagaaauggacugggucuccauaauaucauugugggucaggcccguuguuuagcucuuuggugugggaagcacugggaaaguaggcaaggaugacacaaaugcuuuuguaucuaaguguuaaacacuagacuggaaaugagaguguaugaagguaguugcuacuuucuagguaugaugugauagcaugauaucaugcucacagcaugaaaggagaugaguggaaaagcacuuuagguuaaauugacagaacuuguuaguguaaauggugagagacacgacgaagaugacucccuuggccuuacuugauuaugucagugcucucacacaauuaacucgaauuagaagcuguucacauuuuaaugggaacauucaauuugauuccgcuuauacuugcacuuccgaaacuaaaucaaaucauauugugcuuaguaccugucauguuuagaucugcacaauuaaaauauuauuuaucacuucuucauagccaaaagaaugcaacgguguaaagauuccaguugaugccaguaaaccuaauccaaaugauguggaguuugauaaucuguauuuggauaugaaugggaucauccaccccugcacucauccugaagacaaguauguaauccauuucggccuugauggcacaagucgcagaaauucuguguucuaguauauugucugcuuaucauuauagaccagcaccaaaaaaugaagaugaaaugaugguugcaauuuuugaguacauugacagacuuuucaauauuguaagaccaagaagacuucucuacauggcaauagauggggugguaaguacuuaaaaaaaucauuucgaagccucuauuuuuguuuuacuauuuucugaauaucucagugaaagucagcugaauaguaaaaaauguuaacuucgguuaauuucagauagaaaagucucauacuuaauaauucauugacauuuucuuuugucauuugcugugcaaugcuauggauuauugauugauggcugccccuuuauauagacguagaccgagugaauuuagaguacuaagugauacaugcaaagguguugggagaagaggcaguuuggauuuacuaugggguaaaaagugaagguuagaaaugaugcuuaggaauauuuugaauagcauuauguaaacgugagauaauacauuuauaggcaccacgugcaaaaaugaaucagcagcguucaaggagguucagagcaucaaaggaaggaauggaagcagcaguugagaagcagcgagucagagaggaaauacuugcaaaagguaaggagaauaaguugaacauuccccccucagagaauaaaguuggagagggaugcugaggccaauuagaacuaguucucccuccacccaaugucugugguguggcauuuucguugguuuuaucagguuuacuuguuggugugugcuauccacagcaguauaguagacagaaaauacacauacacacacuaacuuuuuuauuuuuuugucacuaaauugcauuuuaagucuggagaaaaagaugucauaggccuaacauuuauaaauuuuauuuaugcuauuuuaacuugcuggacaguguguaaguauauauaguuauuuuagucauggcuuguacuuaagauucccuuugccuccuccccaacacaggguuucucuguagcccuggcugccccugaucuuacuguguaguucagacuggccuugaagucagagaucugucugccucugccucugccucugccuccugagugcugagauuaaaugcauacaccaccacuacucugcuguaguuaagacucuugcagcuuguuuaugauagaauauuuuaaugauuuauugagaacuauugucaaaauuaaaaccauuauucaaugcuuauguucucuuacaaaagaagaaccucaugauuuuuauguuuuguguuguaguaucuuuugugugcuuuguauuuuuugacagucuuguuaaagcagugguucucagucugugguuugcgaccccuuugggcagugggaagacccuuucacaggggucuguauaucauauacucugcauaucagauauuuccauuaugauucauaacuagcaaaauuacaguuauaaaguuaugguggggucaguacaucaugaacuauuaaaggguugcaccaaagaagguugagaaccacuaaguuaaagcuuaguuuaaauugacggggagaaaugcugcuuucuucuuagagaguggaucaucuuuuucuuaagauuauaacaucuuucauauuuaaauuuuuuuguuacucuucuaccuuaauauugauuaauguacuucaguuuuuauggggaaaacaaaacauugccucuuucgucuagguggcuuucuuccuccagaagaaauaaaagaaagauuugacagcaacuguauuaccccaguaaguagucucaggcuuugcuagcuacagcuaacuccuaaauuauagguuaauuuuuucuuucuaucauucuagggaacugaguucauggacaaucuugcuaaaugccuucgcuauuacauagcugaucguuuaaauaaugacccuggguggaaaaauuugacaguaaguuucacaguuugguacuucagaaagauuagagugauccuuugaggcuguacuuugauaugacugauauuauuuauuccuuucccccgauaaaaugcuaguugacuaucagagaaaagagaagcuuucaagguuauuggaaauggguugccuugcauggucagguuuuauauagcugaauuuucucuuaaugccaguuuuauucucuucacugugaagcuguaaaaugggauucauaauuuuuaaaaauacagauaagaauguaguuuuuaacuagaaaguacauuugucauuagauaucaaaauguagcaaaauaaaaguugugggacuguauuuacaaauggauauuucucaugaagacuuaaguaaaacuugagugaacuuuuuaguuguuguagcuuaaggaguguuucucuuuaauuagacuugauaauuggacuuaauaacucuuucauugaugguuugcugcuguauccuugguagugaguaguuagaccuugugaaagggugaguagucacucuauuguuuugcauccuuugugguagguuagucaguagugcuguggccuuaguguucagcacauaccuucauuagugauuguuccaucuacuaauacacacugaggaaauuguuuuuuccucuuuguucugauagaaacuagggaggugaacuaaacauaugaaaccuuuuuuaauagguuauauuaucugaugcuagugcaccuggugaaggagaacacaaaaucauggauuacauuagaagacaaagagguaaaauucaaaagaauuugauuauaaugaauauaacccaggucagggguguagcuuaaucauagaagacuuaccuaguacaugcaggaccuuggguuuuuaucccagcacugacugaaaacaaacaaaaaggcauuagcuagaaaauacuuggcaaguugugguucuucuguuguuuguuguauguuucuauaaauacauguuucuuuuuuuagcccagccuaaccaugacccaaauacucaucauuguuuguguggagcugaugguaaguuucuucuugagaauugauuguucuugguuuaaaccagaguauguuaguagguuguugugugguggguauuucaggguugguugacuaauucucagaugucuuacuuaaguuuagaaggaaugacuguugauucguuguuagacugugguugguuaaccugugaugaauuuuguuuauuuuauuuauuuuuuuaagcuuuagaugucuugucauugaguuuacaguggacaguuucccacauaaucccuagugguuuauuauuguagguccaugucucugaaugacuuuauagacugaaaacuacuacuagauggcuuuuugauuuugcugcuguguucuguguucagugggacuuuuuuuuguaucauuguuuaguaguacuuugauuaugguacaggauacauccaaaguaccauucauuuguugcuuucuuauugauagcugaucuaauuaugcuuggucuugcuacacaugaaccuaacuucaccauaaucagagaagaauucaaaccaaauaaaccuaaaccaugugcucuuuguaaucaguuuggacacgaggucaaggauugugaagguuugccaagagaaaagaagggaaagguaagagcuuuaagauagacauuacccuauuugaaaaaucuguuaucaugggaaaauaugcacacugucacaaaguauaccauuucaaccauuuuaaaaugugccauuaaccaccagguuuauucaaacuaccucauaaagauauuucacagaaaugucgcuuuugaaauaaugugaaguaagccuguauucacaagcuuauacacacucaaucccuucuacauuacauuuuucuaauguaauuuaugucuccaugaugauaaguucccauagauaacaaugucuauugaaugugaauuguuuauggaagauauuuggaaugauuacuauuuccuuugaaggaaauacagauguauuaaacaucgugauacuucacuguuuucuguuuucgugggcuuacuugguugaagucccuucuacauguauuucuacuuuaaaaauuuggugcuuggggaaacugaagaaacaguuaaguauaguauacuaugugauuuuggacagacagcagaaaaagugaaguauacauggaucugaguaaacacucacacaagggucagcaggaauacacaucagaauacugauauuggagagacagaggugaggccuuccaugguaaccuaugaguuagaagguuuuuuauuuuuuuugaaaagguuuuaauuuaaguguuugugugugagagagagagagacagagaggagacagagacacauguuuugagcuucuugaugugggugcuggaaacugaauuugguuucauugaaagaacaucaacugcucuuaaccauugugccaucucuccagcuccuuuuauauuuucuaaaagguguuuaaaaguauucuagaacaugaaagaauauucaucuguauguguuuuuccaaacaacauauucacugcuggcccuucauaccaaauaauugcucacuucugauguagaugugauuauuuuaaaaugguuuggugaacuuuuaaauuuuuaguacuuaaguauuaaaugggucuuaaauuagaaaaacucuuuaagacuugcauggcuggaaaacuacaggauuagacuggacacagucuccacugucuuucuuacagcaugaugaacuugcagauagucuuccuugugcagaaggggaguuuaucuuccuucggcugaauguccuucgagagguauguuuugaugguuauuagaacuggcuuucauaaaacauguucuuuccauugcuuugacguuagccuucuuuucuuguaguaucuggaaagagaacucaccauggccagcuuaccauucccauuugauguggagaggagcauugaugacuggguguucaugugcuucuuuguggggaaugauuuccuuccucacuugccaucacuagagauuagguaugugaaucugugugcugugccagugguugucucagccuucuugacuuuacagagcccauugguuuuaaugaauaauauuugucuccugguggcagggaaggugcaauugaucguuugguuaacauauacaaaaacgugguacacaaaacugggguaaguuuauucuugaauaauuuaaaaacauaaguauuugguuuuucuaagaagaucauuuuacauguauuuuaucacuuacaggguuaccuuacagaaagugguuaugucaaucugcaaagaguacagaugaucauguuagcaguuggugaaguugaggauagcauuuuuaaaaagagaaaagaugaugagguaaauacauuguaguagcugaaauugcuccugucuuucguaggcugugauguacuuuuuacccgucugagaguguuguaauaacacuguaguauguugucacugauguacugucaagcuuuguacuugauuauucuauaaagacugugauguuugcuggguggaacuguguauuguacauuauuugaguuguguugcagguuuucuuuuccuaaucuuauuuaggguauaaauccaaaaacuugaagccuaaguuggcaagcuaucauguuuuuauaagaacuauuuauacucaggguuaagucuuaggaguuuguauuuuagaaguccagguguagggucugaguuggaugccauaagcuagggcugaauuggcagaaaaauggaggcucuguggagagugauagcucuuagguaagugaaaacauaaaggaagaaacuaaaguaacaaagcacuuggaaauugcuuauggaggauccacaagugcuuguggagaaguccaaguuucuauuuugggcaauucagaguuuguugauuccauucauguguauaggaaauuggggugagggacagauacaaaguguucguuuuagagaugaguaugaggggacugcaggauguccuacauggggcaaaucuugaaaacaguuuuagaacuuuggucgauggaaggaaguacuugaagccaugagguggaaugugagauucugugggcuuguguggaaugaaagugccucuacaagaacccugggaacauugaccauuaguaagaauaaggaaucagucagcuaaagagaggcagaaggaaaucccuaaauagaaaagaagcuauaguuuagagugauguagucaugcuacccaccuagugcuugagcagaggugcaaaaccucaggaagcugauaggccggaaggaagggcagcaaccuagaggcagagugauugaagauugauuguagggguagcagagaagaccagaaugggggcaaugagcugauaguagcuucuuaaauggaaagagaaacuuuuguaagcugauuuuuuuuaauaaaaaagacaaauggcuauauugaacaaagagcaaguaauaauuauauuauuucuguguuuuucaacuuuguggaccacaauuaugcucucuuaguuuuaggacuuuggaccgaugaguugacuaaguaagcaucuuuuccaauugucuucaguauuuaaucaaguuuucuaguaucuacuggaacaacuguuuuggaguugguuguuugggguguguaugaggguguguguguggagugugugugggugugugugugggggugggggaguguuugacuauaucuucagcacuauaucuuucacuuuauuacuguugauacuuaacaaaaaauaacauauacuaugcuauaacuugguauaaaaaucccauggaaaagcagucuuuaugugugcuacagcaaauguuguaccauuaaaugauagugcuaacuuagcauuaaauuagcauuaaguuuaguguuuuagauguagugugauuucuugcugaccuagcugagaauguauuuuaagcuuuucuguccuugaaguuagucauauugucuuuucucaaggcugcacaacagaagaaacaucagaauuucaguaugaaacuucuagaaaauauguuuguggcuuuuggucaugaagguuuucauagcacauaaaaaaggccaauacuguucauaccagcaguguguuguuuuguuuaugugugaacaccagccuuuagagccauauauucauugggcagcagaauggaaggaaggcuucagaaaaggauguguagguacuuaugaaaauugaacaguuaaaccuaaauugugcuaugcaguucaugagcuuugacaaucuuuacuaugagcagccuagcuaugugccaguguuucaauugccagugauaaggcagcagacaaaaacuagacaaaaauucugcccucugagagcccucauucuuuaggggaagaucgacaacaaacauaguagccagcucagccuauaauguggugggcuuuuaagugccauuaagauaaaaacuaguugagauaguaucuggcaaacugguaauggcaauauuguaguucuaaaaaacacagcaaggggccuuaccaagagaugagugaagacacgaauagugugaggguguaugacacgcagauguuuaaagaaagcacuuacagcccagagacuagcucuggacaagugcugccuuguauguacacugaacagcaaggggcaagcaguauguggcagcaggagaggugugaaguucuaaaaagugauagaggaccauaucuagguaccccuguaggcuauuuuaaauacuuagcuuuguuauauaucaaagggagguucuagauagaaaacugauccgaucugauuuuucuccuaccuugcuauggagagcguauuucaucagaugaggcaagcacuuguuuugaaaccagugccaauggggcuggccagugggccaaaauguagguuguaagagagaaaugaggugucaagaaugaccacaggaaagauggaccaucuagaaacugccauauccagggauccaucccauaaucagcuuccaaacgcugacaucauugcauacacuagcaagauuuugcuaaaaggacccagauauggcggucucuugugagacuaugccggggccuggcaaacacagaaguggaugcucacagucagcuauuggauggaucacagggcccccaauggaggagcuagggaaaguacucuaggagcugaagggaucugcaauccuauagguggaacaacaauaugaacuaaccaguaccccccccccccagcucgugucucuagcugcauaugaaucagaagauggccuaguuggccaucaguggaaagagaggcucauuggucgugcaaacuuuauaugccucaguacaggggaacgccagggccaagaagugguaguggguggguaggggagugggugggggagugugugggggacuuuugggauagcauuggaaauguaauugaaauaaauacccaauaaaaaauauggaaaauaaaagaauacuauuaaagauuuaaaaaaaaauuggagcagcagcuccucuaacauuuggaugcaggaauggcuuagaaguggagaugagaauucuguuuuggacuuguuuaguucugaguacccagaaggagauuuugaaagggaagagauucugguuagcauauggauaguguuuaaagccaagacagcaggugcucauuuccaugggaagagagaagugaaaagagguguuaguacugagccccagggaacaauaacauugagcaaaggcgggaagugagacuagaggaaagccagguaaacgacugugugugauucaaggaaguucugaaaaagacuaagauaucacagucuacagcuggcuuagaaacuuugaagagagggaggagaaaagcuugauuagagcaguuagugagggagccagcuagauagcucagugguuagaggcacuugcugccaagccucaugcccuucauauuucuggaccucaugugguaggacagaacagacuccuagaacuuguucucugaccugccuggagcgcgcacacaaacacucacgcacacuguucucucuggguuggauuuccagaaccacagaaauaaaagaggaagaaauuaccaguuuccacacugguaaucugaagguuucauguacucauacuggaguauauuuuguuaaaagcccucuccugagcugagugugguggugcacaccuauaaucccagcagaggcaaguagauaucuggguuccaggacagcuugggcuacacaaggaagcuaucuuaaaaaccaaccacaacaaaacccaccuuguggcggaaaacaccaauuucaggucucauuaaaguuuuguauugcacuugacaggauacacuuagaagagacacaaguacaucugccugggguagccuccaguacuuguaccugcuggcuuuuuucuguuuuaggccacagcagcagccacgagcauuuuacuauuguuucacuuugcugaguauggguuuguaaaccuguggaauaggccauuguuaauugggagcaauaucagcccaguuucagagaaucgaaaucauggcuguucuuuuagaagagagaaaaagaacccuacccuguauauuaacuuggccuagaaucaacaauagaucagaauucccuuuuuucuauugauagcuuuagacgaaagggguuagucuuuguggaauuccacuucuugcuugcuugccauuccugcuggaauuaggagugauugauuagccuuuaguaaugcagcagaguguauuuauucaauugucuuguagaauuuuuuuuuuggacaggguuugucuguguagccuuggcuguccuggaacucacucuguagacaaggcuggccucgaacucagaaauccgccugccucugccucccaagugcugggauuaaaggcgugcaccaccacuguagagguuuuaaauggcaguuauauuuagcaacuuaggauucauuguuuucuuaacuuguauuuucuccauauugcauacaagauaaaccuaagaucuuugucauagcucuuauauuuuccuaaacauguauuuuuaagauccuaaaacuuuaagaauaguuuacuuguauaugaauucaguuuucugcucaucuagaguucucauaaacagggaucuauauauauaguguguguaugugugauaugugugaugcucaguauugucauauacccagauaaacggucuuuugaaucacuccugcuaauguuuaacucugauauuuuuguguaauuauuugacagaauauguggauuuuauacuuuuaggacaguuuuagaagacgacagaaagaaaaaagaaagaggaugaaggugaguuuuuaauuuuaaucauaugagauuagccauagcuuaacuuuuuugaaggauguuauugugcaguaacuauuccuuguucagucaagaaaucuguauccaaguagcugucauggagcuggcaaaagaauacugguauccuggcagugguggcgcacgccuuuaaucgcagcacucaggagucaguggcaggcagauuucugaguuugaggcuagcuuggucuacagagugaguucuaggacagccagggcuauacagagaaacccugucuugaaaaauccaaaaaaaaaaagagagagaaaagaauauugguaucucugucucucuguuuuucugucucugugugcgccccucuccccuccuguguguguguguguguuuugauaggaaguauguguaucugucuaucuagcccaagcugaucuugaguucucaauccuccugccucggucucugaaguacaaagacuacuaguaugugucaucauuuucuuuaaaaaauaugguucauuuuaaaagaaguccuuccuacgcuuuggagucaggauucuaccuaauagaaaguaggcagcaagugacacucugcuguuagaauuauuuguaaauauuagguaguuuuuguaauaagaacaguuggcucuuugucucuuggaaguuacuacacucacuuucucuuucaccuuugucaaauuaauucucuagaaugugaccuaagcuucauuucucaccucugaaaucucuuaagacuccucaaucccuccagaauucaauucuacuuugguuuuggucuaacuguccagcuuaucuccugcugucuuccaaauucaccuauguguguguuuccuucauuuguacauccacgugcauuaugccuuugcuauucucuccagucucacacagagacucccuuguuggcuuugcuccuaguguugaucaguucuuucucuuacuuugcugcuguuucucugucugugauauugauucuauacuuaguugcauaauacuuuauagucacuuccuucuuucuucccccacccucccuuaaccagauggaguuugaaacuuguuaccuuuauuauguuuuauaagaacugagcgguaucuggaaacugaaagggagaaguguugggaugcuuaccauugcauuuggcuucaagaggacugucagaguuagaguuacuauuacugugaugaaacaccgugaccacaaacaauucagggaggaaaagguuuauuucccucacaguuccauauaacaucaucaucacaaacagugagggcaggaacuuggagguggagcugaugcagaggccauggaggggugcugcuuacuggccugucuuccuggcuugcacagcuuucuuuucuccagaacccaagaccaccagcccagggauagcaccacccacaauguacagggcccuccacuaucaaucacuaauuagaaaaugccuuacaggcuugucuacagcuggguccucuguaggagcucuuaauugagauucucucuuuucagaugaugcuagcuugugugucacguugacauaaaacuacacaagcguauuauuauguguacuuuagggcagaguuauuaaguauuacagacuguugcuuagaagauguaaguaaucaugugauguuaaugaacauccaugugauuuucaacuaguaguaaagaacgcaguaaaauaaggacuauuccauuguuuucuuugcuuccugucacuguguuauaauuuaauuuuccuucuauuuacguuagagagaucaaccagcuuuuacuccuaguggaauauuaacaccucaugccuuggguucaagaaauucaccagguugucaaguagccaguaauccaagacaagcagccuaugaaaugaggaugcagagaaacucuguaaguggcuuacuacuucugugugacguugggugaugaacauuguauccuccucagguuuuguuuuacagguuuuucccaacaucuuuuuacuucauuaaaucuaucuuuuucaagacgaaaaucacuaaaugaaguggaaaaaaaaaaguauauggguuagucaguacauuacaagguaguuuaagcagauagcuaaguggcugugggguuccuauaauacaaauggccuauagcuguucuucucuguccugaagcacugaguaguggauggugcuagagauaugacugggacacccaacuguuucaaggcugagacuagagaggacagugacuuagacaguugauacaaaggucacccaaauagauacauaaggcuuggguauacauucuucugaucaaaacugguaugcauauuugaaagugcuuuuaaguucuaugugaaguauagcugaacuuuucuugguauguaguauggacuaucuucaugcuaagguuuuuguucugauaucauuaaagccuugugagcucucaauuuuaaaguaguucaauuuacaugaaauaacuaaucugcugugauuaacagaaagaaaacaacuaugaaaauauuuucuguuaugacaguuuuggucauauaugguaacuauaauuggaaauuuuuaaaauuuuuuaaaaauuaaguacuaaaauauuuaugauccuauugugaucuucgaauuugguacaagggaaaacuaauaaccuaaaguauuauccaaguuuuacaauauuaauaaaaauuuccacuuuucuauuuuauaugcuguauuaaaaaauacauguaaaaugauuuagcaguuuucagauggaaucucauuaaauugcuucuuuccuggguaguugaguauggcugaccacuucauauuugauuguauucucaugagcuuugugugugugcgauugucauuuauuauagguaacauauaccauauugaucauuuuuuuuccuucagagguuuuggguuuuuuuuuuuguuuuguuuuguuuuuguuuucuuuuuagaacuuuacuguuugauaguagagaaugguuauaaauucaugguaccagaaaacuacuaaaggaaaauaagauuuaaguugaauaacuuuuuuaugucuguuaagcuauguuucuuuugcuacaaguuuuauccuaauucuuugguuguuaauuuucuugggaagaggacugaugugggacaagaccagucuguucuuucuagauguguuugcucuguucaauagcuuuaaaagcuguuaccgugaaacuugguaagugguagguguuugauuaugccuucuuacauaaaaugaauaaugaaaucuuucuguaauaucauaauugucuacagaguccuucaauaucuccuaauacaaguuuugcaucugauggcuccccaucuccacuaggaggaauuaagagaaaagcagaagacagugacagugagccagagccagaggauaacgucagguaaagccuuuuuuugggguagcacuugguuagcggauugcugaaagagauguggucuaauuaaugcuguuuagcuuacaguggcaaugccuucagauucuugccuaugaucuuuuuauccagcaguaauuaauguggagaguuagaauagucacuaauuccagggagauguguaagcuauugcuguuaaacccaaguaucuagauuaguaugcaggcaagcucucuguccuccaagccacuucccucagagaccaagcaccagauuaaugaggcacgaauguuuagcucugaugauaugaucugaauguuacuguuuagagauuaaccuagaaaguucagauacauuuggacaguaauauaguuugccuugccuugaaaugguuccuccuuaaaaaugaaaugugcagaaaucauuuuaagagauaaauauguauuuuuuaaaaagaacuacgcaauugcacaugugcaauuuuguugcauggcagaggaguuuccuuuaacugcauauuuaaauuuuguagugggaaacguugauucuguaauuuguuuagaaacuggacuuagaauuauuacuuuaaaagauuauuagccucucuuacaccuagguccagauuacccugagcuuucuguacaaaagaacacaauuuuaaaaauuguagcucacuacgaauuuagggaaauaguguguuucaaaguucaucaaggcauacuucuuguacaggagauaaaaugugggguuuuaauuuaugauuaaaaacuucauguauaggucauauguggcuuuucuaauauccuuuaauauccgauuagugaguaaccaugagauaaacauuuauuuaaucuuucuauaguuuuaccaucucugucacuucgguuuucauccuaaaaaauuuaaauuuucuucauuuuuuuuuuccuuaauguguuuuagccuggauguauguauguguaucacaugugugccugguaccuggagaggccagaaaggguugucagguccccugaaauuggaguuacaggugauuguugggugcugggauaugaaucugggucuucuggaagagcagccaguacccuuaaacucugagcugccucucaguggcccuucccucuuuuuaaaggcaagaucuuacugucuaacuuugguuugcauggaacuugcuuuguaggccagguuggucuugaacugccagagaucugccugcuucuucugcuucugaauucugggauuaaaggcaugugauuaacuagauuguauuuuguuuaucguguagccaucaugacaaacacugguuuaauagguaacuugauuuauucaguaauuuauggcuuaauacuggugcuugggauaauuaagguagaacuguuuuucuauuaagaaaugacuguuucauguauauuuuuauguaaaacaguagaguuagaguauaggccauaucuuuuaguucugugacuccuuuugguguugguaggugguuugaggaggauagugucuucucuacuguuacuuuguuaaaguuuaagacuugggcaaaaguccuuaauggagaaugacucaaugcucuuggccaguuuugauuuccaaaaaguguucuuuaguuuuuucuuguucuuuggauaaagugucuaaaucuuuuagaaaauaaaaauauaaaacaaaauccauuggguaacaaucuaugggcuggagagagagaugagagguugagagcauaagcugcuccggaagaggaccuggguuugaaucccaguaguuccacugcagcuagcagccagucuguaaccccaguuccaggagauucagugccugugggcaugagacaugcaugugguucuuagucauacacuuagguacauaaacauaaaaggugauuguguauuuucauuguuaacgauaagugacugcuuauagguuauaccaggauauaagugaggagauaagaagagagacaaugcagaaaugaaugucuccuaguaaaacuucagaacucuuauuugaaagaggaauaagacaaacaaggauagagagaaaaauuauguacacaaucuuugcccacuccauagauuauuuuaugccuuauuaacauuuaaaauaacuaccacuuuaaaaaugacuuaacucauaccuuuaauauauuaauaaggacuuugaaauacaaaauauauucaauacuuuaaucuuagaacauaguuuuagaguuauugcacaauuaaagcaaauauggaaagcaguauuaaaauuggcacagacaaguaucauguauuugcucaaugaaugauuauccucuuuuuuuaaaauguauuuucuuaauguacuuauuagagucaguauuuggguuucugauguuuaaguugauaaugcugaaaauggagugguuagaaagcuaaugaaucuguuagcuuuuuuguucagcuucuucaauaucccuuagauauuaaacaugaauugauucaguuugggaaucaguagacaaucuuuagucagagauguauuaauuaaauauaauguuacuuuaccugguuuagguuaugggaagcugguuggaagcaacgauacuacaagaacaaauuugauguagaugcagcugaugagaaauuccgacguaagguuguucaguccuacguugaaggacugugcuggguucuucgcuauuauuaccagguaucaaaagaaguuuuccuccuaaguuuuuggcuaaucauuuuagaaaacaaguaauuucuauaauuguaccuaauauugaauauccuuagauaaagccuacacuuguaguuuuaaacuuacuacuaaaaauuauuaccaugaauaauauuuguaaagacuuggaaguuccuuaagaauuagucuaucaauaaaacuugguucuguuguguuaaaggauuuuaaggauuacaauguuugaguuggucauuaauauuauuaaaguuuaaguggguuuugguuuguguguuuguuuuuuuaaagaguuuaaagccaauugggcauuugaaagucacuaagaaacuaaagaaaagaugcaguauguugcguaccaauaaaaauuugaaaggaauuugauuguaacaauucucuuauguuacugugauuuuacaugagaugaauugggucaguguguccagugcacugaguagugguggaaagaucuuccuucuuguuuuacagcacacuaaaaaggcuucucuuuuuccaugagcacaacuugcuuuuguuuugauuuuaguguauuuauagucaagagaaaguugccacauggaaguauaauaguacauuuugguuguuugauucucagcuacuguugauguucgcaacuacuacugccaccuguucaguaaauaccaggugaaaaccguguuugguuuuauucgaugacagaagcucugagauuggaaagaaaugucaucaaauauauuuuaaggauaaauaucuuagugaauuuguauuuguaaauacaaaguuugauauuaauuacugauuauucaagaaaguuuacaauauuuuuuaaauaaaggaaccacugauaugaagcagacaguuauaaacaguauuuugaacucagaaaaauuaaugaguggaguauaugccagaaaucauguuuuacaaauaagauauuauagacugauagucauagcuaauuuuuuuuuuuaaccauguucaucauuaagaguauuuugcuuuuaauugucauuaaugauuuuagggcugugcuuccuggaagugguauuauccauuccauuaugcaccauuugccucagacuuugaagguauugcagacauguccucugaauuugaaaagggcacaaaaccgguaagcuucaagucaaugagaaguaggaauuugaauuucauaauaauugggagucuuuaaccuuucccucucuugcaguuuaagccacuggaacaacuaauggggguuuucccagcugcaagugguaacuuucuaccuccaacauggcggaagcucaugagugacccuguaagucuuaguguuuucaaauguguuaggaacauuaggcaaaguugacuuugcaugucauaguuuuaaaaagcugaaauaugcaaagaauguguuuuuugcuuuucacugcauaaugugguauucuguacuuucuuugucucugaguuuccuacccaguaaauaaaacugauuuguuuucaaucuacauguuauuauuuugagacagggaauuacuauguaguccuggaacucccccuguucaaggcuggccuugaacucaaagagaucaaccucugacuccccaguacuagaauuaaaguugugaguuaaucacacccugcauaaugauuuuuauuucuuucaacccuaugagaacuuuaaacauucuaucugacuuaccuaaaauuaacucuaagcuuguucuuuugugcugguuacguagugagacccagccaggagguaggaaauguugaguaacuaaaccuuucacugccugcauguaguccauaacuaucaguucuaaaacucuuuucuuuguuuaaaguuauuucauguuuuuugagacaagguauguggcuuuuguuuuugauucuuuuacuuucuuccugaaacaggauuccaguauaauugacuucuauccugaagauuuugcuauugauuugaaugggaagaaauaugcauggcaagguaaaauuuagauaucauuccuuuuuguuuguuuguuuguuuguuuggauuggggguuucucuguguaccccuggcuguccuagaacuaguucuuuggaccaggcuggcuucaaacucagagaucugccuaccucuaucuucugaguucugggacuaaaggugugcaccaccaucaccuuguuuguuuacaguuuuuaaugaaguugaucaaucaugacuuacaggauaaaaaaaacucuggaaaccauacuuucauaauuacaugugaaaaguagauauaaauauucaaucauaaucaucagugaucaauaguaauucuaauaguaaaauaugguaagugguaacuuacugaaauagguuaaaauaguguucuuugugaguuuuucuucaaucaguaaccccuugccaccuuucaaaacugcuaagaaagaaacacagucaugcauguuugggguuauggaaacuuguaaaauauauaguagaaacuuaacaguugacauuuuauguuuugcccguucuuuacauuccuuaugugaauagauuaugugggaaagcaauuuaaaaauucacacuaacuuuaagauguuaaucacuacucaacaaaaguuggucauugaguauaacacacaguaaaaaacacuugcucaucaaauucuccucugacacuuucuugugcuguauccuuuuuuuuggauacuaagcucagaauugugaggcagagggggcguaucaucaauuuacagauugaagggcuaagaaguagcucagugggagauuauuuaccuggcaugcacaagugccuuugauccccccccaaaccucauaaaacucaucacucccucuaccccuggucccugcaaaaucaaaaccaacaaaaaauguacuguaauuggggguuagcuuuugguuuaaauaguagugauaauuucuuauuacuuuaauauaaugauacuaaaaaaugcauccaauauauuggggcuauuuaaaaugugcuuuggucacauguaaauggauuagcgucuccaaaggcuuuugaaggaacuuuguagaggaugauuuaauuagagaagcagugaggaaauggagggcuaauuaaaauaaguuaauuaauaaguaaaucuauuuguguuuauuaaguacauaauucauugcuugcuuagguuuacaaauaaacaaguaaauuuuuaaauauauaaacauacagauugccaauuuauguaaucauaguuauuauaguauuuauaucaauaacaauaaaucuucucaauauaguaauuuuaggaagaagauaaaauaaugcccagugguuugaauuucuucauauccuugcuaauauuuuucuccuggauuuuuuguuguaguuguuuugguuuuuugagcuacccuaaccacuaugaaaugguaacucacaguagcuuuaauuuacauuuccccacugguaaugauagugggcauguuuucaugugccuuugggguacuuacaucuuuaaagaaauccuagucaaauccuuuagguugugucggguuuuaguuguugcauuaaaauuuauagccuuuaagcauuuguugaugauuuuuguguauuuccuucaguucugugguuuucuuuucccuuguucugguguccauuaaugucagaaacgauuacacuuuggugcucugcuuuaucuguuuugcuugucuuuguguaaccagggaaucauuugccaagucuaguauugugaaccuuugcauauuuucuagaacuuuuuauaauuuuagcuuuuauauuuuaguuuucaguccuauuuugacuuaauauuuguauaugguauaagauaaggacccagucucauucauucauauguggauaacuacuuuucuaugaaccagcuguuaaaaaggcuuuuuucuauugaaaaaagcuacuaaucuagucuuuaugucugguuuuaucccaguaccauacuguuuuaaugauaucuuagaguuauauaagccuuaacacuagagcugggcagaugucaaccauuuaugccauuuugucuacuucccgucaaaaucccugagauauuauuuaacauguuucaccugggcugccccuacuccaacaggcgggccuuucauagucaugugcucacaaucuaccauacucauggugccuucuuccucuccuuccuagugucccugccugagagcccacgcccugccccuucucuucugccuagcucaggcuguagacaucuuuauugaccagacagggaugacuugagggcacguuuguacaacaaaaucugguauuugugaggaucuccucauuguggaggcucuccuuguuggugaagggggcaaccagaucuugggguacagaauuuagcauuugaauacaagcagcaacagaccaauccccuacuaggacuuuucuaggauauuuugggucuguauuaauuaguuagcacugugacaaaauccuugacacaagcagccuuagaaaggaaggguguguuguggcucaugccuccagggacugagccuagcccaggggagggugugggaaaccaggggaaaccagcuaucugguuacugucauugaagucagaaagcagaagaugaaugccagcuccucuucuuguuauuggggacucuugccaguaagagagaucuucccacauucaaggggacucuuccuccucagugggaacacucacguauacguauaucccagcguauauccucagugggaacacuuacguauacguauaucccagcguauauccucaguggaaacacuuacguauacguauaucccagcguauauccucaguggaaacacucacguauacguauaucccagcguauauccucagugggaacacuuacguauacguauaucccaggaggccccaaagccagucaagccgaugguaaagauuaaccaucacagggucucuuagaaaguuuguucuaggauggcuucaacgucaguuucuuacuuuuuauuuuauauuuuaugcaucaaauuacauuaauauuuucacuuauacuccacccauaguccaaaaaugucaaauuuaguacuauuaagaaauauaguuuaaaacacaacuuuaaaacuuaguggaagcaauguuaauauauuaguugguaaagcguuuaccuggguugauuauaccuuaaaaugauaggaagagaaauguaguuguuuaaaaaaaacaaaaaacauuuuugacuguguauacuuugacaauauauauuuaauagcaauacugggauuuuauacaauuuguuacauguuauaguuuugauuacuuuauguuuuauauaugaacagacagcuuagguaauuuugucaaaguuuaaggaugacaaaaccaagaucuaaaccuagggagucagacucuagaugagcucucuugaaguggcuguuaccacaguacccagugccugggcugcuuugggaugaagagaggaucagauggggcagugcauggagcucaguggucaaggaggagugcucuguucuuccucugcuuacuuccagcacauugcugguaaccauuucuuccugcuccaggccacgaacgugauuugcucuuuggugauuuuauuacugucagaggcacugcaagcuguuuccugauuagauucagcuucuggaauuaauauuguaggaaguuuuguuauaggaaagcccuacagagcuuucuuuaaauccuaagucaaauggguagaaaauaaaagauaaauaaugauuuggguauuuguugguauauuucucucaaguguaugacucaacaaaauuugaacaacuucuuucccuguguuugcuaauaauugaauuagccuugucuagauuacaggugaucauuucuuuuaggcgcugcaaaauuuauaccagaacuuagauucuuuuauugcaguaaaaucaaaugcuucuuuacugagaaaauaauaguaacuaaguuaguaauguuugcuuuggaaaccuuuucauuucuuaaaauuucaaauacaguaguuuguaguagugguuuuuuuuuuuuuuuuuuuuuuuuuuuagaauuguuuaguucuauuucacauuuguuguuacuuauuuuuaaguuuuauuuaccccaaauacuauuuuuuucugaauuccagaauaacaaagaugugguccaguaacauuuuuuuaguacuaugauagacacuauauuaaugucucugaaaaugguaacuguaggcucaagugaaauaaugccuuuaauucagcacacucgggugccauuuccagccccgacaggaacagucuguucuguucccaacuaguaguaaguuauuuaggccaagcucuaaagaauguuugcaugcaaauuaaucagauuaauuauaaacagaguauuguagaagcuuggaaauuaaagggaccuuuccuguagucuggaaauagaacuggguaugugagguaaauuacaucauuuuacaaagaaucgggaaggccaaaggacaagcucaagcucaaggaagaugagcuaauaguuggccugagggcauuaguaaggugauagcacugcaaguguguaaaguaugggggcauuuuugccauuaccaccacauaugaaaauauuuacauuugaguuuuggauacaugacagaguucaguucuauuugcuagauguucauuugaaacagugaacugaaaucaggugauuguaauggucaaaugguuguuuucuccagguguugcucuauugccauuuguggaugagcgaaggcugcgagcggcucuagaagagguguacccagaccucacuccagaagagaguaagagucacagcgcccacuugaucaauguggagucuguccagcacaaacuucauuucuguauaaaaguagacuuuuuuuuucauuuggaaaguuucucauauaggaggcauaaauuauugauuuaccuuuuauaauaggcaguaacuuuccuucuuaaccuauuaccuguaaauugaguacuaaauaauuaucauuuuaaauucaaaaguauuuacuaaauuuguuaaagauuaacaguucaucugggcuuugguggcauaauccuguuauuccagcacugaggggagcuaaugcaagaggauuguugaaaguuaaaguucagcuugggguacaggaugagacccucaaaaaaaguuacaguucaagaauaucucuugaaguauucuaggaacaagcagguaacauaucuaaugauauacauuuuaagccaaaacuaguggaaacaugaaagugcucacuuuuuacugauuaaagaacaaucaucaagaggaugcucguauucuaaacccucaacauaagugcauccaguuugauccaaugaguacugcuagagauaaggccacagauuagccccagcaauccugaccaaaaaaaaaaaaacugaauuaaaucacauucuagaucaaauguacugagcagauaauucagaggacauucaucccauucagacuauagaauacacuuauuucuuagcagaccauggaacuaucuuuaaaauagaugauauauuaggauacaaaccaagucuuaacagauaaagggagauagaaauaauuacuuguauuuuguuugaucuugcagucauaagacuauaaaucaacaauaagagaaaccauagagcauccauaaacuuggcgauuaaacaagacauugcagaacaaugacugguccuugaagaaacuaaaaaggaaauaaacauuccuaaguuaauuaaaaaaagaauccccuuugacuuuuugauucuuaaugacauccacacacauacuacugccucuuaggaaggcauuccucauucucuccgucugcuuucuuccaauuaucauucaaaggauuaacucuucuugaaagaguugaguaagacaagcauuaacuccuagagggcuaacuugaaauguuaaucugcauaaaaaguaguaucuuauaauuauggcagaguauuuagaucgcacaaauugucaugcugaacucaguuuugaaaauuuuauaaaguauaaauauaacaaauuuaagaaacuauugauucauuuuuaguuuuccuuagagaauguuuaugucuuaagcaagaagucagcuacuuuauaacuaagaaagucuuguccuuuaucaugcaaugcguccauguaugucucagcaauggccucuuucuuggguuuacucauugucgaaacucauuucagaauaguauuucuuccauagagccgcacagcaugcauuuaaguuuguuacuuagaaagugcuuuucuucaguguugugcugcauuagucuuaggguauagaugcuugcuuuuguuacagcuuuauaaguuuuauuagaugugcuugcuugacugcucuuauguuuuuuauuuagacaggagaaauagucuuggaggugauguuuuguuugugggaaaacuucauccacuacgcgacuucauuuuagagcuguaucagacggguuccacagagguaugguaguaguuuguucacuaacuaagaauacaugaguuacagguuguguguguuauaauuuacccuuaacuuuuucaaguacaaaauguuguaacacugaguauauuuaggauauuguacagcuagcagcacuguccauguauagaacuuuuucuuuuacucacacagaaauuguaccacuagacaguuacuaaacagcaccuccccauccugugaucccacagucaaguacuuaucuuucuccaugaguuuuuuuuauuucugauaccucauguaacaggacuccaaugguaugaauccucaguagacugccucauuucacuuaguauguuaaaguuuaucuacguuguaggcaagacugaagugucauuucuaauaaugacugauuaauuuucaauaagaagcaaaggccacgcuuuguuuaucaguucacuugcugauauaucuucaccuuaguuuggcucuucugaauuauaauccuccuaacuuaggugaacuuaagagaaggcacacaaaucucuacugcguccuugugguccauucuuucaguuauaguauagaaauguguguuuuguuuuuuuuucccacagccaguugaugugccaccugaauugugucacgggauucaagggacguuuucuuuggaugaagaagccauucuuccagaccaguaaggacccacuugaauuugagugagacaacuagaacaaaacuuaguuagcuuuuccuuuuuguuugcuaccuuauuuucuaguaauacuuauuacugugaaaguuauacuuacaacaaauucugcugagcuuaaaauaaggacaugguuuccaaagccagcuuuagcaucuagcagcuuugcugccuuuuauggcuuucuggguuccugaaacuaaggugccugcacagucagagcuggcaucacugcuacuccuauuccagugucacuugcuuucuccauucuucucuugaauacacaguguuuucagagacaagaucuggauaagaaacagaaaagacaacugaaauaaauaagccagauuuuuagauuuuaaaaauguaacaaugauacuuuuauuucuuuuaguuuggcuuuguaaaauaaaguuguuuaaaagccgaauauuauuuaugcuauuuuaguauuucgaaauuuuuuugaugguuauaguuuacauaaaaauacuucaaaauccuucauaguuuuucccucccauugagugaguguguguacaaguguguacauacauucauuccugugggaacuagacagcuauauuggauggcuuccucauuuacuuuuuacuguuuuauuucauuuucuuuuuugagauauauugucucucugacccuggagcugucauauuggcuacacuggcuggccagcaaguaccugagauccuucuguuuauaccuuuucagcccuaguauuauuaggacggauggcucuguucaguucuuacauggugcuggggauuagagcuuagguccucauagcaguuuauguauagcaguuuacugacugaaucauuuccccagcuccacugcauaauugucaagaauguaaaagacuucugagacacgaguguuuagacaguuacucagggcacauauucaagagaggacuuacuaaucauaguguguguuggguauuuuaaaguggcuacaauauaaugucauaucuaugauauaguauaaucuaguaaaugguaguuugugagagauacugauacugagacaucaucauaacuuucuguuaaucuguuuguuggcuucuuaugguuuacaguuguguuucuccgguuacuauauuacuaguuacauugaccuucuuuacuaaacucucucacuuuuuuuaaauccuuuuuauucaugugaauucuuaucuaugugugacuaacugugugugagugcacauagugugcaggccugaagaagguaucagaauauccuaaccugggaugaaccuuaacaugggugcugacaacuaaaguuggguccuucagaagaucaguguuuccucuuaacugcugaacccuuucuccagcucccauucaacguuuauuauuauuggcuaaucucuuccugccccauuuggauuaaucagugaaggggaagugucuuuggcuguucuguuuuacagauucuaauauaaacccuugcccauaauugcuuucacuuauaauaaacuggaucaucuuauaaagguauuguuuucauuaguacauuuuaaugacuuauuuuuuucaaaagccugacaaacagcauaucuuauuuguucacagaguuucagugugcacacaggugauuuuucucauuucucuuuagaacaguauguuccccugugcccauguugcgggaccugacacagaacacugcagucagguaaguuuucuagaauucagagcauucauccaggguacagcuuagauuuuuacaagugaauuuuaacagaucuuuaauuuacaaggaaauggcaguguuaauuuacaguucuuugagauugagaguccuuguguugcagaccucagagcagagccucuugacuuuaaauuauguauauuguuaagguuacugauuuaacaagcaugcuuaucuguuuucugguuuccccugacaaccucugauucuuugaggauuagaaaagugggagguagaaaugggguuugugaguagcaugucauacagaagcaggcagaccuuugugccccaguggcucacacugccuuagguguuauaauuauuacuauaauugugauucugcagaauuagaaaauaaaauauguaguauauuuuacuuaagauuagcuggcaaauuuaucucuuacuguagcaucuucuauugaguaaaaaauaaagaacauaauuuaacugcuauaaauaaaagccaacacucugcuuuuuguugugguauaauugcaaauauuguugccagaauuuuuguuguuaucauuuaggcaagacuaaagcagauacauuuaaggauuuggaaaauacaugauaauucuuagucuuucucccugacauauuguuaaaauugcucauacuuucaggaaauacuuuagauuuuaauuaaaaaauuucauugcaaaauguaaccaguuuaauuggaggccuaaauggauuuaauuaguagcuaauugccauucuaaaaggucgugugugugugugugugugugugugugugugugugugugugugcacgcacacacuuuuuucucugcuccuuuuuauauacuuuguucucacucucugucuucguguucuuuuguuaagggagaaguacagacuugaaagccaugcucauaagcccaucacaaacaaucuggcucugucaaauuuauuguggacacugcauuaaccugugggagcucagugucucauuggugccucaggccaguugauuacauucguuuucuuuuugaauugucacaguuuuguucguacuaguuggguuuucuucauuuuucaaagauuuuacuaccuagcccucuagaaacaguuaauucuacucaagcuucuaauuaggaaagagaacguuuccugagagaguuaccgaucaguggaugaguuuugcaguauuuuggggugauagauguugcucugcgcguucauuguuucugaaccugaagggcauuauaauguuugauaugaaugagucccuguguucauuaaauuuacaaaacaaauccaagaucuaggugcaaauucagcuauauguugaaaguuuaacuucaaacauggaacuuuuugaguuaauuuuguaaagauuuguggaaaacuugagcuaauuuuuaucuuucaauguaauuuucagcauuuucucugaaaugguguugagaccaugguccaguuuucuacagugguguguguguguguguguguguguguguguguguguguguacauacauaugcaaguugcaguuaaauuuguuuggugaaugaagaccaaaaaauagaacuuuccagucagugucuaucuaccuccugcuugagaaacucuuuccucagauggacuuuggauugguuccugucauaucuggucuuaucuuuaguacugagaaaguguguuauuacacaaauuacuaggguacuucaaguucacgucuucaggaaggguuauuuuucuuuuaauuggauuguguaugaauggaauuuuaaauguaacgauuaccacaguauuuauaaggcucacagcuggcagauagguaacuaugaauccaaagccugaaggaaguggaauacacacacucagcagcagauugcaugguggaaaccacuggggaggguuuagcugacacugccugcaguccuuuguaggacacugaacuagauaacuucuccucauagaaugucacaauucugcaaacucuuuaagugcuuuaaaaugucaaguguaugaaucaucaaaacuucccugcaagaauaguuugcauugccaugcuggguuagcauuaaucccagaguggauagggaaagguagaagaaaaaugaagguugucauuuggaguuuucuccuugcuuugaauagagugcucccauucuuaaacaguaauguugaaauagcauuugucagaauaauuucuuuuuguuuuaaaauuuguuaugagacaugcagguacauggugagcucagagggcgggguuggggaggagguugcacaagcauaugugucggucagaagacagcucuauggaguugggucuucucuuccaccuucuuguggguuucagagauuaaauucagaucaccagguuugugcaguaaaugccuuuacccucugcaccauuuugacagcuccuaagaauaacucuuaagaugaacuaagucagaagagaugucgugcaucuacaggaucuucuaugguauacaaauaaacguguuaguuccuuauuuucaacgauauuuaggaucuacacuuuuauuuauuucaccucuaucacauuugugaggaaguuaaaaugaaauacaacuggcaaggaagggguguguuauacucucagcugguaggaggaaaccaauguugaaacagcaugguuacaucuauguuagguaaaagcaggugaaaauacucucaggugcauagaguugcauggaauaauguaaaucucaacaugguucucugacuuggcuaagcagccuauugagucuauaggcuggccugguuuaggugcuuuuguuuaaggcuuuguggcaaggguccuaccauacagcuacaggccauuuguauacugucuuuccuuuuccuuggacuuaaagugaggguucagguguuccucugcuuccucuuccuagauaaauugugcacaccugguuucuguuucugguuguggagauugucgauggucaucuguauguuucucuucagugcucuaccugaacaauuuaaaaauaauaaaccugagagaagugaaggacucugaaauguuuggaccuguauaaaagauuaucuguagccaaagauauaucagucgguaacugugcuugccauuaaaccuggaagacugguucggucucagaagcccacauggaaguagagaaccagaaaacuccuacaagcugucucuguccuucauacuugugccacaaccguaugugugcugcugcauaaacaaacauaucaauagaugaaaugaucuuuuaaaaggcuuuugaacugaaauagauuuuuuuuccucguuggaucuugccuacuagguauuuugcuuucagaaauaaguuugugcuguggcuaacguuaccacauuggaaauugcauuucuaaaaaaaauaugaaagaacuuuuaaaggaauuauuuaaaauuuuagaagucuuuaacuuuaggagaaagacuauucuuauuguggccucagauauucaaagaaaagaaugauuuagucuuuaagauuauccuugcccccugaauuagaaugucaaaauuuacuuuuagguacuuuuucucuuucuaaaugauuuguacuaucuuaaauauaaaaaucauugugugggugugguucugagaggaguuuggggaauuuauuuucuauauuggcuuaaaaaauuuuuuccuucagagcauaaguauggaagaugaacauuuuaaacacuuaaagcaaugguacauaaagucacuugcauguguuuuguaaauaaguguaucucucuucccaaaugcuaguuugagcucuuaacuaaaucucauuguuaucucaguaagugcaugcuggagcauaccuuuauuuccagagcuuaggaggcagaggcaggcagauuucuugaguuugaggccagccuuguguacagauuuagaggaaaugaucuuucgcaccccaggacuguuuucucuuccugggagcuuguucuuuugcugguuuucuucauuauucuaguuucaggucauuccacggguaacuugcugguauauuugcaucucagccuaucauuugaacuugaacaucauucugguuucaucuccacauugcacgugcuuccugacgagcuccacauuaucucagaugccuagugaaggcucuugccugaacuuucuagguuuuuuccacaugagaauaaagacuggagaguuuagacauuuguuguaugugacuguagaauaguacuagcuuuguguguuccuugggagaauucgguaaguacauuauuuuuguaggguucacaguucucauagaucuuuauugagaaggacuacuugaauuaaauuaagcuuuucauggucuugggaagaagaccaugccucuguucccucaauugaaaccuugaccuguguugacugugagugcacugcaggugacgguuccguacacggcacaacuuuaaaauucccuguacaugcaguauaccacuguaugcaccacauuucuuuaucaucauuuuuguacaaggccauauuagugacuguaucuuguuuauugcgaauauugcugcaguagauguggagauguagccaucuuuuuguuucuuuuaguuuuauaccuggcagugggauugccuuauaggcauugugucuuuuaggguuuuuuguuuguuuguuguuguuguuuuguuuugcuuuagaauuguaaacauuuuuccauaauguaacuauaacauguguucccacaguaggugagaguuccuuuuccaccccgaguacucaggaggcucaggcaggaagaacaagaguuuauggccaguuggguuguguauguagugaccagcaauuaaaccuacuagaaaagggaaaauacuucaggauuuggaguaggcaaagauuauuuuuuaaaaaugagauccuaaauucacagaccacaaaagcagcagcaguaacacgagccuacuguuuaaaaaaauuaaccauuuuuuaaaauccccuuucuagauccucaucaacauuuguuacuuuuugucuuuuuaauaguuaagcuguaauacugaauuggaaggacuucuucugguugauuugaauuccuugcugacuugugacucuguuucucucauauaauugcuagccauuugucuugucuuuugagagauauccaauagccuuuaaauuuugucauuucauuacauagucuggguacuauagcuucugucugguuaauaguuugcauauacguacuuccauucaauaaauaaucuuugccuacucuaaauccuaaaguauauuuccuguucuaguaguuuaauaaucacuggucauauauuuguaucuuuugaguuguuuaaggugaaacaugguggcuagcuuuuauuuuucugcauauguauauacauuuucccaacauuuguugagcauuguauguucuugauaccuuugucaaacucagguggcugugaagacaccaauuaauuucuagaguuuuugucauggucugcugguuucugugucugcauuuugaagucaaagucuguggcacgucagcuuuguuugguuuugcucaggaugcuuuauuugcuauggaucccauguuguuuaugugauuauucuucauaauacuaugaagaaugguauuuguaguuucauggcuauuguuuuauaccuuuagacugcuuuugguaauaugaacauuguagcaauauuaaaggcucuguuucuugagcuugggauauaucucuaccuuuuuguauaucgugaacuuuuugucacugucagcauuuugauagcagauauauuuuacuuucuuaguuuaauuuauuccuaguuuuuccuccuguaaaacauugaauauuggggaugauauggccucuaaaaaauguuuuuuaugugugugugcuugaauguuugugcaaguaccugaggauguuagaaagagaugcuggauccucuggaacuagaguuauagugguugugagcugccugguguggguacagguccucugcaaagagcagcaagugccuuuaacuacugagccauuucuuuuagccauaugagacugcuuuuuaaaauuuguuuuucagcaagaguuuguuaguaauuggggguugggggguauugucucuuugucucuuuguccccccucuuuucucucucuuucucauuguguguguguguguugauuuuuauauccuguaucuuuacuaagucuaucaguuccauugggguuuugggucuucagggaauucucuauauaagagcauuuaaucugacagcaguguuagcuggcuuaugagguuuuucuacuugggaugacauuuaucucuuugucuuacuuuauuaccauagcaaaauuauguuagauaugaguguugaucuuuguauuuuuccaucuaucagaggaaacacucaaccuuuucccuuuaaagcuuaaaguugguugugcuuuuucauacauagccuuuguuauguugacauauuuuccugcuaugccuaccauacugaggguuuuuaucaugaaagaauguuggauuuuauugggugcauuuauuaagaggaucauacuguuuugccuuucacuuuguuaauguaaugcugccuuaguuacuuucuuauugcuaugauagaaucccugaaauaagaggauagauuauuugagcuuacgguuuuaaauaauuugggccauagcuguuuggccucacaaacuugggcaaaacauuaugauaauggaaaugugaagcagaggagaguuguuuuauuucaugacuaaccaagaaacaaaauguuuuaggaaguagccauaaaugcauauucacaaggacccgcuccccagugaccggcuuccuccagguagucacuuccugguuucuacaaccuccacaaaugguguaaccaugcaguagugaucagaguucaaaucaugaguguaugaaggacauuacauauucaaaccgucccagaggcacuaccuuuauugacuuguaagaauguucuugcaucucugggauaaacccuacccgaucacgauguuugauauuuuugaugugcugucagaaucggcuugacaggauuuuguugacaauuuuuauauauguguucaucagaaauacugguuuguauacuacuuuugcgauaugucuuuauguaacuugguguuugauuaauucuagccccauagaauaaauuuugacauagucucuuuuuucagucuuuuggaaugguuugaguaagauugguuuuaauuucagguguuuuguagauuucugcaauauccuuuucugccacuccauaauuagucucauuuauuguaccuuaaguugcagccccuuguguuuuccuugauugccugauaaaagaauucucuuguucccuucccccuucccccucccucauucauguauaccuugguuuauaggaggcaggugaacacauagcuuuaacuugucaucuguucugugucuuuuuuuuuuuuuuuuuuuuuuugguuuuugguuuuucgagacaggguuucucuguguagcucuggcuguccuggaaccaggcuggccuugaacucagaaauccgccugccucugccucccaggugcugggauuaaaagcgugugccaccacgcccggcuuguucugugucuuuuauugcaugucuacucuccuuauuuguaagacaacuaagaaacauucuuuauuucucaguuuagaaggggagauagcuuggugccuaaucaguguccagacugccacccugauguguguauaauuggaaaccuagcagauuggaaacauacuggaggaaguaagucagcuguuaggagacugaguaccugagagaguauauagcaguguuucccuccuuguguuugcaaagccccagugacagcaaacacauaauuucuguguucaguacacuauucugagacauuuuacugcugguccuguuuugcccuccuuccacuuagccuaguaagacacacuagggauaaaaagaguuguaaguaaacggaagaugaaccaacugacuaaaucaaguauuguucagugguuucuuguacuugugcuaauuuuuauuuuuagugugauuuauguauuuaaaauacacaauugaggucucaguauggguaaguuuuuuuuucuguaacacauggauccuaauuguaaaaauggugauacugaacaagaaagaaaagaauuagcugacucaaaauaucagcuaaaugauucaguuaaaaaaauuacugacuauaacaaccucaaucauaagaguaauuuagaaaaauauuaaaaagauaggauugacaagaagauagugauuacacagagaaaaucacaaauaauaaauugaaacauauguuuguucuauugugcuuauauuuuacccaugugauauuuugcuuuuuuuuuucaccugucuuccaagaaugaaccuuauuucuuuaauaagcugaaauucacacauuuagauuauaaauuacaacaugcugaauaaggaugucauaagcauucuugaguauaaaccugauauauaacuaaacuucuagaauggccaucgcugagucagaagaaagacuuggacauauaccuaacaauuuagggggcuagguauacacaccuaccaccaccagaaagggcauuuaauugaauuauucaguauagcuuuaaguguuaaucaaaacuuuauuagauuagggugugugauguuuagugacgcucuuaauguuuguuuccccucauagguugcugucuuuguuagggauucuauugcugugaugaaagaccaugaucaaagcaacuuggagagaaaggguuuauuuaguuuacacuucaugucacuuuucaucaucaaaggaaguuaggacaggaauucaaaaagggcaggaacuugggagcaggagcugauggagaggcuguggaggaauguugcuuucugacuuacucaagccugcuuucuuauagaaccugggaccaccagcucaguauuggcaccgcccuugggaggccgggucuucucccaucaaucacuaguuaagaaaaugucccacaggcuugccuacagccugaucuuauggaggcauuuuguuaauugagguucucuccugucagaugaccguagcuuaugucaaguugccauaaaacugucuagcacacuuaauuaucaaauauuuguguacacauuuuguauuuuguuauaaguuuucucagcauuuccaguauuacacuggaaauucuuaagaauugggauaaugucuucuuauuuuucugugaucauuuacaguuaucuagagccuggcucuuucuauagagaaaguuaccugaagacaaugcaauagagaucagagguaguuugguaaggaagauauuuaaccauuugacaaaaucauugucuacgauaacaauuuggacaguuuucaauuuuaguuauucugguuagacaucuuuguuuagugucuuuguuuccuugaaaauuaaaaccaaugacaccaucagaucauucaauuuuucguuguucucuuucaguauuaauuuuaaagauccacaguuugcugaagauuauguuuuuaaagcugcaaugcuuccaggagcaagguaacaacaguaaacuaccuaccuaagaugugugcuuuguggcaguguucaucccuguauccuaaauaguguauuuuuaaauggccagaaagccagcaacaguucugaaaccuggugacugggaaaaauccagcaaugggcggcaauggaaaccucagcuuggcuuuaaccgggaccggcggccuguucaccuggaccaggcagccuuuagaacuuuaggguaaguuguguaauuccuauuuguauauuaugagguuuuuuuauuguuucuugaguuauuccauaaacaagucaguauuucugcuauagauauuuaagagacgacacagcacgccacuuuguuaucuagauuagugauuuugauaaucaucuuuuuccuccuccuccugccuugccugugucugucuguguauauaucucugucucuauugagacaguaucucucuguagcccuggccuggaacucacuacauagaucaaacugacuuuaaacacccagagauccacuugccucugccuucagagugcagauuaacuucuuuuuuagauguucacuucuguauuucuuauguauugaugauauguugcaugaagaguauauucuccuagcagguuuuuaucuaguuuucuaacagacaaaagaaugaaauauugucuuugcugucaaguuuuggauuuguuauguauuauuacaagagugucuuuaugacauauuaaccaauacauuaauuaaauaaauaauuaaaacaaaggcacuaggcucuuaaauuaguguuuaccuaugcaugaaaggugguauaucauugauguuugcauugucaauguuuugccagcuaagauguuuauuugaucaucuguauugccuauauaaauuugugguuuuuaucuuuuacccuuauuagcuguugaauuguuuuucuuagcuauagaagaaacuauguuuagaggacuuugaaacaaugaaaguucaggcugggauuaaaaaagauggucugggguuggugugguagcacaugccugugguacuuggaaagcucaggcaagaucacaagucggaagccaacucaggcuacaaagcaagacccuauuucaaagcagcuugcuggaggaaaugcuaauaacacacaauucaggaauuaaaaugauaacucguuuauagguauuuugauguuaaugagacaccgaaaaagugaaaagguaauucaggcagaaaguuucuaguagcauguaauuuauauaucaaauaauagaaaauuguggcuuagagguuaagaguaggauuccuuuuucuaagcuucuuccuguauuuauaaaaguuacaauaccaucuacaugucaguucccuaauauguaaaguggauaauaauugcaccuaccucaugaugacaaggugguggcuaaguagaguucugaguuucaaagauguuuuaucuaaauucuuauuacuuggaacuuaccuugagaaaauaguuuaaguagcauagcuguacacuuaaugucuuguucaucaacauauguaauacuagcucuaaaugagaaaagguuuaguaaaauaugagacauuaacauagugaaauagucuaaagcuuuuaugcuauugcuauuaagaguaaugaaaaccaccuggcaguauuugagaugguaaauugaaauagcaaaauauagaauagugauuaguagugacagcaacuaaacaaauacuaugaacaucuuaaugugguagaugaacacuuccuaucaccauuacuauuguguauaguuuggaaccuuaguuuaauuaaaaaccuuauuuuuauauuaaucaggucuaacaauaaagaggaaacuaccaauguuugauuugucagcuuaacauauuaguacaaucucuguauauagcucucuauguuuucuuauguaagggucucuuuuacagccauguuacaccaagaggcucggggacgaguguuuauacgaacacugcacuaccaccugccaauuaccaggggaacaauuacaggccacugcugagaggucaagcucagaucccaaaacuuaugucaaguaaguuuuuacugauugguuauuguauauucuaaauaaacuaugacagcaaagguugcugcuuucccauccucacugccaagaaagauuguugcuuugauuuagagauagaauuaaacauugcuagaaaacuuguaagagaauacuuuauacaaauucuuucaauuacuuucugucuuguuuguauuuagcuuacugaauaagaugaacugaaucuucuuuuucuuuauuuauaaaccuauuucugaguuaaccuaugcaggaagagguauguguuuauccauugauaacuaaaguauccaaacaguuaaauagguuuauuagauaugaaauaguuaucauuuagaugcugauagacaaaaguauuccuaucuuggaccaaauuguauguuaguuuuaccaaacauaaagccagguguuaaguaguaauaucucucaucugaaaaaaccuuggccucuuucaccucucaaaaccugaauuauaaauaguugauaaugcuaaccauaaaggaaguaauauauuuugauuuccauaguagugauggaaaauaguugaguguuauauaugcuauuuaccauugauuuuaauuuuauuccuacuuaauguuacauuugagauccauggcugugcuuguucaucaggaagauacagaucaugggccagguucucuaaacuaucuucauauaguugcuacccaaccagacaagggcagcaugggggagaaaagcauuuggcaagaaacuagcauuuguuauguuugaggggcauuggcacuuaaaaaucuauuuuuuuaauguuuguaguauuuuauaaauuaaauaucaaaagaagggugugagcuagggauuuggcuaaacaguagagcccuuaucuugcuugucaggguucuguguuugaucucugcuacuaccuggaauaaaaagugcugcuuuaaugcagaaaacucaaaaaucuuuaaaucucucucccuucuuccuuucacuucucuacuuucccuccuuuccaacucaauuguuauuacuauuguuuguuuauuuuugagguaagguuuugcuagccaguauauagcccugcuuggccucagaguuacagaauuuuuucuguuuuagacuucugaugcuaggacagugggcuuaauucaccacaccagacuuaaaccacucuugauccaaauaauaccucaguacuguaggccacagagccaggcauuacuguuaggugugcugaggagcuguuaaagugccaggucaaguagguaauuguuagaagcgucugcucugugccuaucaugguuuuaauguuaaguugauuuauaaaccauuuucuaacuuaaagcacagacuuuuuucauauaguacaugagaagaaauagguucugaaggucuuauuucucucaggacucacuuguuaucauguauggggucugauuaugugacuuugcugguuuguaugacucucugaaauugauuacaaugccaucacucacucucagaggacaugguucaaaucccagcacuuaugugguagcucacagccaucagugacuccaguuucggggaaucugcuauuuucuucuagacuuugacagcauagcauguacauuguagacagauaugugaaaguaaaacauccauaacagauaaauaaaaauaaaucuuugcucgcgcgcaugcaugcacgcacacaggaaaggauaauaccaaaaauuaggugcucuggguuuacuaacauacauccuuagcagauugguggaacaaaggugggaggaagauuccacaaauuugaggccagacugagucacagagggagaccuuguuucaacaaaacccaaacccacaaaacaaagucuaaacuaucccucuuugguaaguguuagccuagguuagugguacuuugcuuauuaacaggaguccauaaccuauagaacaucacuaaugauaaauuauaaauuugaaguuuugguuagaaacuguuuuauuuuaguaaaaucgaaaacuaagccucuuaauuuuucaacagcauuuuucgugucauaauuauuuuauuuaauaugguaugguguaaaauacacugaagaugaaccauuuggucaaagugccucuucuaucagcuggugucucuuacuguuggucuuuuaccuuuaaugugacagcuugggucacauuauauauacuucuuuguuuguugauaacuuuuuggaaucagguguagcccugaguagucaauaugaauaaagcaucaguuuuugcauucuagagaagguggcacaugacuucucuucauuuugaucaguaagcuugucacuuaucugcauuugaaaagugauuuguuauuauugcagucaguaaacgugaaaucuuuccugauuugccgugcugauugaguaaauggucacuugagacacuguuguugaagcugguugauguggccuuagagcucuagaaaagggaugccuucuuaaagaccaaaggaaaaauauuaacugccccuccuuguucuuguggcuucugaagugcaauucauugucucguagguuuuuuuccucccacucaaaaagaucuucuguuagagucauacaaaugaaugguaauaaguuuguuuuacugucugcuucauuacuuauaagccaagaaauauuucuacuuuaugaauacuuaagggcuauguguauuacucagagcuacaugaaaaaauuuguuuaaagguggcuuugaaaauauuuguggcuguuuuuagcuuuucuuuuuggauuaaaagcaaagaauguuuaauaauauaugagagaaaaauuuaaaauuuuauauuauuaguucaaguuuuagcaaaacacuauuuuugcuaaugcuaagauuaugugaaaaaggguuguucugaaaaugagaauuaaauacggaagcacuugauguaccugcaaauggugacaugggaaugaauguuugccaccauuuucuagcacuuauagauagacuguuaggaaaugcucgcccuugaugcuucuguauuauuguauucguucuuaaaaauaaucuuaugguuaauuuaauguacaucauauuugaauuuaauauaugugaagagauggguugagaugccauuacccuccaauuacacacuuucuaggagaaaauaaacauuuuuccccuucauuuucagaaaacauuaggguaaauggcucuugaaaguuuauuuuaaugugcaugugucuuuuucauugucuuuaguugaucuugaauaaaucggguuuucaugugaaagcuuuucuaaguauuguagaggguaugcauucugugguuauuaggauacaccauggaaccagacuuugagaaugaggucuuaaugauaaacauguuuccagggugaagcacagaggcaugcaacagcaucugaaucagucauucuggugguuuuguuuuguuuacuuuugucggucuuuuaccuaauuuuguaaauguaaagacauaaaaaauacaagcuuuuaaacauuuuaacggauucuuacuaauuuuuguauaccaccugaauaggucauuggucuucaaguuuaacaaacaaaucagaaaaaaguacaaauaauuuauuuuaauuuucaguggucuauuuucucauagauugcaggucauuguuuagcaaauguccuaaguuuuccaucuaaggaagccucacaaaggaaauaauugucauucuuauaugaauuucuaggcuuuacauguuuaagguuuccuuugggguuaaaguuuaguucacuugguaauugguccugcacaaagccacgggcuccauuuuccagcaccauacuuaccaggcaugguccuguagcucacucuaauaccaaacaaauagaggcaagaggaucaaaaguucaaggucaucuugguuacuuagauuaugaggcuagccugagauacaugggacccugucucacaagauaagauaaaauacugauuuuucugacaauuucuagucugaaucauucuggucccagaaugggucacuuuguucucccauuucugugaacuucguaauuagcuuccagaauuuccacugagguuuugagcccuaguuuacaucuuuggaccauuuggaagcuuuuucuacauuguaacucagcuuuacugcuaguaauaucauuuuuaagcaguaaaacaggauauaauucagcuagagagaauacuugcuuuucuggugaaggacuuccucuccuuuuugaaagagggacccccuaguuggaugcugggaacugugcagguugguaccagucauuggguaguauggccauaucuagagaacaaccccaggcuggcuuucucagaccuguggagcagggcagaaagcucagagcagaggaugucagcugugucaugcuacagucaucaguuaucacauacuuuaacuuggcccauuugugcuuuauaaaaaauuuaaaagcauuaauucuuuuggauucuuuuucuuuuguaauaccaaauuguacauuuuuuuuguuuguuuuuuaacuaggucuaagcuucuuuuagaaagcaauuuugaaaagcaugguuuuuguuuguauuuccauuaaacuguaugccugaauacguuaugguaagcuguguucuugcuccugguagucuggagauggccacuguccucacauagugaaugcacaacuucuagaccuagcuguuuuaaucaggucacagcagaccaugcuagaggcagaugauaacuggaaggcagaagucaggagcagugguugguugauacuaccccuuugaguguuuuaaaugugaaugcugagccugaccaggacuugaugggccuuuccuucauuguaauguucaguuuauguaggagagcagcagccauuugguuuuaucuaaguagauaaaacuuccaguucugcuuugcaauaauggggugggggugggggcuugaugaugaggaaacuacagaaaaauaggggguucuuucauuagcuuuucuugaugguauguguuggaaagauugcaugcuuucuauuugaugguguugcaauuggcacacucaugagacaaguguccauuagaauuaauccugcuaguucaguguacagucaugaaaaaggcugagauccuuucuuuuauuuuuuuuuauaacauuuaaaguacacauaaaaagucuauguaugugauacauagccacgcacuacaggaagugagagagaaguguaaguauagcuaagguuguuaccaaaacugccuugcuagccacaaaaauauaaccaacgagagucugugcuaauucuuucuguugguuauuuuccauuaauggcuaguucugacuccggcuugcuuacuuauuuuacaugcucucuccuuccuuuuucagggacuuugaauuauaauccauguuggcaggugauggucgacgcuuucgcaagcauuuugugaacuccucccauuuguuuuccagauaugaggccccaagauuccuggcgaggcccuccuccucuuuuccagcagcauagauuugagagguaaauaaagcuaaauaaagcuuuugugcuuuagacgcuuccugcauugauaucuggggugcugcuuacuuauaaaccaaacguaccugcuuggaaagaaugcuuuuucucaccccaaauauuuuuuuugcacuuguuuuuaggaaauauguaauuaauccuuugaauuaaaugcucuuguuuauauaguuuccuguguuucuugguuuucuuggacuuuauuuuauugaugcauugagguacucuaagaaaaugcaacacagagcuuaaaauuguauuagguuuuugucaagcuaaacaaauuucucuuuagcaggguugugcaguuuaaugaggcauaacuaaugguguuccacuuuuaucaugucugccagcagcacagcguuaguacagaccagcuauugauucuuaccacagaccucuucaaguccuaaucagcuucuuugguacaacuuuuucagggcugacaggccuauuguagagcagugucacuguaggucaguaguuauuaguugccacugaaaacaguuucuuuaacuacuuaagacugaacugaauuaaaugcagaagggacucagaagaggauuaugggaucugcagucuaauaaguaccauggacuaggaagaaugugacaugauuuaauaacaagggauguuugacauguguucugucauucauaaguucuguguuccuaagucagaugaaccugccaugagaagucagaugggcauguuaugaauaacuauauuaucaucuguagaaucauuuacuuaagaguauaauguauuguuccaagcugguuuugacagcaucaauaaauguaaaaccaaauggaguuucaugaaaguaaagcuuccuuuuucacauuuccaguuacaaucuguuuuuacuuugcugaguuagccauuuuaaucuguucacaucuucagugaauggacugcauuaacaaaugguuccagaaauagugcucuucuugcacaaauacuuagcagcucuugagcucuuccaaaauugccuucuguuguuuucuucaagauugcuacaaaaauuuguguaacucagcuguuuauugauagugucaguuaccucaugcaaaccauauuuuaaaucaaauaugauugguaaguauauguuguacaugcucaaagaauacugcacauacuauuuaauuaucaucaaaauagcccagguugaccucgaacuucuaguccuccugccuuacuuaguuucucaagucugagaguagggauuauagguauacaccaccaugacuagcuuaacaccguuuuaaaacaaauaaagggauaaauucuucuaaauuguuauauuuguuuuuuucauaucauuguucauuucuucaguauguuaauaaaaauuucuaauguguuucuucacauuaucagcacuguguuaacaucuucucauagaugugguguuaauuuucauuuuuacagaaacugagacacauucaguagcuuauccaaggucagucuuccauguuucucguuaccaagaaauguuuuaguagaacagaacucaucagacuauuuccucugaacauaauauaaagccacagcacaucaaaggaaaugaaagauuagccuccacuucuggggcucuaucuguaguugcagcagcuuuccuucuggucuguacacauggaagguuggucuaggacuaccaucuguauccucuuccuugcucugcuguuuuaucauuuucuuguucuuauccuauccucaccaagaacuguuauuacccugacuuugugaacccagaaguaagagacauuuuguuuggguuuuugugggcuggguggguaguuuuagauacuuuaacaucaccccugaaagaaaaaguuaaagauaagcauuuauagaaucauuaauucauuguuauuuagggaauggaacucuuuauuuuuggagguaggaucucacuauauggccacauuggucuguaacuugcacucuuucugccucagccucccaaguacuagugaaggaaaccguuuuauucuccuaagcuucuuuagcuaauaaguggucacagcuuauugcucauuucuauacccuugucauucucaauagucagaccuuacaagacagaguaggaaccauuuuuacuuuaccaaaagauuauagauaauagauggugguagucuuaugagagucagguuuuucuaauccuuaguuuagagcauuuccaguguacuauuuuggggcguuguuaagaauccuauuaaaacaugacuuuugaguauaucuuguuccuaaacuauaauauauugucuugaauuauuucuucccuugggacaguacuuaaaucucuauauauaucccuuugaccuaaaaauacagcugguugagggcucaguggauaaaagcaacagccaccaagccugacaaccuaccugauuuguguccccaggacucagugguggaagaacacuaauuccuguaaguuaucuucuaagcucacacauauauauacacaggcaaaugugaacacacaaaaauaaauacaugugauuuccuuaagaaaaaaaaaucaguaagagauagguaugguggcauuuaucuguuaucugggcacugagaagguugagacagaaggauuuguuucaaaaacaagccauuguuccucuuucccaaacagaauaacuuguaguuaauggugcugacucugugcaguacuagccagcauuuaaguuucuuuucagccuguacaacacagcuguucaguuuaauuuuuuuacuugugguuacucaacuaaauuauggggaaaaaaaaucuuuaaacaauaugauuaaccaccguacaaauuuaaacuauccaaauuggugggccuuaguuaccaacuacucucuagagcaauaauuuggaagcuuuaagaauauuguugucggccgggcgcgguggcacacgccuuuaauccagcacuugggaggcagaggcaggcggauuucugagugcgaggccagccuggucuacagagugaguuccaggacagccagggcuacacagagaaacccugucucaaaaaaccaaaaaaaaaaaaaagaaagauuauuguugucaauacagaaguggaugcucauagucaucuauaggauggaacacagggcccccaauggagaagcuagagaaaguacccaaggagcugaaggggucugcauccuauagguggaacaacaauaugaacuaaccaguacccccagagcucgugucucuagcugcauauguaucagaagauggccuugucggccaucauugagaagagaggccccuaggucuugaaaacuuuauauuuuccaguacagggaaugccagggccaagaagugggaguggguggguaggggagcagggcggggggaggguauacggacuuuugggauagcauuugaaauguaaaugaagaaaauaucuaagaaaaaaauuuuaaaaaagaauauugucacuguaguagcaaguagugccuugccuuauaaguuaccucaguuuauaaccacuaacucuugcauuuauguauguauguauguauuuugccuuuuuguguuuguuuuuguuuuguuuugauuuuuaagacaguuucuuaguguaguccuggcuagccuggaacucacucuguacaacaggcuggccuugaacuuacagagaccugccuggaucucccucccaagugcugagauuaaagggcugcacaccaccuugcuuuuugcuuuuuuuuuuuuuuuuuugagacaguucccacuauguagucuagccuagaauucgcuaaguagaccugauuggccuuaaauucacagagauccaauugccucugccuccagagugcuaggaucaaaggugugcaccaccacauguaguccuacuuacuagaaguuagggaaggcuaaccuuaggguuuccaccucacauuuucgaaacauuguuucaaaguuucaguuugcuuauauuuguaaauuaauauaauuaacauaaaaaugauuguugaugguaaauaaauacagguguucuugccagcaaagagaaaaugguaguauauaccacuguuacauuguucuuucucuugacauuuuauuacuaaugauuuucaucauagaaauuaucuuugaucaaaaacauuagugaucauuuugaacaaaaagaaaauuuguauguuuuauacuaugcguuuaccuucuaacuuauuuuuagcauauaaaaaugcuuuuaaauuauauuuauaguuuauauuaugccaaaguaguuccaugaaauuuacuaagacuaaaaagaaaaaugagugacaguccagggucugagcugcaguuuugguuuguaggcuuugcacacgugucccacaucggugaccccugauggcaguccaucaccacaggucccucaccucugcagaggucagaagcaccguccuuacgugugcauagagcuguucuucucagucacacagggcauucgugcuagaauucacuuguacugauaauaaccucaagauaauuaugagucguaaccauagacaaccucacccugacuuugaaucgacucugaaucacaugcaauguguuguauuugagcucugguuucccuccuuuccauaaagaguugcuuugcucuuccuugagucuucagacagcuguugucuuugaacuguuacacaagaauaauuauuuugcuuuuuuguuguuuugauuuaagaaggcuuguuguaacugaagggaaaguagaauagcuucagauuugaauagcuaacuguaagaagaauuagucuacuacccaaugagcccaacuucaggcuuuuaucccuaacauuuucucucccacaaagaagugaaauucauaugcugauagcauuauagugaaagcuggcuagucagaaccuuggugaauauaagaaauuuuacugaguucuuccuggcaucaucuuuggccccaaaauuucuaauguuaaaguauacaggaacauuuuuuuguuuauuuauuuuuugugacuguaaguagaaguuaaaaacuucuuacugggaaaguuccauuuuaaauggugauuauugucuuuagaaauaucuuuguuacauuguuuaugugacagguuuuaauuaaguuaugauuuaaugccuucuaccuguuguuguguaucuaaaaguuaaaauaggcacuugaagacaauuaaaacaugucuuucaacuaguaaucugggacagcaaacuggguuauaauagcuguugaaucuguguucccauguaaacuguacaccaaaugccagucagcccaugccaauuagugcucauguugcuaggucaccauggucaauugaaaacugcaucaauagaacuugaaaagguuucuucacgaucagaccuucugacauauugagcagaauaauggaugggaaaaaacugccaaguucccuacccuggauucaaaauacugagcaguaagaauucacuugcaaccugcaauuaacuagaaagaauagaaucuaagaacgaguccagacauuuuuaaaaauaaagccucuuucuccuacuuguacauguuuacucuuuuggacagcaucauaaauguaaucagcuugcugauuguggauccagauaaaagaaacuucacauuuaaaaccauauaaaauguuuuauaaaaguuuaucagcuggcuuuaugcaucccccuuuuaaaaauuauuuauugcguuacgugcauacugaugaggugguagugggauauuaccucauguggagauuccagcuuggguucugggaauugaacuugggucaucagacuuguaaggcagguacuuggacccucugagccaucagcuguaaacaucccuuuuaauaaauugugguguuuuaugaagugcaguacacgucacugguuaccagagacacaaaggccaucauacuacauagucuguauaucacaucgaggugaauugaguugucuuaaacguuggaggagauaacccguccauuuuaggcuugugucguaaaauaaagcaggcuucacuuccgauacaaaugucuuuuuacagaaguguuggagcugaaccucuacugccauggaaccggaugauccaaaaccaaaaugcagccuuucagccaaaucaguaccagaugcuaggaggaccuggaggcuauccacccagacgugacgaucaccgaggagggagacagguaauaaguacaaugugggcuguagagggaaagcagcauacugcgcacuguuaacguuugucucuuaggaauucauauuuuguuaccaguauuucuggagaaauuguuaauagaacagcuuaggugaacucuugucaucauuaaauacacauuuaugucaaguaucucaccuaaauaguuuauauaugggcagucuucaagacuuccauccucggagcccccuuuaucauagcucaguggugauuaacaggagucacagucaccaaaacacuucuuuuuagcuuagaggauauuguauuauuaaacuaggucugucauuaacaaaugaagacuuucuggaagcugaaaguaaauuaaauaaguaaaauaaaauaaaacuaacacaaaaguacuuguuuacugguugucuuuauucauccuagaauuuucuuaacugauuguuguugagucccuccuuguggaagcaaauuucucuuuaaagauuuuuccacacauuuuucugcuaaauggaaagugccaugugaugcagaagagcauuauaauucaauguauagauacauugaggugauguagcuuugucuucucaauuccauucagucuuagcaaguuaaagcugaggucuguuuaauauaauuccccuagcaaucugugagccugagcaggauucguacuuuaauccaacacugcaacucugcugucuagucuuccuggagucaggcgccugcaguacaugcggaguuuuaaauugcuuacuugguguugccugcaggccuuugcaguacuuuguauauuaguuuucuacuuucuuuuucuugcuuugugcccccaccucuuuaauccaagaucucugacguggaaggaaaaccauuuugauaccuuaaaaguguauuuuuguaagccuguuucaacuauacaagaaaauggucaccuuaauuacuuacaguuaaugcccuuugagaaaauguuguuaugauucauuaaaaucauuccacagaauuuacauuuuuuucuacccaacaccuuugaaaagucauauuaggaaauuacugcugucugugcuacuggaguuuagguggcacuaggcaguuaaaauaacagcauuuuaagaugaagacaugagaaaccauggaagauucugugugcaguuacuucauuuuacagucaggaacugaaagccugugaucucauaguuuggaggcagagcuggggacacugaaccccaguucaagauauguaaacaaguuggaagauucuuuuuuggaaauauacucauucguuuuagucauguuuccauguaguguuuguuaaauugcaacuauugaaguuagaguuuauuguuaaagggaaugaugcuuucauuuuauuuguagugaccuuaauauaucucaacaaguccuuagcacacauugcagccuccaggaucugucaugccauagaguguaagcuguuuaagugguaaaauagaaccuuguguccuaaauaggaauccccucuucccuuuagacccaaacccgguaccacacucauccagcaaaugcucuuacuauugagcuauauucccaaaccuuuagaaaaagaauuaugaauuguuuuuguauggaaauguuuuguaagcauuuuaauaacguuuuguuaauguucuguuuuucauugagccauauauauauauauauauauauauauauauauauauauauauauguauauucuuaaaaauaacuggccauuaggccucaguaagucccuuccuuugguuaaaugaagagacuuuucuaccaaggacucagaauggugggaaauuuuuaaagcaccgucuuuacagcaugcacaauaucugcaggccgagaccagacagaauccagcauagagagggagguggacacaaaguccuucccuuaguuaaggagcuauuggcaacugguaaucacugggaaauguuugaaugguuuuuguuuauuuaaggguuuagcucccgguaggguguagauccugguagguugacuaccaguaaaggucacacaggcaaaaguauaugggcagcacaaaugguacuuugaugggguaaaaaaaaagagacaaguugggugguuugagaagaguaggggaagggaaugaauauaaucacaauacauggaaauucuccaagaacugauacaaauauaaaaauaaaccccacucuacacacuuacaagaagcauuucacuguucauuugucugcauuuuagggaguuuccuagaugugguuguuauuaaugcuguggaguuaguguucaauaauucaaacuuuguuugggucuucagcuuuguuugaacacacacuuuugaagacuuuacaugggauguaccuuaagaaagagucugcuucuucaugaggaggugcucuuccacggagaguaaaugucuacguuagguguuauuaauccagaagauaaauucuuucuuuuguuuacuuucagggauaucccagagaaggacggaaauacccuuugccaccacccucgggaagauacaguuggaauuaggcuuuuguaaagcuuuccacauuccuuuuaccagucuacauuuuuaugcuauuuguggaaagguuucuuucucaaguaguaguuuuuaauaaaacuacaguacuuuguguauuucuuuuaucuguguguauauuuuuacugaucugaucucacuguuucaugcugcuuuccagagauguguauggcauaauacagugggucugaauuuauuauugcuuguaaacacauuugacgaaauuaggaguccuggguuuucauuaugguuaaaauucaaaacagcucuaugcugauuuuaaugcacauuaauaauuagguauggacauugagcugcacauucugcagacgagcauauauugcucaacauuucuuugaaaacauuucauuaaaguacuugacuuacagaaauuuguggacuuuaguaaaaaaauaaaaauaaagcuaaacuuuaaaaauguuggugucuggugucugauuaucucagcugaaagucuugacuuacggugccugugcaaacuuauuuacagugccaacuuagacagaagcaguuccuacaauuaaaugucaagagccagucagugucaagguaugucuuaagaggauaugauuagcacuucaagagcagcauuuauuaguauuuuacuaauaaaucuuugaauauuuacauuuuaacaaauuucauauuugugguuuaguuuuaagggcuucuaaaucucuuauuuagggaucauuuuuaaaaauucaaguugaaguuuuuuagcuaaagaaucaauacucagcauauuuuaagugauauuucacaguggccuucagucuggaucuucucccuuucguuugagcacacucacucccuacgugcauguuuagaguugacacagcuauuuucauuucauuaccaaaacaaacuuaggcugguuacguuucugugaagacugaggcuuucuuugucucagcuuuucuagccuaauauuguaaaguaagauuucuuuuggaccaucucacuuaggacguugguucuuuagaacacagcuaaagcauacuuguuaauuuuuuauuauguggggaaaacaauccaccuuugaauagacaggcauuuugaaacuuaaauacauugcugaugauggugaaagcagcagggucauuuuauuguuggaacaaagaguagccauuagcaauugucaaccuuuguguguuaccuucaugccacauuauaguaaugaauccuacuauuaaugucucucauuuagccuucuaaauacucuaucuuccaaagggaacau

SEQ ID NO: 1139 - RNA, 4095 nt, Mus musculus
auaaaaucggcaauaacacuuuaauauagauuuguggaauucuggccauucuagccagaacacacauuuauaagccauaaauaaagcacgcagaaaccauaaauuaaaucagacccgagaccuggauuucaccauguccagaaugggauguguuuuucuccuuucuccugguccgguacaccagacucuuacauuauuuuucuuuccucuuuucaacaucaguacaacccucugguuuucuguuaaaacuacaugguuuuacaccaagucacucacaaaaguuuuuuguuuguuuguuuguuuuuaaagucagacuuuucugcaacaacagcaauagagaacaacaacaaaaaucaaacucugcagaugucuugagaagcaguagucuacauagaggagaccaaaggcuccuuuaaaacaaguuuauauguauacauauauauuuccauucccuucccuauuuagaaugacagaucacuguggcccaucuauuuagggacacagacaggugagacugcucccuugaggccugaagugugguggcuacuuuuccucaaagcucucccaaagucuccacucagccucucauuucccuuguccccagugaccagagcuagcagggccugaaagccaucuucuuaggaugaguucauaauaggccuggaguacacuccuugguaguaggaagugucugcagccaggggcgaggcauccaggcccgcuuuguucgugacugggcccauggccaagcugccuggcaugggggaaccauagcccccuggguagugcaugaccuguucguaggccuugagguccauuuuguggggcugaugguggugguggcuguggugauguugcugcucggacgacaugagguuguugauagagaaggggugguugaaggcguaauggugcucgggcuucaggugggccucugguggcaggccuggguggugaggugggcccagcaggugggcugcagccugcugcugcugcccaggcgagggcgccggcucgggaggacucagcgcagaggcaggugcucccuuuagcucgcuuaggccaccucgcuugugcuccugacacggagaagcgcuggaauggggggacucggugcccgccggagucucggaggccgagcccgcggccuccccgagcugagccugagaggccugggacccaggagcggucuucuugccuccgcuacuggccgcacccgcggcuuccuucagugccaguugcuucucacacuugaagcgcuucuggcggcgcagguagcagccguucucgaacauguugcccgagucugggugcaggguccagaaggagcccuugccaggcuugucuggcgagcggggcaccuugagaaagcagucguugaaggagagagaguggcggauggaguucugccagcgcugcugguucugccgguagaaagggaagagguccaugauccacugauagaucucgcucagcgucagcaucuuguuggggcucugcuggauggccauggugaugagcgagauguacgaguagggagguuuggcguguguguagcugcgucgguaugucuuggggucccgagcgcggcucaggccggccugcccguacauggggcucaucgaguucauguuggcguagggggcaaggccacccauggccccggccgccugucccccgagcgggcucagacucggacucaggugaggucccaugcccgccacgccggccgccccggcugagccgcucaugcccgccauggcgccggcgcccggggacaugccagcuagcgacgggcucauuccagcgcccacauaggaugacauguucauggagcccgcgcucauguugccggaaccgccgcccauggcagccgcggacaugcucauguauguguucaugccauucauccccaggccggcguucauguugcucacggaagaguagcccugcggacagagcccggggaggagacagguuagcaccuaggcugagcucgcccgaucuucccacccacccaccaguuggacccagucccccgcaauucgugcaagccucuggaaucucuugcuuucccuggaucccagugcaccaacaccaaguccucugggccccaaagagagccggaaaagagaucgcccuagggccagcgggaccugaggcucagccucgcccagauucuagaacuucagugaccuggaccaccgccaacucaggcgccccaaauguauuuuacucucccuaggggcuccucaaaucagcuggccagcacacugagucagcaccgaggccggaaaucuccguugcuaucccagguagucaaaagccaccuuuggaaccucacuggggcagucucaagcgaaaaucaucucaguguccucuauucugggguuucguaccgggaccccacuccuuagucauaggggagugaagcgcagugccugcacagaguccgggagcagcuggaggcaucgcguggaggaauaaggaagggaccgccaacucggcuaggaacuguuagugucccggcuucguagcgacaaacuuuuuuucucuuuguccacuggucuuugauucuuugccuguaccucuguccccaacuccuacccaccuucucuuccccagcuccccacccccucgccagccgaccucccaccccuccccagccgcgcgcugccaaacauaacucuguuaggauagugcguggcucggccacgaagaggauuuggaggcgccgcaagucaauauuugaucacaaaguuaauauuaucucaaggcuaacagugugucguauaaaaaagagacccauuugaguagaaggagggcggaaaaggcggcuguccaggaaggcuagaggugggggggcggguaccggugaagggagcgugcggaggcuggggacgcggagauagcugucaccccacuucucccuggccagggcaagagcuuaccucgggcuccgcguaguagcugcuccagucggauggcucgugcccuuccaucuucacggcucccagcauacuggaagccgagugcauggcgguuuaaaauuuaacagccacaacaaacgaccagcaaucagcccccacccccacccucuuaaaaaaaaaagucagcaaugguaccguccccucccucccgcccucucucgcgcucccccucucucccucucuggacuccacuuccucucucucucccgcggccugcggcgggaaguagcugggagugggcgggaagguggcuggcggaggagggggccgaagaacccuggaggccggaacccgagacucgccgucgggcgugcacucugucgccgcgcucccggggcugccggugcaggcugaggcuggcagugucgagcugccgggaggcggcgggaagcuagcggcgugggggcgggcggggggagagcgagaggagggggaggaggaggaggaggagguguggaccgcgcagcggacaagugccgcaaugacgugagcggcuggugauauagcgcggugcgcuggcgcuggccuccaauccccagaccccgggcagcccauuugaauaaucagcucacacuuaggugagaggaagccagggcuagcguuccgcaccugccgcugggcgccccgagcuagcccaucuccugcugucccuggcacucccaagaccccgaccugcaagcaggcgugcuggcgcccugguggagucccuuccuuuacguccacggggagucuuccguggacccagagaccugggaucaagccacccuuggagaaacucaggucuccugcucccgccccgccccuccucaucgccccaagcacgggguucgucaauccgaaggcgcguaccgccuugguggccugcaaagcgaggcaagccagauuuauuuaucucggguuuccucccuuuuagugcacauucccugucaaaacaacaagcaggugacagccaauuugcaaagcgcuguccuauuuagaaaaacuguguacacaccuuuaacucgcuggccgcugcuccggaggccccuccccguuacaguuaagucccggggcggccucaggaggcgcguaggacucgcguggucuggccgcccuggucgucagu

SEQ ID NO: 1140 - RNA, 1573 nt, Mus musculus
uccuccacgcgaugccuccagcugcucccggacucugugcaggcacugcgcuucacuccccuaugacuaaggaguggggucccgguacgaaaccccagaauagaggacacugagaugauuuucgcuugagacugccccagugagguuccaaagguggcuuuugacuaccugggauagcaacggagauuuccggccucggugcugacucagugugcuggccagcugauuugaggagccccuagggagaguaaaauacauuuggggcgccugaguuggcggugguccaggucacugaaguucuagaaucugggcgaggcugagccucaggucccgcuggcccuagggcgaucucuuuuccggcucucuuuggggcccagaggacuugguguuggugcacugggauccagggaaagcaagagauuccagaggcuugcacgaauugcgggggacuggguccaacuggugggugggugggaagaucgggcgagcucagccuaggugcuaaccugucuccuccccgggcucuguccgcagggcuacucuuccgugagcaacaugaacgccggccuggggaugaauggcaugaacacauacaugagcauguccgcggcugccaugggcggcgguuccggcaacaugagcgcgggcuccaugaacaugucauccuaugugggcgcuggaaugagcccgucgcuagcuggcauguccccgggcgccggcgccauggcgggcaugagcggcucagccggggcggccggcguggcgggcaugggaccucaccugaguccgagucugagcccgcucgggggacaggcggccggggccauggguggccuugcccccuacgccaacaugaacucgaugagccccauguacgggcaggccggccugagccgcgcucgggaccccaagacauaccgacgcagcuacacacacgccaaaccucccuacucguacaucucgcucaucaccauggccauccagcagagccccaacaagaugcugacgcugagcgagaucuaucaguggaucauggaccucuucccuuucuaccggcagaaccagcagcgcuggcagaacuccauccgccacucucucuccuucaacgacugcuuucucaaggugccccgcucgccagacaagccuggcaagggcuccuucuggacccugcacccagacucgggcaacauguucgagaacggcugcuaccugcgccgccagaagcgcuucaagugugagaagcaacuggcacugaaggaagccgcgggugcggccaguagcggaggcaagaagaccgcuccugggucccaggccucucaggcucagcucggggaggccgcgggcucggccuccgagacuccggcgggcaccgaguccccccauuccagcgcuucuccgugucaggagcacaagcgagguggccuaagcgagcuaaagggagcaccugccucugcgcugaguccucccgagccggcgcccucgccugggcagcagcagcaggcugcagcccaccugcugggcccaccucaccacccaggccugccaccagaggcccaccugaagcccgagcacc

SEQ ID NO: 1141 - RNA, 3733 nt, Mus musculus
auccaucaguacacugucaucuauuuauuuuguacaugugacgucauaagcaaaggcuuugcuuguguucuagcgaaacuccaauaaauaaauauguacaaauaugcugagcuuacaaaaccguaaagaaaaaccuuucuuuacaaaagauacacauauaauacauuuguuccuuacacuaacauaugaacucauuccuagcuuacuuaaaacaaaacccuucuggacucuguguggcacuaucuagagguguguaccuucucauuuuauuguauccagaaagcaaagcuaugcagagaaaauuccucaguuucuugauaauaaauggccuuaacauggccugcuacuuauuauuaaccgacauuuaaauguucuacaaagguuggaaacucuuaagaccaguuguccugaaaugacuggacaaugucccuguggauguugucaaaaugcagauucuuaugaacuggcacacugggguggggcaggggugggggcuaggauuuugcaauucuagccagaucccaagcgaggucccaauucuuguguacaggccaguggccagggcuagaagaucccucugaauuacgagauauuguucaagagucucauuaaaagaaagccccaucuaggcacccccagacuccauucccaaguuuccauguuucccucagcagcacauugcuuguauuucgggacuacaaggggcaggcacaguugagagucagcucggcacgaagcacacaacucaugcuuuacuggaaggugcuuccaucugucaggcucugauauguugaggcaggaccacauacauccuuggaaagcuaugaauguggcccaguaugucucaagauagcaauguccuauugucaugucaaaggguuggacaaaggauccucugcacauuuugaacacugucaaaaauuaauaacacuguagagccugcauaaaaaucuuaacaauaaugaccucuuuugucauucccauucaaaacaacagcaacaaucauaaaacccaggcucacccuuucaaaaacaaagauuucaaaaaaaaaaaaaacccuacuuccuuaaguuuauuuucugugacauuccagcacuauugacuaguuaguguucagcugaaauauuuuagcuuuuguuaaaauucuuuugcuuugguuaccugaaauuucugacuaaauacccaaagccagugaaaaagaacguuuucugcuuuuaguguuucuuuucuguuucacauaagaguuuggaaacaacgguaagggcaaaguuaugaucagguuuggggaggagaaugacaggagggggggaauggagggacugagaaagcuguggggggcuggagacuuacaagcagaagaaaacuggagggaagaaaauacuaaauacuuuaaaaaaaauaaauaucugggucaucuccagcccauggggucaagguuugccuucaagccuacagaucagcagcacuaggaggugaggugagggacugggguacucugggaucuccgcuguauuugccaccuccgcccaguuguccaguaucuacuuggaagaaacugggcuguccugcuucaaguccucccuacccucgcuuguccugagaggaugggcucuucucugguuauuauaccagccagggugcuuuuaaguugccagagaacacagcugggaggcuggagagagagagaggagaggagagguacagagcccggaaagacaaaggccaccugggucucuggagcaaaucccucagaacuucugcagcguccgaucaguccugacgugcugcagcacuaccuccuuggcggaagaugcgcacuuguacuccagcucugcacgagcagcgcccugcuucuugcgcaggugacagagaagcgccaaaagcgccaccaccagggacaggcuggcaauggagaugccaaugagcacgccagagugcacuggccuugcagaagggggaccugucggagagccuggcguagggcugacuggaggcuccccagagcccuccucuuccuuggugucuucccuaacagggauggggucacagucuuugcuaaucugaccagcaagggcugugucaggcccgcagauacacucauaggagccagggaaguuucgacauucacuggugaagcauucgccuugacugcacucaucaauguccgugcauacggaacccucguccaggaugaagccuucagggcauucacaaacaguaggagaguuagggucacagucugcugggcacgaaguuucauugcagaacauuucgcacuugugcgguucauccggcuugggugcgaagccuggagcgcagaugcaucgguagucgguggggcucacuggcuggcacugaaacucgcaguuagauccgaaacacggauccagaagcuccacgcacucuccauccaccaacucauagccaucauagcagaagcauucgaagccgcccuugguguuaacacagagcuggggacauggauugggccccugcuuacagucauccacguccucacaccgguguccgucugcagccaacugguagccugucucacacauacaggaguaagagccuggcacuucagcguugcugacacaaaaaugcucgcagaguucguugcacgauugaaccacaggucuugcacacgaacguccaucggccugcagguccaugucucuggggcagaggcaucuggguucauucgugcuccuauugcacaaguacucacagccaccauucuccacgcugcaauuccaggcuccugucgcuucccaagcccagugucccucugaaguuccgggcggggcccugcacaccagcuccaagccaaggggcuccaccgcggcggaacugccuaccggcagcguuugaaaguccgcaccacugaccccgaacgggguguuguagguacuagagaugugggcagccucaggaucgcgaguauucaccgucagaggccugcaggaagcugugaaguaaaacucacagaggaaacccugggucucagucucgcauggcuucucuucccaggccggcucgccgggugcagcuucaguugcugucgagaccgugacgcacagagggccgcagaguggagccgucuggucguugggccgcgcccaccugcuguaacuggugugguuaucgccaguaacccacuggaagccgcgcaggggcccgagaugcaccgggucgucacagcccugcgggagcuguaaaccgauccagggcccuaaauccauacugcucuggcucagcagaagggagaugacaucggcagccacugaggagcgcacugucaucaaauguccuugcaggcgcuggcaggccuggcuggcaucgaggaaggucgcggggcccuggaaaagcgcgaagcacucaugcuccacgcauugacugccugugggcugcagcuuggcuagugcggagagccccaggcuagcuggagccagcacacccagaaagaaaaucccaagcaugcuguccaggggugcaccgugcaaguuccgagaaaagcuagcccugcgcuggugcagacacccaguccaggcagagggguuuccguaugccugcggcgacagcagcuagccucuaucacaaccuagacguuucuagcccaggcuccuagucccugcgaggcagccucuaacaugccacuccgcugaagcuccaguuuauaaaugcgcggcccucccucuuugcacguucgggaaaaggaaggaagugccug

SEQ ID NO: 1142 - RNA, 3733 nt, Mus musculus
caggcacuuccuuccuuuucccgaacgugcaaagagggagggccgcgcauuuauaaacuggagcuucagcggaguggcauguuagaggcugccucgcagggacuaggagccugggcuagaaacgucuagguugugauagaggcuagcugcugucgccgcaggcauacggaaaccccucugccuggacugggugucugcaccagcgcagggcuagcuuuucucggaacuugcacggugcaccccuggacagcaugcuugggauuuucuuucugggugugcuggcuccagcuagccuggggcucuccgcacuagccaagcugcagcccacaggcagucaaugcguggagcaugagugcuucgcgcuuuuccagggccccgcgaccuuccucgaugccagccaggccugccagcgccugcaaggacauuugaugacagugcgcuccucaguggcugccgaugucaucucccuucugcugagccagagcaguauggauuuagggcccuggaucgguuuacagcucccgcagggcugugacgacccggugcaucucgggccccugcgcggcuuccaguggguuacuggcgauaaccacaccaguuacagcaggugggcgcggcccaacgaccagacggcuccacucugcggcccucugugcgucacggucucgacagcaacugaagcugcacccggcgagccggccugggaagagaagccaugcgagacugagacccaggguuuccucugugaguuuuacuucacagcuuccugcaggccucugacggugaauacucgcgauccugaggcugcccacaucucuaguaccuacaacaccccguucggggucaguggugcggacuuucaaacgcugccgguaggcaguuccgccgcgguggagccccuuggcuuggagcuggugugcagggccccgcccggaacuucagagggacacugggcuugggaagcgacaggagccuggaauugcagcguggagaaugguggcugugaguacuugugcaauaggagcacgaaugaacccagaugccucugccccagagacauggaccugcaggccgauggacguucgugugcaagaccugugguucaaucgugcaacgaacucugcgagcauuuuugugucagcaacgcugaagugccaggcucuuacuccuguaugugugagacaggcuaccaguuggcugcagacggacaccggugugaggacguggaugacuguaagcaggggcccaauccauguccccagcucuguguuaacaccaagggcggcuucgaaugcuucugcuaugauggcuaugaguugguggauggagagugcguggagcuucuggauccguguuucggaucuaacugcgaguuucagugccagccagugagccccaccgacuaccgaugcaucugcgcuccaggcuucgcacccaagccggaugaaccgcacaagugcgaaauguucugcaaugaaacuucgugcccagcagacugugacccuaacucuccuacuguuugugaaugcccugaaggcuucauccuggacgaggguuccguaugcacggacauugaugagugcagucaaggcgaaugcuucaccagugaaugucgaaacuucccuggcuccuaugaguguaucugcgggccugacacagcccuugcuggucagauuagcaaagacugugaccccaucccuguuagggaagacaccaaggaagaggagggcucuggggagccuccagucagcccuacgccaggcucuccgacaggucccccuucugcaaggccagugcacucuggcgugcucauuggcaucuccauugccagccugucccuggugguggcgcuuuuggcgcuucucugucaccugcgcaagaagcagggcgcugcucgugcagagcuggaguacaagugcgcaucuuccgccaaggagguagugcugcagcacgucaggacugaucggacgcugcagaaguucugagggauuugcuccagagacccagguggccuuugucuuuccgggcucuguaccucuccucuccucucucucucuccagccucccagcuguguucucuggcaacuuaaaagcacccuggcugguauaauaaccagagaagagcccauccucucaggacaagcgaggguagggaggacuugaagcaggacagcccaguuucuuccaaguagauacuggacaacugggcggagguggcaaauacagcggagaucccagaguaccccagucccucaccucaccuccuagugcugcugaucuguaggcuugaaggcaaaccuugaccccaugggcuggagaugacccagauauuuauuuuuuuuaaaguauuuaguauuuucuucccuccaguuuucuucugcuuguaagucuccagccccccacagcuuucucagucccuccauucccccccuccugucauucuccuccccaaaccugaucauaacuuugcccuuaccguuguuuccaaacucuuaugugaaacagaaaagaaacacuaaaagcagaaaacguucuuuuucacuggcuuuggguauuuagucagaaauuucagguaaccaaagcaaaagaauuuuaacaaaagcuaaaauauuucagcugaacacuaacuagucaauagugcuggaaugucacagaaaauaaacuuaaggaaguaggguuuuuuuuuuuuuugaaaucuuuguuuuugaaagggugagccuggguuuuaugauuguugcuguuguuuugaaugggaaugacaaaagaggucauuauuguuaagauuuuuaugcaggcucuacaguguuauuaauuuuugacaguguucaaaaugugcagaggauccuuuguccaacccuuugacaugacaauaggacauugcuaucuugagacauacugggccacauucauagcuuuccaaggauguaugugguccugccucaacauaucagagccugacagauggaagcaccuuccaguaaagcaugaguugugugcuucgugccgagcugacucucaacugugccugccccuuguagucccgaaauacaagcaaugugcugcugagggaaacauggaaacuugggaauggagucugggggugccuagauggggcuuucuuuuaaugagacucuugaacaauaucucguaauucagagggaucuucuagcccuggccacuggccuguacacaagaauugggaccucgcuugggaucuggcuagaauugcaaaauccuagcccccaccccugccccaccccagugugccaguucauaagaaucugcauuuugacaacauccacagggacauuguccagucauuucaggacaacuggucuuaagaguuuccaaccuuuguagaacauuuaaaugucgguuaauaauaaguagcaggccauguuaaggccauuuauuaucaagaaacugaggaauuuucucugcauagcuuugcuuucuggauacaauaaaaugagaagguacacaccucuagauagugccacacagaguccagaaggguuuuguuuuaaguaagcuaggaaugaguucauauguuaguguaaggaacaaauguauuauauguguaucuuuuguaaagaaagguuuuucuuuacgguuuuguaagcucagcauauuuguacauauuuauuuauuggaguuucgcuagaacacaagcaaagccuuugcuuaugacgucacauguacaaaauaaauagaugacaguguacugauggau

SEQ ID NO: 1143 - RNA, 2217 nt, Mus musculus
cucuccgguauagcccgcggguagccuguguuuaaaccucuacacacguacacacacucagacgcgaacacacacacacucacacucacacuuccacauagaugcuaccaaaguuuggaagaugguccgguugguggggcagggaaaagaaaaguccaguagaggugugucugagacuugcaagacucugaaaaaggugagcuaaaugcaaggcaggaacucaggaagccuggcugcauugacaaucggagguuuaggucccaaaugaccuuggaggaggccaggggaaacaauacuagggcagcaagaggagagaguggucuaauaaccccaaacccuucuccagucuccauuccucuccuguucugagcaggcaucuccaaggccagacccuaucuaguugcuugagaacaucgugcaaguuuugucugggcucagagaucauggcccccuuucccaguucaauuccugcagaauccucuggggaagguguguugcguuccuuuguucugguuuguuuuguuuuccuccaagccuaucucagaccccucaaugaaacuggccccgggguggggagggggggagggggcuuugcaaggagacuguaugagcuacaauagagccuacuugguuccuuuugacgugaucauuuccaucgucauuugagagucucaaaagauagaggugccuacacaauccguuugcucacaaagggcauugaagaggagugucuugugggcagcugggaggggaggaagggaaucugucacuuaagacuuuuagaugcuaagcacucaccaagaauguggagggcuguguucaaaucaaagcuuagccaccuccuccccaccucucucaucugccuauuccccaagcgugcgcgucaucacacacacacacacacacacacacacacacacacacacacaccaagaggacccugcacuccguggcagucacuuccaccccacugccaggaggcggugcuguugaacucuagaccaauccaaggacaguagagcauuacuuacuacaacugcuacggagcagcucagacugccuggagcaaagcugaagguuaggaaauucgucugugggaagccucgcgaaguucccauggcuuacaaaugaauagcuucucugguucaguacagcucggacuuuagaugagaacagaaggcugcgguguccucacguggagaaaaacauucacagagggacgcguggccaagagggugaaaugaggcaggcagauuucugaguucgaggccagccuggucuacaaagugagcuccaggacagccagggcuauacagagaaacccugucucaaaaaaaccaaaaaaaaaaaaaaaaaaaaaaaaaaaaaaaaaaaaaaaagagggugaaaugaaagcacugaaauuguaaaaagaagcagguggaacauccuccaucugcuugcccaugugggacucugucucugucaagccagagcugggaccuguagaguccaccacccccuugacugacguugucuuuauugggucaaagcugccucagcucuccaggaaagaaaacuccagagggaaugggaauaaauauagcaaugccuggguccuaggaaagagagaagaaugacuagggguuggacaaggggauagccucuagagaagggggcagcuuucuuaugugggaugggaccuccaggggcacuguuccagaguaggggcauccccuagguagaagacaacagggcauggaccagaggcacugucugcagagugugaacuggugggauuauucagugcugugagagcauggaauuaaauggugguuacccuccugaguggggacuuuucaauacgacaacugccuuaauuaggguuucuguggcugugagaaaacaccaugaccaaacgcaacuugaggagagagcaguuuguuucaucuuccugcuuaagguucauuguccagaggagucagggcgugaaccuaagggcaggaacggacacagaggccagagugaaauguugcuuacugccuugcuucucaaugguuugcucagcuugucuucuuauaucacccaggaccaaccagcccaagaguggcacuucccacaaggagaugggcccguccacaucaaucaucagucaagaaagugcaccacaggcuugccuacaggccaaucaacugggggcauuuuuacaacugagcuucucucuucccaaaugacuau

SEQ ID NO: 1144 - RNA, 2217 nt, Mus musculus
auagucauuugggaagagagaagcucaguuguaaaaaugcccccaguugauuggccuguaggcaagccuguggugcacuuucuugacugaugauugauguggacgggcccaucuccuugugggaagugccacucuugggcugguugguccugggugauauaagaagacaagcugagcaaaccauugagaagcaaggcaguaagcaacauuucacucuggccucuguguccguuccugcccuuagguucacgcccugacuccucuggacaaugaaccuuaagcaggaagaugaaacaaacugcucucuccucaaguugcguuuggucaugguguuuucucacagccacagaaacccuaauuaaggcaguugucguauugaaaaguccccacucaggaggguaaccaccauuuaauuccaugcucucacagcacugaauaaucccaccaguucacacucugcagacagugccucugguccaugcccuguugucuucuaccuaggggaugccccuacucuggaacagugccccuggaggucccaucccacauaagaaagcugcccccuucucuagaggcuauccccuuguccaaccccuagucauucuucucucuuuccuaggacccaggcauugcuauauuuauucccauucccucuggaguuuucuuuccuggagagcugaggcagcuuugacccaauaaagacaacgucagucaagggggugguggacucuacaggucccagcucuggcuugacagagacagagucccacaugggcaagcagauggaggauguuccaccugcuucuuuuuacaauuucagugcuuucauuucacccucuuuuuuuuuuuuuuuuuuuuuuuuuuuuuuuuuuuuuuuugguuuuuuugagacaggguuucucuguauagcccuggcuguccuggagcucacuuuguagaccaggcuggccucgaacucagaaaucugccugccucauuucacccucuuggccacgcgucccucugugaauguuuuucuccacgugaggacaccgcagccuucuguucucaucuaaaguccgagcuguacugaaccagagaagcuauucauuuguaagccaugggaacuucgcgaggcuucccacagacgaauuuccuaaccuucagcuuugcuccaggcagucugagcugcuccguagcaguuguaguaaguaaugcucuacuguccuuggauuggucuagaguucaacagcaccgccuccuggcagugggguggaagugacugccacggagugcaggguccucuuggugugugugugugugugugugugugugugugugugugugugugaugacgcgcacgcuuggggaauaggcagaugagagagguggggaggagguggcuaagcuuugauuugaacacagcccuccacauucuuggugagugcuuagcaucuaaaagucuuaagugacagauucccuuccuccccucccagcugcccacaagacacuccucuucaaugcccuuugugagcaaacggauuguguaggcaccucuaucuuuugagacucucaaaugacgauggaaaugaucacgucaaaaggaaccaaguaggcucuauuguagcucauacagucuccuugcaaagcccccucccccccuccccaccccggggccaguuucauugaggggucugagauaggcuuggaggaaaacaaaacaaaccagaacaaaggaacgcaacacaccuuccccagaggauucugcaggaauugaacugggaaagggggccaugaucucugagcccagacaaaacuugcacgauguucucaagcaacuagauagggucuggccuuggagaugccugcucagaacaggagaggaauggagacuggagaaggguuugggguuauuagaccacucucuccucuugcugcccuaguauuguuuccccuggccuccuccaaggucauuugggaccuaaaccuccgauugucaaugcagccaggcuuccugaguuccugccuugcauuuagcucaccuuuuucagagucuugcaagucucagacacaccucuacuggacuuuucuuuucccugccccaccaaccggaccaucuuccaaacuuugguagcaucuauguggaagugugagugugaguguguguguguucgcgucugaguguguguacguguguagagguuuaaacacaggcuacccgcgggcuauaccggagag

SEQ ID NO: 1145 - RNA, 6992 nt, Mus musculus
uaggagagcacaggaugcgcccugggucaggaggacgugaaaagcgagucuuuguaaccuucucaaugccagagcugugguagugugaaagcagcagugcgccucugcucccuucagagcacagccuggugucaagguccagguuccaccggcugcugcugucaccgcaggggagucuagccccucccagaaggagacacagaagaauggccaucucaacugguuuguuccugcugcuggggcuccuuggccagcccugggcaggggcugcugcugauucacaggcuguggugugcgaggggacugccugcuauacagcccauuggggcaagcugagugccgcugaagcccagcaucgcugcaaugagaauggaggcaaucuugccaccgugaagagugaggaggaggcccggcauguucagcaagcccugacucagcuccugaagaccaaggcacccuuggaagcaaagaugggcaaauucuggaucgggcuccagcgagagaagggcaacuguacguaccaugauuugccaaugaggggcuucagcugggugggugguggagaggacacagcuuauucaaacugguacaaagccagcaagagcuccuguaucuuuaaacgcugugugucccucauacuggaccuguccuugacaccucaccccagccaucugcccaaguggcaugagagucccugugggacccccgaagcuccagguaacagcauugaagguuuccugugcaaguucaacuucaaaggcauguguaggccacuggcgcugggugguccagggcgggugaccuauaccaccccuuuccaggccacuaccuccucucuggaggcugugccuuuugccucuguagccaauguagcuuguggggaugaagcuaagagugaaacccacuauuuccuaugcaaugaaaagacuccaggaauauuucacuggggcagcucaggcccacucugugucagccccaaguuugguugcaguuucaacaacgggggcugccagcaggauugcuucgaagguggcgauggcuccuuccgcugcggcugccggccuggauuucgacugcuggaugaucuaguaacuugugccuccaggaaccccugcagcucaaacccaugcacaggagguggcaugugccauucuguaccacucagugaaaacuacacuugccguugucccagcggcuaccagcuggacucuagccaagugcacuguguggauauagaugagugccaggacucccccugugcccaggauugugucaacacucuagggagcuuccacugugaauguuggguugguuaccaacccaguggccccaaggaagaggccugugaagauguggaugagugugcagcugccaacucgcccugugcccaaggcugcaucaacacugauggcucuuucuacugcuccuguaaagagggcuauauugugucuggggaagacaguacccagugugaggauauagaugaguguucggacgcaaggggcaauccaugugauucccugugcuucaacacagaugguuccuucagguguggcugcccgccaggcugggagcuggcucccaauggggucuuuuguagcaggggcacuguguuuucugaacuaccagccaggccuccccaaaaggaagacaacgaugacagaaaggagaguacuaugccuccuacugaaaugcccaguucuccuaguggcucuaaggaugucuccaacagagcacagacaacaggucucuucguccaaucagauauucccacugccucuguuccacuagaaauagaaaucccuagugaaguaucugaugucugguucgaguugggcacauaccuccccacgaccuccggccacagcaagccgacacaugaagauucugugucugcacacagugacaccgaugggcagaaccugcuucuguuuuacauccuggggacggugguggccaucucacucuugcuggugcuggcccuagggauucucauuuaucauaaacggagagccaagaaggaggagauaaaagagaagaagccucagaaugcagccgacagcuauuccuggguuccagagcgagcagagagccaagccccggagaaucaguacagguaaagugccauagguuacuuggguagcugggcagccagauguaggccugggaggcacagaccacagaacugagagcagagacaaacagucagcaggccauuuguuguuuaaagccaaccucagcagcccaguccaaaagugccuaucuguccuaugaguucauguggaguagcggcaaggggaccaaggaugcagauauggcagaguuccauggcaucucacacuguaaucuucuguuuuccacagcccaacaccagggacagacugcugaagacuauguggccuuagagacagcugccacuaccuucagagcuaccuucuuagaugagggggaagccacaucauucugaaugacuugacuggacucucagcaaaaaaauugugcaccuuccacuuaagaaccugguggcuugggauaggcagguauuuucuuggugccuuugauaugucugggggugaaagcuguguguugguuugucauuguggggaguuuuguggauauugacagaccucacucaaacacccuuuucaaauccaauagcaacugguuccucugguuccuaauuagggggaaaggagucagaggggugggacaggguggggggauggggcuucaaaguuuuuucuuaucacuugauuuaucaucgaaggaguuacuggugcuaauuacaauggaaacaguuccuuuccaucacaggacagacagcaaaccaauuuaaaacuacuuaacuaggugagagugcucuacccuuccuauagggacuuuuucaggauggcugccuuuguguacauuugccuucuggcauuuccccuucacgucccccccccccccccagcccccuugguauuguugaaacugucagaaugagaggaaguucaaccaacugcuuagggaguaagcuggcaggaaguuuagauauuguauccccucacucuuaacuuucugauagccuuggguuuaugggcaagcaaaguuacaaguugggaaguugcuucaagugagugagaggucuugguaaaagcauaauccagagggggaggcaggaggggauuguuuuaacagauauuugaaugaaaauaucagaaugaacugaugcuaacacacaccugauuauugagaaacaauaacaaaacuccuagauucauuugucuuugcgcuagcacaggccccaacuccacugcagggcacccugucuaccuuuauacugucccuaacuggaagcugguacuguaggcucagaaagccuuaggaggcuuucauucugaacguaaggaaaggaugugugagccaggugaugggcucuauuuuaaaugcucccauuuaaguuuaccuuaguccacuucacaguuaaaaguacaucuggaggacuugagcccuaucuuguuggcgugacacauaccaaaccaaggauuagucaugaagaaaguucucucucucucuuuuuuuuucuuaaaaaaaaaaaaaaggagauagaggggaaagggaaaggggaagagagaacagcuaaaaaauguccagccuuuaaaacugcuuagagccaucuuaugauugacauguuuauuucaaaguguccauuuacaaaagugucccuuaaacuugcaaaagugucccuuaaacuugcugacgguaauguuguuucagcugcacaggucugucuggggacuggaaggcaucccuggugagucacuucaguaucucugggaggcuucaucuuaguugucucugcuguuugaaaagcugagacauggaaugugucuccaucaugagauucagagucuuuguucucagacuagagaacuuugguuucuaggaacaaaggcacccaucccucaaguugauauccaggaaucgaacguuaauaacaagcagauucaagaccuuuggaaauaucuuagagaaauauauuagagaaauaccuuuuuuuggccaauuuaaaaugaagauauuuuuauuagucucucucucuccucccucucucucucucucucuucucucucucucucucucucucucucucucucucucugaaaacacaagguggagaguaaugggaaaaagaucgggcucagugggaugccugaaaugagugcauuuaaaaaucaacucagcaucuggcuuucaguugaaguuuggguguuuggaacaggaucccuggcaauaacugagauuggcagcuaauccauuaccagcagaccagcauuaccagccuuucagaucauucagaugaauuuagagccaugguaguaucugcauauacggacaugacccuaaaagcaucacuuuuaccuccaggccuucaacugcucaccuuuauggcuggagaugaggaagauaacugaaucuaggcuccccacagcuguguuugaucuaugcccaggcugcuguguaggacuucaacugaccaggaugacuuaggggauagacaugaagcuccauuuccaauacuccuagggguacaggauccacucugugggacccacaacagggaagggaaugaugaggaacauauuuucucaaagugugcuuucagcaugagccacucccguggagacagagcucucucaucuccugaccugccaaagccuucaggagaaccauaccucauguggcaaagccaauggagccacucacuguuccuaaaugggugcuuuauuuucacauauauucuuuuuuuuuuuuuuuuuugagacaggguuucucuguauagcccuggcuguccuggaacucacucaguagaccaggcuggccucgaacucagaagucugccugccucugccucccaagugcugggauuaaaggugugcgccaccacugcccagccucacauauauucuugcuguccucauacuugagacuggaaaauucuggcuuagggcaucuaagaggcaaagcaauaaauaagugaacuucuacuggaccaaagguguguuaggcuaugccuucucuacccacgacaucagugagcagagacagaacacuccucugccugugaggaccagaggaaguacuacuuggcaacagaauuuucuuaaguccagaccuggaaaaacuguauuuuggaggggcauaccuucaggccuccagccuacccauuacugaguuguagguggccaucacuguccuuuguauuuuaugugguucuggcgaugguagccagcacaugaguaugguagacacuagccuuccaggaucccuauacuccuaguaccuugcauuauuuuuguucauuauuaaagauagucaaaaagcaauaccuccucacccccaguaauuugaggaguuaaacaaacaaacaaacaaacaaacuacucagaaagaagugccuggagagagagagagcccuaaacacuauuugcaaaggaagucuagccucaguuuucccuggugucuagcauggcuuugaugcaaccccaaauguaugcauuuucuggcuuuggagacccacuuaucauuaucauuacuaccaucaccaccaccacuaccaccaccgucaccaucacugucaucaccagcucagggugcuacgcaucaucaugguguuuuauuaaugacaguaacuggaugaaucccaccugucucuaacugagagcaaaaaggccagacagaagaggagcagaaagaagagaagcgggcugcuuuccuucagcuucauacccggggaaaccgaguaagccucugggaaggucuacccugauuccuuccccagagcacuggauaauguggaaugaaacacaaauacuuuugaguacauguucacagugcagggcaagcugccgagaaagaacucuuuaccuccucaucaaguuuuccuccucuuugaguuccuaaccaugagccucgcguggacuguuaucaccaaccaaacuuucaauagguggaugggaucacuaggucauuuuguucugccucucuuuucucauaaauauuucugcccaaacuaaaggaacagagaugagauuugaccaaaaaaggaaaaaaaaaagauuacuccauucaaaauaacauauuuuuugaaagcaaauauaggaaagccuuuuccuauuauuuuuuuucuucuuagcuuccccauugucugaauugggaaaacaggaaagcauugcuuucuagcaccugcaaaaugguuuaaugccccugcauauuuccauguccuuccaacaauagauuuagcaugggaaucugaaauagacgcccugaaaacaucugucucuuccccagcuccuaaacccaggcuuugauuauguaugguuugugaaaucuaucauccaaaacggggacagacacaccucaauccuccauggggucaacaacuauauacccccagugaccccuuaggcaaggacuuguugagaacugcaucacauuuugaccuguucucaacaguacccaucuauuucaggugggaucucuggaccuuuccuccuucccaucuugucugcaauguggcaaauggcuucuuuuugcauuuuuacuccgcccccaccccaagcugaaguucauuugcagaucagcgauuaagucugaauugugugguggucagucuuguuuccuuuugucagggguuauuguaaauguuaguaauuucgccucaagcccucaguaagaacauaaauauuuuaaaauaugugcguuugaaaucuguuucaugcauccuggaacugugggaugcucaggcaagagugacuuuagucuuucagugaauguugcccagaauguggguagggaaggcucacagguuacucuccuccuuagagcuacaacauaacauucugaggggagucacaggguugccuuuaaaaagugggagcuaugucaugcuuugagcuuucuguuaagcaccucuccuaauaaacucugaaaaaauauuuguuuugaac

SEQ ID NO: 1146 - RNA, 11932 nt, Mus musculus
cguaagaucacguaaccaacggccggaaccgccuuugcagcuggaggugcgcgcgcagcgccuuccuagccuacggggggcggagcccacuagggggcggggcgcgcucguggcgaccaauccgcggacccugcgguccgcugucccugcuggccugggccaggguacggguccguggaggcacuggcuaagaggugagcgugcugccgacugguucgucuucuaggcuguccucugucuucugucccuuggagcggcgggcugugggggauguaggcacaggacggggaguacgggggugcggcgggacaggccgaaaugaccacgcaggcuggacucuggaggccggaggaagggcuggaccuugccgccagaguucauucucccugcggcuuuggaagaucaucggugguccgggacucgggguagccaagguggggucagagguggugcagucagagaggccaccgacaccgaccuuuauucccugccugagagccaggaucccucuagggugggcaggcugcggagaacagcgucuccuggaggccuggccugggagucccgaccccgggacuacuaggcgaccuuggugaggaggcuaggcccacccugagacggccgaaugccaaugaguuacaauggaacacagcugucacuagaccucaaauagccgcucgcuaugaccggugucugcccccaggggagguaaacagggaaaucugcucagggccuucuuggcugauggugaagucgcugccagaucuccuggaagaacuucgauuucccuugagggaccagggcgagguguuaggaaaucaggcuggccguaugggcaucgggccaagaggggucuucagcuuuagucuucaggcuggggccggggauucugaagagcauuggcccuugaguacuugccucuugucucucucauaccaguauuuccuuuauuuaagcuuccucuguagguagguaguguucccuguagaguccccuuuagucaacaugacauuccacaggugccaaauuuacaauugcacucucuaggagucuuuucuguguuugagacuggagauuuuggguaguggucucuugaaugaaauggagaggcaauggcagauccagguagacauauggaauccaaggugaugucuagcgucaggugaaggagaucuaggaaugcucuggaggguggagacuuggagacccauguaagccuggaaaaggaaguuagauucagagacagaggacucugagaagagugcacaaagcagaagacaggaaguugggcuagcauuuuggaauccaggacaggaaucuugggggauauguuaacugcaggggaauaaccuuucauuuggugaagcuggaguugaggggguuguugacaaacuauaguugaaccaagacgggcaugaggcuccgguucaagaugcccaucagccagcuaaucauacuggccugucacccguaagaugagauguccuuuacagguguguaggaagcccaccaugaaccagcaaaggucagacaaguuggaaguguuugcuauguuguguuccauaaaggcucagaauggcugggucuucaagaggaagaagugaacguccagagaagcuucccacuugcucaagguuacacaguuuguaaacgcucuggaacuugaauuauuucaggagagcagcucaguuuaccugguguuuaaggacauugcaaauaaggauggguuuuaagcuauuuuucuaggaagugcuguuuucagugguaaaagugauuaucaaauaacaauuucuugcucaaaaaaacccaacuagauguaaauuuuccuauacuuuggaauaugucuuugaguagauuagaaaauaaccuugauaagcaaauuacugccuuaaugaguuucacuaaaggugaacuuaucauuugugcucagcacugggggaaggcuugccaguauuguuuucaugagaauauuucucaugaaagccuuucugggacuuuagaaacugauaagaagugaaguguaauuggacucuguguucuauauguguuuuuuuuuuuaagauccauuuuguuuuuaauacuaugcacauuucuuuguuaggguaugugcaagugaaugcaggugucugagaagucagauccccuaaaacuggagguagagcaguugugagucacccagugugggugcugggauuaaccuuggguuuucugcaagaacagcauguacuuuucuuagcugcugagccaacucuuccacccuaucuuugaguaaugguuguuguuguuuugagauagggucucauauaguuccggcuggccucaaaguuggccaagauugguuuugaacuccugucuuccugucuuuaccuucuaaaugcugggauccuaccuggcaguguugguuauagauacaugcugccacauccaguagugauuugaaucuuucaaugagaagauuugaguauguuaguuacuguuuauauucuuaagaaccaauguaacucacauaauuucaagcccuuucuuuggucuucauucgugagcugauugagucuugauuuuguuuucaaagcugcuuuuagaaggaagauggaaaguggcacaguuuugcuggaauccaaaucuucaccacucaaccuucugcaugagaugcaugagcuccgccuucugggccacuugugugaugucacuguuagcauagagaaccaggguguccaugaagacuucauggcccauaaagcagugcuggcggccaccagcaaguuuuuuaaggagguguuccuaaacgagaagagugcagauggaaccaggacuaauguuuacuugaaugaaguucaggcuguugacuuugcuucguuucuggaguuugucuauacugccaaagugcggguagaagaagaccgugugcagcagaugcucgaaguggcugagaagcuaaaguguuuggaccugucugaaacaugcuugcagcuaaagaagcagaugcuggagucuguccuuuuggaauugcagaauuucucugagucucaggagguggaggccagcaguggcccccaggugagugugacccccagcuccaaagcaaguguaccaggggaggaugcucacuccaauggccuuguagauuccuccgacuacccaauagagagacugggcaaugggcucucaccagaaacaccauccaagaaguguaaggagaaacuggacaagaagaaagauguggcuaagccucccuucccuaaaaucagaagagcaagugggaggcuggcuggaaaaaagguguuuguggaaauccccaaaaagaaauauacaagaaggcuccgagaacagcagaaaagugcugaggaagccgcagagaaugacaaguguccucaggaccaaagcccagacaaugagaggauggagacugagccagcugccaaaagugaggcuugcccugcuaguguagaacuggaggaaagccugcagaaaguggagggggagaaggaagaggaagaaggaaaggacggggaggagaagaagaagaguaacuuccagugcacagucugugacaaggccuuccuguacgagaagaguuuccugaaacauaucaaguaccaccaugguguggccaccgaagugguguaccgaugugacacuuguggccagaccuuugccaaccgcugcaaccugaagagccaccagcgccacgugcacagcagcgagcgccacuucccgugugaaaugugugccaagaaguucaaacgcaagaaagaugugaaacggcaugugcugcaggugcaugagggugguggcgagcggcaccgcuguggccaguguggcaaaggccugagcuccaagacugcucugcggcugcacgagcgcacacacacaggcgacaagcccuauggcuguaccaagugugaugccaaguucucacagccaucagcucuuaaaacccaccugaggugcggcuaccugggaauguugcuauguggagcagggcuggccugcaugcagggauguggguucccaugugcuaacaugcucugggcaguuggagaugguuuuaggacuugaaccaacaugucugucucuguauaucuucauuucuccacuggugccaucuaggacuugggaaauugaggcaauuuuuaauccucuuuggaggaggaaguaagggaaguggcucuucaacuucucagagaaccuuuggcccccuccucccacgcauaaggccaggacacaggagagccauccagaauucuaggugcuguaugccuccugguagccugaggucuccaggccacucuguacuuaagcaaaagcugggcuauugaaguuccaugaaaugauauguagugcuguaggacacuucccaguggucuuuuaguucucagggcuuggaaagugccauucaaugguugaucuaagaauaaagaucuaaaaaucagaccacacuuucuaacuuuuuuuuuuuuuuuuuucugagacaggguuucucuguguagcccuggcuguccuggaacucacuguguagaccaugcuggccuugaacucagaaauccgccugccucuuccuccuaagugcuaggauuaaauuuaggaauuuagcaguaucauuuaugcuugcuuuaauuuuucagagauggucaugucuuugccucucaaguauuggcaucaaaggcaugugccacaucguaguucuucguguauuauguucucauuccagacaagcaguuaaauuuucuacuguauucuaccuuugcccucuaaagccauggggggcgagagcauggugguugucaucuuucaguuugccugaguucaaaguacuuguguaggaagcacucaguagaucauggcugauugcuacaucaugcugguugugaaacugaaaugcuccugugugggucucagcaacguaagagcagauuuuuuucucuuuagacuguucauguuaggaaaugacaguaaaauauuuggucacaugguacuuugucaacaguaauuccuaagguuauuucaaaugaggaagcuuuucaaauguuaagugauucucugccuuccagugccucacagcauaaauaaggcccaggagagauguaggagcucucaagugggaaguucacucugguauauggaacugaguacagauaucaauccuugggucuugcacagaaacuucauguguguugggauguacaguaaacccuugccccugagccaggguuuuuuucuauauagcccuggccauucuggaacuugcucuguagaacuggcuggccucgaaauuagagacuucaugucugccugucucccaagugcugggauuaaaggcgugugucaccauugcuuggcauauggugaacuucugaucaguuccauuagucauuuaucucagcacccuuggaggaaaugguuuuugcauaguacagaggaauuuggaaauuguauugcaaagugaccuuugacauauacccugaguuaccaucugaauguuguacuuucagaguucauacaggggaaagaccuuuugucugugaugaauguggugcaagauucacucagaaccacaugcugauuuaucauaaaaggugccacacagguaaauacccacacucuugugauugacugucuuuccuagcuagagaagaaaacugcaguugcuuaguuagaaguuggcauccaccagagcaucgcagguuacagcugggcuucagcuuuuccaucgagucaggcuuacagauauaccugcugccugcagugcugcuguaccuggucugugucacuaggcacuaaaauggagcacccaggucuuugaugucuaagguauuuaagaguuguaccccgaagucuauuuucaggagucuguccuaaagaauuaucugcuaucugagaaaagcugugcaaucagcucccuucuugcuauguuuaauaacagaauuaggagcaacaugaugggcaaaccacaaggaaguguuugcauaggcuggaaauccaugccccagcucaagauauggcucuucagaggaaggacucuugaauugcaugggcacaucugugcuuucaugaaugcuuaugaauggucacagugccaacuguugaaaaccuggacagaaaccaggagcaaauacuuaccugacaaauaaucauauuuagauaagauauuaacucuauuucuaaaaaucuuugugauaguuuuccgugagugggaaagauguuuuauucugguucagcauugcacuccugugguugaaaauguugauguaaaguauguaggacaaagagccuggucuaucacuuuguacuauauccccucacccagcucuucuuugcuuacacuuucaccuguaagcacucaacacagaccucaggucaagcacaguccagacaaaggagguguggaccauuugguacuggaaugcaaaacuccaaccggaagcugugggggaggcagugucacaccauagauuuagaguugguauaugauuauuaauguauuaaaacuuuauggaagccaauguuuuaauguuuguaaaauuggggggcacaccagcugauggcauaagaacuuaaaacaacaaaaagugaggcauugaaauugccaugcagucuagucaagucgacuggugucacuagccucgaagcuacuugauaauccauugugaacuucccuucauuuuaacagagggauuuuuacagaaaugguuguuugagaauaauccaacagacccccaaaguuguaaaauuuucuuauucgcaguaacugaauuucuuaaucuuagcuggcugaacaguaaccauugauucuugucccguggaaugcuguuuugauuucccaggauagucccacuuuuagcaaauagcaagagaagaauguuugauguuucauuagaaagugucagcugcugcuugccaaggucuaaagagaagacuagcucuuccucaucugguuguuuuaaugccucuguugguauuuuugucuuaacuguuucuguaggugaaaggccuuucaugugugagacauguggcaagaguuuugcuucuaaggaguacuuaaagcaucauaacagaauccacacuggaucgaagcccuuuaaaugugaagugugcuugcggaccuuugcucagcgcaauucccuguaccagcauauuaaaguccacacggguaugguugcauaguaccaggggaaaguucagucuggcaaggaaaacaguucacaagggugagauuuauuagaaaggcacuugaagaauguugcuuuggugucacuguggccauaauauaguggcucagggcuuuccaggguugauuuucucagcguagagaaagcauggccagauucauggcagcaggaacuuaggaagguuccucacauuaugcuaaaccagagaaggcuagcaggaacgaggggugguaugaucuuauccuacuuccaagccaucaggaaguagccagguccauaaagaucccacagcacagccuucaaaauagugagcagcuugagcauuaagaacgugaacuugggaagcacauuucuauuucauuccuucugaaucagaagcuuuaugagugaaaacuugccaaacuuuguuauaguaguauuuuuaacccucuuuacccacucuggggccuuugauuaaacuuguacauguugucugaaugcuguaccacuacauuaauuuguggaacccuauuuuuauguuuucuuuuuugagauagauuuucuuauaucccuugaaguuccuauguagcccaggaugauuuuuuguuuuguuuugguuuuuuguuuguuuguuaguuuugagacaggguuucucuguguaucccuggcuaucuuggaacucacucuguagaccaggguguccucaaacucagaaauccgccugccucugccucccaagugcugggauuagaggagugcacuaccacacccggcccaggaugaucuuuaauuccugauucuccucucuauaccccucaagugcuaggguuacuugucuggcuuccuuuauguauguauucaucuaaucuaaucuaaucuaaucuaaucuaaucuaaucuaaucuaaucugguaugcuugccugccugcccuccuuccuuucccucccucccuccuuccuucccccccccucccuuccuccaucccucccacccccccucucuuucuuucuuucuuucuuucuuucuuucuuucuuucuuucuuucuuucuuucuuucucuggcuuacuuccuuuauuuauaguuuuuguuuguuuguuuguuugguuuuugagacaggguuuauauagcccugacuguccuggaacuuauucuguagaccagaaugaccuugaucuuagagauccacccaccccugcugcucaagaacuggaguuaaaggccuaccccacuacugccaggcuaauuccauauauuuuaauuaauuacguuuauuguguguauguguaugggugauuuaagugcccugauguguauggaggccagagccaaccuguggaguugguccuuggcucuccccguguggguccuggagaugaaauucaggucaucaggcuuggcggcaccuuuacuuccugagcugccuuguaggcccuuucugguucugauaaagugaaagugagaacauuuuaauaugcaaguggggacaguguuugcagcaugggguuuauugaaagggcacauagcuuccuguggccugacagcuugaguauggaugcuuauaugauccacaccucucacaguuguacacgguuaaagaauguuaguguacauaugugcacacacugaagcauuuugauagggcaguccauuacagcggauaguagguuuguauuucaucaauguaaugucagcugcacacacagaacugaccuauuucugguacaguuguaagcucuugggauuacaguauaguaaacuggugccucugccagguaguccuugggucauggugauguaacuucccuugugcugagucuucagaguagccagggugcacagauguguauccagaguuaaaaggagacugaagaugccauugaguaguuuccuucuuucuuuguucaggagagcggccuuauuguugugaccagugugggaagcaguucacccagguaaaugcccuccagcgccaccaucgcauccacacuggggagaagccauacaugugcaaugcauguggacggacuuuuacugacaagucuacucuccggaggcauaccucaguaagugaugaguagccugcuugaaaacaaagcccuucuggucaguccaaagggucagaggugguagcagguucucucuuuggguguccugaagugacaucuagccaauaaggugaaggaccccuauggccaagccuaugguaaacacuugcaagcaguagcugcugaacagggcagauacuugguaauuagugcacagauuuaaaagccagggagaucuuuuguuuauuuuuuaauauuaaccuuuugaucgauaaacaguccagcucuguuuuccaggcuguucuuggacuuaugaccuuccaucucugccuuccaugugcuaggguuaugggguuuuuuugagugguugugugccagugucuggcccuaaagagagccuauuguuuuaaaauuugcaugcauuaguaaauaucuguaaacugggaaacguagcuacacgugcagugacucuuauuuuguuuuauuuguagauacaugauaagaauacgccguggaagucuuuccuugucauuguagauggcucacccaagaaugaugaagggcauaagacagaacaacccgaugaugaauaugcaucacccaaacuuucagaucgauuacuaucuuuuggugaaaauagccauuucaacaacuuacuggaaguccaaggcaaugugccugccgugcaggagaacagcucuacaggcgcugcuugcaaagcaguggugucucaggacgcucugcuuaccacuuccaucagugcccuuggugagcucaccccacaggcaguuuccaugccugcacaccuucccuccuugaccaauauggagugagaacuugaaguugugugccaagcagucuguguaauugcuguauuccaggugaugccaggggcugaggaaaaguugucugugcaaaaauguaggcaagacuggccuugcagguuucuucagacuuccaugaccuugcacgucucuuucacacuugaacauucuguuaacauucugaucugcaugaucucagcuacauuucaucagcaaacacggcaguuagcauagcucauuuaacccugguguagccguacaugucaaucacacuaaugcuugauucucuugacgucuaaaccacugcuugucuuaaucauagaguacacagcauugacccagcuugggaaagugcuguucguggucuccuggucucgcccugccuuaugcuuccauguguguuuacuucacucuggucccuuuagggcguuuuucuacaggguuaaaguagaacuggggccacuuauuuuuagcugauucuuccugagauaaaagcaaauaagauuuauucugggaacccuagaaugggguugaagaaguagaugauuccguucguuucucuccaacccccuuuuguaggcacgaaaagaugaauggcggguggaacauguucaggguaguaccuuagcauguguacagguaaggagucugucauaacauccaauuugggaugagcuguugaauuuuguucccuaaaucagauuaagucaaagcuguccuaccaaagaauccagcagacaguugucucucuacagaagugugagaaauaaagccuaggugucagagcauuuagcuagguacauuuucacaaacagcaugaugagugagccuggcaaaucuugacuauuuugccaggcuuuuuuauaauguccagagcuccccaaacccccauuuucacaggggaagaugacacaaacuaguaacugcuacaaauucaccucuagaagaaugcaagacucuagagcaguggcucucaaugacccuuucagagguugcccuaagcuaucagacaauccaggauauuuaauuaugauucuuaacaguagcaaaauuaguuaugaaguagcaauggaaauaacuguauggcugggagucaccacaacaugaggaacuguauaaaagggucccagcauuaggaaggcugagaacccuugaacuagaggggaccagaagccuugguaugcucaacuucuaugccuuaacaagcggaucauaaggaaccagggauguuguuucaaauguuccuuuggcuuucucaugcugaauuuaguaauuguucaacaaauuuccuaugaaaaaugcauuuuaugguacuugcuaucccugauacaugguugcagggccauggauggguauguggacccugugccaccugugacccuuaagcauuaauuuuaagagggccuuaaagggggaauucuuaugcuuucugguugccuuuccucucugcuuuuacuaaacuugcugugaaaacacucugguuucuaagggaaugacuccuaauguucagggugaagauagaucacacaaugauagaaacugagaguucucacucagugaucacuuugugguacuacccucaggagcuggcgaggccaccaaaagggguuccaggugcugguaauguuucccacuugcucuugaaaguucagggcugaauuauuucacauucgguuaugaccuggcaaucuaguuguguuuacagacaaaaacagacaaaaagacuagugauuggcauaugaccauuuuaucugguaagagaaaaccugcccagcugauguacuguguuauggaauaaagucaucuugaugagaaggaauuuaaacaauagauuauuuuguuaccuauuggaagaacugucuugaauuuguuucuuuagaaguucuaaauaaaauuguuuaaugugcuaauaau

SEQ ID NO: 1147 - RNA, 38490 nt, Mus musculus
cgaaaggccacgcgugccgcgccugcguguccgcaccugcuggagggagggcuaagucgucccgggagccuagcuagucagcagaggaggcuuuggcugcagcgggugacauggacaacgcagggaaggagcgagaagcgguccagcuuauggcggaggccgagaagcgagugaaggcuucccacucuuuccuccgaggguuguucgggugagcgccagaggucuugcccuuaggggucuuggugcccgauccccugcccagccggcugccaccgcagaguaccccgcgcaacugcuuaggguuacgggauucccaguggcccacgcucuguuuugggucccguagcauccagggccucaucgcaucccuugggccgugucuggggugucucuccagucagcacacacugcaagccccagaaccuuuuggggauccucaggccuuggacaccccucacccacacccggagaaccucuagcucacaauccccaggcacccuuaaacaacccagaacaccuacgcguccucggagaucucuguggucccccaagucccaugcgucgccaacgguccggugcuagcuccaggguccgcgccaagcugccucuucaaggaugccaccccuccugguggaccagauuuauucauuuccccugguugggcccguaaaucccccgggggagccaggacugugagguucuggaauucaaccuggaguuuggcagcagcugguggcucguggggagcgcgaagucugcgccccuguaucccgggcacuugcccgcuggccuuggcucaagggccuugaaaucauauccuccuugguguguuuuucauuugccagagugacuuguauccguaguucaggcuucccguuugaugaacuguauguaacauugcuccuuuuuaaagucagaguauccuuugggaaucccgugauuuuguuaauucuuacauaucuugguagggaaggguuugguuuacauucugagcuuucaaaaagcaaaaccugcccugagagcuuguggaagaauucugggcuguugauuaugcgaaugauucagcuguuuaugacagcgguagaaauuacgugugccucuucuuuuuuuucucccauuugaaagugaaagaucuguaccaagaacagauuuuaauuaucgagagggacuagagguacauacuaaacugcugcauugugagacgcaguuucuguaaaaauucaguauagacacuuaagugcugaaaauguacccagugaacuuugacuuuuauuuuuacuucauucaucugacuacuaauuacauuaauuauuauauaauaguuuaauugagccccauuauguuugcaucuccaggaaaugcuuagagucacauugauacaguuuaugguaccauggucugccaagauagagaaggagaccaugcuuggagaccccuaagggcauuugucucugcuaguucuuaaauuucucauguaauaugaagcuuggaaguguagguguaaguuauagauacugcuuccucuuucaaagggacaaggagcauugcaagugccaaagacuaauucuugucugagucacaaaacacacacuggauugcauucagucugugugaaauuuaauggcagaguagcucaccuugggagaugauguuaauacacauuccacaucgggaugugcuuccuugagccaguuauggacauuuaauuuuggucaagaggagcacuguuuugaggaaacuaugucaaaucuugagacacucaucggaaaggauuuugaggaaucuuuauuucugaagaaacaucuuuugggccguugcugcccugucaguggcaggccagguaggaagacuuucauuucccauccacgcucaguuuguguggagucacuuagaaacagcaguccagguuguuaccgugggguuuggaaaagguuagcuuugcuucuuugggccucaguuucuucugcuauaauccagugugucuugugauuaauaaucaaugaguuuauaaaauacuuagaccuguggagguuggaaauggcuguggcaugauuauccacauacuuaucagagcuggcagucccucuuaucaaagaagcagaagggcagauggauugaguuuuaugggauuucagagccaaaaguguggucacuagcuuaaaugaauaaauaccuuaagagucuuagccagguuaaguguccuuugcacucaggacugggagguuucuagucauauuugguucugaaagcuuaggagaagaauauguagaacuucauaugauccauuauaaguauauaaguauuugaaaccccaaacuagaccuauuucucuuuuaguuacaaugguccugugggugugcuauugcaagcaucugucaucaccuuacacguugcccugccccaccccucuuugguucuaucccucauuuacgguaguguuauccauccccaugugagacucucaaguuaacagggaauuaaucauggcaaguaucaucggcgcuccugcuuaagagauggacaggugaugauuuaaggaugugucagacauuuaaaaaggcauuuggcuuaaugcagauguuucacgucacugacuguuaaucuccuaacugcagauuaaagcggagcuugacuccaucuccuguaucccaaacaccgcuuuugugauauacuuuguucucaguauuguuacauaacucugccuuucuguuguugcuuuagauggaaauaugcgaggaaauccaugagagugagucuauuggaagcuucuucagcuugguagcuggagguugagggagggaggcgugcaugaguacaguuauccccccagcgaagcugcuacagcuucccuacaagaaaaccauuugaaaggaugcagacaagccugcaaccaauguuacuucuguuugguuuucugucuuauucccgguuaaagaguaacuguuuuugucuggguuuuuuuuguuuuuuguuuuuuuuuuuuuuuuuuuuugguuuugguuuguuuguuuucuuuguagcugugccgucaaauuaauucucacuuuuucugaagagcacaacaguguguaagaccaccacugaaaaagucaaaguuucacuuagugcauugccagaguggagcuguggacauuuguaguuaaucaaaguuuaauuuagcaucuccgagaacggcuagaaggaucuuuagcugcccagacugacaaugggauacuuuccaagugcaaagaccuccuugcuaucuccauuuguuacuaggggaaccugcagugagggcacagagcacacugaagaaagccguacuuacugaaugauaggaaaguguuucugagcuuccuuccuuuguuuguuuguuugcagugcuagggaugcaaccccaggccuuguacauuguuaggcaaacguuuauccugccacugagauauauucucaacccccugaugguuccuuuucaauguuccuucaucucaggguuaauaaacgagguggucucgguguaaauuuaaugaaggauccuuuuggauuacugcaacuaaacaugggucuacuucaugucugucugugaagauucagauauuucuuagauacuauagacuagauccauauuguucccuuguuuuuauuucagugaagauugcguuuccauguuuagcacagucaugugauagcuuugagagagagcauuuacaucuuucucaguuaugauuaauacuuaaauguaaauucaguuuuuuuuuuaaagucauuaaucaucuggauguggugacacacaccuuaaauacuagcauucgggaagcagaggcagguagaucugugugaguucaaggccagccuagucuacauagugaaucccaggacagccagggcuauguagagaaauaucucaaaaacaaaacaaaagccaaacaaaacaaaaagaauaggaaaaauaauaccaaaaaaaaaaaaaaaaucaugaaugugcucacccaguaaucuagaggcugaagcuggaggaucuuggguuucaugucagccugucucaaaaacaggagaguaaauguagacucgguuacuuacgaagaugaacuuacaguguaagacauaugagcguguuuauguauacuucuuauaacuuaagaacuaagauauggauauggauaauuguuuauagaaaaauaauaauacaugucauuuaaaucuguaauucugggauuuuguacuucugauuuuuuuucaacuauuuuuuauuucaugagaauuauucaugacacuuaugauuacaaauaauuccugguugauuguuuaugucaaccugacacaagcuagaguuaucugggaagaugacugcaguugagaaaauguuucccuagauuggucuguaggcauuuuccugauuuaauuguuaaugcagagugggaggguacagcccacaggacucuguccuaagcuagauaagaaagcaggcuggguaagccgugaagaacaagccaguaagcagucuucuuccaugguuuugcuucgaguucugccuccagguuccugccuuggcuuccaucacugaacuaggaccugggacguguaagccaaauaaaccuuucccaucuuagaguugauuuugaucacugugucuucucacagcaauagaaacucuaagaccgcuccccgcccccaaacuggcauuuuuuuuuuuuaaacagcaaaaaaaaaaaaaaaugggguaaaccacagguguccaugucaccagaucacaguguuauccuaaucauaggggacuuuauacaguuaggccuucagaacuguauucauugauuugaugagaagauaguauuacauucaaaaaauugucagcagcucacacgguucacaggaaguucaaggugggaguuaaaauuucagaaugcuaacuuuucuguuuucauguagaacuuaucaaaacaaugaaaaucuuacauagaauuaauuagucaauauuugaauuaaggcauauuucucauaguagggaacagaauuccuguuuuacuggguauuuuucaucaagggccauuguuuuauuugaaaagccuuagcaauaucuguggagauaaaaauuauuuuuuuccuuuaaauuaccaauaucuugauuaguggguggguuccuguugaacuguccuuucguucuuggaauaaacuccucugagaugcuuugagggucuuacuauagcccaagcuggcuucaaauuugugauccuucugccugcuugagccucccagaguaacgguaacaaacuauucuuucuuucuuucuuucuuucuuucuuucuuucuuucuuucucucucucucucucucucucucucucucucucucucucucucucucucucccucccucccucccucccucccucccuccgucccuuccucuucucucucucucuuucuuucuuucuuaacaagcucuuuugaaaucuguuuuuacacaguuuauuuagaauuaucuuacuugugacucuuuguauauagccuuuaugagguugaaauguugauguuguagguaucuuagaaaaugaguuuaaguguuucucucuuuuccuauguuuuuuuauggguuguguagcuacacuuagagugaaacuguuggguuuguaaguguguauuuucauuucuuuucuugguuuguuuucaacauuugugguauaugugcaaacauccagaagccagaggagaauggcaaaaugucucuccuuuaacacuuugugcuuuauucucuugagaaaggguauguaucucucugaaccuggcagaaggcugauggccagcauacacaccggcaguacuccuggcuccacaccugcacggugcugggauuacagauguguguguugucauucccaacacugagagucucccuagcccaguucuuucacuaacauggguuguuuuguuuuguuuguuuguguguggguguggguguuaaauuuggaauauuuaaaugcacuguuuguucuaaagucaauuuuagucaauuauauuuucucagaaaauuauucauuuaaucaaaacucgacuugcagaguuaugccagaaucuuuuuuaauuucuaaguucuuuuucaguauuuucuuuuuugauucuugguacguacuuuugcauuaugguuuccuccgucuucucccuugaguuuuugauccuuuauuuauucuccagcagccaguuaguauccucaucugcucugcugcuugcgugccuuuuaccuuauuuuucugccuuuguugcuuuuugauuuuccuuaccauuuauuuuucccucuggcucuguuuuugcagggguauuaauuuacugucucuguuuugcuuauaugaaugugauguaggugugaauucuuaaacugcuuugacuguauacuguaggaccugauacauagugcuuugaucuuaagucuguuugcucuuugaucuaggaguugcugggggcauccuucuagacagaagagacuuaaaauuuuuuuuguuguuguuaaauuucuguuuuauuuccuuguaauuagaaaaccaacaaugaucuuucuucuuucuuugcugccuaauauguuaucagugcucaugaauggucauaugaagguggauguuugcuucucaguuugauacagauauauaauaucuaacuacugauuauauaauuaggacuaggccauuugugucuuuauuuauuugauaugcuuuggacugagagaagcguguuaaugucuugucuuuuuguguuucuguggaucuccuauaguuucugcuuuaagaaagugacuauugcuuuauucaguuaauacaauuccauuaugaucuuuaucuuuaguauuauagaaugagcuuauuuuaucuuacaugaugcuuuugaguccaaaaucuaccguguccauucuagaauacuaggauguuuuuaaacaugucuuacauguuuuuaaauuguguacauuuccuaaguugugacuauguguuauauaagaaagagucauuccaguggccauguguccugugucagccggcuucuccuuucccacaagcugugauggcuuugugacugacucuggggaaguuaaguggaaaggacauauacuucuccuggaacugcaggccuauccugugcuucugccgagucuuuauucucuugagacauuaagaaggggacacccuggguguagaaugagggcccuuaggaaagaaccaacaucacaaccguccugcgggugaauugagcuagagaagccuuuacaggauggcagggcuacuugagcuuguguugugacacagauaacggaguuggcuguugugugcugguuuuguuuuauauuuuacauagagucucacuguuuaccucuggcuggccuagacucaguuauguagaccagacuggucuuaaacuucugguguauguuuuuuauaccaccuuuuaaaaaucuuuuuuauuuuacauagauagguauuuagccuacauguaugucugcaccauaugcgugccuggugcccaaggaggccagaaaaggaugucagaucuucugaaacuagaguuacagacaguugugagcugccuuauauaggugcagggaauugaaucuguauccucuguaagagcagcugaggcaacucuucugccgucuggggcauuucuggcucuguauccuaagccuuucagaagagacuuacauuagcugugccucuucuguggcucuguuuugugagcaacucugaaagugauauugaugugacugguucucaacugucgaagcauuuuguuggauuuacuguacuuuauaauuuaucugauucuguuuaccucuggcuggccuagacucaguuauguagaccagacauaagauguuugugguuuguucagcuguuauauuuaugacauaaagcuuuuaaaaauaguccagcucccgcuccuuacuuagaccucguuauuucguuuguucuaaaacaccuauccccgugugcuagaacgugugugugccuucuccuuccuccacugccugcuuuuguugguuuggugugggaguuuugcuauuuguauuuagacaaauacaaaauccuuugcauuuuuauuuuuuuaaccuuucucauuaucuccuuuagucuuagaucuguaauaaauguauccagugcccacccacugacauucucugguucucuuuuguuuguuuguuuguuuuugguuguuccgagacaggguuucucuguauagcccuggcuguccuggaacucacuuuguagaccaggcuggccucgaacucagaaauccgccuuccucugccucccgagugcugggauuaaaggcgugugccaccaugcccagcuaaacaauuuuuuuauuagauauuuucuucauuuacaauucaaaugcuaucccgacagucccuauacccuccccccacccugcuccccuacccacccccuccuccuuccuggcccuggcauuccccuguauuggggcauauaaucuuugcaagaccaagggcuucuccucccaauguuggccgaccaggccaucuucugcuacauaugcagcuagagacacaagcucaggagguacugguuaguuuauauugcuguuccuccuauaggguuauaccugaaguuugggguuuuauuaguggcacaugacaaauggcuuaacuagcuauuugauagcagugugacuuuguuucucucuuuaguucuuggaaaauucagcugucagcuguguacgcuagcauugaaaccaauccuaacuugauuuuuuuuagguuuauaagcaccuaugccuuuugauaugggagcccagagauuuucuuuauuuauggaauuggguagcuuaccaggauuucucaguggaccuuaguacaagguuggcugguucaguguuuggauucagguauuuuuuguaucuugggaauuuuccgagauucuggcuaaaacauuuguuuccucuucccucuuuggaggacucuuaaguacauggagucagucagucuccuggacugccucccacugaguccaggaggacuugcccuugacccugauaaggggccccaaggagcaaaagaagaaaggacaggcacauagacacaccuauaggugggccaugcucugauggagaguaccaacuaugcaacaacccagaaccucagugugauugcugcguacagcacacaguagagauuugcuagucuuaguaagugcucucuguacaguuucaggcgguaggaagccuuugccacccauucugagggugacccauguggggaaggcuuugccaauuucucauggaugagggugacccauguggggaaggcuuugccaauuucucauggaucugagauguuggauccuagacauagccaaaccaaugucaacaucacacauucacccaagacuuccguggcgccccacagccagcagcagcagguggcagcaugggcuucuguaguaggagaggagacuuugcuguuguagaguuggguacaguguccggaaggaguggcaccguggagcaauaguuagaggcccccuuccuuaggcaagacugaacucaucucugcagcuugccuugccuucucuccuugcucugccuccugguaaggaguucccucccucucucccaaaggcagucuucuagagacuguggcucuguccaagguacucuuuuucaguuuccugaccugcacugcacugacccuucaggucuaugccuggccuagggcuccuaagucagggcucccuugcuggggagugguucucccugaaucuuagcccacagaccuccucccaacuuauaucaggagccaugcacacuggauuuguuucuuuuuaccuccauuugaguggagguuuucuauaugcagguuguguuuguacauuuauauuuagguaacauuaucccuugggaguuauagcaguuauuaauauuuuauaaagauugaaauucaugucaaagauuacauuuuauaaagguaauuuuuuuuuuagacaaaauuucacuguguagcucuggcuacaauucacuauauagauacagauggcaucgaacucacgcucaagccacugccuccuuugugcugggauuaaaggugugugccaccaccuaccugggaagauggguuuagaaugucacuggucagauccgguuguguggaauuggauuggaaguugaauugaugcuauccuuugcuuucuuagguauuuaccuaucuuuguuuguuuguuuguuuguuuuuuaaaccaacguucuguuauuagcucuuauuggugcauacucuuccuaugaaggcggagcuucagagcauugccagaaguccagucagccuuuucaacuacccaugccuauccucuuaccuuaaucaggaaauuaaacucaauuaauacuuuuguuagccaguuguuaaauguggaguggaguguucugcuuucaugaaaauccaugauuccucauccacccccuuaaauaagcagaaacaaugaaaaguucucagaaaguugaaucugaauauacaggagugagcuuugaggcaucuuuuuguuggcaugugcuagcacccaaccugguugcuucuccucgucuccuagcugacugccucucugagcaggcugugaaugguauuacgugcaugugguccgagcaagauccaaacccuggacuuuuagacuuuugugcugaacacugagcucugccaucaguuaauggaaaaaugaaggaacuucugauugcugcuuccccucucccuuggccugggaauaucuuaaagaguaucucccuucuccuacuuguuuaauaaacauguuguuuucaaauggcacauaaguguacuacagugggacauuucaauguuaacuguguugugcagaccagagcaguugucaaaauuaaucaccccaagauacuuuuuauaucucuguggagaaaauuaagaaucaucuccacuggcuauuuugaaauguugucaacaguauuuauccugcugugcuguagaacaugagacauucuuccaugagaucaccuacauaccuguaccuguuaaucauccuaccccuccccccugccuucuccugcccguaacccuucccaaaccuugguaacuacagaucuaucccauacuucuguuuuagucagguccucugcagcaccagaagcaggggauggaagaaagaagucagaauuuacuaaguggacuuugagauaguaacaagagccacaucacgcugagaugcugagaaccugguaguuaguccuuaggcaggcuccuaaacaugaagaguaaucccacagcagcugucccuuauccugagguccucauuacaacucagguuucacuuucauggcuuugugcaguggcuucucagagccuccuugcagggaaucuagccacaugcugccuuguugcagcgucuucuaagacucuagagcaagccucuaugaccccauuacuuauauuuuucaucucuccaaaaccuuuaccauguguucaaugccagauucugcuugcuugggauguagccuuuccucuugggccauggcugcaguggucuaagcuuagaagaacauuucucuaggugggucuguuagagcaagauacccuagagacucugucaaacuuacuucccuccccuuuccuucccuccauccuucuuugcaagccaaagcaucauguagccacacuggccuuaaacucacuaaguagcuuagauugcaguagcaugcaucggucaucccagcaauccuaugaguuggaguguggaauagagacauaagaaucaacuggaagcucucgggccagcgagucuggaguaugcagccuagcagcaaaaacaagggagaccccacuucaaagaggugaaagggagaacgaauuccugaaaguuguucugaccaccaugcacucaccugaagucugaugcacacaaaugcacauauacaauuauuuuauuaaagcuuuauuguaaaacacuuguaggaggaaaacauucagcaagaauagcuagaucuaaagucuauacaucucagugaacuucaauacagaauaaaaguaguuuuaauaugcaggguuuuccaacaaguucugaaguucuugguguaugcagccaugcucccuccccacccccugcuaagacacuuuucguauucuacucagugucugugauuucucuuucuuggcuguagucucuuuaacacuuggcagaugcuuucuccaagcucauguuaacucacagcuuuuauuuugcuuuuuugugacaagguuucucuggguagcccugaccaucuuggagcucgcucuguagaccaggcuggccuggaacgaaaagauccaacugccucugccucccaagugcugggauuaaaggugugagccaccaccauccugguggugccaccaccacccagcugcccgcagguuucaaacugcucauauuccuuuccucuagaaacuauauuuucccgaucuuucuacucuauuuguccaccuaaaucugguuaagagcacuaagcagugaccauucuguagccuggauauuguugugucuuggaauucuacaaaguacauaguccauuacuuuuuaauucacccucaugcacguuuucaggauggggcagaaccuagccagauucuuugccagaaugugccacaaauggcccuguuccuguuagaguccuuguuucucucugagacccagugagucacacccucacuguucacauuuguaucaucauccuucccuacccccacugcaauagcacauuaaucucuauuuauagcucucuggggcuuugcuagucugugucuccagucuccuccauauuucuccugcaaaucagccacaugaacagauuuaucacuguaauaaccccacuucugauacagauguuuuauuauuuacuuuuugcugcgacaggauaucuuauuaaagcaacuuaagaauuuauuuggcuugagguuugagagaaguccaucaugguagagguguaauaggaagugguuucauuacuacaggaucauguggcugggacuccucaccuacagaacaggaagcagagaccauacaggaagcagggcccagcaauaaauaucaaggcccacucaaguggcccauuuccugcuuagucuguauaauguauguauguauguauguauguauguauguaugcaugcaugcaugcagggcugaccauuuaaaauuggauaauuaauugguaauucuucccuagggaagacuauuucucucacucccauuccuuagucgcguguaguucuuugugaaggguugaaaccuugugggcuuuacccccucgucuacuugggugugucucuuguuauuuuuauucagcucauguuuaggcugugauguuggugagacuuuaugguuauagcuucugauguuccuaggagauaguacucucacacaagcucccugauuggcucuuaaaaaucuuucugcccccucuuccucaguguucccugagccuuaggggaguuguuuuguagguguauccauugggacuggguuccacagguuuguucuuauuggucauggcuuucuauaaugguccccaucuuguugcaaagagguuuccuucaagagugaugaagacuagacuuaucuauaaguauaaggacaaacauuuagaauguacaaguuauguuuuugcuguuuaguaaaguggagguugucgcugcuccuucaagaucuaugacuucacuaguccuggguaguggcaagguuuccauuaucagguagauauccuucuuguugagcaggucuuacgucuaauuagagagcuguuggcugcugccaugguaugagugcuaguauugcacuccuaggguuauaguguugcugguuugucuuugugguucacaggcaucauagcugaguaggacuguugcuugucuuccuccuuuggaugcuugcguggugcuuuuugguaccguaaacgcuaguccucagggaggagacauucaggucaguuccagcucaggugucuucagcaauagagacuuuacuugcaccccuuggaggcaaucaguggcaauaucaauagccuguaguauuugagauacugaccaaccaauagcucaaaagagggcuuuucaugccgaguuuuagacauuuuuguuguaucgucuuuggcucuuggagggaacacuuucaacccagaugagaaaauuucauguaaauuuauacauacuuauauagacuuauauauacauuauagauuuuuagggaagauaguuaauaguaauaguaugauuucuuaggacuuuuucaggcuuucuuauccucuuuccuuuuucauauuuauggcagagauacuuuuaaacagagagugaguggauuugucucuccuuucucaauauuuucuauuuuugcuugcuaccuugaggaacacguggacagcuuauuaaaaauugcuauguggagcugggcucacuacugcaugucuggaauccuaggacuggagaggcagggggaucuugaguuuaaggcuugccuauauagagcaaggccuugugucaaaacaaacaucaguagcaaccccccccccccccgaaaaacaaacaaaacagaaagcaaacucaacaacaguaaaaccaccaggagcagcaaacaaaacaaaacaaaacaaaacaaaacaaaacaccaaaaaaacagugauguggacagauucuuccaucaacacacucacagccaaugcugucauuguaaccugugugccgggcccuggucugaccucuugcugcaggauaggcugagauguuccugccaguaauaagcacagugguucuugucuuuguagcagcccucaggguauccggauuauagcccugaauucucucugguugugccugcacacagauacauugccauagcuguaauuauuugagauauuucuacucuaauaucuuguaaucuuuagaggcagcuuuauuucugccucugcaguuguuaccuuuuccuuuuggguacaucucaugaugugugugccauuaauucacuccagucuacuuugauaccucccuccucccacccacaguuuuaaaauaguuuguauuauaguugccagugugcucugugcuccaaacagugauuacuugggguggggaaauaauaggacuugagaggauuuggggauuaauuaacuucugacagcuuugcucuucacuggcccuuagacagcugccauggaccuuggucuacagugacugaccucagcaguaaguggccaaggagcucuggccucugaaaugaaccggugcuaggcugaggccucagggggagccaggucuugugccugcuggaguuuccuuucaugguagagaaggugucuccuuguucaaggucagaaacuccugauaccaaaggacgcuuacuuuagcucaguuuaucuuuuuuucaugccacuuuggugccauaugcuggcaucauguuaccucauagcagagauucuuuucaaauucucuuguguuucuaagaguauucugcucucuguggagcucaggguagccaucaguuggauuauuugaauauaaauacugaguauugcucuuuaaaacucauaauauuuaguguucaugugcuaauuaaagauauuuuccaaaagguaugcaguuuuauuuguuuguggagucuguuauuuuccuuccaucuuugcauaguuugggaauugaauuuagguugacagacaagaaucuucacccuaucagcagccuaccuuuuauuuuuauauugcuacccaaugcuuacccaccccacuugggggcaaagaaaggcucauguaucccaggugggccugagacacauuauauuguggaugcuaaccuugaaccuuugaagcccuugccuuuacuccccaagugcugcuauuacagaugugguccuuccugugcaguuuacauggauugggugaggaucguacccagggcuuugagcgcaguaggcaagcacucugccagcugagccauagccccagccuauauccugguugguuuuuuguuuguuuuuguuuuuuguuuuuguuuuugaugaugagucuucccuagaugguuuguugguuuguuguuaucuguuuguuuuugagacugguucucauguaccacagacuggccucgaacucauugaggaugaccuuaaaugucugaucauuauacuucuaccuuccacguuuugagguuucagguauauaugccuggcuuucuucauuuuuauuguuuuauuuuuaagauugauuuuugugugucuguauggguaugugcauaugaauguagguaccuuuugaggucagaggccaugagaguuacaggcuguugugaguuacccauuguggguacuuggaaccaaauucagguccucugcaaaagaaguuuguguucuuaaccacuaagccaucccuucagccccucuucucaaguaaugagagugcuugugauucugaucagaacgggugucuguugaugcaacccagcuagcucauucugccuucucacaaagaucucuagauuugaagucaggagugagcugagcugcaccucugugcugaguggccauggagagcugcagaccuccagaugacagugucucuucugugagaugaaggaaguauccucucugguuauuauaauaauuuaaaaaauguccuguuguggcaauacuuggauguaagcuuagcacagcauacggauucuguuguuugcaucuugaaaguaggauaagguacauuuuaauuaagcuaguuuuauuuagaaacuuaauaagaauggcugcacugacuguaauuacaguucaagauucuggguacuugacagaaaacaagacgcagggaaaggcuagcucguguuaacugugacuaaaagugagaaacuucucgugugaggacuuuuccacuagggaauccuauuaguucauugcuuuuuagaaaaaaaaaagaagaaaugucgauggauuggagauauggcucacagguuaagagcccuggcuguucuuccagagggucuugguucaguucccagcaccuacagggcagcuugcaaccaucuguaauuccagauccaggggaucugacaccgucuucuaguuucugcaggcaccaggcgcacacacacauacauaaaggaagcaagucuuuaaaagaauuuuaauggcgauuugaaauagagaaaagggaccugagggcugagguugaaagcuuuccuuuuuggaauagcuuaaugacauccugccauuccuucugugacauggccccaggucauuuauuuggcagcuagaaguagcaguguuacugagauauuauucaccuagcaaauaauuuaccugucuaaagugugcucugaucuuuuaaaauguuugcauauuagagcugugcaaccaugaaaagaaccagccccaaaugaaagagcguacccuuugccgguggcacccuuccugccuccccaaaugaaacaaugcacccuuugccaguggcacccuuccugccuuuccccagcacucuuggcucuagauaucauaagucugguuugugacaucacaacagaaugccugagacugaguaguuuaaagggguggauuuuuuaguucuggagaguagaacuuagaaaagucaagguacuggcauuuguugcgagccuuuacuguccucacaugguggaagugugcagagggggcagauguuguacacuuuuguggcagaggagcaaaggggagagauccuaccucaaaagcccuugcuuuagcucuccucauucgcugaucaugaccuaucuaagcucaauggacaugcccuuguguucacucccugucaagucuguuuccaccuuccacucugagguccucaauguaugugcugcagucagagucucuugggccuugguuuuccuuugugauuuuauauuugcaguguagacagacacgauagaugucuuguauggaagggccugagcuaauuagaagcagacuugaauuuagaaacucuggaagguaaacaccaaagaugaauuuggcuuuaugucugaagaaauugcugacuauauaaagcuaucucuuagaggcugaagaggcaguucagugguuaagagcacuggcugcucuuucaaaggaccugguuccaguauugcauccacgugguggcucaaaaccaucuguaaccccaguucaaggagcucugaugccccuucugugcucuguaggcacuuguacauacaugguacacaaauauacaugcaaagaaaugcuuagauacauaaaguaauuuuuauaauuaaaaauaaauaaaaauuaagcuaucaguggaauuagcuaccaagugaagaacuuucuagaacuacauauauucuagcugcuguggagugcccucuucucaagauguuacacagugauuuuucuguaccuggugaggcuguggcucuaaggugcuuccauauuggagacaggcuaaacugugccagagcucacauggcacacaguagcagagcagcaaaauaauguggcacuuucucaguacucuguuucuggguuuuguggcuuuugagacgauuggggcauugcuuuugagguagucucaccauggagcucaggcuggccuggaacucagccaucucuugccuuugucaguccacuguggguguuacaggccugggccaccacaucuguccauuagguguuaaagaauggcaagauaaaguagcuucacacuucaaaacauaaucuucuuugagaaguacccuucuaauauaaggaaaucuacuuacccuuccugauagaaaacuuguauuaaaaacaaauuagauauauuuauuuuuguguaugaguauuuuuucuacauguauguauugguaccacauacaugccuacugcccauugaggucaggagagcucgguaucagaucuuccugguacuagaguuacagacgugagccaccauauaagugauaggaacuggacccaggucuucugcaagaacgaguguccuuagccacugagcccuaaguuacaguguagauacauuuguagaccuuggauucaccguaucuuugucuggguguuguuuuuaugguaucugcugugugguccaaugcagugacuuuagcccuccauuccucagccuccucaacuggaauuuaggaucaaaaagaaucuuuuaguuugcguuuccauuguuaugaagaagcauuguuaugacuagggaaauacuugcgaaagaaaacguuuaauuggggcuggcuuacaguuuuagagguuuaauccauugucaucauggcgggaaacauggcagcaucuaggcagacauggugcuggaggagcugagcauucuacaucuugauccaaaggcagcaagagacuguauuccacacugguuagagcuugaucuuaggagaccucaaagccugccccccacagugacauauacacuuccuccuacaagaccacacccauucuuauaaggccauaccuccuaauagugccacuccccaggggccaagcauuaacaccugagucuaugggagucauaccuauucaaacuaccacaaagaguaucuguguuuuugaauagcuguuaagauucuguaguuugucuugugcacagaagagcucauugaguauuucagaguuauaauaauauaguaauaauuauacaauaaauacaauaauagucucgguauuauuucagugagggaggggggauaugaaugaaugauaugaauuaacaagaacagaaauguaaccuugcguuuaaauuucucucagaggaaacacaagaauagaagaggcaugugaaauguauaccagagcugcaaauauguucaagauggccaagaacuggagugguauguacaauguuuuguuuauuuaccaggcaguuacuuuaaaaacaguuugguaggaggacaggacuguguguucccuuuaaagagugagccaagcauuggugcugaaaggauccucaucucggguagcuaacaagauugagcacuggggcguugucugucucagcuucugccagccacccaguguaguaggcuuuaccacaucugcucauguucaugcuccugccugccaccccagagccuuggcacgugccauuaccuguuuacauacuuuccccuuguuuauugcuuucuucugguccaucuucaaagguuaucuucucagccagcucucuucugacuaccccuuaaaaacagugaucucucccuggaaacuuucuacucuuccccacagcccacauuaccuccuagguauuuuagugauuuauauuuacaugaaucaucacauggaggcccucacuagcauguaccuucgagggucagaguguuuaugugucugcaauuggacuccaucccuaggguccacaccgugucucugaugugguggauagucgguauaguauuuaauugaauaaauaaacaaggcucugaaguuaaagcacuggugcacugguggugagcaugacaccauuuugucucuuuauaauuuuaaaguucuuuuguaaugauuaagcuaaugcuuuucagccaccguugagacugacaaguuggguaacuucccagagacuauucuccuuuaaagacacuuccaggucaagagagaccaagcugcucuuguuagcagugauuggaauuuguguuccaagcaaugaaguggcagcaugcaauuguauaaccagcaccaacuguuaccugggaggucgaaguagccgaaaggagccagcuguugugcuguacucccagcaggaaaaggauaggucaugauuagucgugggacaauaaacguagucaaaaguaaaaugucaaugggacuuguaaagaaaugagaagugugcuggaaugugcuggggagagguuugucugcagugaugaacauggcuggcaccagugcuuccagagccaggccuucccaaccacuucccggcagguccgggucauucauucuuccaaggcagagccaggcaaagcuccugaucaguuggguucugccugcagcuagcuuagccuuggcgcuucucagacucuuguaagucuuaauguggcucuucagcugcuagcagggauuauucuuacuaacuguagcccuaaaggccaguucucacagguuaguguuugcauuaauccuuuuaugcugcuagaacaagauaccuucaucugaggaauuuauaaaauacagaaauauauugcucagaauguaaggaauguaaggauuagaaaaguaaggacucuugcuaguguaugcaauggugucagcguuuggaagcugauuaugggauggaucuccggauauggcagucucuagaugguccauccuuucgucucagcuccauugcauugacaccauugcauauacuagcaagauuuugcugaaaggacccagauauggcugucucuugugagacuaugccggggccuagcaaacacagaaguggaugcucacagucagcuaauggauguaucacagggcccccaguggaggagcuagagaaaguaaccaaggagcugaagggaucugcaauccuauagguggaacaacauuaugaacuaaccaguauccccagagcucgugucucuagcugcauauguaucaaaagauggccuaguuggccaucaguggaaagagaggcccauuggucaugcaaacuuuauaugccccagaacaggggaacgccagggccaagaagugggagugagugggugggggagcguguggggaacuuuugggauagcauuggaaauguaaaugaaauaaauacccaauuaaaaaaaaagaaaagaaaagaaaagcgaggacuccucagcacuucuaagaugccaucuuguugcuucaucccacaucgcagagggagcaaagcggcguucuccuuucagugucuuguguaagagugcuaauuccacguauaaguguguggauuaaccacuccuuuaaagggccuaguggguaauacugugccaucuggauacucaauacaaagggugggggauaccaacauucagaccacaggagcacccaugccaagcuagguagucagugcuuucuaaaucucacguguacucuucugucagaaacagaggggcagaucagaaauugaacuggagcaggcuccaggguuuguauggcuuccuuuccuuggugaccagaaggccaugugggaaugaggucagugccuguggcgagggugcuugggauccggaaacaacuaaagcuuucacagaauuggaugucuuauuucuuacgagugaauuuaaagcaagcaguuacuuagcgcagugcacugcuuugugucuguuguuaguuaguacugcuccuagcucccagaacagucugaaggaggagagucucacuuagcucgugguuucagagacucacucugugcuuguuuaaccccacgugugugggcagaaggcguggugggagaggugcuucuucaccuuauuguagacaggaagcaagaagagcaagggaaggaagguggcccugucaagcuuuaguucccagaccucaccuaggcacaccucuucaagcuucuagaacugaccagcuggaggccagccauucagaacaugagucuggacaugguaacacaucacuguaguccugacauauggaaggcuggcauggauugaguucagcuucaggaagggcaagauccuaccuuagcaaaccacgucuuucccccaaacccuaagguuucacgccauucuuagucauguuuuuccuaguggagcagacucaauaaugacagcugagagccaaagacacuggauugagagaugagaugaauacccuuggcuucagugcuuugcccuuuaacugugugagcugggugcaccuuguugggcugaucucaugauguggacuagcguucaagcgcauaaauuuuggcuacagucauuaagaaaggaggcucuguguucaggaaagcaggccuucuggaacugccggggaaagcgaccaacacccaaugcacuuguuucaaugugacgccucuggucucugccugcaaagccuccuuuuagagacuuggacucuuauuuggaaaggccuuguuucacaauuuaacuguggcgccuucuucagcugcagggaaugcguuuugucaagcugccaaacuccacaugcagcuccagagcaagcaugacucugcuaccagcuuuguggaugcuggaaaugcguacaagaaagcagacccucaagguaaggccgcucagaggcucugugugacugccuuggcagcauuuccuguggccuugagguuggugugccacgcuaagucccgguaauaagaauucuguguuaugggauagaaaggaaauuuugguaaauguaauaauguuuacucuuuaaucauaaagacauuagucugaaaggguuaagggacauuugagacaguuuuucgucaugcagcuaaagcuggcuucaaacuugcagcucugcacccucugacucugguuccaaaguucugggauuacaagcaccuuaucucaaccucaugaaacaugguccugaacuaagaaggaaacccugauguuacuguacuccucgauguguuuuauguagugagagagugguuuaaaagguguuaaagguguguuaaccacacagagcucuuuauuguuuuccuaagugcucuucaaaaccuuuuuuuaaaaaaaauaguagauuuaaaaaguauugcaaauguuauuuccuuuuggagaaguauuaaaguaauguauuaaaauccuguuacauguacauggcuaucuuuagucuuuuuugguugauugguugguugguugguugguuuuucgagacaggguuucucaguguagcccuggcuguccuggaacucccuuuguaggccaggcuagccucacucaaacucacagagauccgccugccucugccucccaaaugcugggauuaaaagugugcacugccaccaccaccaccaccacccugagucuuuuuucuuuuguagucuauuuuguuuaaccuacaaaucuaaacuucuaggaauguaucccaaagaaaaauguccagcuuuuuuuuuuuuuuuuuguagaaagguuaaccguauuuuuauuuccuaagugagaaacugaacacuguggguauaagcagaauguggggaggcgcacagcagacuuacaaugccuucauauuguagaauaccacacaagcauccaagucucugguuugguuguggugacacaccccugugaucccagcacuugggagacugaggcuggaggcuugggaguuacagaccagccuaggauauauguauguauguauguauguauguauguauguauguauguauaauccaacccuacaucaaagacacaaaguccuggguuucauaaauguacuuugaccugguacagccucaugugcuaauuuaaauuaaggagcugaauucuggaugacuacaguuucuccacaaaaaaaccacuggauaagaacuuggugaugugggaacaccgggccuuaguggugcaauccauaaguucugucuguuuuucuguagucuguaagguguaguggugaauggacauuuuaaaauauacuuuagggagcgguugcuucucguuuuuuguccuucuagucacuuuucuguuucuccuguuaagcugccuccuucugccucuuucagccacacuuuucugugacaggaaacuuucuggcucauuguuuaaaagaaauaaguuauuaggauugucaucaugaaguuuucccuucguuaagcggaauaccaagacuauuuuguuagguuagcauacugaaagugagcgucugugaacaguauacacauuuacauacaauuuaacagaugaacaaguauuccaaagugcuuuaaauguuggccaccugaagaauggaguccacugaaauaaucuuuuucuugugaaaaagugauauuucccaaaauuaauauagagacacaugauacugaugaagaccgcguuuacccuguguaguagcagguguaauuuaucaauguugguggcaaucccuguggucggucuuguuucaucuguaauacagucugucaccugaauggauccccuaagaguuacuaagccaggaugacugcagcuucacugcuuuuaaauaccagugcggccgcugggaacaaagccacacuaaugaaucuguacugugcaugauuguaucugcuccuacuaaccagccugcccacccugcacuccagccuguaccuccuuacccacgucaguagcagccaggaggcgggcucacugaacccucuuucacugaaugaccuuuucauuguuuuucuuaaaugccaacgcuugcuucagaggcuaucaacugcuuaaaugcagccaucgacauuuacacagacaugguaagacauggcauugcuugaauggcugugggguggaguccuuacgcugcuuuagagcuguacuuuuucuuguuccuaaacuggcugguguuuguguaggugaagccgguguguaacucuuguuuucuccccuaggggagguucacaaucgcagccaagcaccauaucaccauugccgagaucuaugagacugagcucguggacauugagaaggugagcacugaccacgcacggugcagacgggagaugcuuggccucuuggcugguucagaaucauuacagguguccuggcggagucuuccuaggccuggcuggcugagaaaggggcugcuuaccuggacugccucagagucaccuagcucaccuguuguuggugcuuugguucaugucagaguggucaaaagacauugcaccuuccuuguaccaggggauguuuugcaucaccgcuucacuacacagggcgccacaggguaggggugaaucaaauggcuucuagugcugccauuuuccuucuuuuccuuugucauggugcccuugagcuucuauugcuggucucuuucugucauucugugaauuaaccaguagguggcaccuuuuuucacugaugcaucuuguucuguugaaaggaauuuaagaaauaaaggcugguguggcgguucucgggauuccagcaggcaggaguuugggacugaaggauuguaagcucaaggccaguguggcugcguagcaaggcacugucucaaaaaaaaaaaaaaaaaaagaauuauguuuaucuuacacuuacacacauucugacauggagaagagagcuagcuugucacggucccugacuuugaggcucuuacaccguuaaaaauguccuugucuugucuuuuuccuaguuggacucacaagguuguggucagugaagugugaaauuuauguaugagaaaucaauuacccugaaguacuaguuuguucuagauauuauucacuguccguauaacagaugucucuucauucucuuguuuuauucaaagauuuuaucuauuaggcagugagaugugccaucguacauccaaaugacuucuuguagcuuccugagguaaaauacucgccagcauguaagcaggucuuaccuccgugauccucgagagauccaggggagacauagcuuguuucugguuugggcuccugaaagaccugguuuaguaguauugcuuacagcauaggaugagcacauaucuuagcuuuggcuuugucuugaggcuauuuaagguuuaacaguguuccaucugcacaauggacuccuaagguugaaauagugagaugcaguaggcucccuuucagcuccagggcccgcaaaugccuggaacuuaacaugccccuggcuucagggaugcuacggugaacagcaguccugggccuucccuuguggagcuugccuuucugugggagauggaaacgcaugugugacaguucugagaaacauuccagaggacuguauugucccuacugcuuuuguauagaauucuguguuguuaagaggggguuaguauacuuauuguuuuucuucugucuugguacuugaccuuuaauuguagcucguauguuuaacauguauacuuguuucuauuuuuauuuuuccuuuuauaauacugaggaacucuggggagcauauuagguagguggacuauguggcuaaaguauacauuagaugugucgcauugaagaauuguucuaggucuguguucuugggauacuccacaauccaaagacuucaguaguguugucucugacaacuguagucacuacuuuacagaugggcagaggcugugggcuuuuagagaguauucagcuagaguucccaagcccacuuuguucuauuuguuuucuuaugucugugccucgcacuuucaguccgauuuucauguuacacugguuguguaucugggaaagcuuguaaaugauggcaaaggacugcaaaccugcugcuugcuucucuauaucuauauaaacacaaugcuguuuugcuguuuaaucaucagaagcgaaagcauuguggcacaugcaaaacaugaaauugggccagugaaguagcucagagggguaaacacuugcugugcagccugauaaacuaguccagucuacagaacucagacaaagaggaaagagagagccagcuccacaaaguguccgcugacuuccacauccucuaauauucccuccccagauuaacauuucaaaauguuuaaaucacgcaaaacugaaguuuauugagaaucucuaggauauagcauuuauuccuauguuguuacaggaucagugaauaccugcuaccagagcucaaucagcaauuagaccccaaaguaugacuagagcuauugugggaaaugcuugccugaucccugcuugaaagccuccuguagacuuaucuguugccauuugggcugaagaggccauugguuuuucaggcccuuaccuuuguacauggucuguuuccccuguaacuuccugaaaaguagcuaacucuucccagaaccuaaccucaucaggcuugcuaaagcaguauaugucauccuguucuuugaaccgcuuucuguuguuuggggcucugauagggcguguuucgccuuuugaaguuucccgugguccgauuccacuaauccugucacagccugauguaagcugcuagcuuucugcucucuccauccgacuacuguuagaguaucacaaauuuucaggagcgccuuugccugugauagaacagucagggcugcugcugugcuuuguagaacauaacagcuccacagcacucuaagcuaacauucacuuagcuucgaguacauuugaucauggugggaaugcugggguaagggguugguuaggaagcagguugacagaauucugccaucuucauucuguggcuucagucuaccagacuuggccaugucuuuuauguuuugggaaguagaaaagaucaagggaagaaugcaaaauaagauguuuagcuguucaucuuucgucagagagcuagucauggcuacccuagcugcauggaagcugggcuguuugcuguaagugagggaaacuguuggcuaccuuucuguugcuuuuaaugaaacagcaugaccaaaacgaauuuauggagcaaagaacuuauuuuagcuuagaguccuacgggauagaguucaugaugacaggaagacaugacagcagaugacaggcauuguggcagaagcaggaaaccaagaagaugcagcagcaucuuuaaccucagaggagagaaggaacuaaaaacggggugaugcuauaaacucucaagauaaugcucagugauguacuuccuccagcgagccuguacguacccauaacguugccauacagcaccaccaacugggaccaaguugucagcuaugugagccuuagagggacauuuuuuauucaagccaccacagauagagagucagaauauucugucuccaggaggcuuuagggcuacauacuuuauucuguugacugaggaggccaacuuguaaaagauuugucacugaauaaguuuaauuaucagaaaaaaauaucuguguacauguagacuuaaauuuuuuuuauuacauuaauucacuuguuuugugauuacacacauuuuccauuacacacuuguggaaggcaggguacaacguggagaaaucccuucucuccuuccacuaugagagucccaggaaucaaacucagauugucagacuugcuagcaaaugccuuuaccuacagagccauccuaccagccccaacauguaguuuuuaaugcaaaucucuaagugaauuguuuguaaguuaacuguauguacuuucaggcuauugcacacuaugaacaaucugcugauuacuacaaaggagaggaaucuaacaggcaagugcuuuucuucauaucaguggcaggcuuuucauaugugauaaagggaacgccaucuuugucaucuaagcaaguguccuuaggccaggucuccucagcguugucacuuucuuacuuucagcucugccaacaagugucugcugaagguggcagccuacgcugcacagcuggagcaguaccagaaagccaucgagaucuaugagcaggugaggacuggugucaccuugacaaauuuguaaccaucacuacuauauaccgcuagagccuucccaucacuuccggagaaagccaggaaagcagccugcucucuguuuuccugauuugccguccuugacccuuugacaugcauggaauaaugcaccaucuguuuucugugacugauuucauuuuuaagauucuucauauuguagcaugugucaguguuucauugcuuugcauggcugaguaauacucuggcuuuuauguucaucugcugauaggcauuuaaggagcuuccacuuggggucuguuaaggauaaacugcugugaacauuugcacuuagccugugugagagcauguucucagaugucuugacuccauacuugggaauggaaucaggauuguuuggcuucuugguguaucaaugccugucuugcuggggagcuagcugacucucacagaguacuggaucauugagcauucccagaacaguguccagggcucagcuucucugguccucaccagcaucucugugauuccuaaugaaugugaaggauaaucuguucuuucucuccugaugagugauauuaauauucaugugcucacuggccauuuucucaucuuuggugagagauuuaggaguaauuuaauccuagauauuaggauacaaguccuucauggucaggaaaaaacuuaacuuacaagcauuuuucccauucuguggauuucauuuuuguucuguuguuugucucuuguucuaguuuuucagucuuuaaaauaaauauugaggggcuggagagauggcuccacaguuaagagaacuagcugcucuuccagaaguccugaguucaauucccagcaaccacauggucgcucacaaccaucuguaauggaaucugaugcucucaucugccaugcaacuguauaugcagaaaaagcaguuauuuacauaaaauaaauaaauuuaaacaaaaauaaguaaaauguuacguuuauuuauuuuguauguggagaguauaagugccaccuguggcaaacagaggacaacuugaauuggucuguccuuuuaugauaaauggcagcuauguuaguggguuugagcccaggagagguuaucagaucaccuguauuagaagggguuguuagaguuaccgugguuaugagccacaugacguaaaugcugggagcugaaccuggguccucugggugaacagcaagcaagugcucuuaacuaaugagccaucucucuaguuccaagauguuuuuuguuguuguuguuguuguuuggcuuuguguucuuuuuguuuuguuuuguuuuguuuuguuuuguuuucuugcuuuacuuuguaauucuggggauugaacccagagccuuaaacacagcacucaggugcuccgccacuaagcuccaucaccaagcuccauuacuggcccuggcuuuuaguuucuuuaguuuguuaguuucaagcaucuuugaaugcuuauugaggaauuuuuuucugagagcuccuuuaagcaaacuuaaacagucuaacauuucugcuaccuggaauugucuguugcuucuguaguaaguuucagguuuugcuauaaucaguaacuuucucguuugcucugcugugacugaugggugaccuucaccuugugcucuguugugauuggugaccuucacuuugugcucugcugugauuggugaccuucacuuugugcucugcugugauuggugaccuucaccuugugcucugcuaugauuggugaccuucacuuugugcucugcugugauuggugaccuucaccuugugcucugcuaugauuggugaccuucaccuugugcucugcugugacuggugaccuucacauuguacucugcugagauuggugaccaccucauuguucucugaggccacaucugauuuccaucauccuucugugcacuggccacacugacuggagauuuagguauguugguggaggcagaagcucagacuccccuuuuuggaugucucaccccuguuaggccucaugagaccuuuaccacucucuuuuaauuggcuccuucuggaauuuuugggugcuggguucuuuauuuucauagugggacuacaauaaagaaaaauaaagcccaguaauccccacccccacccccacaccaggggauuuuucuugaugucuugucucuugcugguuggcuuuccugugcccuauguccacagauguuuggauuuauuaaaaaaaaacagaaagaaagaaagaaagaaaggaagaaagaaaggaaggaaggaaggaaggaaggaaggaaggaaggagagaaagagagaaagagagaaagagagagagaaagcaagcaagcaagcaaacuucuaguuguauuucauaggaagaaccaggggagcuuaggccucuccuucaucuuccaggcauuuuuaaaaguucaugucccucauaauuauuucguaucuaguaaaacuuuguacuacuuggcauggaauauaucaguauaagauagugaaagguauuuuuuaaaaggaaaacagaugaguaagcaguggauugcuuggccuauaacauugccuugcugucuuccgccuaggugggagcaaacaccauggauaaccccuuguugaaguacagugcaaaggauuacuucuucaaggccgcgcucugccacuucauaguggaugagcugaacgcaaaggugagagcgcccccuuucugaugacuuuaccccugaggacagaugcuuugucacccgggaugccuuuuccuucaggugugaagagcuguggugagggcucaguugauaaagcacuggacugacccaaguugagguucccagcacccauguaaaagccagguauacuggcucacauguguaaguccagcacuaaggagcaaagcagagauaagcagaucccugaagcuugugacacugaccucuggcugccauauauaugcgcccuaacaugcuugggcacacagccacaugaacacauacuuauugccugucuccugcuacacacagaguaaaacuaauaguucuuucguggugugcgaguuugacucuuucagcagcugcaaugcuguccucuucagguugccuucagugguugauuuagguagauuaggaacuaagacaguaaaauuagugcacucucuuguuccuuuuacauauguuugcuuauuuauuuacuuauuggggugaggagguaaacauggauauauuauagcacucgugaggaaguuagagaacaccuuuuaggagucaaucuucucuuucuacuaugucggauccagggaucaaacucaagucaggcaugguggcaaaugccuuuaccuguuaaaaaccucauuggcccugauggauggauggauggauggauggauggauggauauauugggggugggagguuauuuguuuguuuguuuguuugagacagggucuuacuauauagcccuggcuguccuggaacucauuauguaguuccaggguaacuuaaacucagagagaucugccugccucugccuccuaaauucugggauuuaagguauagauuaccacacccagcuucuaagaccucauuuaaaaaaacaaaaagcacaaacaacacaccucagaaguggaguuagaauagaaugaaggucagagaaagcugcaaagcaagagcacggcuggaaaguaagauggggccugaccacacaacacuggccaucagagaaccacagaaaacuacucuagaguccauucuaccucauggacauuuggcauuuggaggaugugaaggucuucucuauguagcacacauacauagauccuagaagugaauuagauuuuauuuuguuucuucucuccaguugcccaacuaaaaucuagaaauuauuuuagaaaugguauuaucaaucauaauugaauacucaaaauaaauagauuuccucuguucugauguaggauuuaacauuauauuucuucaacaguuaaacgagauggaaauaaaauuuuugaacugauagagcauuaacaacuucccuaguucacuaagucucggugacugguuccuuuccucccuuagcuugcucuggagaaauacgaggaaauguuuccagcauuuacggacuccagagaauguaaauuauugaagguaaguacugaaacagcuuugaagacagaagccuuuacuggugcugauggguggagcuuuagucuguaaguggaggaggagguguugguuacuggacucauuacuguaacaaagaauccagcauuaggcgacuuaauagaggaaguugcuuugacuacaguuucauugggccgucuauucgggccccaggggcaugaggcaucuggucacacggagucuacaguaaguaagcaggaagaauggagugcuggggccccucuugcucuuuccuuucauuuaauccaggacccaggaaauuguggcucuuucuucuuuaguucuuccuucuucucuuaaaucugucuggagacacccagaggagugauugaauagugacucuaaacuuagucaaguugacagugaagacuagccaucacuuggguaucuuggacuugacuucuuuuuuccauuguagauauucauaugcuaggagaguuaggauguuuaacucuguucugaaguaugcagccuugaaaucgcaauacaaggcuaaagccuuuucuuggguaaugcuuacugcagacaucccaucuuaugagauacuagggauaucagagcaggagauacuaaggugauuccucuuuaaaauaaaguauuccuucagaaacagaacuuucuagccuaaaguauuuucuugauuuuuuuuuaaugccaucagaaacuucuagaagcucaugaggaacagaacagugaagcguacacugaagcaguaaguuaaaccuucgggauauguugcauuuuuaaagguuuacauauaaaaauuccguuuuguauaaauucuaaacauuuaucucaaugugguucaacuugcuuguauuuuccaaagaucaugucuugcauguuccacaaauggcacuuagugagugcccuuaaguauuagagacacggcacuguaguuuggaacauuuguuucucuugcagagcacuagaauuggguuccuagcaccccacagcucacaaccaucuguaacuccaguugcagaggaucagugccaucuucugacauauaggaacaccaggcucucuaagagcacacucaugacugcauauacauucauguaccuaaaauaaaccagccuaauuuuuuuuuaauuuaguuccauuaaccacgcagaaauucuagcuauauugagcugguucuugauuuuguauuugugauuucugcuauauauguguguucacauauagagaaaacuuaaaugcacaggcuuaugaaaggaaaagaaaaacugauuuuagugaaagaacuuguaaauuagaaugaguaacuuccaaugagagucacuggguuauuacaguaacaucuucaaacagcuuagaccacuauugucuuguauauuuagugguuuuuggauauaauuuccguucuucauuccuuaaaccaggugaaggaguuugacucaauaucacguuuggaucaguggcugaccaccauguugcuucguaucaagaaguccauccaaggggauggagaaggagauggagaccucaagugaagugcugacaucuuuguggcaugcagcucauuccuuuuuauuuugucuucgggcagagccgucuuuguaaauaagccagccacacaguuuauguauuguuuuagcucaccaugucugugucaugugagaaucggaggcuucuauucaguuuguggucaugacaaccaaaguacaucaugcgaguaucugaguccucauaguuuucugagaaguacugccaaaucuuuuucccguucuuuugauauuuucagggcccaugguuaauguugccacguuuuguguuuucuuuuuucuugaacucugguccucaacccaguuuuauagaugcuuagcaaagacccugugcauugguaucuggaugcaaccuuuauacaagugacuuaguuuagggugcuuauuaggaauaaguuuguaauucaguagaaacuguuuggcuuuccuuuauagcuacuuugaagguguuagugauguuucuuguuuugcaaaauaugcucacaugugcaugacaaacacugacaacagcuaggaucugcuaacaucacuugaagcugguagguccugggguccuguuuguuuggauggaugucaagguagauuuccuugguuuuguuuuaacuuacacacacacacacacacacacacacacacacacacacacacauaaaaccugugagauggaauuuucccuuucucuagagacuguuuccacuuuuagcuggagugggaaucccuucauauuugccuuaaaccaucuuuagcuggcaucuccuuuauucacacauccauauaugcuccucacauugucuucugggccacagucaugccaagcuugagcagaguuggacagaaaauuccagcugaauauguguggugauguccauuugucggacauggugguuaaauguuaucaguguagcauaagaguuuguguuaucccugguuagauaagagccucacuuguauuugagggucugugacuuauuucauuugcguguaugagcucugauguccuauuugguuuacauaagacguaugcucuguuauuugagauguugaugcucccugcuacuuuauaugcugauacaguacuguagacaugaccuugcucccuggguccccuuugcugagagacuuuuaugcugggaugauuugugcuugaagagccuguguuacuaggccugucucauugcccuauugugcugcuaucaugugacaaugaaacuccugauuauccagguaaaaauggcccuggaaugguguuuucaucuuuggauggcccuagacuaggguuggaggcuuuuaccaugcaguagaguaguagcuuugcccaggcccagggcuaaacgagaagaguuggaggacugaugagaaaguccguucuuucaaaagugaaacaaaguagcaaaagggggcuagagagaugguuacucuuccagaggacccaaguuugauuucuagcacccauguuggguggcucaaaaccaccuguaaacccaggaauuccagugcccuccuuugccuuccacaagcaugugcgugcagauaaacacauacaggcaaaugaaaucuacacauauaugcaagcaagacacucauuuguaaaauaauaaaucuuauuauuuuaaaaagaaaaaaggaaaugaagcagaaacuggccccaugagaacaggugguaggugucugucaggccccugucauggugguaacaggguguaaaugcaggaagccgagaggccuuugcaugucugaaacagagggaaugugcccuagaaucugaugagagcuccuuuuuccuuccaugccuuuagggguuucuguaugauagcuggcuauaccaaagguaaaaguugcaauggaaccuuguugauacugcuugacuccacuagacucucuaauguaaagacaaaaagugaguuacuggggcuagagaugccucauuugcucuuucagaggacccaggguuaaagucccagaauuuauaugggggcucacagcugucuauaacuccaguccuaagagauccaccauccucuuuuugccuccacugguaccaggcaugcaugugaugcucacgcauacaugcagacaaaacaugcauacacuuaaaaauaaaaaaauuuaaaacuguaauguauaggaaagagaguuacugcuuuguucacggccagccacaggcagccuuggaaaugagguauggaaauggcucuaagucaguuccagcagaagagcaucugaacacuggccagccucuguucucugccucccaguucagucuucugaugcgaccauuuaaagugagacccacauggugucuuacggggcacugugguuuaccuuucaucauggcucccuaacacaccuccaugaagaaguguuggguuguuaaaguaguguuuggauuacuuugcugcuuguaaagaaacuuacucacuuauuugcuuuuccugaaguuaaaugcugggccaggcaucaugaacacuuguaaucccgcaguaucuacaaggugaagggaggaggauugcugugagguugaggccagccuggacucccuagugaauuccaggccagccuaaguuaaugugagacuccaucuaucucaaaaaaccaaccaaccaaccaaccaaaaaaaaaaaaggacugaaaggcugaggugagucccuguugaguuuauuuugucucagcacuugggaggcugaggcaagaggaacgugauuccagacuaagcuaagucagaccaucuaaaaaaaaaaaaaauacaaagaacacacuuuuggcagaagauaaaagaaugaggaccauguccggacaggaguaugcaagcuuacucccuucaaaugucccgcagacacagagcaaugcauucucucaagauguccaggcuuuaggcuuucauggucucuagaauauugugaccaaaacgcaacgauuguuauaguucucauauuugagugcaucuggagauaauucauaguuauggcaguuaauauuucuuacagaaaaguuuuccuuuuguggcaacauuuuuauagcuugugugaauuccuuuuuuuuuuuuuaaugacauaaaacaguauuuuugcacaguuguaaccaugugugauggugucacuauaaccaaaguauaugcaccagcccuugugcauuuauuguucccucugguauugugcacuuaaaauguccaaauucaaaccucuguaacuguggagaaucuggcagcagcacagcaugcccgugaccugccugcuacagugugagcugugaccaguaagcaggcacuguaaaguccuaaguugcucucaggcaagggaguccauuacaaaaacaaaucguguaacaauaaaucuaucuuagcuaaaagaacguuuguuuuaugugaaccuguacaguaaauaaaguggaaguuaucgguaac

SEQ ID NO: 1148 - RNA, 12480 nt, Mus musculus
gcggccgcugggaacaaagccacacuaaugaaucuguacugugcaugauuguaucugcuccuacuaaccagccugcccacccugcacuccagccuguaccuccuuacccacgucaguagcagccaggaggcgggcucacugaacccucuuucacugaaugaccuuuucauuguuuuucuuaaaugccaacgcuugcuucagaggcuaucaacugcuuaaaugcagccaucgacauuuacacagacaugguaagacauggcauugcuugaauggcugugggguggaguccuuacgcugcuuuagagcuguacuuuuucuuguuccuaaacuggcugguguuuguguaggugaagccgguguguaacucuuguuuucuccccuaggggagguucacaaucgcagccaagcaccauaucaccauugccgagaucuaugagacugagcucguggacauugagaaggugagcacugaccacgcacggugcagacgggagaugcuuggccucuuggcugguucagaaucauuacagguguccuggcggagucuuccuaggccuggcuggcugagaaaggggcugcuuaccuggacugccucagagucaccuagcucaccuguuguuggugcuuugguucaugucagaguggucaaaagacauugcaccuuccuuguaccaggggauguuuugcaucaccgcuucacuacacagggcgccacaggguaggggugaaucaaauggcuucuagugcugccauuuuccuucuuuuccuuugucauggugcccuugagcuucuauugcuggucucuuucugucauucugugaauuaaccaguagguggcaccuuuuuucacugaugcaucuuguucuguugaaaggaauuuaagaaauaaaggcugguguggcgguucucgggauuccagcaggcaggaguuugggacugaaggauuguaagcucaaggccaguguggcugcguagcaaggcacugucucaaaaaaaaaaaaaaaaaaagaauuauguuuaucuuacacuuacacacauucugacauggagaagagagcuagcuugucacggucccugacuuugaggcucuuacaccguuaaaaauguccuugucuugucuuuuuccuaguuggacucacaagguuguggucagugaagugugaaauuuauguaugagaaaucaauuacccugaaguacuaguuuguucuagauauuauucacuguccguauaacagaugucucuucauucucuuguuuuauucaaagauuuuaucuauuaggcagugagaugugccaucguacauccaaaugacuucuuguagcuuccugagguaaaauacucgccagcauguaagcaggucuuaccuccgugauccucgagagauccaggggagacauagcuuguuucugguuugggcuccugaaagaccugguuuaguaguauugcuuacagcauaggaugagcacauaucuuagcuuuggcuuugucuugaggcuauuuaagguuuaacaguguuccaucugcacaauggacuccuaagguugaaauagugagaugcaguaggcucccuuucagcuccagggcccgcaaaugccuggaacuuaacaugccccuggcuucagggaugcuacggugaacagcaguccugggccuucccuuguggagcuugccuuucugugggagauggaaacgcaugugugacaguucugagaaacauuccagaggacuguauugucccuacugcuuuuguauagaauucuguguuguuaagaggggguuaguauacuuauuguuuuucuucugucuugguacuugaccuuuaauuguagcucguauguuuaacauguauacuuguuucuauuuuuauuuuuccuuuuauaauacugaggaacucuggggagcauauuagguagguggacuauguggcuaaaguauacauuagaugugucgcauugaagaauuguucuaggucuguguucuugggauacuccacaauccaaagacuucaguaguguugucucugacaacuguagucacuacuuuacagaugggcagaggcugugggcuuuuagagaguauucagcuagaguucccaagcccacuuuguucuauuuguuuucuuaugucugugccucgcacuuucaguccgauuuucauguuacacugguuguguaucugggaaagcuuguaaaugauggcaaaggacugcaaaccugcugcuugcuucucuauaucuauauaaacacaaugcuguuuugcuguuuaaucaucagaagcgaaagcauuguggcacaugcaaaacaugaaauugggccagugaaguagcucagagggguaaacacuugcugugcagccugauaaacuaguccagucuacagaacucagacaaagaggaaagagagagccagcuccacaaaguguccgcugacuuccacauccucuaauauucccuccccagauuaacauuucaaaauguuuaaaucacgcaaaacugaaguuuauugagaaucucuaggauauagcauuuauuccuauguuguuacaggaucagugaauaccugcuaccagagcucaaucagcaauuagaccccaaaguaugacuagagcuauugugggaaaugcuugccugaucccugcuugaaagccuccuguagacuuaucuguugccauuugggcugaagaggccauugguuuuucaggcccuuaccuuuguacauggucuguuuccccuguaacuuccugaaaaguagcuaacucuucccagaaccuaaccucaucaggcuugcuaaagcaguauaugucauccuguucuuugaaccgcuuucuguuguuuggggcucugauagggcguguuucgccuuuugaaguuucccgugguccgauuccacuaauccugucacagccugauguaagcugcuagcuuucugcucucuccauccgacuacuguuagaguaucacaaauuuucaggagcgccuuugccugugauagaacagucagggcugcugcugugcuuuguagaacauaacagcuccacagcacucuaagcuaacauucacuuagcuucgaguacauuugaucauggugggaaugcugggguaagggguugguuaggaagcagguugacagaauucugccaucuucauucuguggcuucagucuaccagacuuggccaugucuuuuauguuuugggaaguagaaaagaucaagggaagaaugcaaaauaagauguuuagcuguucaucuuucgucagagagcuagucauggcuacccuagcugcauggaagcugggcuguuugcuguaagugagggaaacuguuggcuaccuuucuguugcuuuuaaugaaacagcaugaccaaaacgaauuuauggagcaaagaacuuauuuuagcuuagaguccuacgggauagaguucaugaugacaggaagacaugacagcagaugacaggcauuguggcagaagcaggaaaccaagaagaugcagcagcaucuuuaaccucagaggagagaaggaacuaaaaacggggugaugcuauaaacucucaagauaaugcucagugauguacuuccuccagcgagccuguacguacccauaacguugccauacagcaccaccaacugggaccaaguugucagcuaugugagccuuagagggacauuuuuuauucaagccaccacagauagagagucagaauauucugucuccaggaggcuuuagggcuacauacuuuauucuguugacugaggaggccaacuuguaaaagauuugucacugaauaaguuuaauuaucagaaaaaaauaucuguguacauguagacuuaaauuuuuuuuauuacauuaauucacuuguuuugugauuacacacauuuuccauuacacacuuguggaaggcaggguacaacguggagaaaucccuucucuccuuccacuaugagagucccaggaaucaaacucagauugucagacuugcuagcaaaugccuuuaccuacagagccauccuaccagccccaacauguaguuuuuaaugcaaaucucuaagugaauuguuuguaaguuaacuguauguacuuucaggcuauugcacacuaugaacaaucugcugauuacuacaaaggagaggaaucuaacaggcaagugcuuuucuucauaucaguggcaggcuuuucauaugugauaaagggaacgccaucuuugucaucuaagcaaguguccuuaggccaggucuccucagcguugucacuuucuuacuuucagcucugccaacaagugucugcugaagguggcagccuacgcugcacagcuggagcaguaccagaaagccaucgagaucuaugagcaggugaggacuggugucaccuugacaaauuuguaaccaucacuacuauauaccgcuagagccuucccaucacuuccggagaaagccaggaaagcagccugcucucuguuuuccugauuugccguccuugacccuuugacaugcauggaauaaugcaccaucuguuuucugugacugauuucauuuuuaagauucuucauauuguagcaugugucaguguuucauugcuuugcauggcugaguaauacucuggcuuuuauguucaucugcugauaggcauuuaaggagcuuccacuuggggucuguuaaggauaaacugcugugaacauuugcacuuagccugugugagagcauguucucagaugucuugacuccauacuugggaauggaaucaggauuguuuggcuucuugguguaucaaugccugucuugcuggggagcuagcugacucucacagaguacuggaucauugagcauucccagaacaguguccagggcucagcuucucugguccucaccagcaucucugugauuccuaaugaaugugaaggauaaucuguucuuucucuccugaugagugauauuaauauucaugugcucacuggccauuuucucaucuuuggugagagauuuaggaguaauuuaauccuagauauuaggauacaaguccuucauggucaggaaaaaacuuaacuuacaagcauuuuucccauucuguggauuucauuuuuguucuguuguuugucucuuguucuaguuuuucagucuuuaaaauaaauauugaggggcuggagagauggcuccacaguuaagagaacuagcugcucuuccagaaguccugaguucaauucccagcaaccacauggucgcucacaaccaucuguaauggaaucugaugcucucaucugccaugcaacuguauaugcagaaaaagcaguuauuuacauaaaauaaauaaauuuaaacaaaaauaaguaaaauguuacguuuauuuauuuuguauguggagaguauaagugccaccuguggcaaacagaggacaacuugaauuggucuguccuuuuaugauaaauggcagcuauguuaguggguuugagcccaggagagguuaucagaucaccuguauuagaagggguuguuagaguuaccgugguuaugagccacaugacguaaaugcugggagcugaaccuggguccucugggugaacagcaagcaagugcucuuaacuaaugagccaucucucuaguuccaagauguuuuuuguuguuguuguuguuguuuggcuuuguguucuuuuuguuuuguuuuguuuuguuuuguuuuguuuucuugcuuuacuuuguaauucuggggauugaacccagagccuuaaacacagcacucaggugcuccgccacuaagcuccaucaccaagcuccauuacuggcccuggcuuuuaguuucuuuaguuuguuaguuucaagcaucuuugaaugcuuauugaggaauuuuuuucugagagcuccuuuaagcaaacuuaaacagucuaacauuucugcuaccuggaauugucuguugcuucuguaguaaguuucagguuuugcuauaaucaguaacuuucucguuugcucugcugugacugaugggugaccuucaccuugugcucuguugugauuggugaccuucacuuugugcucugcugugauuggugaccuucacuuugugcucugcugugauuggugaccuucaccuugugcucugcuaugauuggugaccuucacuuugugcucugcugugauuggugaccuucaccuugugcucugcuaugauuggugaccuucaccuugugcucugcugugacuggugaccuucacauuguacucugcugagauuggugaccaccucauuguucucugaggccacaucugauuuccaucauccuucugugcacuggccacacugacuggagauuuagguauguugguggaggcagaagcucagacuccccuuuuuggaugucucaccccuguuaggccucaugagaccuuuaccacucucuuuuaauuggcuccuucuggaauuuuugggugcuggguucuuuauuuucauagugggacuacaauaaagaaaaauaaagcccaguaauccccacccccacccccacaccaggggauuuuucuugaugucuugucucuugcugguuggcuuuccugugcccuauguccacagauguuuggauuuauuaaaaaaaaacagaaagaaagaaagaaagaaaggaagaaagaaaggaaggaaggaaggaaggaaggaaggaaggaaggagagaaagagagaaagagagaaagagagagagaaagcaagcaagcaagcaaacuucuaguuguauuucauaggaagaaccaggggagcuuaggccucuccuucaucuuccaggcauuuuuaaaaguucaugucccucauaauuauuucguaucuaguaaaacuuuguacuacuuggcauggaauauaucaguauaagauagugaaagguauuuuuuaaaaggaaaacagaugaguaagcaguggauugcuuggccuauaacauugccuugcugucuuccgccuaggugggagcaaacaccauggauaaccccuuguugaaguacagugcaaaggauuacuucuucaaggccgcgcucugccacuucauaguggaugagcugaacgcaaaggugagagcgcccccuuucugaugacuuuaccccugaggacagaugcuuugucacccgggaugccuuuuccuucaggugugaagagcuguggugagggcucaguugauaaagcacuggacugacccaaguugagguucccagcacccauguaaaagccagguauacuggcucacauguguaaguccagcacuaaggagcaaagcagagauaagcagaucccugaagcuugugacacugaccucuggcugccauauauaugcgcccuaacaugcuugggcacacagccacaugaacacauacuuauugccugucuccugcuacacacagaguaaaacuaauaguucuuucguggugugcgaguuugacucuuucagcagcugcaaugcuguccucuucagguugccuucagugguugauuuagguagauuaggaacuaagacaguaaaauuagugcacucucuuguuccuuuuacauauguuugcuuauuuauuuacuuauuggggugaggagguaaacauggauauauuauagcacucgugaggaaguuagagaacaccuuuuaggagucaaucuucucuuucuacuaugucggauccagggaucaaacucaagucaggcaugguggcaaaugccuuuaccuguuaaaaaccucauuggcccugauggauggauggauggauggauggauggauggauauauugggggugggagguuauuuguuuguuuguuuguuugagacagggucuuacuauauagcccuggcuguccuggaacucauuauguaguuccaggguaacuuaaacucagagagaucugccugccucugccuccuaaauucugggauuuaagguauagauuaccacacccagcuucuaagaccucauuuaaaaaaacaaaaagcacaaacaacacaccucagaaguggaguuagaauagaaugaaggucagagaaagcugcaaagcaagagcacggcuggaaaguaagauggggccugaccacacaacacuggccaucagagaaccacagaaaacuacucuagaguccauucuaccucauggacauuuggcauuuggaggaugugaaggucuucucuauguagcacacauacauagauccuagaagugaauuagauuuuauuuuguuucuucucuccaguugcccaacuaaaaucuagaaauuauuuuagaaaugguauuaucaaucauaauugaauacucaaaauaaauagauuuccucuguucugauguaggauuuaacauuauauuucuucaacaguuaaacgagauggaaauaaaauuuuugaacugauagagcauuaacaacuucccuaguucacuaagucucggugacugguuccuuuccucccuuagcuugcucuggagaaauacgaggaaauguuuccagcauuuacggacuccagagaauguaaauuauugaagguaaguacugaaacagcuuugaagacagaagccuuuacuggugcugauggguggagcuuuagucuguaaguggaggaggagguguugguuacuggacucauuacuguaacaaagaauccagcauuaggcgacuuaauagaggaaguugcuuugacuacaguuucauugggccgucuauucgggccccaggggcaugaggcaucuggucacacggagucuacaguaaguaagcaggaagaauggagugcuggggccccucuugcucuuuccuuucauuuaauccaggacccaggaaauuguggcucuuucuucuuuaguucuuccuucuucucuuaaaucugucuggagacacccagaggagugauugaauagugacucuaaacuuagucaaguugacagugaagacuagccaucacuuggguaucuuggacuugacuucuuuuuuccauuguagauauucauaugcuaggagaguuaggauguuuaacucuguucugaaguaugcagccuugaaaucgcaauacaaggcuaaagccuuuucuuggguaaugcuuacugcagacaucccaucuuaugagauacuagggauaucagagcaggagauacuaaggugauuccucuuuaaaauaaaguauuccuucagaaacagaacuuucuagccuaaaguauuuucuugauuuuuuuuuaaugccaucagaaacuucuagaagcucaugaggaacagaacagugaagcguacacugaagcaguaaguuaaaccuucgggauauguugcauuuuuaaagguuuacauauaaaaauuccguuuuguauaaauucuaaacauuuaucucaaugugguucaacuugcuuguauuuuccaaagaucaugucuugcauguuccacaaauggcacuuagugagugcccuuaaguauuagagacacggcacuguaguuuggaacauuuguuucucuugcagagcacuagaauuggguuccuagcaccccacagcucacaaccaucuguaacuccaguugcagaggaucagugccaucuucugacauauaggaacaccaggcucucuaagagcacacucaugacugcauauacauucauguaccuaaaauaaaccagccuaauuuuuuuuuaauuuaguuccauuaaccacgcagaaauucuagcuauauugagcugguucuugauuuuguauuugugauuucugcuauauauguguguucacauauagagaaaacuuaaaugcacaggcuuaugaaaggaaaagaaaaacugauuuuagugaaagaacuuguaaauuagaaugaguaacuuccaaugagagucacuggguuauuacaguaacaucuucaaacagcuuagaccacuauugucuuguauauuuagugguuuuuggauauaauuuccguucuucauuccuuaaaccaggugaaggaguuugacucaauaucacguuuggaucaguggcugaccaccauguugcuucguaucaagaaguccauccaaggggauggagaaggagauggagaccucaagugaagugcugacaucuuuguggcaugcagcucauuccuuuuuauuuugucuucgggcagagccgucuuuguaaauaagccagccacacaguuuauguauuguuuuagcucaccaugucugugucaugugagaaucggaggcuucuauucaguuuguggucaugacaaccaaaguacaucaugcgaguaucugaguccucauaguuuucugagaaguacugccaaaucuuuuucccguucuuuugauauuuucagggcccaugguuaauguugccacguuuuguguuuucuuuuuucuugaacucugguccucaacccaguuuuauagaugcuuagcaaagacccugugcauugguaucuggaugcaaccuuuauacaagugacuuaguuuagggugcuuauuaggaauaaguuuguaauucaguagaaacuguuuggcuuuccuuuauagcuacuuugaagguguuagugauguuucuuguuuugcaaaauaugcucacaugugcaugacaaacacugacaacagcuaggaucugcuaacaucacuugaagcugguagguccugggguccuguuuguuuggauggaugucaagguagauuuccuugguuuuguuuuaacuuacacacacacacacacacacacacacacacacacacacacacauaaaaccugugagauggaauuuucccuuucucuagagacuguuuccacuuuuagcuggagugggaaucccuucauauuugccuuaaaccaucuuuagcuggcaucuccuuuauucacacauccauauaugcuccucacauugucuucugggccacagucaugccaagcuugagcagaguuggacagaaaauuccagcugaauauguguggugauguccauuugucggacauggugguuaaauguuaucaguguagcauaagaguuuguguuaucccugguuagauaagagccucacuuguauuugagggucugugacuuauuucauuugcguguaugagcucugauguccuauuugguuuacauaagacguaugcucuguuauuugagauguugaugcucccugcuacuuuauaugcugauacaguacuguagacaugaccuugcucccuggguccccuuugcugagagacuuuuaugcugggaugauuugugcuugaagagccuguguuacuaggccugucucauugcccuauugugcugcuaucaugugacaaugaaacuccugauuauccagguaaaaauggcccuggaaugguguuuucaucuuuggauggcccuagacuaggguuggaggcuuuuaccaugcaguagaguaguagcuuugcccaggcccagggcuaaacgagaagaguuggaggacugaugagaaaguccguucuuucaaaagugaaacaaaguagcaaaagggggcuagagagaugguuacucuuccagaggacccaaguuugauuucuagcacccauguuggguggcucaaaaccaccuguaaacccaggaauuccagugcccuccuuugccuuccacaagcaugugcgugcagauaaacacauacaggcaaaugaaaucuacacauauaugcaagcaagacacucauuuguaaaauaauaaaucuuauuauuuuaaaaagaaaaaaggaaaugaagcagaaacuggccccaugagaacaggugguaggugucugucaggccccugucauggugguaacaggguguaaaugcaggaagccgagaggccuuugcaugucugaaacagagggaaugugcccuagaaucugaugagagcuccuuuuuccuuccaugccuuuagggguuucuguaugauagcuggcuauaccaaagguaaaaguugcaauggaaccuuguugauacugcuugacuccacuagacucucuaauguaaagacaaaaagugaguuacuggggcuagagaugccucauuugcucuuucagaggacccaggguuaaagucccagaauuuauaugggggcucacagcugucuauaacuccaguccuaagagauccaccauccucuuuuugccuccacugguaccaggcaugcaugugaugcucacgcauacaugcagacaaaacaugcauacacuuaaaaauaaaaaaauuuaaaacuguaauguauaggaaagagaguuacugcuuuguucacggccagccacaggcagccuuggaaaugagguauggaaauggcucuaagucaguuccagcagaagagcaucugaacacuggccagccucuguucucugccucccaguucagucuucugaugcgaccauuuaaagugagacccacauggugucuuacggggcacugugguuuaccuuucaucauggcucccuaacacaccuccaugaagaaguguuggguuguuaaaguaguguuuggauuacuuugcugcuuguaaagaaacuuacucacuuauuugcuuuuccugaaguuaaaugcugggccaggca

SEQ ID NO: 1149 - RNA, 3977 nt, Mus musculus
acagagccaaaggaguuuuuuuuuuuuaauugagcaaggcauggcagguacugcaagaagaguggagccaggggacagcuguucagaugugcagaaccugccugcagcagcuccuuuacugucuccuggugcaaacacacuggcggugcccuccagagccggagcacccuucugcgagaugaaacacuauagggaaggagcacaaguaaggaacagucugcaugauccuucuagacucagcccuuaggcauuuuugcagcugaauuuugucagggagugugugccuuuccagggcacgcuguagaucuggaaggagcagagugccuucugcaaaagggaacaaagagaaacaaucagugugaagcuacagcaaagacaaauacccacuccgggaugauggaacaaguguaugcaaugauggaagcuaaacccuucucccuucugagucccaggacacuuagcagggucuguucaucccuauuauuggaugguauguguccccuuuccugguuccacaagaccauauucuucagccccagcacagcuuguuaaggaguagccuuuuaaggugugggagcccuagaggucaaggcaguggaaaaggcucagggcccaugagcccuccaccuaaguacuaagagggccaccaggaaagaagcccaggcauaggacacaucucuaaaaguggcaaagguauagggaaggaugauaaggaaaauguagcuaucaccacaaccauggugucacaucccugcagacaugguagaagaggcacagaagacuccaaccauuaaauagguucuguucucuuucauguggucuuggcagguggcucuggcuaggauuaaaaagagccuuucuccccagcaagaauacuugcaguugcuucuagcucaguagggauaacugaacaucaauagcccaauucccaggaaaaauuaauucagcaauuaaucaugugcaaauaaaccccuccccuauagggauacauauuugcauuggcaugaacauacaugugcccaacaccuguauccauuuaugaaucaccauuauuaacuuuugccugcacgauugcccuuaggcugauaucaaguaccuacccucaucagauggggcuggucauggaaaggacagucagucaaauuugucugggacuugguacauguaguucggcccaucuccacauccaaaaaauaguucacuccagccacgagcuacagugagaagagcaggauugaacagugcagucaagugacuuccacacagcugccuuccaucacagacccgaaguguuuaccuaggacuuaugccuggauucauaggcagccagaaaucucacccacagacaagcgccccaggcucuguuggcaauuguuuuauucugagcaacucugacaaguugucauauguagcugacuaagaggagaagcagaacacaaaaggcagaagcuagcacugacaaaccuuucugugaguagggaaggcuguucuaggagccuagguuuguucucugagcauaagcaaaggcucugggcugcagugugggauuaacucaauucugcugacuguggcuccucaggcucagacacgacagcacugguggagagccagccauuccccauacacagccuagagagaacauauuuauuuaccuaggacuccuuccuuucagggacaagaggacaugggaugcuucacacacggggauguuucaagucagagggaagagcacucuuaaaugauuucuccuucagagagacucuccagaauuuucucaagcaugucauuucccuguaggucuuccauuugcaauuuaagaauagcacuuaucccucuccccauaauggggcacaccagaucaacuugucagaaaugggaagcacaaacugagggacauaggucgggguggagggguacagggcucuguguauugauugccccgcaggaccaaaaacagcucuggauuugggagaauguccugauuuuccuacuaguuaaaggagaccugcagaccaaagaaccuacaacuccuuauacuuugcuccaucuguugccacaauuaagaggugcacuggcccucaagguccaaggcagcugggaaguggaguuuucucaagguugaucccagcagcaggagaaaaaaauggagcaggauuuaacucguuuguauuuucaagagaagguagaaaugagcucuacacacuggcauacaacucuuugucgucuaaaaccugggcuuccuuugggucaacuuuggggcuuuagcagcuccugcagcuagcuccucugucagagucuaagucuaagguagucuguccaucuacucaguggguggagggugauuagagcuaucuugggggguaauuagcaaaaccccugagggauaucccgaggauauuccagggccacaagaagagggaagcaaggcuucuuagaacaacuagacagcaccuucugagaagacacaaggggaccugccuggugaccugcaccaacaugacagccaagaaacucagacaccaaucuacacaguuaugugucccuuaaggauagaggcuccuucugagaaaugugcccuggccacacuguguacaagcuaauacggcugcagcaucaagggguuguuuagcuuugagguucacccaucacaaaccgagucauggcugaagggagccugacugugugguacaggacugaucaccacagcugucuggaccauucuacagugcuaccaaaacagcaaggcagcacaggcagugcucagagaaaaagacaggcugccagacuggauagaaauggcccuugcuagcagaguccauaguggagaccagcaaacugagacuuugagugaaggaccugaguguucguggguucccaauuuuccaaauggaaucuuggguauguagagaaugcccuuguuuuccggaaguguugacucugaaaguauacacaaaaauaagugacuauaaacacacacccacguacacgugcuccugaguagagcaaggagauuggaacauggccaaguguuuacuggaaggauggggugaaaucugccgucugucagaaugaguuucaaguagcgcgauuaagugaagccagaucauuagcaguugacauugaccccaggcggcuaagggaggugagcuccgcccagggagcguuugaccuacauccuuaguaccuucucuggguggccuuuuggaaacagagcuaggaggcccacccgcugggcucuucugaguuccagaauaaacaaaagaugaauguuaacacaaugaguagaccagagaagaaaggaagagagaggaccgcucccauaagaagcaaagguguugauuaacaacugcagaugcaaaccgcgcccuagcuaggggugccugggugggagcggccuggagacgucgggagagcaggggacagcagggacacguaccugcuuacgagcucucaccaccuguauggcgcggcugugguacgcaucguugcugcccuuguuguacucgcucacagcgaaguccaacgcucgccgcacgccuuccucauuggcaucugccuccuccggggcucccaacauucgcgggccuuguuuuggggucgccgcccaggccacggccaggacggccagcaggaacagcaaggagcgcagcgggcuggccaugguuggcuaggacaaagggauaaagcuccaacaagacucugaguuggugcagaacagacgcugcuacuccgugcgacuuuuacccaaaugcgagcguuagggacccgcccgccucuccuggcuccuccuuuuccggcggccacccucccuuuuccgucugcccccuagcgggccccgccuccucuuccgaacggccccgcccucccucugcuucagucagcugcuagucuguucuugccuuguaggucagauaccucuuaaagagcugccagauucccauucccugcugagccuccccucccccaucccugccccg

SEQ ID NO: 1150 - RNA, 3977 nt, Mus musculus
cggggcagggaugggggaggggaggcucagcagggaaugggaaucuggcagcucuuuaagagguaucugaccuacaaggcaagaacagacuagcagcugacugaagcagagggagggcggggccguucggaagaggaggcggggcccgcuagggggcagacggaaaagggaggguggccgccggaaaaggaggagccaggagaggcgggcgggucccuaacgcucgcauuuggguaaaagucgcacggaguagcagcgucuguucugcaccaacucagagucuuguuggagcuuuaucccuuuguccuagccaaccauggccagcccgcugcgcuccuugcuguuccugcuggccguccuggccguggccugggcggcgaccccaaaacaaggcccgcgaauguugggagccccggaggaggcagaugccaaugaggaaggcgugcggcgagcguuggacuucgcugugagcgaguacaacaagggcagcaacgaugcguaccacagccgcgccauacagguggugagagcucguaagcagguacgugucccugcuguccccugcucucccgacgucuccaggccgcucccacccaggcaccccuagcuagggcgcgguuugcaucugcaguuguuaaucaacaccuuugcuucuuaugggagcgguccucucucuuccuuucuucucuggucuacucauuguguuaacauucaucuuuuguuuauucuggaacucagaagagcccagcgggugggccuccuagcucuguuuccaaaaggccacccagagaagguacuaaggauguaggucaaacgcucccugggcggagcucaccucccuuagccgccuggggucaaugucaacugcuaaugaucuggcuucacuuaaucgcgcuacuugaaacucauucugacagacggcagauuucaccccauccuuccaguaaacacuuggccauguuccaaucuccuugcucuacucaggagcacguguacguggguguguguuuauagucacuuauuuuuguguauacuuucagagucaacacuuccggaaaacaagggcauucucuacauacccaagauuccauuuggaaaauugggaacccacgaacacucagguccuucacucaaagucucaguuugcuggucuccacuauggacucugcuagcaagggccauuucuauccagucuggcagccugucuuuuucucugagcacugccugugcugccuugcuguuuugguagcacuguagaaugguccagacagcuguggugaucaguccuguaccacacagucaggcucccuucagccaugacucgguuugugaugggugaaccucaaagcuaaacaaccccuugaugcugcagccguauuagcuuguacacaguguggccagggcacauuucucagaaggagccucuauccuuaagggacacauaacuguguagauuggugucugaguuucuuggcugucauguuggugcaggucaccaggcagguccccuugugucuucucagaaggugcugucuaguuguucuaagaagccuugcuucccucuucuuguggcccuggaauauccucgggauaucccucagggguuuugcuaauuaccccccaagauagcucuaaucacccuccacccacugaguagauggacagacuaccuuagacuuagacucugacagaggagcuagcugcaggagcugcuaaagccccaaaguugacccaaaggaagcccagguuuuagacgacaaagaguuguaugccaguguguagagcucauuucuaccuucucuugaaaauacaaacgaguuaaauccugcuccauuuuuuucuccugcugcugggaucaaccuugagaaaacuccacuucccagcugccuuggaccuugagggccagugcaccucuuaauuguggcaacagauggagcaaaguauaaggaguuguagguucuuuggucugcaggucuccuuuaacuaguaggaaaaucaggacauucucccaaauccagagcuguuuuugguccugcggggcaaucaauacacagagcccuguaccccuccaccccgaccuaugucccucaguuugugcuucccauuucugacaaguugaucuggugugccccauuauggggagagggauaagugcuauucuuaaauugcaaauggaagaccuacagggaaaugacaugcuugagaaaauucuggagagucucucugaaggagaaaucauuuaagagugcucuucccucugacuugaaacauccccgugugugaagcaucccauguccucuugucccugaaaggaaggaguccuagguaaauaaauauguucucucuaggcuguguauggggaauggcuggcucuccaccagugcugucgugucugagccugaggagccacagucagcagaauugaguuaaucccacacugcagcccagagccuuugcuuaugcucagagaacaaaccuaggcuccuagaacagccuucccuacucacagaaagguuugucagugcuagcuucugccuuuuguguucugcuucuccucuuagucagcuacauaugacaacuugucagaguugcucagaauaaaacaauugccaacagagccuggggcgcuugucugugggugagauuucuggcugccuaugaauccaggcauaaguccuagguaaacacuucgggucugugauggaaggcagcuguguggaagucacuugacugcacuguucaauccugcucuucucacuguagcucguggcuggagugaacuauuuuuuggauguggagaugggccgaacuacauguaccaagucccagacaaauuugacugacuguccuuuccaugaccagccccaucugaugaggguagguacuugauaucagccuaagggcaaucgugcaggcaaaaguuaauaauggugauucauaaauggauacagguguugggcacauguauguucaugccaaugcaaauauguaucccuauaggggagggguuuauuugcacaugauuaauugcugaauuaauuuuuccugggaauugggcuauugauguucaguuaucccuacugagcuagaagcaacugcaaguauucuugcuggggagaaaggcucuuuuuaauccuagccagagccaccugccaagaccacaugaaagagaacagaaccuauuuaaugguuggagucuucugugccucuucuaccaugucugcagggaugugacaccaugguuguggugauagcuacauuuuccuuaucauccuucccuauaccuuugccacuuuuagagauguguccuaugccugggcuucuuuccugguggcccucuuaguacuuagguggagggcucaugggcccugagccuuuuccacugccuugaccucuagggcucccacaccuuaaaaggcuacuccuuaacaagcugugcuggggcugaagaauauggucuuguggaaccaggaaaggggacacauaccauccaauaauagggaugaacagacccugcuaaguguccugggacucagaagggagaaggguuuagcuuccaucauugcauacacuuguuccaucaucccggaguggguauuugucuuugcuguagcuucacacugauuguuucucuuuguucccuuuugcagaaggcacucugcuccuuccagaucuacagcgugcccuggaaaggcacacacucccugacaaaauucagcugcaaaaaugccuaagggcugagucuagaaggaucaugcagacuguuccuuacuugugcuccuucccuauaguguuucaucucgcagaagggugcuccggcucuggagggcaccgccaguguguuugcaccaggagacaguaaaggagcugcugcaggcagguucugcacaucugaacagcuguccccuggcuccacucuucuugcaguaccugccaugccuugcucaauuaaaaaaaaaaaacuccuuuggcucugu

SEQ ID NO: 1151 - RNA, 1201 nt, Mus musculus
aggaguuuuuuuuuuuuaauugagcaaggcauggcagguacugcaagaagaguggagccaggggacagcuguucagaugugcagaaccugccugcagcagcuccuuuacugucuccuggugcaaacacacuggcggugcccuccagagccggagcacccuucugcgagaugaaacacuauagggaaggagcacaaguaaggaacagucugcaugauccuucuagacucagcccuuaggcauuuuugcagcugaauuuugucagggagugugugccuuuccagggcacgcuguagaucuggaaggagcagagugccuucugcaaaagggaacaaagagaaacaaucagugugaagcuacagcaaagacaaauacccacuccgggaugauggaacaaguguaugcaaugauggaagcuaaacccuucucccuucugagucccaggacacuuagcagggucuguucaucccuauuauuggaugguauguguccccuuuccugguuccacaagaccauauucuucagccccagcacagcuuguuaaggaguagccuuuuaaggugugggagcccuagaggucaaggcaguggaaaaggcucagggcccaugagcccuccaccuaaguacuaagagggccaccaggaaagaagcccaggcauaggacacaucucuaaaaguggcaaagguauagggaaggaugauaaggaaaauguagcuaucaccacaaccauggugucacaucccugcagacaugguagaagaggcacagaagacuccaaccauuaaauagguucuguucucuuucauguggucuuggcagguggcucuggcuaggauuaaaaagagccuuucuccccagcaagaauacuugcaguugcuucuagcucaguagggauaacugaacaucaauagcccaauucccaggaaaaauuaauucagcaauuaaucaugugcaaauaaaccccuccccuauagggauacauauuugcauuggcaugaacauacaugugcccaacaccuguauccauuuaugaaucaccauuauuaacuuuugccugcacgauugcccuuaggcugauaucaaguaccuacccucaucagauggggcuggucauggaaaggacagucagucaaauuugucugggacuugguacauguaguucggcccaucuccacauccaaaaaauaguucacuccagccac

SEQ ID NO: 1152 - RNA, 1201 nt, Mus musculus
guggcuggagugaacuauuuuuuggauguggagaugggccgaacuacauguaccaagucccagacaaauuugacugacuguccuuuccaugaccagccccaucugaugaggguagguacuugauaucagccuaagggcaaucgugcaggcaaaaguuaauaauggugauucauaaauggauacagguguugggcacauguauguucaugccaaugcaaauauguaucccuauaggggagggguuuauuugcacaugauuaauugcugaauuaauuuuuccugggaauugggcuauugauguucaguuaucccuacugagcuagaagcaacugcaaguauucuugcuggggagaaaggcucuuuuuaauccuagccagagccaccugccaagaccacaugaaagagaacagaaccuauuuaaugguuggagucuucugugccucuucuaccaugucugcagggaugugacaccaugguuguggugauagcuacauuuuccuuaucauccuucccuauaccuuugccacuuuuagagauguguccuaugccugggcuucuuuccugguggcccucuuaguacuuagguggagggcucaugggcccugagccuuuuccacugccuugaccucuagggcucccacaccuuaaaaggcuacuccuuaacaagcugugcuggggcugaagaauauggucuuguggaaccaggaaaggggacacauaccauccaauaauagggaugaacagacccugcuaaguguccugggacucagaagggagaaggguuuagcuuccaucauugcauacacuuguuccaucaucccggaguggguauuugucuuugcuguagcuucacacugauuguuucucuuuguucccuuuugcagaaggcacucugcuccuuccagaucuacagcgugcccuggaaaggcacacacucccugacaaaauucagcugcaaaaaugccuaagggcugagucuagaaggaucaugcagacuguuccuuacuugugcuccuucccuauaguguuucaucucgcagaagggugcuccggcucuggagggcaccgccaguguguuugcaccaggagacaguaaaggagcugcugcaggcagguucugcacaucugaacagcuguccccuggcuccacucuucuugcaguaccugccaugccuugcucaauuaaaaaaaaaaaacuccu

SEQ ID NO: 1153 - RNA, 175184 nt, Mus musculus
ugauucugcauccugcauggcucuaacaauggaugcucagccuagcaguucacaggagagcagagaauguucuguucaggaaggaaccagagaccauaagcuguuuuacagagagagguaaggcugacaguuucuguuaauuuaagagauacuaaaugggggauacucacaauguccuuuucaggcugucccagauaaaagagcugccuggagcucagagcaaccaguagaagaaagccaggugccuagcugcugcagaaguugagaaugagugugauauuuagauguaaagaagacguucagaugaacccaagcaaggagcuucucugaacacaccuggguccacuaaucagcucaaccuccuuccuaagccauccaaaucugauuuuuuuguuuucuauguacagcuaaagguccccagaagccaagugcugcacagggcucccaggcaggauuugagcuaccuccaacucugacacuccaaauucuacuuggcuagaugcggcaguuucugggggcaaaaucuugguuuugaggcaaggggcaggaaucuauacaagauagcuauagauccaaggaaccacuagggaauuagcaauguugacuccccagggagaaaaaguuuggguuugggagagcugaagcaaggugaauuuucccuuguuuugaaagggggucauucagauaagacaacuuuugauccucuuuuuggcgaauuuucuaauuccuucucuauaaaaucuguaaggaaaacacgcccacucgagcaugauuuuccccaacguuugaaauguagauugucuucguaggcggcucuacuagggcucuccucgaccuacuccaagccaccacucugccccacccccaaggcgucgucggcccaguuuccuuccacagcaacuaccauggggccacccgcagugcaccuacaaugguguugguccgagcuacaggcuugagucccagaguaccgauuucaggcuggucucugucuuuauuccuucugcuggucaggacgugggucuuucucugaaccuacaguguccagagaaaccuucugaaccucaagucgaccuggagccugggaggucuuuuaggaccaagggaagccaccguuuccacagucggcggcuaauucuuguccuccuaguucccaguggcagucccccuucccccaucucagucgccccaacguuuccagacacuagcccccggccacccgccagccgcuaucacuggcgagggcacagcuagccuggagcaaaguuaguggccaccuucgugugcugccgcucucucucccccuccucuuccucacggccaccuucucccggggaccgcggccgcauacucuugcacacaagucgccaggcuccgcgagaccaaagaguggaacggcacaucccgggucaccccuaguucagcccgcgcccuuugugcuccuaggggccaagaggaccggguucuggaaggguggcgccgcagcccuguguucggcucucgggaacugugugcucggggcagcccagggcgcuggcagugauccaaggaggggagcggcgggggaagcugcgcgcaggggagggcagaggcggagagccacgagcccagaagcagaggcgggcuccgcaccgccccgcgccccucacgcuucccggcucucgagacgcgcgggcggccgccugggcgcaccagccgggucaccuugucccggagguaagucccgagcaccagagcugcgcgggaggaccccgggccaccggagugggcggguguggcgggcgcgagaggaugcccuggcgcaggcggguguccugcuccgccucgcagcgcgcagaccaggcggcggugauggugugccggccgcgguaaguccugaagggucgcaguggccggacuagggagacacagugucgccccgagagaggggagauggcgccugacggggaagaugcagagaggacaggaacugguaauaccggcccagggugcgacuuggcgccuugccaccuuggguacccaggcggcgugaaggggcugcugugcgacgucgguuagagcuagugcgucugugucuugaguucggcaaagccaggcugcugggggccaggccgguguacuggaacaccuagaugauaccgaccagucccuggagcuaccuagcugaguccaagaggggcuggcgagaaaggcauccgcggagguggcagucagugagguccacaugggacaggaaagcaaagggccgaggggaaagagaauguagaguuccagagcaucaggauuggggugggugggugcacaaucgguuaccugagcggaagaccggacuucuagaacccuucaccuccauccaaaacgagaccgguuuuuaugagcuguccggucccuggcagcgcgacagucugcagccucggagccgccaguccuggcgccgagaugggcgcaagcagaugcgauuaaaggguucagauucuaauuuuguugucucugggcgugauuucuacacuucauucguguccucucuguaaauacuggagagaguggagcauccauggaguuggacacuuuucuuaagaaagaagggcuuugggcaugugccuguuuuguuggacccuagcggugugguggaggaaccuucaguugagcuuugggcaaguaggauaaggguugguuggcuuuacuaaaggaccacaagaaggggucuucugguauuccucauuuucugugggguguucugcuagcagaagcgcaggcacacggugccucagacuuaaggugcgcaccacacuccugcgguguuugauguggagguggcgccucugcgcugcgggcaagaacuggguugccugugucuuucauagucucaccaggguuuuuggugcagcaaacaguggucucaguuuagcuguuugggggacguaggggucugacaaauaccuaggggcuguuuuucuguuuagaaucaggcagcgggacaugcaucucuagggcccucuucugcagagccgcgaggugguaaccaucaggcugcgaacugcgcagaccugcagcuugagcggugugggggauggagggggggacggugcaggggguaacaaccuccuaacauaucucagagccuguggauuuuucuuugucaaggugucugcagcuuggguguuugcagagaagugguuucaaagaggggaaaggggguccugauaaaagugucuguagccuggugucuguuuggaggaggggagaagcugaggggaauuuucagagaaguugcucaugccuuugaccgccguuucgaaguuuuagaccacaggugcggggccuguggaugugugagaaagcaucuuucuuuccucuuugcuuccuucucucgcaccuaggaacacuuuagccuuuugcugggacaagcuugucucuguaagugaucagaugcccuucucacccugcccccacugccugccccugcagagaggacucauaguaaauuagcugccccuuuucagugagagaggguacugugguaccagggaagagggagcaggaaggaagcacuucaaacuuuccuauuacagaaaucuucaaugauauggaaagguagagagaugcccuuggccuuggccgccuccuccuuguuucucagaguccuggaggccuuguuugggaaagacuucaaaaucuauucccaaaaggaugacugaggggaggaauauucggugauuccacauuauacaaauaaaucauagcaucauuuggugucuguaagccuauacaauuaugaauguaugaauguauccaacaaagcaaauguauugguuaaaauaauaaauuauauugcuguuaaauuguauuuuuaaaaugagcuagaaaaguaauauguuuacauacggguuuuucgugagugcuucauuuugauuuuaacuuuaaaaagaaaaaaaauaauuucuagcugacuuuaccugucugcacaugguccugucucugagaaugauggcaguuuauugcaagcuggccuggccaucauaauaauucguguguguuuuguuucuaugcuggauuggaucccagggccucaccacaaaugcuaaacauugcuauaccacugagcuacauucuggauucaaaauaugacuguuacuaaugaucucaguagagcacagaugauguucauacaaggaaagauauuccucuccucauuuauaucgcaggggggaaaaaagauagcccgcuacuuuuauuggaagaacaaguagaccauugcuggaggaaagacaauuacaauuacugaggaaaacuggccuuuuaaaugugcuauaccugucuaccuggggucugagcaagauuuuaguugacuaguuccuucaagaacaacaaaauaauuuuuuuuaaaaaaaugguaaaaucuuuaaaccucaauuuguaaauuauaagcaauuaauuucuuccucauuuaacagugaccuggaagggcugcaauggacugaacuuguccuucauauuugccuccucaaaugagucuuauuugcuagggagcaauugcuuauguaaauugucugcugcuguuguuggcaaggcucacugagagugcugcaugcuccagggguucauuaggaaaccuacgugggcauuccugucucacuuacuggauccuaggaggcggugugugugugugugugugugugugugugugugugugugugccaugccugcugggauuugguacccagugugauuuuaguacuauagagaggugugccacaccccagagaaggcuaggagaguuagcaggaggaaugccuucccuugcagagccccuuaguguaccucuaaauuuucuuugagauaaaagcuauuccuaaaaaaaaaugucagugguguuccuagaguuggguagacuuugaaauaccuuuaugaagagcacuguacaaagggauccuuaguuauccuuuuguuaagugagcacuuucaucauguccucucauauaaaacuuugguaauuuuguuuuaugccagugcaggccuguacaucucccuuuguucuuuucuagucccccugccuguuggagaaugcagaucccuaggcauagacuggcacaguauugcaaccugugguuugaacagauaccacauuuuuagaaacacuaugggaaggaaggauagggugucuacuugucagaaucagcugguaggagcaaaugagguuacauagaaauguuacauggggcuguuuugcauaaaugugcucaugugagauguuuugagggguauagccuaugaucuauuuacacuguacuggggacauugagacacaauguuaaaaaggugacaauauuccaaccauugaaggcaggcugacuagauucuuacucauacuuccagaauugcaauaaugaagaccagcugguaguuuuagauaugauucuuuuuuaaagcauucucugugcaagauucuugcauguuuccaauuauugcugaguuuaaaaaucugucuuaaagguggucacgagcaacugagcaucacuuuguagcccaguuccuuggucauuguuucuuacaaccagauugugugcuaggggcaaaaggaagagggguagcucuucccuuuccuggcugccacucucucccuguagaacuuucaggaagacccguggaaaggucauuguuccaaacuuugggcuucacugcaggugcuuugaacuaccuuagaaaaaucucuucacuuuuaugagauucuguggcuuucacccccauuuuucucaggauuuugaaaacagaauccuuacaauggucacuguuugauaaaggaaagaagcugcagguaauggauguguuugagucuugucuucguguccuacugcugugaagagacaccaugaccaugacaacucuuaauaaagcauuuuacuggggcuugcuuacacuuucagagguuuugucccuuauuaggauagcaagaagcauggccguaugcagacauggugcuagagcagacccucaggcagcaggaaggaacauucuuacaacuugggccuggcuugaccuucuacaaccucaaaaccugucccccaaugacauacuuccuucaacaaggccacaccuacuaauccuuucaaauuucagcacucccuaagcauucaaauauaagagccuaucaaagccauucuuauucaaaccaccauaagucuuaacugaagguuuccuuguggaugcuuauauagucacuggcuagcugagaaaacagaaugggcuucuccuuccuguaucugaaucuuaaaacuguugguuggccggagucucaggaggacaguguacacaccucagugagggcagaccagcucucccauaggaauaugugagacacacgucagcaguccuaucugcuaacaauuuccagagaccauggaggagagccacaugagcaauagcaucuaaccuaacuaaaaguggauuccugacacauuguaaguuaagcccccauaaaggaaauuuuuaacagaagccagccaccaugugggacacauggugauuuauguuauguaugucucaaagucuaaauuaucuuaagcuuccaggugacaaagaaucuauucaauugcugaaaauaaaguaaaacaaguuacuaaaguaaaacaacaaacggauguggggauucaaagaaugguuagaaccaguaagcacaaauagaaaauaucacacacaugugggagauaagaauaaaagucaguucuguuauccucuuauaauccaucuuaccuaagaggcugaagcagaagccuuggaauuucaaggccuaccuaggcuuacaugaaaucuuuauggccaaccugggcaacuuaacuuaucaagagcacuucucaaauuaaaaaaaaaaaaaaaaaaaaaaaaaaaaaagaacugaguauauagcucaguugcagagugcuugucuagugcacacagaaccuagaaucacucaccagcaccacaaaacaagcagaaagcacagagguagcuuuggaacgucacuuacaucaaaacaauguauggaguccugcugguaugacuacagggacaagcaucuugcugcuggaguucaaauguguuuaaugugaauacuuuuuggcuuuuaguuccuagcuggguuucaauuauauuauagagcacuuuggagaugugacucagaaaaagaaaacucagauagagccuaagauccaucuuuuagaaaaggauuacuguugaaauuuauacuuugaacaauuaugauauucaguuugaauuuaucauuugaccuauuugagcugccauucagaugcgucucuaccuguuuuccccccuuuuucuugguccaaaaguauuuauaucuaaaacacaaauguguuacaaacacuuagaaccaguaagguuacauucuacugccuuaacuuuaaacacacuucagaaagcaggaugcaguguucucaccuccaacacauuugggauucagccuucucccuuaggaaauuaaagcaguggauguuauauaaaccaauucucccaugggauguaaaguaugcauuuaaacauauuccuaugagcuuggucgucaccugguggggauggcuaugagcuagagcagguuugaaauaaguggauuuaugucucaagaucaauucugggacuaguaccauguugagaggggaucuacuaagucaagcuuuaguagauuucuaggauacccaacucauccaaagagagacuggcaccagccccacacuuaaugacuugcagagucuaaaaaugccuuuaguaaguugcagacuuuucuacacccaccuucaacuccaaaaaucugaguuucagccugucucccauauauguucucccugagaaaccuuguuuauacuaguuguacacaccaugaaagacugguacaggggcuuagugugcugaggagaggggaaacuucacagaaaacaguagccauguaggaugucugagauggauccagcagggucgggcuagagcuugcagcucagacauuccuagauagacuucagaacugguuaucugcucugcaugacucauaaaaguucccuaaaugcacauuaacuacagugaggaucuguaggccauguucuaccuggaccccagucuugauuugucccuaucugaucaugccuugcccuugcucccauuucuuccuccccccccccccacccacccccccgcacccauagaaccaggaucugguugauuaauguucaaacuaccccccacuuaacccccagguauucagaucaguuauuucagcgcuuugauauaauaucauucucuaaauuccuugacagagauagauuuuuauuuaaagcuuuuuuuaaagacaggaaaguaaucggacuuauuguuucugaguccacucucucccuuucauuuacauucugacccugguuuguguguguacauguuuguguauguggaaaugugagaagguguuugugcagaugugccuucucuaacagcaagggcucuguggccuguaguauagcugccacaaaggggcucagaaccagaacaucccaggccccaagucagcuucuuugaucccuauguccaggcccuguugcguaaugcucacuggcaccauugcuaaucugacugcuccuagugacugguaccuuggcugugaaaaagagccccagauguguuuuacaauacugcagcuuuuuccagauccauagggagacaauguauuuguggacucagaacacgcagaaugcugcagcucccuuucuuguugcugauucuccaagguacuuuuuuugagaacugcacacuacaggauccugaaucacugagccugucuccauccuacauuucaaaaacuguccuaauugaugugugucaccuacacacauggccagggacacaggaaaugcuggugcagacaugacuggagcacugugaccucucuccaucagugcuuagcuguuacccagccuccagcacucucuucuuuguuagaguaggaguguuuucaagugugcagguuuucuguggccucaagauuccauuuagcaaaguuuaaauugugguaccugcucccuaccaaaaaaugguuggccauuuuuuuuucuugcacuagaagguuccucuguaaauccacugacacuuggcucacacccugugcucagaauucugcacugucuccagccaccaguuaggauccuacagaguuauccagguacacugacacccagagaaaucagagucauaaauagugcuagcggggauauucaguauaagcuguaaguuggcccaguauaccccugcaggcuugccuuuccuugucuuguuaucuagcuauuguagaggccugcagaggcuugccugauuaagaauuacaugcuacaaccaauuuaaggcuuaucugucccauguuugaacagacauacugucuggcagguaggcucauaguauuucaguaaccguuaugccugcccuuuuagcaucaggacucaggaguaauagguuaagggaaauuaguuuauuccuuaacugguucuauucaccucuccuuagcugucauggccccucuguugccuuggauacucagaugcacaauguagauccucccaucuagcccaaaggucuacccacagcaucuuccuguuaggaaguucugccuccaacccuggaccccauagucuuagccuuuucuguugccuuuacauaaugauggguagcuucagcucugacagacacuucaaaccaaggguugguauuccuaggauucacuguugucccuagggagaaaucagucccaccucuuuauagauuguccuccaucuaagauauaugucugucuucuggaugaggguugaggaagcugugcggucaagaaugugugugaagggacuucaggauuggcaaugucaaagaaguggaacagaaauaagcguaguguggagaugaugggugggugaguggugccauggcaggagcauggugagccuugauagggugcguaacaaaugucgucuucuuucucagaccuauaguguccuggaaauuauuuggauguacaggugacauagggcuagcuuugggagaaccaugggcucaaggagacauuagcacuucaauagaaacugggcuuuguaaggagcauuguccugaaagaauuaauauagagaugaguacuggcccaugaugggccucagucacugcugcaagguugaggaucuuccagaguucaaguguuucugacuucauuuucuaaacuucagggccuugggguuuauacuugagcugggauggaaauacuagucuuuuguucaacuccucacaucauagauggauagcugucucugaagacauuugugugacuucuagaugagcuaguggauuuaggaaaugcaggccuaucugaauggaagggccagaucaaagcuuguauggcuuguuugcaucaugcuaugaguguuggcacagaaaugcuaacaccggcuucaacucuuagauccuuacugcuagugaugucucucccuggccagaugguagcaccaaggaaggaaaggaggggagugaacaagaggggaggggagaugugaaaugugcuucuaacuccauuugguuuucgcagcacacucuggagaugccccuguuuccacacuuggacacuuggcaugaccagagagccagagggugccaaccugcuguccagccuuauguugcaagagugggguauuguugcagaggcacaucuuuagggaauacuugcuuuuguggcugucuacaaaggccauguuaccucaccugccauauuuggcugccaaggccuccugauauugcuggaacuuacuguaacuuuuaggagugucaugcauccugugcaaaaggcaaagagauucauauuagucugccgcaugggaagugccgaguggagcaaagcauacuuaggugacuucucuaucugugcaguuuagauggcuuuccuagggcucaaagccuacagcaaaucugcaagugagaccugggguauaggcaagguaugacucaguuauacaagcguacaggggaacagaaaucaccuggaaaacauccaggcagccagaggggagguucuuauugccaccaaugccauaggccccagaacaaccaccuaaacuaaagagguuacccuuguucuuguguugguuguagcauuaaucuuuuuccaggguauggaaauguuuuguuuugguuaauuuugcuuuuuggugcuugcuugcuuccuuugucucucugccccucccucucccuuucuccucugcauuuacugcccagaaauucuggucuuccugaaaguggcacuuagagacuuguauauuccagaaauacauuuuagugaguuggagucuguucaguggucuuuaagccaguaccuuuguguguuugggcagggguuggggggaggcagggggagucacacaugaacuugacugucucugaagggccaaaucaaagggugugaggacuguggugguuacuuuuacauucuugugaucagauggcuggcagaaacaaugcaagugagguuuauuuuuguuuaccaucuaagaguuuucauuuucaguucauaggcuuugccuccauuuauucugauaaggaagauuuucguuuuguuguaacuuacauuuuccauuuaaguaccacccccuaaagcuuccacaaacuucuaaaguaggucucuaucugggggccaagguuaaacauagaagcugguguuucguauuuagaccauaauaagaguuucuaaccaagcugcccaguggcaugacuguugguuuugauuuucagauuuuccuuagcuuacaauggaauucugcccugagagaccaauccuaugaugaaauaugguaaguuuaaacugcacugaacacagcuguauguugccauccuguugcugugguuaaaauaccauaaucagaaucaacuuauagguggaugaguuuguuuggguuuauggcuccagagguaugagucuaucaugguaaggaggcaugguagcaaguagugggcaagaaauggcagaagcaggaagcugagcacucacaucuuuaauuguaaacauuaagcugagaaagggaaccagauagaaugaggucauauaaucucaaagccuaacccagugguguucuuccuccagccaggcugaaccaccuaaagcacaccaaacagcacaaccaccaaauagagauuaagaguucaauaccugagccuacgaggaauauucucauucaaaccaccccagcacccaaccugucgagcaucuaaaugguuuaauaacacacgaguugaauucucaggugguuucccuuuggcauagugggauucucaguggcuacagcucucugugcuggauagcaaggugaaaagaacuagacucaagagcacuagaccagagaagaaccaaguucaaauuccagaaccguagucuuggcugaauaauuaucacuuugcaccaccauagacuuggggaaucuaaaguggaaccaccauaagucagagaucacuguggagacaucuggcucacagcugauuuuucuguccuaagacagacagagcccaaaacucagccuccaguucauugcgugaaauguuucuuggugggaacacucucugcagguccucugccauccaccagcuuccuucccacuuccuacuucgucuuggaggaguacucagaagugcaguguccacuuccagaggcuuuguuguuccucuuuucuugaccuaacuacucacccuaccuuccuaggcacuccuccuuacuggacacaucuggaccuaucgcuaaccacccuuucacaguagcuuccugcaguuccuuuuaccugucaucugaauguuaggauuguccaaggacaagguggcuaaauugaacaucugccucuggcugucucaccagccuucccugggcaucugcauucgagccacauaggacagagcaccuagauaggaauaugaagcuguugaaauaguaacuguaggcccucucgucucaucaguauugacuacuaaucccaaaacauguguuuccuuuuauccuuguuaugcacauauucauaugugcacaaguguguguguguguguguguguguguguauguaagcaugccauaugcccaucuuuaucucuagcuucuucuagauucuucuugguaacuuuauucagagcucagguuggcuauccagguuauccuggugguacacuccucucaaguucaaggucuucaauuuuggugaauucuggcauuacugggaccauguaagauggguuauuaagaauuuacguugacaaaacgugcuugagauccagagugcaagcuguguagauuuuaucauggaguaagagaacaggaagccuccauggucaugggcuaucaccccuuucuccauggugauugacaggcuaacucuguuuaauuagaaugucaguuuucauugccuuuugagcuugguggugugagucacagauucaugaaggaauaaugaggcuucaaugcuaaacauuucuuugagugaagaaucauccuaccagauaauaaaaucaagugguaaaauguacauuuacugaucucacauccaggcaaguuuuaacaaggauguucagaaaguggauccauauauguuaguuuguaaagucuggcaaccacugugaaaaagaaaauagaggcacggaagacuaaacagcauuacccugugauccagcaauccugcuucaguguauauauccaagauaguugaaagcaaaauauugauauacuucaugccccuguucauagccacauuauucaagaaaacuaaaauauggaagcaaucaacagauaaaugaauaaguaaagcauuguaugcauaaaauaaaauauugcugaaccauuaaaaagaaggaaauucugauauauguuaaagccuggaugaacauuggagacguaaguaaaauaacccagucacaaaugauacauaccagugguuaacccuauagaaacuggaaguaggaugcugguugcuagcaacuagcaggagggaaaauagugggcuauuguuuauugguuauggaguuucagauuacaaaaugaaaagcuuucagagaucccuuacagaguaacaaaauuacacuuaauucuauuugcacuauauaguagaaaaugguuaagagggggaacuucacgauaguguacuuuucacaacaacaacaauaauaacuacauuugaaaauauuaugaucuuaguuauuggcaaauaguugacagguuauacagauuaucuacugcuguguaacaaaccacccccaucugcauucucauggcucacuguguaaggauuuaaacagagguccauggagcccauuuaucacccucuguaggcuucccaaagguuugagauuggaguguauugguuugcucuuaccccagaauugggccaagcaccuacaugucugaucacugagcuugcucccagcacaguagcuuugaaacagucaauuuccauguguuacagauggugauacaugaacaggaaguuggcagccugcugcaaauaucuccaguucauacaaugucagcuccauccuguucuucuggucaguggcaagacuuuacaccagcccagacucaagaugaggccaauuggaccccuuagaggguuugcaauuacugucagucuaucaugaaaaguaaagacagauagagcacccuaaaauauauuccugggagcccagugcuaggcaaggcaauauggggaccuggaagaagcaugcgacauguaggaaauaagcuacuuggguaaaacaagauggcaucuccccucacaggaucaugacacauucugagggaacauagcauaauaguaguuaauauaagauguucaggagguauaauuuuaugugauuuggguuuuaucaaaauaaaaagaacuacauuagaaacuguaugaucuuagguauuaggaaaucauuuaacagauuuuucauguguguguauguguguguuucucuguguuuguguuuguguuguuguuacuuaacacacugucacccagacuccaagcuuauagauuccugauccuauagaucaggaauuugaauaaggugcaaggggacagaggguguaaucauguaauucacaguuucuaaggaguaugauaauuccauuauaauaaucucuaaaugaauauaagaagaauguauacaaguauguaaaaagaagccuggauaugucuagccuguggcugaauaccuuagcauugguaaguaggcaagccauagguaaacuaaauucauacuauguguuuuacauaaggaauugaaagcaagauuuaaaacauacaauuaguagaaauaaauacuugcaacaagugaauaaaagcccuguuuuagucauacuguuugccccugcucugugccagcauucuccauacacuugugcuuuacuuccaccgucuucccucccaagagagcucuucuggguuccccaagauuguagucggaaggcauuccucugcucucugagugggugugugccuucucucugugguggcagacuuggcucaugccccacagcagugagagcacuucuagaacaguuugcucacccugcauuucugggugguguuaaagcucagagacacagcugagaagaaugaagaacacucuaugccugggguguaggcuaugcugugcugcccugagugcacauguguucauauaagugguauugggccucuggacuggcccagaugcagaaugcugugucaagaaucaaaccuauacauugugcuggacagaggagagagucuaggcuacuaggcagaaggaauggggcacagucagaguuuagagaagcuagaugaaauguagacuuuugagguggcguuagauuguauuuuguacuaaugguaugaugcagguuuaagggacagcaugagaaacaaguaaaggcagacaaacuugucauaauuuuuuucaacugcugcauccaguuggccccagacuuaguauauuaacaucuuggaggauuagccuggucuucuaguaccaguuaaaugugagaacuaacuaaggacaucuggaccugggaaagugcaggcuuggaaagcuggggaaguugggugcccuuccauaauguuuccugagaguccccaugaugacucaccauuaggcuacacuauucuacaccacaguguggcagccuucagguuguuggcuucuuaaaugacaguuaagugauccagcucaaauguucuguuacagaugcagucaauacaaaccccucuuacuuagugucuuagucaggguuucuauuccugcacaaacaucaugaccaagaagcaaguuggggaggaaaggguuuauucggcuuacacuuccacauugcuguucaucaccaaggaagucaggacuggaacucaagcaggucaggaagcaggagcugaugcagaggccauggagggauguucuuuacuggcuugccuccccuggcuugcucagccugcucucuuauagaaccaagacugccagcccagagauggcaccacccacaaggggccuuucccccuugaucacuaauugagaaaaugcuuuacaguuggaucucauggaggcauuuccucaacugaaacuuugugacaacuccagcugugucaaguugacacaaaacuagucaguacaauugaccccuuguuaacuugacauacaaacacaucacugguaagccucaacccuuaguuucuuauucaucccuaagaucuaaauaacuuuuaaagucccacagucuuuacauauucuuaaauuuucaauaucucuuaaaauccaaagucuuuacaauuaaaagucucuuaacugugggcuucacuaaaaaacuuccuucaagagggaaaaacaucagggcacagucacaaucaaaagcuaaagucaaucuugaacgauccaaugucugggauccaacucacgauuuucugggcuccuccaagggcuugggucacuucuccagccauggccuuuguagcacacucguuguccucuaggcuccagaugccuguacuccacugcugcugcucuugguggucaucucgugguacuggcaucuccaaaauacugcaugaccccuucaguccugggccaucaauugcaaccgaggguacaccuuugccaauggccucucagagugccgagccucagccauucuucaugaccccuucgugccuccaaaaccaguaccaccugggugacucuuacacauuaccaaguccugcugcagcacgaaauaaaaccuaaguuaucucuggaacacagccucugugcucucagaaaacacuucccagaagaugucaccucaaugaugcuggucucuucuuaaucaccgcuaauuucuuaguuccagcuaaccagcaucaauagucccaguaaggaaaaguuuucacuuuaguaguucugguaucuuguuaaucacagcugauucuucagccccagcuaaccagaaccacagaaucuucacaaucuaaaauagcaauggcccugaaaagagucuuuaauuuucccucugaaauuucacaagccaggccuccaucuucugcacuguucucaacauuaucuuccaagcuccuacacaacaucugacagagcacuuaacauggauggaucuucuagcccauuguuccaaaguccuuccacaguccucccccaaacauggucagguugucacaggaauaccccacuaugcugguaccaauuuauguuagucaagguuucuauuccugcacaaacaucaugaccaagaagcaaguuggggaggaaaggguuuauuuggcuuacacuuccauacuguuguucaucaccaaggaagucaguacuggaacucaagcaggucaggaagcaggagcugaugcagaggccauggagagauguucuuuacuggcuugcucagccugcucucuuauagcaccaagacuaccagcccagagaugguuccacccacaaggggccuuucccccuugaucaccaauugagaaaaugcuuuacaguuggaucucauggaggcauuuccucaacugaagcuccuuucucugugauaacuucagcugugucaaguuggcacaaaacuagccaguacacuuagucucgggaagucacaaauauuacugcugcuacucuccuucuacuaaccucaaucccaccuaaguagacucagcaggaaggagcagacaccugugcugcuuacagggaagacugccaaacccacagauaguauuaauaugggauaaugaaggauaaaauucuucaccuucagauguaugauuagacaccaguacuaaacacacaaauauuuguguacacaauaagccuuuaagccacacggauucucaucaaaagauucaucucuguccguuuucaaaauuauauuaacuuuucuuagucuuaauuguucuccaauaucuuuaguguuuccaguuguucuuaaaagcugugucuagaguguggugcugcacuuggguucauaaguuagaagcugggacagagauggauggcaccaauuuuacaugcuguacagacacauuagucaugugaacggucuuggaauucuucaauuucaucacuucugaauccuuuuagugaaaugauagaugagaaagauggggaaaagauuggaaaugccaggucaucauuggucugguggcuucuccagacuuacacaagaauaggugucaagaccaauuacgauuuaccauuucugacuuuuuuucucuuuuguuccuguacuguaaaguccccuuaagcaugaagcacugaagcaaguauguaaauaugauacggguuacaauaauagagcaaaaaaaugacaaacaugagcacacaucauaguguucagaagcugaacaaucaacuaucuuucuucuacuagucucgaggcagaaggugcugacucagugcucaguggagucaguacuguaucucuauaaucucaugacuucccuguggcuucuucugucccagauaucacaucugaggucacagaaaauagagaagguggaaagaaucuuccaggagacucuuuagguggguccauggcuaccauugguauuaagaaaguauguaaugaacauaaggauuucccuuuucuagucuucuggggucaaggugaaggaucauuauucauccaagucaucccccaggggauagacuggagcagagguuucagggaaagauggauguguuucagacaacaauggauguguuuauaaacucagagagaaaccaacuagugacagguuugggcagagcaucaggcagacagauauuagagugaaaguucucugugcuugggacagugcagcuaguaagcagcuggauugauuuucacugucaccaguguccggaccacacauugagagcacccagguucacaguggcucucauuuuucuguuugauuccuuugggauuauuuaaaaacuaguucgccuucuguuguucagaaaugcuuuaagcaucucacuuacagcuuucugagcuggaagcuucuuccuugguguggggugugagguugugacacuuuugaggucuaaugggagcuuuuaagccucuagggaugccauucucaaugauuaauacuggcuuucagggugaauucggucucagaauucacuggguuaguuccagagggaauagauuguuauaaggaguaagcccagacccuccaaggucucuucuuuauuacgugagcucuuccucuuacaugcauucccucuguaacaucaucaccccuaccagagcugagcugaugccugcuccauuggcucucccacacugugagcuaauuaggugugugugugagggaggggggguaucagccucaaguauuuugcucuagcaacaggacacagaccgugacacaaacaaauauuuuaaaaaugcuguagauugaagugaagcaaucaugaaagaaccaccagcagcagucgauuacuucagcauucaggaggcagcauauucagacuuguguguaugccagacaccugggcucugcagaccugcagguuauagaucagccugucuggauuggagacugauagcuuguguuucuaacaggugccaggugcuucuagcucaaaggucacaccuuagcuagguugggaaaggcucaggugaagagaagggacagggagcauagacaaguauguuggggauauauugcaaagggagguagaaaccauuucagcagaagaugcugacaacagcuuguuguguuccacaucuguuuuuacuugcuguaaaaaaacacucauauaaucugaauuuagggucaaggagcauuguguguuuaaggucaucuuauguaacacuacaauaaaaacaaauacuuaacauccauuucauuuaugcacuuggaggaggggaauaaauguacaguguggcaucucuacuguuaucuucuuuggaggcagaguguugaaaggaggcuuuugagggacugggacaucaaugccagcucugucccuucccaucuacacagcccaccugauaaccccacuuuauaccaaucaggcaaaacagagccauagguuacuagaggagugacccuaggagagaugacaaaaguccagaagaccaacaacaguccaaaagcuaggucagaaaacucaguucuuuauccucugugcucuggcuucucuaguccugaacuguagaugaauccugugcucuuaagggaagagaaggaauauuuucaaagacaguauguucuuuaccauauagaagaauuggguaaaauaaugacugcauaucugcaacaugugcgcacauaugucccucuguguaucauauuugcacuaaccacuugucccuucucuuggagggcuuugcuuuggcacauggugggugauugugaggaggacuucacugacucaucucacuacucugcacugucauugccuuccacuccucccugugacucagccuggaccccaugccugucuuugaccaauacaucuuauuagaagugucagugagucuguccugaauaugguauagcugacaauucucacugccagauaccuagugacuccacuuuaugccaagcaggcaaaacagagccauaaguuacuagaggagggaacccaggagagaugacaagaguccagaagaccagcaucacuccagaaccugggucagaaaacucagugacugcugcuuuaacccacccacucaguguucucuuguguuuccuagcaagucaugacacauggcuaggaaaucaucuguauucauaagacaauuaaguaaugcaguccuaaugcuaucugugagcaagaccaccauuacugaagggaguguggaaaucauucagcuagagcccuucaguuucugcauagaugcuguauucacacccauacagacuugggagagcuaaacgaaacuuaucauaccauauggaugcagguacuuucuagacagccucaccuuaccaccaauacugaugucugccuauaacugaucauggcuuucacugcuugacagggagcugagaaaagccuguugaaccagcacagcaguugaguggucauacuuuauuugcuuccugugagaagcagaggacucuuucauauuggagcuguggcuggggggaugcuaguugggcccucugugcuuugacugauuccugcuuagaaaguggguccugguuccugguuuuagugagugccuauuccuccagugacccuaagucucuuaugggccaaauacuggucuucaacacagucaccuaggcagagucugugccauauccacucccucugaaagggugacccgucuugguaguccuuggaaggccuuaugauuuucuugaaagacugagagaauauacugaggagcaacacugaacaaagaaagugugugcuguagcuggucuuuuuauacuucguguguuuuucuuucuuucacucuuccaccuuccccacuccccuuucaacuucaaacacuaacuaggagagaaagggauagaagggaaaggaaagagaucccugaauaaauucagggaucagaaaggggaaccauuaucauuagaguacuuccugcugauuggggauguuuaguuccuuggagcaaguuugaucuuugccuucaggauaucuaaugucuucuuguugcuuccuucuuugugcacuacuacuuaacaaaccacgacucacagcaaccagcaacucaccaaacucucugggucuuagcauuuucauacccucugaaaaguccucauaauuugcaacaucacacaaccacagaaacuauccgcagcuggcaaaaucacgccucugcuagggcaggaggcaaaucauacucagcugcugcaaagcaaucucauauccucacaccuggcaugaaaaugaaaacauaugcuuauaauguuucuguguuuuguaaagaaaccaaaauuccagaauucucauugcgcugugccauauuuaaggucacggagaguuacugagagguaauagaacacuagacuggaaaggaagggaauaggagaggugggcccuagaguguggguuccacuaagcuuccacuguggacaagauaacucucuguugucuggucugggguucuuuucuggugacuuagaggucuugugcauuuuuaaaccuaucuugccuguaucuuucuaaaccaaauaaaauaacaaaaccugauccggacccuugcaaggcacuaguaugcuuuuuguuauuauaaugaaagaccugaggcaggccaacuuugcauagaaauguaaguuauuuucuauuucauacuuuuggggccugaauaugcaaauggcaugaugcaggcuagaaagagcccugccagaagcaaauaagagugugugugugugugugugcgcgugcgugcaugcacguguaugcauuccugugugcuuguguguguguuuaucuguguguguguguguguguguguguguguguguguucaugcaugcauguguaugcauucaugugugcuugugugugugucugugugugugggaagaagugaggguauaauaauucugagggugaccuuugugaggauguucuacuaggccagcagcguguuaaagauccccauuuccagcauagaaacccaauaucuaaacauaugaaccuuugcaaaucaaacaauggacagacccaugcaucuuccuuagaguugggcuguucuggucuuugcauauaccucauugccuaccaaugaggauauguaaucagucaauacaaauucuuccagcuacaaguuuccuggaaaggaauucacuaaucucgucucagcaccuggaaacucagaccucuuacaaacagccuuucuguucucacuuuuccauuaggucauaucaaggauaugucugauuuuccugccuauaagcaagguccucuaagccuugagaaacaacacauuucucagaauggcaggcauuuaggagaugggugugauguugguggugugucuacaugggauuaagacauuaauuaugauaacucugcucugcuaacucuauuaauaauugauacagagaaagccuaccaggccggggguuaaauaggcauuuuggaaauaucaaaaugcugugauguccucagaaaaaaacucaaggaaguauuaggacaucacucuagaacucuuuuucucuagccagugucaaagccaauugcuuugacagaauuauacaaacaaacaccaugaaucuagaucaguucuuucccucccucugguaauuagcacacacuuguaaauugacucugaaucuugcuaaauauuaacuucuuuacagucaucauagguuucccauuagggacaugaaucucaguuaaaacacaauuauguauccaucuauucaucaaucuaucuaucuaucuaucuaucuaucuuucccccucuacccaucacucuguacaguuguaaagcuuuuucuugguuuaaguugacuuauuuuaacaagauuucccucugauauuacauauucuuugaaaacuacucauauuaaaauacuagaugucaggucccaaagaacucaggacagguggcuaacuggugccuauuagcauacuaaagugggugcuggcucccaggcucacucaguacauguggcuucucucagcuccucucaccccacuggagcuacccaaacuucucuaguaugcuucccuucccuuccucuaguuucugauuccuauauaacccugcuguuucuaccaugggcuuuuuugguuucuuuugcccucucauuucuugguccucucuuucugucucccuugcccuuuuucuucucuuccucuuucauccccaaccccucucuuugcauggccuguuucagucugcauggccugguucaguugucugcuggucauauuuguucuacugcuuucuuucccuacucuggauucuucccgaugccucugguuguacauaucuacauagcuucauaccuucauaucuacauacuuuuauaucuacaauaagaauuuagcagauacauuccucuacaaggauguuuuaaaccaugaugcuuugaauggucuaugguccucuaggagcauugccuuuuauuucaaggaaaugacuagggcucaacccuggcaguugccuauggcaaauaaagucauauaauagugaaagcuugaauuccacauugauucccauaaaacccacaaaccuaaggguuaagagcaggugucacaaaccuagcugacugcucugcagaugaaucucucaucccagccagguacaugcacauugaaacaaguauucugaaaagcauacauaggugggaaccuuucccagaggguuaggcuucucauuugaccaauaaaugggugauuugaugugccguuuuuuuuuuuccucuagugcaugguauucaaaauuaugacuaauaaaagggcucaaugggauggugggguuuucuugguauuuuuuuuuaggaugugaucucucucuuucucucuccuaucugugugugugugugugugugugugugugugugugugugugugugugcaugcaccucugagugugugugcaguguuuuuaguaguaugaauagucaaaagaaaacucacaaggauaguuguuggaggguauguggaacagcauaugugcagucuggaaacaguuuacuuagggaaauaauuuuguagugaagauccugaagacaagagugaucucaccucucaaagacauggggagcaucagauccuagaugcacgagccuuuguaugguacccauauggaaauccauuuuguaucugguacaggugaaaacugaguagggauguggaugccaauagcuggacacauacuugcaaaaacccuucaagcaggaacagugauaagagaugagcuuagagcauccacaagagguuagauuaucugccagguugauagguuuguacuucauucuaugggugugaugagggcuuggcaggauguaugcagugggaaaaugggaugguuggcuuuugugaaguagucacagacagggaugaguaugaaaguuuuaaggcaggcagaagcagagaccaaguuacagauaguaggugcucuuuucuagaugauauaggccagacuugaaucagaguauugccuuuuggcuauagauggacauggguugggcuacugugacucaggaugacucuggaguuucagauggagugacugcauuguaaucuucauacggacaagguugcugccucuuuugcuuuuguaaauucagcaucugauaucuaacccugagccccagugcuuggaaugugucuggugcuuucuguauaguugagugaguagaaaaggugaugaaagaaggcagaaaccuuccuucuguauugaaaccuguauaagaacuuuguuccagugcuaaugugagccagucauacuuagaggguuagcaugggugggugcuaaugaaggcacuauuaacaucagaagaguccugaguccuaagacuagugguacucauccacccagaggaggaucaaguucuguuuccucaucaccugaacauaugauaccugagcagaagauuggcuugugguugaggaguuacauagagguugaaagauauaauaacaaaggcuucagagucaggaacugccugggugcucaggugaaugaauuauaaaucaaucauacugacaacagagauuuuauuaauguccagcuggaaggcuccaagguuagcaaugugaugguugaacugaggaagaaaaaagaaagagagccuuggaggugagagaccaagacaauccagagcuaguaaguuagcaaacauugacauuacaaaaugguauaacucauagugaagagagaaaggaccauucuuucuuggaacuugucuugacaaugccuuugguauugagcccuaacagaaguuagggacaggaagagaaaagccagucaacuggaauggagagcaacugacagaagacagguuacagaguggaaauaguauccagaggagcaggccuucucauuccugcugcaauucauguccuaggugggguuggcuggcuccccacauaaaccccacuguagccaggcagugguggugcaugccuuuaaucccagcacuugggaggcagaggcaggcggauuucugaguuugaggccagaccggucuacagagugaguuccaggacagccagggcuacaaggaaaaacccugucuugaaaaacaaacaaacaaaaaaccccacugagaaggcagaggagaccugaaguagcagguacuauguaguucuugauccugugaugucuccauguaagaacuuggcagugcuaguuuuauccuaaggaagaccuacagguccuucuuauaacuuugcaguguauaagggcucuugugaaguucuugcccacucuguacaucucugugucccuacuuucuugggagaaaaacauacuguuuuauucagugucugagaaacuuugauacccuguggguguguuuauuauguagauauuuaacuaaauuguuagauaaccguuucuagucacaaagacaacaauacaugaacuugcaacaucuuguaagcuaacaguuguuuuauguacagcacuaguggauuuaagccaagacaaggauggaauaccaugguccaaagggcagacuugcuuuucuagcaugggauauuuuauauuauauuuuguggccuguuuaucauaagcaucacaagaugacaaguauuauuaucagacaagacaucagugccaugguaugcucuaucugucuucagcuugcugaaggucaacucuagacuggucuagaagauccuccccuucaaugccauuuuugaauacgacauucaucucucauuguugucucugucuugguccauaucucagaauagcuucauguauaagcugagcccauuucugcuugagcagccaaugcuauuuugugaugucagugagguagaugaucucucauggucuaugauuuugaacucauuauggcuccuaaacgucaucauguagagcucuuagaaagauggagaacacauacuagguguggucuagagaaaggaaguuaggccauguccuugaaagugacauuaguugaacauuucuuuaggugcuucuuggcuguuccauauuucucaguugaaaaaucuuuguuuagcucuguaacccuuuuuaaugggguuauuugauuuucuggagucuaacuacuugaguucuuuguauauauuggauauuagcccucuauuggauuuaggauugguaaagguuaugcaucaauggagagagagguccuugguccuagaugccccaguauagggaaaucaagggcggggaggugggaguagguggguggguggaggaacacucucauagaagcaggaggagggaggaugggauagggggcuuccuggggggacguggaaaggggauaaaauuugaaauguaaauaaagaaaauacccaauaaauaaauaaauaaauggaugaaagaaagaaagaaagaaagaaagaaagaaagaaagugacauuaguaucuguccucuuguuucucuuuuacuuaccaaaugucaugagauagcagccuguucugccacauccccacaggauguguugugcuuccaaaggcccaaagccauagauccaauagaccacggauggaacccaugaagccacauaaguccuuuaagcuuuuugucucaagcauuuuacaaaagugacagaaugcugacucauuuacugaaaaggagcaugaggagggcagcuuugacucacuguacugugucccugagauguaccaaacuggcagccaauaucaaauugugauugcaacaaguccacgaaggaacagccuuuucuccaaauacaggacgguuuauauggacagaaauagguucaaaucuuaggacuuggacuugugcuucaaaguccaaaaugcaggaguaacacaauugcaaagcuguuggggauuuaagugagaccauauuggcaaacgucugcuaaagccuggcagcauucuacguaaauaguggcuguagcuaagugaagguggcuauuauuuuuacauugaaaaaaaaaaguccuaucuuaacugcauggcucagaaacagccagagugugacccuguucccugccuuuucguguguauuuuggguacaccuaucagucucuauuagcaagccagcuggcaugucaacagggauggcacugaaccugugguucaguuagaacaucgguucucagccuucuuaaugcugugaugcuuuaauauaguuaaugcuguagugaccccuaaccauaaaauuauuccauggcuacuccauaacuguauuuuucuauuguuauaaaucauaauauaaauaucugauaugcaggauaucugauauguaacccauaggaaagggucauucaauccccccaaaaggguuaagaacugcugaauuagaaguacuaucaucuaagauaaagaugaaaagcucacugucacaaaguuuucuccuuuuauuuagauucccuguuauuuguuccaaagcugcacuagaaaggaugugaguuuugauugaugcuaggaaaccuagauguagguguuuaaccuuaggcaagauaacagauaccuggcuucccucaccaucugcuuccucaccuauaauaugaacaccauaauucuuccugacugauguuggcaagcuguccacccaggaugaugagugucuguggcugagcaauagugaauucuacuccucccguuacucgaugggcaguaaaguuugauacuaaaucaaauguuccuauaaaaguucauggagguggguaaacguauuugcuuccaugcuggagacauuuacgacagucucaucuuuauuuauuuuucaguggcaaccuuuguaucucuuucuaauucucacauucuacccaauuccuucauaaaaacaacaacgggacacuuuugcuuuucuuugccuuaaaucuagcuuuagagagcacauuaaaggguuuuacaauaucuucacaagcaugauucaguucucuuacgaucuuacugucagcuuguacuuucuuagaagcuuacaauauuaucugaauuuuauucuguuugucuuuuuuuuuuuuaaaugaaaagccuuggauaguugguguccagacuugacaaccaacaauucuuucuauuuuaauucaguuuuuuuuaacaucauaaauaaaauccuuagaguucaaaaugauaacaagggucugaguaccugaugagaaagggacaggucuugucuucucuauggacuguacauacuauaaggaaguaccagauaauuggauggucuugugaaaccaaaauuuccuuaguaauauugauucuuugcuaaaaguuugccagauaccagguuuuagaugacccuagagccauugcuucugaagagaaaacccagaaaguuggugaaacaucccaucuaggguuucagaauuuagcuaaugauacaacaaauauuugaugauuauauuguauuuugauuauguaucucaucuguagguucacuacuucuggaauuagaugggaaauguuggcuaaaugcuuacaauuucuggucuucccagucuauguuuucugucuaugguuuuacauuagaagccuaacacggcuuuuccuuuuuuuuuuaauauuuuuuauuacauauuuuccucaauuacauuuccaaugcuaucccaaaagucccccauaaccccccccucccacuucccuacccacccauucccauuuuuuuggcccuggcuuuccucuguacugaagcauauaaaguuuguguguccaaugggccucucuuuccagugauggccgacuaggccaucuuuugauacauaugcagcuagagucaagagcuccaggguacugguuaguucauaauguuguuccaccuauaggguugcagaucacuuuagcuccuuggguauuuucucuagcuccuccauuggagcauccacuuauguguuugcuaggccccggcauagucucacaagaggcagcuauaucugcguccuuucagcaaaaucuugcuaguguaugcaauggugucagcguuuggaagcugauuaugggguggaucccuggauauggcaguaucuagaugguccauccuuuugucucagcuccaaacuuugucucuguaacuccuuccauggguguuuuguucccaauucuaagaaagggcacaguguccacacuuuggucuucauucuucuugaguuucaugcguuuagcaaauuguaucuuauaucuuggguauccuaaguuuugggauaauauccacuuaucaucgaguacauauugugugaguuccuuuguaacacggguuuucauacagagaagaagucuuugcuguccaugugaugcauagacaagcuaggauaguaguuacucagcucuuucccagaccuuagcccagggugcuuaucacauagugaugugaaagcuuggaccagaagaaagaauugugcugugagcuuagaagaaagacucaaaucaccggaguuuaucaggccaugacacagaaaguugugcauauugauggccagacuugauggcugagacauaugcagaccugaggccaucuacacacccuugugcugcaagucacccauugcuuccaagguacccacauugucuucuuguaaucaagaguucuaagaacacuuaagaaaacauauucauucuucacagguacuuaggaauuuagccuauauugucauguauagacacugauuucagaaaauaucucagacuugcucacuuugcaugagcaaaacuugguaccauucgaccaauaucuccuugucaccaccccugugauuuccagccucuguccuucaccauucugcuuugcuacauccauaaauuugacuacuuuacagucucuauaucauguauguggaaucuggccuaugucuuaguuuauuuaauacauguccuccagguucaucuauauggccaauagaacuguugcuucuuuuuucuuuuucuuuuuuuuuuaaagaggaaauacuauuccgccauguuuauguaaucauugucuuuauuuguucauccauugaagaacacuuaaguugauuaugaaucuugccucuugcaaauggcccugcagggaacacaauucacuugugucuuuccagagaccaauuccauuuccuuuagauauauguccaguagugggauuucugcaucauacagugguuuugcaucucucucucucuuuuuuuaaaggaauaucuacacuguuuuccacaaggacuguucuggucaaagaucuugauauucaugaaugccaccauuugaaggagagguggaaauauuuauugaucugaugauguucugacugguuggaacaggaacaggaaaugagguuuucuauucucucauuaucccaccugcugguacucaguuauuucaggagccauggaagauaauugguucacauucaccacaguccgccucugccacccagcaaggcugcaucacaugcuguccauaagcacagucaggacauucacggauggcuguggagagcugccaaugccuaccagccuguaguggcauaaguacuuaaggcacagaauuuugauuauguggcguguauaucuugggaugguuccugucuagguuccauagccuuucagagaauucuuaugguacauauagcuucucucaauggcuuaucugagcagagcugguuuggugguagcagagacggcaaggaccagauguauuuguaauaaauuagcaaagagcuacucuccugucauggggaaauuaagucauaguugaaaucuuuaugaacaguuuccauauauaaugcugacuucugauuaccggccaagggacugaaaagcaucacuguauuauaaauuaugucauugcaguuuguuucuauuacucuaaucaaagcauauuucaaauacauaucugugcauuuugaagaacuaugaucacuacccccaugcuuaguggaaaguaaagugaccaaaugauggauguuaggaaagggaaacagaaagacucgggcagccagcccgucacugaggauggguuugcgaccagauuucaaagcuggugccugugcaucugagcaagcaaaagcaccaggauaggcugacaucucugcugccccagaggauguuugacucacucaguuauaucucauaaacagcacauggaaucaugccaaaaauaaugcuuacaucuuuaaaaguaagugaauacuguuguaaaguguuauugauagaaaguggcagaaaaaaaaaaauugaaaaacccaagauguuauaccuacuauguaccuuccauccuugaccccauaaauggaugggccccauauaacaggcccacacacucuauucagcuaaugaucaguauucauacagucuaauacaaaauucauagccucacuuaaaauaugagugagcguguguguguaugugugugugucuuaaccacacagauuucaacaguuuucagguauuaauguuguagaugacaacaucauuuaguaagggcaggaugcugagcacaccuggagagcagaugugaacagaauuucuguuagacagaaaacuugucauaaaaacgcuuucucuaagauuacccuaaaaagucucucuuuggagauuccaaguaccucacagauaacuucucuucuaaugucccauagcccaaaucuucuccauaaauaauggaggaaagccuuaacuaccugaggcagaguuaauaucuucugagaguuguugaguugcagaagugugaagccuucaauccagagacucugaaauugcagcaucuauugaauaaugucaacaaagcucccaccaagccucaacaaguaucucacucgccacgggaugcucaguggccagagcucucucaagaugcacuacccaacacucaccagagaaaaggcaucuugguacaggagcugaggcuggaggauugcaaagguuuaaaacuuugguuacauaauaaguucuagaucagucaggauuacauugugaaauaauaucucaaaaacuaauuaaaaaauacauagaaaggcaaaaaaaugcaucugaggucaaguauuugccacaaaagcaccuuaaaauauacuuuguacuucacuaaaccugaaugucuauaaugacaccuauuuguguuucaucugccagagauucuccaguaaaauauuuaauuguaaaugacugacaagcuucugcugcugcuggagaguuugucacuuuucagguaccaaacucaucaugaguaguaacaaaggcagugcagcugcaaucuacuaggacaauguagucaaaugugggacauaaaaccaugccaggaaguuugguaagguagggcaaguugagaccuggagacuuggugggcacacaccugaggcuuaggggacucccaguucccuuccagacucaacuuggaacgcaugugccauacuucucacauaaaagaaaugugaccacacaucauguaggcucaagauuuccuucccagacauucuucccagcaaaagguauuuaaucucaggcccacccugagaaguggaguaugguuuuacacacccacuuucugccauaacaauaaacuauuuggaaucauggacugccucuuuguaucaaaaugcacuguugggauccauggagaaggcccucgcuccagagcugcuacugaguccccccuagaaggccucucuacacucucagccauaaccaccaccugucaagccaaggacaaucacugugugaccagcugaagauccccuuccccaucuccauucccaggcuagacccagcccaagggcccccacuuaguucucugcucuucucagguucccaguagugccucaguguccaagggucugagaaccccauggccucugguuuuguuacaggcagauccagcagcaauguggggguaagugcacucaaacuccuugccaccaugcccagugguggagcagaugcaggaccuauaacucuacagucgaaaacacuaauguugaucuauuuggcuccuaggaugccucuaguggacccuugacaaaucuucccaccacuucccuauaccugccuugcauugcucacuuggguuuaucauaauagcuuccuuagaugcucucaggaaaauguuucuuugggccugaagcaagagagcagccaagaaaaugacucagugaauaguaauggucugaccaaugugacucgcccucacaaaggauugacugggacuaucaaagccaaagccauggaaaucaugucauuuaaggaaguguccugggcuauuaaccauauagaaagcaucgaaucugaucuagggauacucagcugcuuucugauuugauaugaggccagcuccacaggcaagaauucauaaacuuggucaagagacuuuugcuagggagaucuugggccauugggaaaaaaauuuuccugcugauauacuaagcaguccuacugucauucuaccuucuaaagauuccugcuuauaccuguagaccaguguuugaucaagcauucaucagagaagcuuaagaccucuguaaaugguaguuacuguaacaguggguagaauaguaaugguagcgugcuugcuauuaacaucuauaacucacccuccaagguucugggaacaucacagcaugggugggaagaaaggaaagaugggaagauguauagcaaaaacuguauuuugguuauggcauaaccacuacauuuaggaacucaacugaagucauaguugcacaagacuuguacacaauuggcccauuaacauuucaucaugaauaaaggaggggaucaugaagccugacuccucccagagggacuauuggcaauuaacaccuguuggggguaggaguggaggcugucacuuucuccagugguggagccacagauaaguggcccuugcuugaccaaauaauuucccucuccaucagguaaccucuaauuccucaaugagccacagacaaaaauaagacauaaaaguaggaaggagacucauuaaacaccaggagagagaaaguaguguaggaggaaaagagagggugaugauaauuaaauuaaguacauaaauuuaugaaacugucuguuuuaguuuaauaaaagugucuguuuucuguugccaugaagagacaccaugaucacugcaaugcuuauaaaggaaaauauucaacuggggcuggcuuacaguucagagguuuacuaguucguuauaguaaugguguaaaacaugguggccugcaaacacaaauucuguugaagagguagcuaaaaguucuacaucuagauucacagacaacaggaagugucugccacauuggguguggcuuuagcauaugagaccucaagguccaccccuccugccagugaccacuuccucuaacaaaggucauaccuaccuacacuaaggccauacuuccuaaaaguaccacuccuuaugggccuaugaugaccauuuucauucaaagcacaacauugucuaugaugauuaaaaugagagugguccccauaggcucguguauuuuauuguucagucccaggguggaacauuuuugggaagaguuaggagguauggcauuguugaaggagguaugguacugggaacuggcucugagguuucaaaagauucucuucauucucaguauguucucccugccugcuguuuucaauccagauguaaccuguaagcucucagcuacucugccaucagggcuucuugccuuugaagaccauaagcccuaaacuaaaugcuuuguuuauuauaaguugccuuggucaugguauuuuguuaaaacaaugguaaaggagacagaaguugguacuaggaagugggcuguugucgcaguccuaaccauguuuguuuugaaggaaucugaagacauugggacuuuggacuagaaaagugauugaauauagcaagcucaguuuaaauggccaucccagcaggaguauggaagacaguggugcugagagcuguguaaacuguacagcccuugcucaaguuacuucagggggaacaauacuagcaaugugacuacagaacacucagcaaugaagauggaugcuuucuucucauuuccuaagaauuugccugaggcuaaacuggaaaaaacaaaaaacaaaaaaacaaaaaaaccucucccccaaccugcaaggagauuucaagacaaacuaaauucugacuuugucaagggguuauuaguaaucacucuuauggagguccccaaugaaaaagacaaagugcuguaaaagggaauauaaaauuuacaauuucaggaaaaaaauagcacuaggaaauuuaauguuggaggcaagauuugugcugaaaaagaugaagugaauaaagaguggggucuuccgugcaagacuccacccagcuaagcuuccaacuuguaaaaaaaaaagaaggccagaggaauuuccuccuccuaaaagcaacaaagaaaaaaugcuuaugcaaaugaaauucaguggaacccuguuucaucccaagcaggcaguugaagcuggcaauuuuguccacuuagaaccauuaaggauacacaaauaaaggggucauggaauccucgugccugguuaagaagaaccgaggaggccagauguauggcaaggaaugcauaaauuuagagucugagaggucauugcauggagcuuugaaagugaagcacugauuacauuggagauuccgagauaucggagauacuagagccuugagacaucugccaaacagaguugcaggugaguaagagacaauccaaaagagaaaaguguguugcagucagugaaucuggaaaaguggggcuaccuaagccuuuugacaucgggcacggagauuuacugaguuuugaauuuggcccugccagauuuuggcccuccuucaauccaauauuuccucacuauggccucauuucuucucacuuuuggaaugguuauauauauuuuugugccauuguauguugaauggguguauuauuuuuuauuuuauaaggaguuauauauaauauguguguauauauauguaugcauacauuauguauauauguauauauaauaaaugggcauauauaaaaauauguauuauaauauaauauaaauauaauacauacaauaaauauauaauaaauauuuauguuuauuaauaaguaauauaucuauauaauauguauauauaacaaauaauauauauguauuaagauauugccuuaaaucuaagaaaaggacuuugggcucuuaauaaguguugagacuguaaaagacuaugcagacuuuggauguuagauuaaugcaauuugcacuaugauacagccauaagucucuggaaguuaggaaguaguggucgaugaaugaaaauggcuuccuauaggcucuuauauuugaaugcuugguucccaguugauggaacuguuugggaacgauaaggagguguggccuuguuguuacaggaagcagauuuugugguuucaaaagccaaugcuauuccauuaugucucucugcccugugguugaaucuuaacauaagagcucucagcugcuauuucgacauuaugccugacaccugcugccaugauccccauugugauggugauggacuuaacccucuuaaacuuugaaucccaaauacauuguuucugcuacuuguugccuugguuaugguguacuaucacaaugauagagaaauaacuaagaaagaagcuaacaauuuaaaaaugacagaaaaucaaaguagaaagcaucaaacccaagccugcugaucagaguuuugaguguaguucacugagacagaaugucauaccagcuucucacuaauauauaucugugcacagcccacauaugccaagauugaagccuuuggcauauuugggagauuguucaccgugucgccaggcaugacacuuuuguuagcagucuaauuauuccaucuggcuaagacacauugcuacacacuauaaaggaagaaugccucaucuacuuauguacuucucauuuguuaauagacacacacuagagacaaauuugccauuuauguuauauaccaguaagcuucuaccaccacaggcaaccugaauguccauuccacaaacuagggccagaaaaaccucugccuacugugggaagaagcuggacacaauuaaaagcaguaucucuauuagcucuauuagcuuuagauggaaaaucuuggagcuguuccccccaagaaacuccuguacccauuacugagcauaaccucugcuaugaagagccaccauucaaguauauuuaguugugcucuagccaugaagaucaguggucagugauccagagugaugcuauuccuacuauccccaaguccauguaggucaacuccauggugaucagcaucaaugucuccaagauaggcagcuacaaauuaaguaucaggggucauguggagaagccagguguuccuggcaguauggucaaucaccaauucccucacuuccuagaagaaaacaguacauagucagcuaagcugaaaugaggaagaagggucagcugcaaccagagugacaccucuagaauuuguuggguuuaacuugguuugaaugguuuuucaacucauguccucuucuuguuuucuuuuucuucuaaauauaaauauacaaaggaugugcauaguugugaauagagccuugagcagucccacaaucauaaccauugcagaaaaaaguaauagugaaaaucaaaaauagggggaaaagagaaaaauaauuauaacaaaaccaacacagacaaauucuuuuuuuugacuuuagaaacuaacgcaccuuggaaacugacuuuguuauuugcacaaauucuaugcacaggcauucuguacaauggugagaagcuguuuucaaagauggccacccauuucaagguaaaauauuuguuacucauuugaccacaguggaagagacaucuauuuaguguacccaagggagaagguacuuccagaguaaauagacaaagucugcuaccuguauuagaacaguuuuguauguccucaaccuauauuuauuuauuuuauuacuguauguauauuuaaagagaaaaaaagagaaaagcuagaguuggaaguaaccuauuuccaccaacuuuagagggaagaucuucaauggaauucccuuucaaaaugauuucauuguacaauguacuagggagggauuguaagccuguaauuaaauacaguucacuuugaggucuguaaguaccaacuguuacccacaucacucaaguaccuuuuucccagaaccaagaagggguaggugggcaccagagugagauccucagacuccccccacccuugugucuccaguaccuacucuguugaagaacuaacuccaaaaaggaccauauaguaucuauauuauuauuuauuuucuuguuaaaauuuaugccaagaaguggaagucuuucugaaguuccuugauaauugcgugaaggcuccaagauuugauccagaaaguuguguguuugauggcauuaauuuaccuaucucauuuauuauuauuuuuauuccuguccuuaguuuuuuaugguaaaguauucccagcccucaucuuaaacccaaggacugacauaucaaucaacaucuauaaauucaugaugucuugauuuccuuuuuaaaauaauuuuuccuuucuuauuaguuauuauaacuauuauuauuauuuuguguauauguacauauguguacauaaagaaggugugcaugcgacauggaaugcauguggaagucagaggacaacuuuauagagucaguuuucuucuuccucuuucuguggguuccagggacaaaaaucacaucaccaagcuuguaugauauguacuuuuucucuacugagcuaucucauugucucauaauugucucuuuugcauguaauaauauugaacagacaauguagccuuguucaaaugguuuaaugaagaggagaaaagagagccggcuccuccugaacuaagcaggacuguuugguugaagaucuuuucugaaauaagggugaacauuggccagucuuuuagcuauugcaccugacuuuaggauucaauucauuaccaaguuauggcuggaacaggagguggccaugauagggaauaauguucacuugcucacuguuuacaaguugaugcuauccauuaggguuucccauguuucgugacuaugugaucuacagagaucccguaacuauggcuaauaguuaauauccgacucccuaauaguuaaggacagaggaucuuacuugugagugcaacuucuaucccauuuucauuaguugcucuacaauauuggguuguugugauauuccagugccaacauagagaaagugaugugucuaauuggcaaauggaagcaaauauccuguuagucagcucuucaccaugauaaauccuuacgaucaguaucacauaaguagaaguuuugcuccauuguuucugaaaucucagucuucauucuuuguuacuuuggguggaugcacauauuagaaaggagcccccuuaacucaugguaaccuggagggaaggaggaaagagaagacuguauuugaauaaccucugcaaagauaccccuauaguaaccuaacuugguccccacaggcuacuucuuaaagucugaccaccuccuggaagcccugugcugaaggccaagccuucgagacaugggcauuggggaacuuuuaaaaugaaaacugugaaauagacacuucuuuuucucaugucuuaccuuaugugugucagcugucacagaccaugaaagcaaaagcauuguccuuucuaaugaaguggcacccuuccaugccuggcucagagaacagaacaacagaaaagcuccuuuaaagcuuaacuuguaaaugcugaaaucucuguagugucuacuuggcugucagagaauccuccugaugaggaagagggcugaagaauguguggauuauacuccauaccugugcaggagauccauuuccuauuaagcaaaaacagauugcauuccugauaugacuuuaacaaccacagugccugcuacuccaagggagcccgagggaaauguuucuuaauuagugaagaaaaauugaaaguggaagcaagaaaacauacucgcucugccacacacacacacacacacacacacacacacacaggcacaaugaaaaaaggugagauuuccucaagcugacacacauacuaaaauaauuagaagcuuuuaggaaaagaaaucucuuuauguuucuaacuaugacaacagugaauuugcauauuucaucuauuuauguauaccauaguuuauuuuauaccuuauaucucagaauugcuuuucuuggaacacuguauuuccauauacauugaagugcuugaaaauggguguuuuauugggacuuagaauguugugccuuggauccuguagaggaucaugagcccaggggucaugguugggucaaugcaaagagaugguacauaugaaggugcagaaaagcagaacuauugcacauuuuaucucuacuucauuggaucucuaugccagacuucacauuuaucucaggucacaaguagugagcuguauuucuaaugggaagucaugcagagcagagaucugaaaggagacuaugagaaagaaugguuggauuccccuucagcuuuuugucucuaguuacucaaccauaagcaacugaauuuacgucgcugaaccccagauccuuccuugaaaaucaugauggugauaacaauguacacucuacagaaugguggugacauacucaguugaauguggcuugucugguguaucuuugagaucauacauccaucaauccauaccuaucuuauaaaauuaguagaagauucucugguguuucauccaagagaguuuuaugaacuagaauaaauaaagcugauaguucaggugugaauuauagacacucacuuuugucauuccagagcaucuugccacuagugaucagggcuuucuaccugaagcuuauuuucauuggaagacuuguuuucaguucauacuggugagcuaucaggauuagagagaaaaaguccuagggauaauuucuaucaacaauuggcaggaaugugguaaacaggugcccaacucuuacacuucaauggaauucccgaguguuuguucuguguugucuucuagacuccccacugucuccagcuuccugcagaaccugacugaauggcauuuccccugaacuucacaccuuaucuacagcuaccugccccucuuucugaaacuacuuccuaaauaaagaacagucagcccuguaggaucucuaucuucaaacauucugaaccaaucauugacucaaaaacauuuagaagauaacugucuguauguaguaagcauauauaaugacuuuccccuugucauuauucccuaaacuauagaagaguguaacaccuucuuacauaauaguuauauuaaucauauaucaugacuaagcuagagaugauuuccaguauaugggaagaugugucuaggucucaugccgauacugacuuggccauccacugucucugaaggugcuggaaucagcuauuggaaagcugaggaauggcagugucuacacuaaagcccucucaggccagccccaggguagaugagggaugacuauccaugccccagcuuuccuuuuaugggaagcuauggcaacgccaaagcauggggauuguagcauugcugagaaggugcucuguuggguaccaucacuucuuaucagcaaaugaauuugucccaggagaagcauaaccuggauguggcacaaggaaggcaaugcacuugggaaguggcuuugcuucuguggggcucaggcugcucugauuugggaugaaucacaguguucagugaaggcaggcuucucuggguauuccauagugaaucuuccccugcacacucugccugccagggaagagcacugcccugaaauaaacgcucucucaaacuggaaaacuauuuuagugacuuuuaagaauaaacgucauucuuugaacaucccguugacaucuuucuuaggaacaugcagaucuacuuucuggaccaaaugcauauccuccaugguacuuggccaucuggcuucugguuagcaggugugcaagccugaggguguagagguuuucuucuucauuagagagaauggaacguaagaauggaaagggccaauggaaaguugugaauguugaauuguaaggguuuguucagaggcauagcucuggguguauggaaaacacauucgggggauuuucugcuuauuuugacauuugucccacuuuaaacuuagacaagaucagaucuucagaaggaaggaacuucuauuaaguuauauaugauaaucauucaggauaauacucucauaauugagccugacagcacacaugacugguuagauucagcaugagggcucauaaguuuugucuuuaacugaggcaggugaguggacaaaccucaucauuucuucuugccugcccuuuccugaugaccaucgugacaggcugguuuuauuauauuucuggcaggggcagcaugccagugaacagagaaaaggcuggggaagggguugcuucugucugguacuugucacacggagaacaacagauguagaaauaugacaagaugcacagaugaugcuaaaaagguagauggaaaacaucauggaaaaaugagauuaaaccaaagggaggucaguaucccaaauauauacucugauguccaaggcuggcugugagcucagcagcagcagcagugcugggagacaaucaguagcaugacucaugguguccaagugguaaaaauagaccagagacucaugaggagagcaucuccuucugcucuugauaugaggugcaaugagcaccauccccagaaacacccacuggaggugccucccaacccacgcacuccaggcucccuccugcugcacggcuucucuauggcucuuauccaugucucuccuugcuaaauucaccauccgccuccaaacuuuggauggagugcaagcuuuacacagauaggggcugcuccaucuggaucucuggugacccuagaaaagcacauaucuaagaaguuacuaggcugguggaauuucucaaaagccauuccuugcaaaauggaucuacauaaugcauagagaguggcuuacacccugagcuguucuuccauugcagucuggguagcuuguuuuagcaccuuauagauuguaaucuagggagcaaaugcagguggaacauuaauaaagggacuaaaucacugacaggcuuuuuuaaaacgagacauugguagcuggguguggcaguacuugucuuuaaucccaacacuuaggaagcagaggcaggcaguucuuugugaggucaaggccagccuggucuacauaaugaguuccaggauaggcagggcuacaggacuccacuuaaaacuuaagaaaagguucagacauucaaacuaugcucuccaccccagcaauggguuucuguaucuaaggcugugagcuucauaaggccugagucguggagcuuuauuaucccuguggugaaagggacaagcuguuagcauuaaguucuuuugaaaauggaacagcauacauacuuucaggccuuugcuuugugaaaaauaauucuucagaaaaugucaaaguggucaggcauaaugaccuaugccugcagucacagcuacauggaacauuguggagcucuugaacccaagagacugaaagucaccuggaugacaacaagacccuucuauguucccaaagugaaagagggacagugauguuggaaaauaguagucugggaccugcaaagaguuugauuaaaaaauaugcauggguuggugaaggaggguaacauaaaccaugguagcgccuuugguauguacuucaggcacaaugccacugcggaaauuaauucaggagugacacacagucaauucuauuucuaaaagaccuuugagguuguugcccaaagcaagcauguaagcaggauggugcuugugauggggaccuggaagagggucugguugugugguggugguauccugaucauaaacccuaggcuucagagagaugaaguauggaagaauuugaaaucucucauguaaaagaaggguauaggucuguagggcaaccuugcuggaacaagauaaccauaagcaacugcagccauggcccaugggugacauauuucugagaaauuaagcagagugaggcauggggagacuucuuuugguucuuugaugucuagacucccugcagugggaggagagaagagaaucaggaaugcaucuguuaguccucaccccucaccugccccaaacaacaucaccccagcaguucaauuugggguggaugccaggaauucacguagaauucuuagaugucuaauuuguauauuaguacaacuaucacauuuuaaugaaauuuaagugaaacaugaucauaaggaaccuucugucucaacuacucuccugcugccauaaaauacucagauaaaaacaucuuaagggagaaaggguuguuuugacucauggugccaugucccuuauggcauggaaaggaugcaggaagagcuugaagcagcugguuccauugcaucagccagcaagaggcaaagaagauaaacguguaugcuuagcuugcuuuuuccuuuauauccaguccaagauuccaaccuauaaagggaucccagucacauuuaaggugauuuuccccacuucaguuaaucucaucuaaagaauccuucacuugcuugcccagaggcuugccuucuaggugguucuggaucuugucccauugacaguuacuauuaaccaucacucuguguauauauuuguugauucaggacugacucuucaagucugccccagguguuugugcugucuggguguuuuccagagcucuucuaaagggacuggcccuagacaucaggccaugaggccugggaucacuucaaaagaucgaagacccaagccgggugugguggcgcacgccuuuaaucccagcacucggggaggcagaggcagguggauuucugaguucgaggccagccuauucuacaaagugaguuccaggacagccaggacuauacggagaaacccugucucgaaaaaccaaaaaccaaaaaacaaaaacaaaaacaaaaacaaaaaaagauugaagguccaaauguugguaagccucuaaguaacaagcuagacuucaccacuguagcaccugaagcaacauauuaaauauuuucuggauaguaacaugucagcuaaagaguggggacacuuaacugccucccucucccuauucuaugaaauccucugguccuauaguaaguguaggucaccuguaucucaguauugcugaugggagguccuuuacacacaacaugguccagaaugacagaucugaaagagauggcuugaauuauuuuauguguugaccccaacaguacgauacuuuccaaaucuuggcccuggauuauaccaagggccugaauuggugcuacaagguucuauaaagagcuccugggagaaaauuucauuuaagucagcacaucuguaucuggaagccacacuguugugcugaugcaggcaucuguuaucccaggcuuucaaagccuuagugaguuguagggcaaaaagccuguaaaauaaaacuauauguuuuauacuccuagaacucuuccuccaugccaagaaccaaacccagagucuugccugcuaggcaagaacucugccacugagcuauagcuucaaaucuuaguacauugagauaaaaaucuguguaugaagcccuggcuggucucaaaccuacuauguagccaaaucuggccuuuagcauucagucuuccugccucagccucccucagaauuauaguuugugccaccacacccagugagcauaggauaaaguuagacuuuuaaaauaugccaaguguucacaccccuagaaagagaaaacacuaaguaccacggcaugcucaugugguaaggaaacuaugccagaugcagaagaacucccucugagagguagagcccucaacuguuuucuuccuugaggccaccagagucaagguggucaguauauugucacuuauauuuuccucauggaaacugaagcauuugcuuccaauuagcuuucugaaauucuucuuaagagaaagaaucugcugugcucugggagauuggguuguuagccuugucuuacacugugggauaaagaaacuauguggaaggaggauuuggcuaggguacccaugaguuuagcccuccuaauagccacccuaaaucaagcaucucagugcauguagugugcugagaggugauuccaagaagccauauaagggaggugaggaacacaagagaacagucagcuuacaauucauugcuuagagccaccgucaugucuuuuuggagcccagggagacaaggaaaagcuccucagagugacucugccuagugauuggugacauaguucauaguucucucaaaccauugggaccauaucacuccuaggacauggauaccaugaccuaacaagccuauaagcuucaauuauauuagagaagaaucagugugccucuguaaaacacuucagcaucucagggaccuucagcauuugcagcccuggagauuuccgaacauuuucugauacaucuuuauugcgcugugguuucugaagauagaucaaaugagacugaacaguauuuugccccuggcugcugugguugaagccauauaaagcacaccauggagccucuuaugucuaaauaaaucucuuuuuccagauuauucaucaauagccucgguuuagccauaguuagauucuauaagcaggcagcucaucuacaagaggagcuccugagacuuggaaaacacaacaugguguccaacaaaugcacguaugauccacuccuacaggacgcaacaucaguggguguagguagucacccaagcauacccugcauuccugauagaucaagugccuacaccuccccacaguguacaacaugauccuaaagagaaagccauaaggaagaacagugaaagagggauagaacauagagaagaggguaaaaagauuaagaaagccauacuaacaaugugaagacuaaggcaaguaggaauuugauacugaauggaaaaauagucaaauucccuguaauuuaaaugcuccgaugaauaaagagguaaguaaaauaaaagaagaaaucaaaaauagcugcuaaaacaaacaagcaaaagcccacagccaauaaaauuaaaagggaagucuagaacugaaaggcuguauuuuaaaucuaaaauaaaauccaaaugagcaugcaaaaguuaaaacaagagcaggaauuggaaaugaaguaaauauagcccuucaaaaugauuuaaaaaaaaaauaagacaagauuucaccagcucccacucccaccucccccacagaacauccuggaauaaucuugagcagcuauggaaaaguaaaccgaacagaggaggaaaacaggagccugcagauaagcagagucucaccacuggguuaggaagaagcaagaguaagggguauugcagaguucagccucagggcaaguucagaaagagccagagaagacugaagaggagaaggccaaagauaugacaaaagagaaaucccuagcgagagcacugauucaccagaguccugaauccuugggguagauggcugucugucagagaugacaaccugacagaucgaaggcaggcuuauuuauccccuaaaggcagaauacacauguauaugcagagguguguaugggugcuucaauaauuugugauuaugagauaauccuagcucucuagcuuuucuuaagguuauuucuuugcaagcaauucuaauaaaucacacauacacacacacacacacacagagaaagagagagagagagagagagagagagagagagagacagagagagagagagagacagagagacagagagacagagagacagagagagacagagaaacaugcacacacauuuagcagguauacuauuuuuuacuacuuauucaugucaauagauguuaacuguuacaaguguuaaauuuauuuuucaauaauucaguucuagaguuuauacugucuucauucuucuuaacaauacaaagaucuuagaaccucuuccccauuuuauauauuuauucaauguuucuucuucaucuagauuuucuaacaccagauuuuaccuugauuacaacuauuauuguuguuuucucuugccauugcuugcuaaagauuacuaguuauuccuuauuuccuuucaacuuuguaucuuguguuuaccgucugugaugaauucuaauuuugaggauuguccuuugauagccauacugaucaucuauaaguaccucauuuucucagucucugaacaaagaaagacauuugugaaugaaaguguaugaguuauaaaauuuuagauuuaaaauuuuacuaaggaauuuugaaauuauuuuggauuuauuuuauuuauuuauuuuuauuaaaaaaauagauucuucucucauauaauacaccccaaccacaguuucacccuucuuccuuccauuccucguccauuccuccucgcuccuccucaccuccccuugcccucagaucuucucccucucuguuuccuguucagaaaagagcaagccuccaagaaacaaaagccaggcagguaaaaagaagauacaguaagacaaagagacaccccucauauugaggcuggacaaggcaacccaacaggaggaaaagugucucaagggcagguaaaagagucagagaugcaccugcucccacuuuuaggagucucacaagagcaucaagcuaacaaccauaauauauacacaaaccugauacagacccaugcaggucccuugcuugccauuuggugggucauauucuccugguauucgucauccccucugagggguacagucuuuccucacccucuucugaggauuucucugauaucugaggggagggaucagauggagacuuucaauuuggacucucucuccaucuaauguuuggcuguggauuucugugucuguucccaucugcugcugcagaaagccucucugguaaugaauggacgaggcaucagucaacaacucaaaugauuguaaccuagucccaccccuggaagccaguucagacuucauauccuccacuacuaaagguccucacuugggucacccucauagauuuaagaaacuuuccaccucacuaggcugccacaccacccaucacaugcucuccaacuccaacugucucugucugaacucucucccuucauuugucccccaucaccugaccccucccaaucccauugccaccugcccccagaaucuguucuguuuccccuuuccauguaacucccugcuuuccccuuauagggcuccuuuuuaccaaaccucucugggacuauguauuucaguuugauuaucauuuacuuaacaaauacuauccauuugcaucuuacuuauuaggucuagauuaacucauucgggaugacuuuuuuauagcugcaucuauuugccugaaaauuuuaugauauugauuuuaaaacuacugagcaacacugaccucuaaauguacaauuucuuuauccauuguuuaauugagggauaugcauuguuuccaguauuucuggcuauuuugaacaaagcuacugcacauaguugagcaaguguccuuguaguaggaugaagcuuccauuggauguaugcuucaaagagguaucgugaggucuuuagguagauagguucacaaauccugaggcgauggccauauuguuugcuaugcuggcuuuccaaguuugcauccccaccagggauggaugaauguucccauugcuccacaucuucuccagugugagcugucacuucuguuuuugauuuuagccuuucugacagauguaagauagaauaucaaaguagcuuugauuugcauuuuccugguagcuaaggauaaugaauauuucuuuaaauguuucuuggccauuugagagucuucuauugagaauuaucuguuuagagcacuaccccaguuauuuucccuaccccaguuuuaauuggacuauuuuuuucauaucuagcuucuagauuuuuuaauauauuuauauauuagacuucuucuucuucuucuuuuuuuuuuuuuuuuuugagacaggguuuuucuauguagcccuggcuauccuggaacucacuuuguagaccaggcuggccucgaucucagaaauccgccugucucugccucccaagugcugggauuaaaggcgugcgccaccacaacuggcuauauuagacuucuaacagacgugguaaaacacugcucacauuaugcaggcugccuuuuugucugacugacaauguccuuugccuuacagauacuuuuugguuuuaugagaucucauuuauuaauuguggaucuuaguggcugcacuauugguauucuguuuagaaaacugucuccugugccaaugcauucaagguuacugcucacuuuuucuuuuaucagauuuagugugucugguuugauguugaggccuuugauccacuuggacuugaguuuugugcaggguaauaaauauggaucuauuugcauucuucuauaugcagguauacaguuuuaccagcaccauuuguugaauaugcuugcuuuuuuccuggaguuauuucuggcuucuuuaucaaaaaucagguguucauagauguguguuuuaugucugggccuuagacccaauugcauugauccacaugucuauucauauaccaauaccaucuaauuuuuauuaauauugcuuucuaguaaagguugaaaucagggauggugauacugccaucaguucuuuuauuguucaggauucuuuuagcuauccaggguuuuuguuuuuccauaugaaguugaagauuuuccuuuaugaagaauuguguuggauuuugaugggacuuguuuuuaguuuguagauugcuuuuggaagggugucuauuuuuacuauguuaacccuacugauccaugaucuaugaacauaagagaucacucuauuuucuucaguuuuuuucuucaaagacuugaauuuauugucuuuuacuugucugauuagaguugccccaagauauuuauacuauuugaggcuacuguaaagagugcuguuuccuugauuucaguccauuugccauuuguauaaacaagugcuuucuuguauaguugcuuuuggagucucuuaugaauacugucauauuaccggcgaauugcaauacuuugacuccuuccuuuccaguuuguaucucucugaucuucuuuauuuuucauauugcucuagcucagacuucaacuacuagaauagauacagaguggucaaccuugucuuguuuuaguagacuuucuuuuaguuucccuccaauuaacuugaucugugcuauaggcuugcuguaagcugcauuuuguuauaggcuuguuaauaaacuguauuuauuauguuuagguaugucuuuugugcccucaagaacuccaguauuuuuaucaugaagggcuguuggauuuugucaaggcuuuuuuggcaucuaaugaaauggcccuguggcuuuuuacuuuucagguuuuuuuuuuuuaauaugguggauuauauuuacugauuuucauauguugaaucaucccugcaucucugggauguagccuacuugaucauggauaaucuuuuguauguguucuuggauuugguuugugaguauuuuauuaaauauuuuuuucuucuacauucauaaagaaaauucuuuuuaaguuguaaagugauuucaguaacagaguaccugugacgucauaaaaugaauugguuaaugucccuuuuguuuuuauuuuguggaauaauuugaguauugauguucacuauucuuugagugucugguagaauuuugugcuguaagugucuggcuuuuuugggggggcagggggagguuuuauuuugaugacugcuucuauuucacuaaggcuuauagguguacuuaaauuauuuauauaugaucuugauuuaacuuugguaagugguaucuauugagaaaauuauccauuucuuuuagguuuuccaauuaaguggaguacagguuuuuaaaguauguccuuaugcuucuuuggauuuccuagguguuuguuguuguauuucauuuuuguuucugguuuuauuaauuuuaauauucucaucuuuaguuagcuuuuauaacuuuuaacuuauaacauaacuuaguuauaagguguuuucugucuuguugacuuuugcaaaaaacaaaucuuuuuuuuuuucucacugauucuuuaaauugcucucuugguugguauuuuaugaauuucaggccucaauuugcuaauuucuugcugucuauaguccucuucuaugugccuacuucuuuuacuuaggugugcuucuagcuugcuuguaugagauuucucuacuuuuuuauguaggcacuuacugcugugaauuuuccucuuagcgccauuuucauuguaucccacaaguuuggauauguuguauauuaauuuucauugaauucuacaaagucauuaauuucuuucuuucuuucuuucuugacucacuuucuuguugaguagagaguuguucaguuucaaugaguuuauaagcuuuguguuauuucuuuuguucaugauguccagcuuuaaucuguuaugguuccaauucuuuuauauuuguugagacuugauuugugucagaguauguguucaguuuuggagaauguuccaugaaguucugagaagaagguguauucuuuuguguuuagcugguauguucuguaaagaccuaguagguucauuuauagcaucacuuagcuccaggauuuaucuguuuaauuuuagucuucacaaccucuccauuggugagaguaggauacugaaguuucccacuaucaacaugugagaguccauuagugcuuuaagcuguaguagugcuucuuuugcaaaacugaguucccuuaugcuugggggaauagauaguaagaauugaaauagcgucuuggaagacuuuuccuuugaugaguauguaguuuccuuccccaucucuuuugauuaauuuugauuuaaaguuuauuauguuaaauaauaaaacuucuacaccagcuugcuucuuagaaccauuuaccuagaauaacuuuuuccaacucuuuacccugagauaauguuuauccuugauguugagguguguuaauuuuauguagcaagaggauggguucuguuuuuguauccauucuuuuaaucugugucuuuucauugagguguugaggccauugauauuaagcgauaucaaugaacagugauugcaauugcucauuauuuuguuggugguggugugguggugauggugaugguauguguaugacuuuguuucuccuuuuuuugguuuugcugauauaagauuauuuauuucuugcuuuuucauguguagauacccuccuuaauuuggauuauucccuaacaccuuauguagugcuggauucauauagcuauuguuuaaauuugacuuuagcauggacuaucuaauuucuuauagugacugagaguuuugcagaguacgguaaucugggcuggauuuuaaguccuucuggaugguagugucucuauugagaaguuggguauaauucuaguaggucuacuuuuauaaguuccuuggucauucucccguuaaacuuuuaauauucuuucuuuguucuauauguuuaguguuuugcuuauaaugugauaggggacuuucuuuucugguccaaacuauuagacauucuuuaaguuucuuguaccucuauagguaucuuauacuuuagguuaggaaaauuuucuucuauuauuuucuugaaaguacuuucuaggcuuuggaccugguagucuucuuucucuauuccuauuacucuuagguuugcacuuuacauaaguguccaagauuuuuaugauuuaacuuauucuuugaccaauguaccaauuuauucuguccuaucuuuaacaccugagauucucucuuccauuucuuguauuuuguugguaaagcuugccucuguaguuacuguuugcauuccucaauuuuucauuuacaggauucucucaguuugugcuuucuuuauugcuucuauuuuuauuuucagguuuuggacaguuuuauuuuuccuucaauugucugauuaaaucaucuugucuuucuuuaaggaauuuuuuuuuucauuuucuccaauuguuuguguucuuuuggauuucuuuaagggguuuauacaacuucucuuuaaggaccucugucauauucaccaaguuguuuuuaaaguguuuuuuuuuuuuuuuauguguuucagcuauguuggaauauuaaggaccugcuauucugggauaucugcagucugguggugaauauauuauccuaaccuauuauccuagcuuuuauugauuguguucuuacucugaaaucuaggcaccuggguuuggguugauuauagggguaggugcuguuuucuugguugucuugauuuggugagaauuuuguuccuugguuuucguuugcucccuggauuuucagauuguugccuuucuuuuuacuaauucucuuggcugauguguucaugggggacugcuuucucuguuggaaguuguaggaauucgagauucagggaagaugacuugggggauccucaggagucaugguggauaggggagaaggaaagauuuuccugguauucuguugcaaugcuaggguugauggugagcuuugaguaugugguuagaauguguagggaaggucugugggaagccucccuggucuuccagcaggcauuacugcugguugagaaaugggguaucuuucuggcuuggagcuggacuuauuuucuguacauuauuuguguguuuauacgugugugugugugugugugugugugugugugguuuuuauuauugauucguauuuucuugauuuucuuuuccacagagaacucaauguuuuuccucccauuaauauaaccucuuaaucuuuguuuuaauguacagaaugggcuagcuuuccuuugccuuaucguaaagguucugaaucuguauaauacaucuucuagcaguucugauaaacucucagaucucuucaaauguugccucuucuccaacucuguguucauuuauccuggaaucccuucucuauucuucaaaaguuuccauuacuagacugagcgauagugucaccuaucuucccauuguuuacugcaucuuuuauguuuuaugcuaaauucacgaaauaaauuugaguucuuuaacuccccuaucaaauauuucaguuuguuucuuaccuaauuacuaugugugaaauucaguguuaacuuuuauuugagaaaauuccuauuuguuuugcacacaggaguguguguguguguguguguguguguguguguguguguguguguaacacagcuaauuuggacugacacacuaaggaucuuuuagcugggcugccccaucuaguguaguucuguagcagcagaguggaaccagcaggcaggauguaggaacaggccuuuagacggacggaccucaguucuggccguugcuggcuuagccuuagugugguauuugugcucuguguucucauaugcacacauaugcaacugaaugcaguugauugaggggacucugcaggugucauacagggaaguuaacaacacaaagaaauaagaauaagucagccuggugcaaguugaccacaucaaccugaaucagacuuuggggagucuaauaacaugguuuauucccaauggauuuaacuccaguaaaauuuaaauuuaaaaaguuuccugguaaaauacaauucucuguggacauuuaguguaauuacauuaaaacucagcucaggguagugucauuucuccuaagaagaugaguucuaggaauaggcuaccuguaccacuuuaaagaguuuggcuugguuucagcaauauagauagcauagagaucauuugagcucuuaaucaccucugguccugguuuugggagcuugauaugacuucgcccaauagaugacacagaugagcaggcuguuaaucacuuucaguucucagcuuucuggacuuaauagcaguuuccccaucuuccccauuggaaagacaauccuauauacuuaacacuccuuuuuucccuggaaaucuguagacucaaggacuucuaugcaaugcuccuaacaguugauguugugucccucuguagacuuaguuugcaccuaaauuuuagaaagaggcuuucucauugaaccugcagcuugcuaguuugacuagacucacugguuagcaagcccaagcaaucuuacugcuucuucaguuaugggauuccagacauaugacaucauauccagcuuuuuauguggaugcuggggauaaaacucagguccucauacuugcaugacaagcacuuuaaagacugcuuuuggaugcugccuuugauggauuuacuucuuucuugugugucuugaauaucuuagaaaagacucauuucaucacuaaccugaaguucuggaaagcucuuucaucuguuucuggauaaguuugaaaguuuugaguugagacuguuuucaauggaacuauaacugaaaauugucauugggaauuuccuuaugucagggugugccugaaagaugccauaggaaauguuuacucaagacaaccuuuuaugagagccucagugugaaguuccccagcccugaaaauagugaaauuuuagacuucagagccauguacuguagcacagggauuucuccagccuagcaaguaaaacaaucuuuguuuucccuucauuguccuaauuagcacugccauucuaguuagcaugucauugaaugacauguuagcaugucaugggugagcaaguagcauggggaugacaauucaguuguuaaguguuuucugugcagaaauacuguuuauggaaacucuucaaaucuuuugggacacugugacauugacugcucugauuuacuuuuuuucccucuuauaguuaaaggauaugcuuucaucaaagccaaaacuccucauuuggaaagagcuuaauucugaagucuaggcagacucccucccuggccaugccuuggucccagccucuggcauccugcugaggucugaauccuggguucuggcuuugucagagggaagaugacucaucucacuauucacugggagaaucccucucaucucugccuuuucacucuaaaacacaguccacagaguaugugugauuccaacuaccaccaccaacaacaacaacaacaagaacaaaccaaaccaaaucaaaaaagcaacaacacccuagaucuguuggcaaguuuuguaaugaagugaaugaaggggccugggccccagcuaugggcaguaccuucugccuuccuaaagcucucccucuuagucaggggggucagacacaccuugaguggacuuguguugaccaauacauuccccagaguguauguuuuagcccaguuuauguuccuugaccuucaauccauuuuugaaggccaucgcaggcuaggagaagcaauaacagcaccauuacagacuaguagccaaagaauaaauggccacaggaguaaauuaaagacauuagcacaggagugcuggauugcacugagaaucauuuucucgucagucauaacuaugaagaacuaauuuuagcuacugauguuuucauguuucucaggcugagccagucuucuguguuccacaugaagguccagaaaacaggcuaagcauuuauuacugcaaugucauucuaauuagaagguuaggucaauuuuagcccauguauuugugcauucauuucugaaacucugugauaaacaaguuguaauuuuguacugaacacauguuuuguuauaggaaaaacagaaaagugauuuuuaguuuuaugguuuuuuguuuguuugggaaaucugaaguuggaaaaagcaaaugauauaggaaaaaguaacuaacuuaguauuuugguuuguacuguaaggauauuauuauuuuuaucauuauuauuuuggcacuggaguuuaaauucaagguccucucuccaaucgccucagcuuuuuuaauagaucauuuuuuauaugaacgaugagcugccuguguuaucaucuuugccuuuguuucuaugaacuugggaaacugcacaugugacuccugcaccugccuuuaccauuuccaugaaguggauccuaucacauuccaggucugccuuggguauccucacuguuaauacaaagagcuguaguuacauggcuucuuugaucuuuggguaaauuauuuucuuccugaaacuguguccccuggaaagucuucauguaccauggacuccugucugucugucugucugucugucugucucuuucuuucuccuccuucccacuuucucuuccucccuccacccccaucccuccccuuacauauacaccccucacaagacucaccaaaauccaaauuggcuguugcagauuaaauccauucaguaacagacacagauuggggauuuucuacaguccaugauuuuauuuccuaucuuccaauuucccuuuaguaugugauuuuuccaaaucuacaauguacauuuuucacauucuauggucuggcaaucuacauuccagcacguucuccagugagccugaugcacagaaacaucugagaccuauucuuuaaugaaacuuagcugagaacaguucuuuggucucagcuucuuggugugauaaugccccuuacacuaauugucugugugguacaggggcaaucuuugaagauuuucuuccaagccagcagcagugucucacaaaauccaggcucuaauuuugcagaaagaggaucauucagaccaucuaaucaacuuuaaugccagaaguaauagucugucuguugaguguuuaauuuucuccaauguauuucuuuauuucuaagaguaugggccucuauuuuuagacacauuuagcauuguuacuguguagucuuuaucugauggugucagcaucugcagccuuugugcuucugauuugugguguuuugcuuauccuugcuaauugccucuuauuuccucuugcauuuaagcuugucuuagucuguucuggcugcaaucacuaaauacaacagguuagguaaugauaacuaauauaaauuuauuucucauaguucuagagucugagaaguccauuaugccauuauauuagggacuaaguaucauauuuauuuguugguuaauggcagggguguggauauucauucaaaccguaguaauauuuaauuuuaaacucagguuccuuccgucuuugggaaacuacuaaggccugacuucacaugcauuuuuugguauguguuugguuuugcuucugcagugaacaggaaggggguuccuaacugaaacauuuaaagcuauguuucuggagggugagaguggagcgaccucaccuuucggcuucuagguagaaauucucaaaaaagaagcccuagguuuccccccucaaaucuagcuucaacaaugugaauuuuagagaccaaacuguuugaugaccucucucucuuccuugauguguagugguggucucaccuuacugucaugcuguuagcaguacaguguguaccagugugguggggauauacuaggauuguggucagaaauuaguaaagccaagucauaagugcauuaagauuuuucaguugauaugguuucuaccauaauuucucagaucugucauugcugugaggaagcugucauagauaaaugggaggguggauauaguauaauaaaaauuuguccauagacauugacaauuucuauuccauaucauuaucaugugacauguaaaauuccuccuacaguuuguaaauuuuagauccauccuuuucuucugggccuuaccaacacuggauucuggguauuuugcccaugagcaauaguuugucaaauacuggugauguguguguuugugaugguaguggugaugaucaugguauucuagggugcuaaggauaauggugcuggugaugguagugugguagugagaguagugauggcaguaccccagugugugugugugggggggggggagguguuguugaugauagcaguaacaugaugguaauuguaaagucacuuagcagugauaauaguauagauagcaucauucagaacacucccucugggugaaguuagaggugggcuuaagagugauacugagcugauggucauguugauacugcuugugacggugguaguaacaguguuggugcuucucuugggaguuauaaguuagcucuuguuaauagugaggguacugaaauuggcacugaugagcuuacaguauaugaugaaaaagccuccucuacuguucccacaucuuccuugcaaaaugccaugcugauggaucuguuaaucauucugauuuggucuauuccuauuguagcauacacauuuugaaacaucccacacugucccccacacauuuauacaacuaugucuuauaugauuguuauguugcuuaaagagguggagaaaaaaguagagaaucaaagggcuagcaugaguuuuaaaggcagcauuuccccaauuaugccaaguguccuuauuucagaaucauaucuuaaguguuagauuucucugaccauuaauaagucagguaaagaacgaauagacacagcccuaguggugcugugaggaacccucacucuccagaaaaaucuguguugaucucugagcaugaaauaccaggacacauugcauaugucacuuaccaggcaugaugcuguucagauggccauaaugcuucuuucacuguugccccugcugaaucacagguguuuccauaaguuuguacuauaggcaaauuuuuaaaauaaaaacacuaauaauaauaguaauaguaauaauaauaauaauaauaacuggcauggcucugaaugccucauugacaauccccacugcugagccccaggcuuuuucauuuauuuguacuaaaggugaacuuucauuguuuaaugaagauucacaaaaaauauuuuuuuucuuucagcauugguauuaucugcuuagcuggagcugacuacuuacacaaaagacuuguagcacggcugggccucgggagcaucuggcaccaguugcucucagauugcuuuguuuaauugagcaguaugagaagggauuaaaaguauugggagugagcccugcccauuacacacccagagcccuggcucagcuaaucugcaauuacuuuaauuuucucccucaguuuucuggguuguuuuuuuuuuacuucagcuucugcuuggcaagcugcuguauagcuugaguuuuguacuaacugugacuacuguucacagauaucuuaagguuucugucauccauggagaucugaacauuagauuuucuaacuuuuccuguaucccugacacaaacauucagaugaccagcgcaggccugucagucaugaaagggacaaagacuaccuuauucgaccaagaaaaaucagagaaagagaaggaaaugcagauauuucuaaaccugaggaauuauuaauacauuuagagacaaaggaaaagucauucaugaguuuggguggugcuuuucuucagagcaaaaccagcgcauuaaacccaaguacgcgaaaacccaaccuauaacauaugauccuaauuucuacacagacgggucccuguguaauucuuccucauucaugauucaggaugcuuucugacagccagacugccgaaaagcuucaugcuguguguaugagugagaaaagagcauaacuugcuuagauccugcucuuggugugaaagguggaaguaaggcuucaacaaaagcugccuuauaucuacaagaacccacccagugaugucaccugccacuuguggugucuguguuuucuguuucccauugaagcugugccuggugggaaugaucuaguccugccaaaguuucagagacacaccccuucucaacugagaugaggucugucaccuguguuccaagccacugggccaucccaaagacgcaaugagaguauugcaauuuuguuguguuucaaagauauuuuuuguucucacuguaugccuaccaaaggaaagaauuauuuuaucaguuacucagcugaagacuggaauuauaauuaauucaauguuauccaaggacuuagugacaaaaauuagcacuuuccccaaaugaaagaagcaaucaaauguaaugugugcauaaaauggaauacuguucagcuauaaaaggaauaaagagcugacugauauaugauauagauggucuaccaugaaagcaacaugcuaaagggaagaagccaaucaccaaagguuugcaugcuucuguugguguaaaaugcccauuagaagcaaaucuagagacagaaagacaguaguaguggccuggggcuggaaauggcaguggguaguguguggggguggugugcugggaaugcucuagaguuagugggaagaguugccuaguucuuaguccuccauuccucgcucagcacugcacuuuagaagguagcuaacguuugaggcagaggcaggcagauuucugaguucgaggccagccuggucuacagagugaguucaggacagccagagcuacacagagaaacccugucucgaagaaccaaaaaaaaaaaaaaaaaaaaaaaaaaaagagcugaugcuuuuaaaagaauuugaauaggagugucauucaggaguguagcauagcuuagaauccccagucaggagugcagcaccugcuagaaucacuagcacugcagaagagaaccaagugaaaauuccuuuauuccuuuauuauuuugugaugguaaugaaauaccugaggcaguccaugaaaagaggcuuuauuucauucccuucuggaggccaaacagcucaucacagauucuugcaagagcaacuuuuaucuaaucaccucauagcauagugcccuggggggcgggggggugagggggaaggaaaggaacaagggugggguggcccuuuccacauggaaaguuacuaaguuaauguaucuggcucaagcuuuuauacuuccuuccuuccucucuuaccuuucucccucccuucuuuccuucccaggguuuacuuaggaaguaacaucaauauuucccaggcacucugacuugacggaaagaaugcacuaggcucaugucucaaaaguuucucccaucagugcuuagagaaucagauuccaaauacuuaacccuggguacaaacuacauucaaaucagggaaccauaggugccucagagcauucacuacuucagcagaguugugggugggggcagggcuggguucucaguuccacagcuuuucagucugagggccugugagggacgcuaaccuggucugaguggccccaggcugcucagcuuccccuugggccuucagaccagugaggagaccacacccuagcaucaaguauacuuggauuccaguccuauaugcuccuuuaacugcccagagcauccuuucuuucaguauuuagaucaccaacuguacucuuuaggacccuguagaaucugaacaacauugccagggccccggugaggcucugucccacagguaccccggagcauuuauuauucuagcauuccgagagcuauguguugucuugugccuuaaggccagaagaaaacuguuucccaacccuuugugagaaagggcgucuuucaaggcaggcuuaauuauuucaccuucugagacugcuuuauggaaccagaauaccaauuuaucaauuagugaugagaaacgauucucuuggggaccaagggcacaaacacugugugaccccauucacccucucccuguaaugaagcaguuuaugaauuugcagagagaauuaaccaucuugcagaccugguuccgauuuuuugugguaaaaugccacagcagucuucuuucccugcaggccaggguccuugcuucuguuuaaaccaucuaggggggugggggaugggacuucugcuuggauaugucaagguagacauaccacuucgccaagcccugaccauacaguagacguuguuuggugguaucuauagacauuggccauacagaaauuguagcuaugccacucagguuuguaggauagcagucaggugccugggacuuguucccagggaagcaagaucucuauguugcucuaauuucuauugcaaaacaccacaguauuuauuuaaaaagugaaauaucauaaaauucaaaauaauuuuuagaagaggauaauuucugcuuacauuucuggcccaggauugaggagacacgucuuucuggcagucauaaggugacacagggcacccuuggcaagauacaguacaugugugaguuagagagaguguguggcuuugugcuugcaugcacaaacguguuagaguguguguuuguguaugaggcauguguaugaaagggugaguccgagugaaaguguguauaucauugugugagugacuaugugaaugugucagaguauacguuuauauacgauuucugcaugcaugaauguaagagugucaguaugggagacuguuaaggacagagaguauuuaugcaugagaauguagaaaagaguguaugagaguucugugauuuugagugugugaauaugugugaacaugugugaacgagacuaugugagggagaacaagugugagagaugugcauguuugaggguauuuuaguucaugcgaauguguaugaacaugugaguauaacuacagauauguuugaaugauuguguguguguguguuugaagaacuuagaagggucuguggaagcaaggaaaggagaaacguuugagucauccaguaaauugaucucuggugaucugagaagcaggcccugcaaggccuguggacgcuagccucagcaccaccguauccuauugguauucuaugacacugguucaugagcauuuauugauuggcuagccgaaacugcaggagacgcgcugaaccacugcuggacagaccucgcuggugucaucagauccuaaacauuggaggccuggacagggugagacacccguuagcucggcucauuugguaggaaugaaguuaucaaugucucacuuuucccuaguguaaggaucuaaauagaagcacaaggcucuauccuguacuuuuuuccuccaucauuauacacugagaaagaugugagucugcuguauacauccuggagguaacaguauggagcuccugaccguuucccccuuuucaauuccauaaugugugugguccagcuuuccugguuuuuguccugucuguucccugccucaaggcucuaagcauauggcauggaucaugccuuucucuuugugaccauuccaccccucaggguuuuccuuaaaaggaagaucuuuauccucaaacuagguuacuggccauaugcgucuuccuaccaggcacauuucaccuugucccuagcccuugucacaccacggcacuuucgagaaccugucuuuuucuugugcugugagcagcaucacucuugugcugugaguccaugauaccucacccagcacauugucucaguuugugccaguagaugcuagucaaguggauguacauuuaugccuguuuuguccuugacacguuuugguggcuugaugcauggccacauccuuccuucaccugauucugagagauaaucuggauugcccauuuugacccuuuaacaggugaguuugcauugguaguugaguccaacugugcucagaggagcugacuacaucccuuugaagccucuuguccucaacuagacgcuggcuuucacuggcacuagagaugauucuuguuugcugacugggugguuucaguuccgcuuuagaaagcuucuaaagucagcacaucuauggucuuuagauaucaucaaccuuaaauaaacuagagaucugacagugcuguguuugaaugugguucauuccccaaacaaucaugcauggaagcccuugaaaaggcccuuuuauggaaauaaugagaugccacuaacaggccaggcuuagaggaaggcauucaggucacagguguucuccucauaugaacagcucagugcugucucuugggaaggaaccaaaacuagaucaauacucucaaacgcauauuauaaagccacacuacucugugugcuuggcccuuccaugccuauuugcuuucaucaggagucugacaccaugacauuuggacccuguggacaccagauucaugagccauacuuaccucuuuuuaaaagcuauccgaccuggaguguuuuacuauaguaauacaaaccauauuaagaugaauagaaccaucuuguuuccuagucaaguccauaauggcuugaugcucucugcuggcaucugucccaacaccuaguugaugaaacucaaauggcagcuuuucuugccaaaggcaaguucuaagagauugcuuguucuaggugguuguauagugauacacucccugcuaagaaacacagccucuggcuaaauaacuucuuugcaaaugaauuuuauuuaugaaugaagucacgguauuucacaucuuaaucuucacaguauacuaucuuuugcacagcuauugcacagcucugugggccacuuauugaacaagagauuuuucuucauugaauaagaguaauguuucauuuucaccaaugugaguuauuguugaccaaagacuguuuacuauucuucaggcacuuagggagcagcugaagacuguagggcuugucuguggaagugugaauguagcgaaaagggugggucugaccagggaacugugucagggaacaugauaggcacauugucauagauugaauggaacacugugagaauugugguguuuugcucuccuuuaagagaaagugauaauugaggugaaccauaugggaauuuuuguguagaaauuaaugacaugggaauuaccggaugccagaugaggacaaggcgauacaccuccugauggagucucaaacauucaaaggccaguuuaaaacagaagcaggcucagggagagugagaaauggacauuaugaaucucagccuaucggacagaguugguagaagauaaaguuuaaauuggggccuugaaaugcaaacaguuuccaagguagucacucagaagaucugaugccaacagaaccuuaugcccuugccucuuaggagagagauuguugucuugauugggcauggucucaaauaucauguauuucuuuaagugugccaacaugaauaaaucuagagaucuuuuauaaacaucucuccuguuaauuaugcuuugaugaauuaaaaauaaaucccaacacucucucuguuucucugucucacucugucucugucucuguccuuuagucggagugcaauuuuagauuacuguauuuguuaccacauaaaaucaaacaucuguaauuagaaaauacuuagauguuauagaaaaugcuaguacuugauuagccugagaugaaacuuuuauguaugcauacauguucgcccguaugugugcauaugcauauguaugugguggucagguguuacaccaggugccuuccucaaucauuugccaccuuaguuuuggagacaggguuucucacugaaccuggagcuugcugauucagcuagacuggcugggcaacaagcuccagggauucuccugucucugcaucugcagugcuaaaauuagagguaugugccaccaagccugacauuuagggguguggggaggcagggagguucuuggcaucaaacucagguacucauguucacauggaaaccacuuagccuauaugagauguuauuauuuguaaugauuauuauuauuauuuuuuuuuuuuuuuuuuuuuuuugguuuuucaagacaggguuucucuauagcccuggcuguccuggaacucacuuuguagaccaggcuggccucgaacucagaaauccaccugccucugccucccgagugcugggauuaaaggcgugcgccaccacacccggcuacauguaaugauuauuaacaugccauaugagauaaugcacucuacauaucuuagaaccuuagauccaguuuccuuccuucuuccuuccuuucccuccuucucuuugucuuucuucuauauuaugcaaggcucaaugauaaaauugucuaagggagaacaauuuggagucaguguuuaugaaugaguucagugcucauccuacuaaauaccuaggaaugcacucauaugcacaugaaguauaccuucaguggaacuguguccacauauaaucuaguggcacagucuuacugucaucaauuuuuuacgucugugcaggcuaucauuuuaaacugugucuucuuuuaguauguucuccucaugaauguguacuuggaagaguccaucccccuuacagacaaacaauucuauuucucuguagaccauugggaugcuaaugugauugaguuucucagaguuucaggaugucugcuggcuucuuuagggcugcaguagauccaguuccugcagcuuccucuauuaggaagcaaaaacuucauagagaugcagguaauagauuucugguuuaaucuagaugucacucucaugggaccuuuuuaaaauucagaacaagacuguguauuuuucugacuccauagcuacuaugcacgucagaugacuaguaaacucugaugcagugugggucugugugaugacauucuuguaauuuucacucucuguuuccugcuccuccagggaaauggguccuauggggcuugugugaccugugaauacagccugcuagccugacuccgagcagggagggagucuaccauggauggcaucauugagcagaagaguguucugguacacaguaagaucagugaugcuggcaaaaggaauggcuuaauuaacaccagaaacuucauggcugagagcagggauggucuggugucuguuuacccagcaccucaguaccagagccacaggcuaguggccagugcggcaccaggcagccuggaaggaggcagaagugagccugugcagcaguugcuggacccaaacacucugcagcaguccgucgagucccacuaucgucccaauaucauccucuacucagaugguguacuucgauccuggggggaugguguagccacugacugcugugagaccaccuucauugaggaccggucacccaccaaagacagccuggaguaccccgaugggaaauucaucgaccucucaggggaugacaucaaaauccauacccuguccuaugacguggaggaagaagaggaguuacaggagcuggaggucagagaauguguuuguuggggacccucugggguuggggugguggggccuggaagauaccugugagugucuagaaaaacccugggagugaaauuaucaugcaaaaaugcugaagguauucucgguacuacuuuacuucugagcuuuugcggaggauggaagaaaugggaaauggcugggagcugugacaguguuucugguuaauggugaccuguggcaauagugcugucaguagggcaacaggcaucagcaauaggugacagagccauggagacacugccacugaauaaaccucaagagggaggggcacauaaggcuaaagacacauggugugggaaaaauuggagaaguguuuuacugucauaguaggucccuuaguuugacaugugaaguuucuacugguagaucauugcuaucucagaacucaaaagaagaaacaauacauauuuaaaaggggaauuaaaucugggaccucucauaaugcugggaaaacacuuguccauugaacuaugucccugaacccagcauaccuuaccuuuuuacuagcugaugcgagugaagacauuugaauuauacacauaaagacuuacgaccaggacuaugugagauacgacacagaaguuacuagucaugugguguaugagugucauugaaggguuacugcacuucaggaagaguagagaacagagcauucccuacuggaacuugaguacaguauccaggaagaaagccugugacacccauugacaggucucugaauagccacccccauaugcagaggccuuuguaccagcuuaugacacuggcagggaaagaagggcauggagccagccaaagcccgagggaagcuaagacacaggugcuuuggguucugugcuaaugacuguugcaagugucugcuguuuuccaaagucuccagguuuggccaauuugauaagugacuaaaucucucuccuuugugugaaucugggaagcaagcaccacaagugcaguaugaauuugacccagaaauucuaaugaaggagugucucguuggcucugaaaacaguccccaaagggcauguggaucugccauuguaguuugaguaacaagaugucaaauaucauuccagaaguggaaccccuauccuguaucuuaagagcaaauauauggaugcucaaugggugauugugggagauagcacugaagcagucgacucugcauagaacugaauggaaaugcuguggcauggggcauauggaggaagccugcuugaaaugcaagugggguccugccacccagaacccuaaucgucuaagggagaauggguucaaugcuauaaaagagaagggcaggugagaagcccaggguagcugucagagacaguggcagagcuagagaaaccaagcccaucuaauaauuuuauuuggcgucagugccccccugcugugccacacccugugguccaagcugcuagauuccaauuuuaaaaguguggaaugacugagaauccauacacacuaaagcuuaaucuacaaaacagcacagagaaagugggacaccacacggagaaacugagccugcaggcuuugacucucagccuucagcugcagagaaccaugggaagauuccuggcaggauggcugugauaauguguuggguaguuuuaugucaguuugauacaaggugaagucauuugagagccucaauuaagaacaugccuccauaauauccgacuguaggcaggccuguaaggugauuucuuaauuagugguugauagggaaaggccuaccucauaguggguggugccaucccugggaugaugcucuugaauucuauaagaaggcaggcugagcaagccaugauguacaagcuaauauacaccaauucauggcccugcaucaguuucugcuuccaaguuccaucccaguaugaguucuuacccuuguugcuuugauauggcauuguaagcaaaauaaacucuuuuucucuccaaguuguuuuggucauagucuuucaucacaggaauauuauuucuaacuaagacagacaagauguguuuugggaagcugcuguaacuacagaguagaaagcagaugugggaaagauggaggagacauagcaaacuggaggcccagagcccuguuauuauaagggauggaaagaagaaaucaggacagcuuuagcagugggaagacauacuucaaaagugaaauuuguuacugauuggcuaugaaaagaggggcccacagagcauggcagcuccaguaagaguuuuuggaaaaucaguuccaagguauacuauguucuugcaauuauggucugggauacuggcuagauugaaacuguaaaagaaguuucugaaugucuauauuaugcuuuuuccaguuaugugugucuuauucccccuucccuucugacacaugcacauauguuuuuugaauuauugauuacgucaagaucauuaagagcuaaaaaggugauuaucuacuuaggccucagucaacuucugaggcuucagaaaagucuaagaauucucuuccaccuuaacacuugaguagguaucugguugagcuugcaacuaaacaaccuauauuuuaaugucguuuguugauucuugcuauaucuguauccacauuuuuuuuuugacaauugaauuccuacugggcucccuuuaauuauaaguuuuucacacaauaauccuagauagcugggauuuuugguuuguuuucuguuuguuuuuuuguuuuuguuguuguuguuguuguuuuguuuuuuaauucugcagaggucugacaucuacccagaaacagucucuugaguuaaaaauuaguaggugguguuaagagggggcaacuuaucuagugugauaaguccaggccuuugauggauagcagcauggggcucugaggaaaugagcuguaccaaccaaaugcuuagcucugcaguagcaguggcauuggcaaccauggagagcaguuuuacgaaaucagguaacaggaacaguaguaguguuacucuguguuugcauuuuagaguggucauuugcuacuuuacacauccagcgcuacuucuacuuuggucagauuaaggaccuucccaaugaaguugauggaacagcaguguuuaaaauguuuacuuggacauuuagacagacuuucugguugaucucucuaaggagcucucacccagacuaagacaucgccaccccacacauaaucugaggacaauaacucaggauacaguacagccacucucaauuucucaaagguauuuaagaaccuaguggugaacuuuaaggagcuauccagagugauuacuggguccugcaagaagucuagaaaagaaagacaaguucucaaaagcauucuuaggguauaauaauagccugucacuccugcuuuuuauugcauuuuucugaauaaaaaagaagaaauuuaaaaagauauugcaguuuuuuuaaugggggugugugugaccugcuugagcuuuaauaauaaugauacagagacaucuguacaauauaaggcuguuggccuguuuucuugggcaguuccucagcuagcccaucuuaauuuaaccagcguuucugccacugugaauuaguugcaugguucucucucuucucugcuucucuccuccauuccuguccauguuucugucccucuuuuccucugccuuugcuuuauucugcuccuucugccccaucucuagccagccagcucuuaauuaugcaaaagccacacuccauacucauccaaugggcauuggggguuauggugauuggugacuuucacuauggcaacuugccuuuuauuuuugcacauauaucugcuagccaguaccuccagaacagaaauuaaaaauugagaguauagggacauuccuuacaauauguguuggguuggguuauccuaacagaaagaaaaauuuuuaaaguauaaacuguucugugggucccacccccauucuaugaagugaucaacagauaugcauuggcuagaauuugcuguguaacacaucgcuucaagauuuagugacuuaaaacaagcauuucuuuugaggucaacacuuugaguugagcuuggcuuggcagcugugcuucauuauguugguugccucuuggcuacaacaauggaggugacauguuagaacucuccccaccaggaugguuaaaagcagggacuugugugugcugggaagcaagaugcucaccagcuccucuuuuguacuaggcaauucuggauccaagaaagcccuucccauccagccacaauuuugagacaacauaugaagucuuugucuuucauuugccuuuaugcuugugugaguguuaugcauggguuuuacagccaguuuuaagaagacccauggaaguuuucacugauccaugaaguguuuggcaucuuuccuucuaccagcuaacaacuggagaaagaugugguuugguauggaaugagggaggcugagggaccucucaguauuuuucaggauugcucacuacacagucucacuggccaggaauacuacugguuucuucaggacagacggaugguaauaauuguguuuguuguccaaccuccucagcaccuccuuccuggcaggaggaagcugcagguuuuaacugaauguccagaagguaugugaccauugcuucaucugauucccagaccucagcugaaaucugaagcuuccaggagcaccuacagcaggaagccacuucacacuucacacaaagaagcucaagcagcaagauuacagggaugcauaauaaagcaauucuaugaaacauaaaauugaaauuaaagcuauggagugaagugaaguggauagaaugcacugcaggagggcuuuacuccugcaggagggcccucaugcacuccaacuuguguccaaagauaacucauugcagacuuguuucaaaacacacugauucagaucccggagcagauagaacccugucuaaaccugccuguaagcuuugagccuuuucuucuuuaugguaaaagaggggguggggaaagacaaguggguacucacagagcacuggcuccauucuaggcacuuugcaaauugugucguauaaugugucuaacacuauagacagggaauacuaagaucucucccuagugaaggcugacacaugcuagaaacccuuccagcaucauacaaguuggcuuugcuagaaccuuuggagcugaggcagaucugcuaacucuagauucuugccuccgaaugcccauaaugguuauuuugucugucuaucugucugucugucugucuguuuuggagaggggguauacuauggcaaaacugcagaaucugcaaauugaucacuggacuugucacuggccuucuuggcuucugagaauccccagccuggucucucugagacuuuugugucugugcuuccauucagagacuugggacucaggugacugcaacuacaguggagacugugcaguuaguuauacacggcggugaguccucagcagacaaaugaggagacucaaagaaucugaauaggaccagacgauuuugacccaaacgacaaaaaacaaauucagaaaaugauaaaugguuuuuucaaaauugauuuuccuggcuucaaauaugagggauuaaccacauaauaauacugucaggggaacuuagacugacuuggguagagugauuuggaagaauuuucuuuucuuguuuuuguuuuguuggugguggugguaguaguuuuuguuuauaucauugcauugacucuucaaaaggaagaguggugaaccuuaaagaaaguuagcuuaaaaaaacaacuagccuccucugaucauggguaugagaaaagaaugauuucacaauuaagagugguguuagcuauguaaauaugcugauaugcaagucacucuccuugaauauuguucuuucccuggccaaguuggguacuagaucugccucucaagaucacgucgagucuaucuuaagaaagauuuuuauuaucuuauuuuaauuuauuuuggauugcguuuucaauuuguucuuuaaugacauuuuacuuuuucagccuuuaguaauaagauguugaaucauugucaucaucuuuuuuauuccuaaauaugacuuccuuauucuuaaaaggaauuuaagaauaaauuccuuuugcaauagcaaacguuuuucuuuuccugccaaaugcacaucugugcguacucagacauguucgccugacugguuuuuuuagcucugaauaugggucaugcuuucuagauuuuuuuuucucgaaauguaaauuauugaguccuuccucuucuacuuauuauuauuugaucuguuagugacuuuccuugauuaaaugugcacgcguuucuucuauggcauuuagccuaugauauuacuccaguugcauuuggcuuucucucccuaguuuuccccucuuccacuaauggcugacuuucugggauuaagauuauuacugguuagaaacugagucuagcaguugaugcuuucaguaggcucacagaucccguguuguugggguuauauacuccagcaacuuucagcuuguccuagaauccacgguccaccuugcucccuccugcuuuaucccuuucuuugccccaacaucacccugcaugagcagugagcuuacauagcaauauagcaucucucuggcucucuuguuuccaggagcucucuauuaaauuuuugacuagacucauuuugacgcuugauccaauacuauauggucuuagacuccuugacccccuuuauaacuaggcauagaucuccacuuucugcuuccaucaguuuagacccucccaucaguaaaucuccugguauccuuaaccaacucuaaaaugcuucagggacuguacugagagaagaaguggagcaacccacaagcaggacagcaggaacccaucuguucuuauucaaauucaauucuuucccacaaguaaauaucuuugguguguuguuggccuuuguuauacuugagagcccugaccuggcuguuguugauuacuuuucaaguuucuagggcggggauuuggcuuuguccuaccuuucuaccaagaacucuugugaagauuugcuggaacauuaugugaaaaucuggacaugcacgaaccagacguggcacauauguauagagaguguuuagaugugaacagauaguauacccucuaccagauaaccagugagccugucugggggacauuucuugauugcugauuuaaguagaagggucuaguccaccguaggugguaccauccuuaggaagguaguucugggcucuauaagaaagguagcugagugagccaaagugaaggagccaguaugcaguguucuuuugugauuucugcuacauuuccugacuccagguuucuucuugagcuccugacuuggcuuccuugaugguggacucuaacuugcaaaauauaauaaauccuucauuuuuucuucccugaguuuauuuuuguuauguucuuuuguuuguuuuguuuuagucuuagauuagauuacauuagauuuagauuaguguguucugucuucauguauacuuguguaccauauaugugcaaagcccauagacccagaaacaugguguuagaucaccuugaacuggaguuacagaccuuugugagccaucaugugggugcugggaauugaaugugaguccuuugcgagaaccaccaaugaccuuagcucccaagccaucucucuagccuuuuggucaguguuuuaucauaccaacagaaagcaaaugagaacugauggcuuguggaugggcuaagaauuuuaaucaaauuaauuaucuuuaaauaauaugacagaucacuacuuacaguauuagaaaauugagcuauucauguguuucccuugagauaauauauccuugaaaaguuguauuuagacauuucugcuucuuugggaucacagccgugucgugugcaauggagcuaucuuauauccuaguggcccugugugauuuuucuagugcucuagcuacacugcaaccuuguucuguucugugagaaaguauugugcggauaacuuugguucgccaaaguucgaauuuuaccuuaaaaaaaaaacccauauuugcaaagcaucauccauauaacuuauuuauuaucuguguguguguguguguguguguuucucuuccacauuguuugauacaaagucucauagugguuuuuuugguguuuuguuuuacuuuuguuuguuuuuucuucugacauauaugacaugacuucuauccuaaaagcuucuggcgauucuucuaucuuaacccucacaucucccuguaggagcaucaugaucauaaaugacaugcuuucauguccagcugcacauguguucugaugauucaaacccaggaucucacucaugcauggcaaauuuuuuacccauucagccauguucccuacucuuauuuacagagaaaugaaauauaugcauguuuauauuaccaaacauaaacaugauuagaauauuaugacugauuauuuuaauucaagguauggaaaaucauugaaauauacaacuuacccauguuucucaaauaacaauaauuaacaauauuaucuuaggcagguuucucaaauaauaguuaccaacauuuaggcuucaggaaacccuuauauugagaaaugaacucaagcuguacuaacaaggauuucugacaguugcauaaaagccagcauuccauaggaauuaugaaaugaguuuucugcaucccacuccaaagggagccauuucccuuaccucuuucacaagggacauaaagcucuccaauugacauagaccuguguauggugucugucagcacauuaaagcccauucugguaucuacguucccucaguaucacaagcaccuuuuauacauuucaaaguccuugucagcauccuagcccuacauauauaugucuucuauccuaaacuuccuucagcucacuggcuucccuaucccagcuacucaccacuuuaacaaccuggcuaugcuugcuaucuucucucucucucucucucucucucucucucucucucucucucucucucucuucucucccucucccacuucauuaacccuggccauguccaguuucuuuucuuuucucucgguccugaacucuuacagauccuucuggauauuuucucucucuuacucucaauaggaaucuuccguaacaaugacguggucaugcaggcaauuucuuuacugaaccuccucacauacugugucaccaucuuccauauuuuuaucuuuuaugugucaguagaggcacugagguauauaauaaagccauuugaugagaaggugagacuuucccuauagugcauccucuuguccuagaaauucaaggucauugugcauauucccuuugauuuuuuucccaugcccccagcaccaaccaaauuugcuggaagcagaagagacaguaauuggaauauguagugcuuugguuaacagccuucauugugacuacuaggucauugucagucuccugagugggugaagaucuguuauagcuauggagcuaauaaacagaaucaucauagagaacagaaccuccugucccugaaagaugaucauuacugucacaaaaucugcccuuucuaagcuacacgcuuuuuagcaugguaauugugacaaaugggguuugaauaacaaugaaaaggaaagcccauaacugacagauccucuuucauccucgguuuugaacaauacaagaagaauuugaauucuaaaugaaauuguaguuauacuaaauuuucccaaucuugacuaaagucuucuugucucaauacucaaaaaaaucuaggacagguugugcugguuaguuuuccuugucaacuuuacacaaccuagagucaauugggaagagagaacuucaauuaaagaauugcuuacaucagauuggccugacugacucauggucauguguggagggcauuguguugauuaauguaggcaggcccagcccacuguggucagugucaucccuagucaggguucucuagaguaacagaacuuacagaaugaauuucucucuacauauauaaaaaggguauuuuuagaauaacuuacauacagccugugguccagcuaacucaacaaugcugccuaugaauggaagauccaagaauccaguaguuguauagucuaugcaguugagugccucagcuggucuucaguauauaucagaauccugaggaaguaggcucuaaugccagugaaggauuggacuugcaagcaggacaaaaggaugcaagcaaagagaaaaagcuuccuuuuuccaugucuuauauaagcuuccagcagaugauauagcccaaauuagaggugacucuucucaccucuaagaucagaaagagaaaagaaaaaauaaauaaacaugagaguucaauagaagauuauucuuugaauucaaagaugucauuaaacgugaaaugauggggugagaagauggcuaggugaagauggcaaacaugaggaccagaauccacuuacaaagccaagugaguguggcaguccaccugucaucccaguacaaagaaggcaaggaagugacccuuguuaugacauggcuagccagaauaaccaaaauggcacacuagaggauuaguggggaaaaaauuggcacaagacacccagugccaaccucagaccuccacuagcauguacccacacccauuuaaauauguguguaagcauacacacuacacacauauacauaugccaagaaacauauuuucauacuauucagacauuauucacaugauucagacauuacugagcacacugaucauagcauaggcaaaagucccaugaaguccaucaauaaaucuaacaaugaguacauauuuugcuuaguguauauucuucauuucuccucucacagaucaugucacaguaucuucuggcaucauaaaaacaaacaaacaaaccgugcaucugaagcaguuuaucuugcuuauauuggcgauagacacugaugaaauuuaggagggaacaguggguggugauggauaaugcagaccuaggguuggagcucugaauuguuaaaaguuagacucuuggaauuguaggaagaggcaaugcccccuuccuuucuuuuuuacuuccuuuuuuucuuuuuuuguuuuguuuguuagagaaguuugccucuuagaaucauuagaucuuggagacagagacuguccucuauagaaaaaggccaaacucucccugcaauggucaugcauugcagccgguguggcuacuguuuucuuaaaaagaaacguaccauaugggaacagaagggugagagaaagauccccauugagcaaugcaugcugaguggaucuuuucuggacuuuuuuuaaugagagcuguguuuuaacucacacauggaaaccaaaagaauagcagggaguuuggagaguuuagaagcuggaguuuccuauagauccucaaagaaagguuuuuacuuuuucucuuucuccuaggggaaaaaaaaaccaaaacaaaaacaaaaaaacauuguuucucuugaaccagucaccugggaaaugugagaccuagagaggaaaugcauccaccaucuauuuuaaaacacacauguucagaacacaguucauguugugggucacugguguuaauuggaaaacaucuccagagucuguagcagguuuucacauugcgccugaagugcacuuguaagcaaagagccaguguacaguagugccuuguguuagagcacaaguacuuagaaaucccucuguuagauagcugaauggcagcaaggccgauguagggagucagugcagccaugaaaccaauggacuacaggcagcaagggaacaguagaguucacucagcagcauugugcuauugcauucuuaaagucucaggugugauguucccuguccagcuuuuacucuguggaacauaacauggaggaucauuaaaccaucacuguuucagagaggcaggagguauaaaguaugaaaugagguggugguuacuguauaccaaagaaugagagaagaguaaaggagagagagaaagagagagggggagagagguaaggagggagggagggacagagggaaggacggcaaucuucaggaacccuaggcaagcaucuggcccaaggucuuagaaauucauguugcuuacuaagaaccugcugugaacauguuaugaacaugguaugcccccuccauguccuagcuucuguguugagauauugacuguaauauaauauugacuguauugaguuuucaaaucugcuacaugguguuucucugagcauggagaguugugacuaguuccauuuuagguguuugaaguuuauggcagcugauggagacaggugcucuaacuuugcuucagggaaugacuaggacuccauaaaugggcucaucaaaugaacgcaacauggcuucuuccuugguuaguacauugggcccucugggucagcuacaauugucuccuuguaacaucaagcccaucugucauaagcauguguuggaagugguguuagacccuuagacuuauaagacuuggagaucacagggcugacuacugucucuccauaaguacauuuuuuuuugucacauuuaggaucucucccuacugugauagacugaaguuugggucaacauaaccuaagguaaagaugaugaagacuucuaggagguuuuuuaagagaaaauacacacacacacacaaucuaccaaacaaacaagagguguauuuuguuccauuaguccccuugggugcugaaacuauaucaaugucucaacacaggauugccauggguuggauggauaugguccuuacaauuuauguuucaagagcuugauucuccaugugcuaaugugagaggugggacuaguggaaaugacuaggccaugaaggugucaauuucagaaaaguuaaauggcucccguugcauugguuugguucucaagaaaggauuaucauaaaaaaggaagaccuuccccucacucucuggauucccaccuuaucauggauguccuccacaccacagaccaguccuccauggcauuaugaagacagaaacacucaccaaggauacuauuuaaauuuucauucccccaaaacuuccugucuuuauaaaccaucagguguuuuauugaaacaaauauaagaagaaaucccaauauuucuauaaguccucaagauguucucagagguaacgggucaaagagagucauaguauucaaugugcuaguaaagacuaaaaaaaaaaaaaaaaaaccaguugcagaauuucuugucauucuauuugugaugaugcugugcuuaacauaacuaucuucaucugacuagaagguagcuaugucccaacugcucauauugccuuuucagcagcaucaccagcuaccaacagcaacaccugacaaacuacaguuguuugggggucaucuggguccagaauuagcucugaagucuaggagcuuuggagggccacacaagauugucuaccugccagcauuccacuuaugggaagaucagccuuauguucugucucagagauguacucacguuuugcuauagccagucuauggauagcaauguaggcacaaaauaaaaccagauuggucccugugcagggaaguuugggaauuucuacaaacugauaaaauguuccucuuuaccuuuggcuaugaauauuccacuggagaggaaaggaagacaacugugugaaaggaagacaauuaugaacuauagaauuauagacaagaaagaagacauuccagccacugcuuuucuacccugucuucauguuaaauucacauuuacaauuaggcauaauauuccugaugcccugaaacaucauggugucguggccacaagggcaacucacaccaaggaaguuggugauuaacccaaaggucucacaacuaggaagagacaaaugaaauuuuaauaucccccuuuuguauaugaagguuacacugaucaaaauuagcuggaucaguacuagaauucauggaaauggcuauagaucacagggcuugcuuauagaaaacuaaggagaagagaaggcuggguacaaaaguaaacagauuggcagacacaugaugaagccaauuguggcaucugaauggcagcuacaagagcauuugcuguaggauucuuuuaacuguuggugugacuuauguacuuaaaauauauguuggugcaaaacauaucauggguaguuuuuuuuuugugccauuuauuaacuaaccuauucuaaccugcuucaaauguaucauacacugacuacuuuaguggugucuuucaauuagaaauuagguaagaaggaguuacagagacuaaguuuggaguggagacaaaaggacagaccaucuagagacugccauauccagggaugcaucccauaaucagccuccaaacgcugacaccauugcauauacuagcaagauuuugcugauagaacccugauauagcugucucuagugagacuacgccggggccuaagaaacacauaaguggaugcucacagucagcuauuggauggaucacagggcccccaauagaggagcuagagaaaauacccaaggagcuaaagggaucugcaacccuauaaguggaacaauauuaugaacuaaccaguaccccagagcucuugacucuagcugcauauguaucaaaagauggccuagugggccaucacuggaaagagaggcccauuggacuugcaaacuuuauaugccccaguacaggggaacgccagggccaaaaagggggaguggguggguagggaaguggcggggggguaugggggacuuuugggauagcauuggaaauguaaaugaggaaaauaccuaauagaaaaggaaaggaaaggaaaggaaaggaaaggaaaggaaaggaaaggaaaggaaaggaaaggaaaggaaaggaaagugaggguuuggggagcagcaauuaucauucuugacauaaguuauuuucuagagagggccaaaaaccuugggauuuuauuguuaaucugguaauauuuuguuucuuaaagcagggaaauaaagaaauagaauucauuaaaaaacauauccuucuuucaggauagucaucucucuguaauauaaguuugcccaauuguccucuggauuuuuauuuauuuauuucaauaacaauugucuuuauuaguaccuuucauuguuaguugagcuaagcaagaggugucguuuucaucgcuucuuggcauuuuggcuaagaucaaguguagaggugucaguuuucuugaucauuucaaauaaacuucuguuucuuugaaaaaaaagaaagaaacuagguaggcaagcagauuugcucuuuuagaugaagugacuaaacauauagggacucuauucugaaaauaaaugguucaucacaccuacauguaaaacauauauccaugaaacuuugaaagaaauguagaaauucuccguaauauaaguauuagauaaaaggguuuuagaaaugguaccaaaaccaaaauccaaauuauuuuuuuaacuccacaaaagucacucugaauaugacuuuaaaacaaguuguagaguaugugagaauacuuaaaaaaaaauacauaaccaacaaagcauuuguaugaaaauuucuuaguuucuuuuuuucccuugugauaaauacucugagaaaaguaauuuaugggagaaaggguugucuuagcucacaguuuuuaguuauaguucaucauaguaggaaaugcacagugcccagagcaugagggaaugggucuugucacagccauaguugggaucagacagcaaugaacacacgcaugcuugugcucagcuugauuucuccacucuuacauaguuccagauccucugccuagggaauggugcuguccacaacagacugggucuucacaccuuaauuaauaaaaucaagacaaguuccuacagauauggcauaggcuaacuuuauguaaacauccccucacuaaaacuuuguuccaaggugguucucaauuguguuaagcuaacaauuacacuaaccaugugagcauguuagcagaguauguauaaauuacucugaacacaaauauaaguaaccaaacaauuuagucaaaaaugggcaaaauauuuaaagauagaaucagauagcauaaacaaauggcaaaugaacacacacaaaagauguccaacauccucagccaucaagaaagcucauagaaaauccaugacuagauaucacuacauaucuauuaggaugacuagaaucaaaaagauugggaaagaaaauaaaaaauaaaaaauaaaauaagaaaaagaaagaaagagagagagaaggcgaagaaaagaagaagaagaagaagaagaaggaggaggaggaggaggaggaggaggaggaggaggaggaggaggagaaggaagagaaggagagggagagggagaaaagagaagagaagagaagagaagagaagagaagagaagagaagagaagagaagagaagagaagagaagagaagagaagagaagagaagagagaaacccugacaacacacaaagugcuggugauaaugcuaaauaaacaguguugaaaauugcugcaggcucaaagaaaaaaaggugacauaaaaucacauuucaagauaauuuuauuaggagaguuacaggcuuauagaaauaauuaggcaugaugaggcccuugaugaguuugagagugccuuagaagaauuagagcauugcauuguugucagcuugguggggucuuggagggagagggagagccuugaaaucuguaggguaaugcucucuaaccuaacagaguucccagcuguuucugauggaaauacaacauaguucagucgcucuaaaaaaguguuuguuucuaagaaguuaaacuaauccugucugacuaaguaauuuugcuuauguauguuugagaaaauaaaaucauaaauccacaugaguuucugaguaaauuuagccauaauauuuauuuugaauaauauaaaacuugaagcagcaaaauguccuccaguaaaggaaugaauagcuacauugugguccuucuuuuucauggauuauuagcaggaggaagagaaugauacacccagaaaacuguauguauucuaggaguguuacacuaacuguggaaggcuuggcucacaagauugugggcugugcaauccccugugaaugacaucccuaaaagacagcacuguaagaaagacaguaguucagggauagucaguagcuaaggcugagcaggggugaagcugguagaugagggagacucuuggaaaucauuaucucuugauuauuugaugguuacauaagccuguuugagugucugaaucuacagaaccauuacaaccgacauaagacaguagacagcaggcagcuucaggaaggccaacacugagucacagguacuggcgcugauggcauuguguggcuuugaucguuggacugugguuauguaaggcauaagugagggcauguggggacucuguucuaucuuugaaacuucuacaggaacuauguucuauuuuuaaaauuuguaugagugucuaaaauuauuucaaaguguguauauauauacacacacauguuauuuugaagugaauauauacuauuucaaaguauauauauuucugugcauucgaaguacaugcaagcuguguacuuuaaauaauuuaugcacacucagagauauauguaaauaaggugauuguuacugaauuuuaauauucaguuuauagccuucaaauuccaacugaacaagacaagguaaauaaaugcuuuccuuugaaucacacagaacuucagauaaucuaagaaaaauguaaguuagagaguuguuuuaaaaaaagagagagaguuguuuaaaauggcugauacccaauuaaauaaaauacuuagccuguuugcugaacacaaggguuuacuauaauuaaugcuuucccaaaagcaacuguuggcuuagaaaauaauucucacaaaugaaggagccuaccuacacugugggugcuucuuagaugugauguuuauagcucuuuggucagaagagaaggguagagcuaagagauaagaugccugaguacaucagagucucccagaguauaggaccauacacaucccauguuuggcuugccucggaguugcagagauggaugauguagaucccaaauucuaaaacuauucagagacaaugaugcuggcaggucccuagaauucggagagagugaacugacaccagacugcucaggugaugaucugcuguuccccugcuguugaccaaaugcaaugauagucucaucucaggcagagaggcugacacccuagggcagcugacaggacugggaaaaauacacuuguagaaauggccaaaagucuuauaaagagagggacacagugauguucguuucccagggcauuuggaguaauuuuguuucauugcagggcaaagagacuauuacugagaauauuuguguguagaugaauuuaaguuccuucaaguucuagggaguacuggcuugcuaccugacuauacauguccuagaacacacuccuuauccugcagucuauaguuauguuccuaguauucuauugaguuccuuuuaguucacacuaauggaacaguaccagcauccucuggcucaaaagaacaguuuucuuccagauguguuaacagauguuugcuugcugaccuuggaguaggugcucauuuguaguguccuuuaguaaguuuuccugaccccaagggcccccuuuggauugcuuggcucaaacuuaucuauuggaaguuucuuauauucuuaagaagagaugugugaaccaaagaccacuaaguagcuuccauuugaaaacaugaaaaggacaaacaggaugggaugccagauugcauauauauauauauauauauauauauucauuccagugguguccacaucagcauuuucauuuaagcacaaucagaagaggggaaaauagaugcagugcuugauccccaaaggaaaagaauucaauuuaaaguauaauuuuucuacugaaauagcuuaugaaggauuuuugacauuuugugugauugcagauauaaaguugcaggccuaaaugcagccaauuccuguuugcccaucuccauuuucuuuggcuuucaucuucucuuauuggcugaaccauccuaucuauagacauagauuuuuucuguacucuuuggaaaguugcagaugugauguuucuuuauuccuaagugaauuauacauagaacuauuuauauauaaaacacacgcaugcaaaaccacacauauccuaagaauaaaauuauuauaaaauuaccaguuacaauacucuuucuuaucuuuccuagucuauaaagugugcuuuuuucauuucuuucuauauugcuuguguagcaaagaaaaauucauguguagcuucuacacagcauauacugucauaguccugcugucuucuuuaacaaggagagcccuguugucuugguuggucaugaccuugacuucugcagaauaugggucagcuccauugaagaucagcuauaugcuuaggcaugucugauuuacucuguauaauugaacuuaagcuaaaaacuaauacugucucucccagugagacccgucaaaaggccaguaacaucuucuuaccuuuugccaaugugggugguucugacugcuuccuuuggugacugccagauuucucacugaccacagaacuguguugcuugguaaucacucagauauuugcagggggcaugcaaugagaccagcuuauguuagcuucaaauacccaacuccugcgcuucucgugauauuugugggaaggcaauguacuauagggaagaacauuuccuucuguauuuauuuuuucaaccauguauaauuuuguuuugguguaaaccaucaauucuugugcauccaaagggcugcugucagaauuuauaguguguuuauagugcucacuuuauucugucuggcagaaagagcuccuucaaacuggauucugauacauccuuggucauccccugugaccauuccugguggauccagcugcucagguugcaucuuacauauugcuagcccuaaucuaaaaucagcccugucucaucauuggagaauuauauucagaaagcaagggcuguagguacaggcauucacucauacucugggagccacaguuucccagcagacugagcauggaagcaugauguuuguacauguauacucuguguauaguauacagaaacaugcauguuugcauacuugguaaccagaggaaauuucccuggguaaacucuauuagcugaacugacaacaaacuaaugucacucagaacgguaaucugugggacuguuacuguauaugguguugucacugacugacgugucaggagguacagauuuguaggguuuuuuuaaucuuuuauagauaugguaucuacccuuauucccuucuggucucaucuguccuuuugauuuuuuuuuuuuuuuuacaagguucauuauguucuccuaugggacugcaugcagcccaguucaucuaaccaccuguccuauggcuauucucucagaagugaaagcauucuguccuggagugagaaguaaacuuauaagaauuaguaaacucagauagucaccaugccucuaggcaaggucauauaaggaauaaccacugcuggugagagagacacugggaccagcggaucuaucuaaagauuguacagggagccccagggaugcaagcuuugugauucaucacccauugugcgucggccuuuggaugauucagcugccaguguguuacccaugcucccguaagugacgacuugaacaaacucauugcuucuccaagcuagaauuggggagaauccauucuuaggucuaccauuugccuaucauaagcaugugcagauguuugcuaaugucuguccaggaagagccaugcagcauuacccuuuuugaaugaacauacaaguucagguauuuccaacaccacagaguacacauaacauugcaaugaaaaaaaauaaaacaccaaaaaacaaaaaaaaacuugugcuucuguaucuuuuguuuuuaaugcuacaucuuccagauaacuugcuaggacugggcuugugaagccaaaaccuaaaagcuguggcuuuguuauaccuugacaauuuugcuucuuaaagauugcacugauuggcaucucaucagcccauuuccuagcagucuugucaagugcaacagcuacucaucaagucugcagacaggcuuguaaaugugguggggucugaagcgaaagcuucagccugugcgaggagaacagagcuuguucuuuuaaggucccaaugagggaaagggaggugcaucgucacaggugaguguguucaagauugacugguaucaccaaacuagacuaagagacacuaugcucucuuguaauucaggccugaggcuagucggcauuauuggauaaguggcaucuggaagagugaugggccuggauaauaagugaugccacauuagucacuugccuugucuauaguuuuucucucuccaggacuuugcuuucaggaagggaacauuucuaggaaggguggggaaacagguuaccugccuauaugauggaaaauuuuaaaguguccacgugaaaaacuguaaaaaguagauuguguucugaauuccccagaaaaauacaacaaacuagaguuaacaaauucuggaacaggcacuugucuuagaaacuaugucuguaguuuucauaugcuaugaagaaucaccuaugcaaaugaugcagauuuaaagcuggggugcauagcuccuaacuuauuugacagugaauagcuuggccugaagcugugaaaccaacccucugaguauuucccuauuacuuaaguugauguaguauauuccugguuuucuccagcaguagaugugguuggcuugugauuugagcagauguagggaccacuugguccuacaucaugcuaugugcccucuuacuauccaguccuagccugcuguuagccuauagcuuuugaacaugcugaucccuuugcacacaagucagauaccacauuacugaccaccagaaugaacucccauuuucuuccuaaaaccugauauuuauuacauauguuuaguauucuccaaaaaccauguaucaaaagcuugauccccaugguggcaguauccugugguuguggaagcuaucaggaagccuguaagucauuggugggugcauccuuaaagguacaaugggucccugauccccgaaccccuuccuucacuuuuguuuucugaacagucagguaagcaaguauggucugccaugaugggcuucuuugccacagguucugcugaaaugaaaccuucaaaacugagccaugguaaacuuuuccuuuucauaaguuaucucauggauuuuguuauagugacagaaacuggauaacacagcauacuaugaguuuguguccauaaccagaaauacaaaacauucccauugccacauuaaugaaaugaggacauagccacuccaagauaugauugaggaaaaggauuuuauuguagauaugagggaaaguacuaggccaugagaacauagggcuggagacaaguaaaagaaagagaagggacagggacaagagagaaggaagcaagcagaacaagagagccaagagaccaagagaacacgugcuccaaauggugggguuuuauagaaccauaaacugggggaagggcagcaaagcucauagguuggagggguuuagaguaguggaugccaugagaagaucuguaaggugccacggguacugaaugauccuggaggcccaggcgcacuuuguauauuaauagguaucagaguuagacaauugucucagguuucuuugauaccugacuccacacgcauugcucucuguccuggucaucuuuaucuguaucuugcugugcccuucacacuaagucuagggugggcugauuuugcuuuuaaaccacacuuguguuuauacucuguacucauuuucuuggcagcggugaugguucuucauccuuccugaccauugucuguguaugugucuccucucucaagguuaaccugauuuuaguggucuugauacauagaggauccccuaguugaaguuuggggauauucaacaccccuagauucuccaugggcuuugaggagggacacucaguuccucacucucucuuagguaucacucuugcugcugaggugcccugccugaccuccaagcaccugagaacuuucuguuucuuuaugugcccuauagauuguagggcagccuauuccccaauaagcuaaccccugagacuccugcaagaggaucuagaugcccacaaagguagcacuacucuuuuuuuuuaacuuaaguaauaauauuuuuagauauuuuuaaaauuuacauuucaaauauuauccccuuuccugguuuccucucccaaaacucccuaucccaucccucucuucccauaucauuuccuaggguugaucccacauuccuauugccaauagccuugucaugcagacuggguaaauuuuguaaaaaacaaaacaaaacaaaacaaaaauaaacaaaaaucaggcuuacuuuguugaauaguuccugggggaggcagaggagccccaucugacagugaacaccaugauagaaugcuuauucagaucaggguaucccaugggaagaguccaggagaauguagaucauuucuggucucuuucucgucuuaaaaagccaccaggauuuaauggugacaccauccuauuggccuuaucuauuccuagucauucccacguccagaugguacagcuggacuuguucccacucuuuuacucccaucaacagaugacuuuggaauagaguccuuagcauaugauuuuuggagauuauacuuguuaguguuuaaaugugagguaucuccacaggcuuauguguuuagacacuugguccucagcuaguggcccuguuauagaaucugcagaaauuguaagagguggagccuagcuggagaagggaucacugaagggagaacuuucgaagacuauaucuuggccuucuuucuagacauggcugucuguuuccucaucugccaagacauagggagugauagccacaaacuccugccacccaagacugagccacuucuguuucuaugccuccccaucaucacugagucauucuucugaaaccgggaggcaaauuaaaccucuccuuacuuaacuugcuucuugucaauuauuuuaugacaacauuaagaaaaauagccaauacacuacccaaacugcaaccuugcaagagaaugacugcaccugaaaucuuaagauucccaaaccaugauuggucuaacaauaguauuugccaaaguugccuucccaggccccugggcacucacaaaccccagaaacaauaacagaaacauuaucuuauagauaaguggggcuucuuaucuuaaucuaaccauugggcgcauacuuguagcuaaucagagaaugaggauuuaaaagaauaguacaugcauauggagcaacagcccucuaacauaauuguaugccuuauugucuugcucugccgccaugacuaaagacuuaccagaagcugcaccagggaugaauccuaacgaguuauguuucauuuggcuccugcuuucagaacaucagauuccaaaggccuuaacuaaacacuucucaaacaagaaauggauuugcuuuuugcccagaacaaaugcuuauuaaaagaaguuucccuuuuaaacaugacgugcauguacaggcuccucuuauucuuucacuaguggaaaggucgcccagccuuucccaugugauccccugccuggugcaauagcuucagguauguauuugacacaagugagugggaaugacagcuauucacagcuuucuucaagaccuggugcuugguccaaaaggcuaagcaaacauuuuacacaagggccugaaaccucaugcaaaguguauugauccaugggaguauggucugcauggggagcugagaaagugggagcuagauuugaagggcugucaccaagacuaacaaaaccaaagcaggacaaaauaugaauaacuuguucacggggcacuguuccuggaggugagccacacaauuguguguuccagcuucauccucaguuacacauuugcacacuaguuaacauacuuugucagccacuccauaguuaguugguaaauggucuucaggucuuucaguuacuccaucaccagcaauagggauguaacccaauauugcaggacaauuuuuggagauuauacuuauaacccaauuuuauuauuaacccaauaauaaaauuccucaugcugugaugauccccaaucauaaaauuacuucauugcuacuugaaaacuguaauuucauuacuguuaugaauuguaguguaaauaucugauaugcaggauaucuaacaaaugaaccccaaaggagucaagacccacagauugaaaacugcugccuuaacaucuucuugucucuuuggcugccuuauagcucugucuggcucugaaucacacugagagccuucagaugauggggagcagugagaaccagggagauggcaggacccugugccucaucuccugcaagacaggccccagagaguaggcaacagagacuucaccccaucccuuucagucacuuacguuuuuauuugguuuuguucuauguuaacuuuauuuuuucaucauucauaaaaauauauuuccauauuucaggauuuuaaucagguuagugucuucuaaaaguacagaaagucuucucaaggaauacaaaaucauuuaagggacauugagcuacauguuacugagaaauaaaaagauuuacuucuaaguagugcauuaaguuacucauuucuaaaguuuauuuauaauuguugucugucuuauaaaaguuugccuuggagcccgguaugcaaacaggaagaggauccacuaugcucaguuuucgcagugcuaggaaucaacccuaggguuugaauuuggugcaugcuaggcacauuccuuaccaacuaagcuacauccccagccuguugugaguuuacauuuguuucuauuucaccaccucaugcuacaguuucaaucugugggcaaccuaggcccaaauaguggaaacuaaacacaugcuccuaacauauggccaagaugauuaaugaauuauucaggacaauugugcucagauccugaaaugggccuuucuuguauucuauguuugggagacagcagaucucugagccauguagguaccacacaauggggcuaaaggggauaucaugguuuuuaaugugacccgauuuugaguaagacagaaaaaaagggacuuuguguuaguuuuucuuuuuucuauugcuuugauaacuaucaugaccaaaagccagagaaaaggguugaccucaucuuuuauuucaugagcuuuuagaccaucuugaagggaauuuuagguagaaacucaaaguagaaacugagacagagaccauggaggagugcugcuuacuagcuuauucucuugacucacucaacuuuauauauauauauauauauauauauauauauauauauauauauauauauauauacacaacccgggaccacauuccugggguaacaccacccacaaugacuggaaccucccauguuaaucauuaaugaauaaaacacuccauagacuugucuauugaccaaucugacaauggagacaauucucaguugaacuguuguuguuggcuaagacuauagaugaguucuucaucuagaaaaaugcacugaguccucucugugccaggacauaccugucaucucugccugcauggugcugcgaacagaucagauuaguagagagcaacacugcagagaauuucuggauaggucaagauucuuccaaggaagauuaagacaguaugucaaguuuuggggcaucucugaugaggagugauauuuuggggaagaauccccuuauaaauuaaggaaaugagcucuguguguucgugggagaaauguucugauagacacugaauacugugccuucuguauaaugaguggaauguggagugagacccaggaaucagcugcugguuguguuuaaugcuaagugguucaaguuuauauagguuuauguggcuagcagcugcuggcucaguauaaugaacccacucagaguucauuuuagggccaagugguuaccuuccugcccagauggccagguggaggaaggagcaugacuccagguccccacacuuguaaugacaccuggaagaaguccaagagacagggaugagucacacuuugcccccuagaaacaacccacagugcuugcucacauuacuacaaugaguguggaguugaauaaagaucaacacaaggauugaccuuguaacuauuuagcaaugaaaaaaaugagaauggagacccaucagcccaaugaggagauaugccagucaggggaucaaccaaucagcaugcacagguugcagggccagcaaccucucccuugauuccuguagcucacaaggagagaccucaugaguccuggacuuucguguuucccauugcugcagacauucccagacaguacccuaggaaggggauuuaaaagagagcugcccuacaaggcacauguguucugugugggugaugcauuguauuucauucccuugggugaaggaaacugcacaucucuuggucuggcugcaucuucucuccucccuauuugguggcucgaugcccauggccauuuaaaccuaugaggauccuacagauggaagagcaaaggaagcauuacaagccaggauguucuuauuuucucugugauuucucuugaaauuugaaaauccauuuuaaccauacugauuaauuauuuuagcgucaugcaagaacaacucuguaacuucaguaugugguucaguuaagaauccgaaaaauucuuauccugaagcccauuucuuuacugcauagggacagugcuguaauacuacagagacagguaaagccagggacuacagugcuaguaugcuugaguguaauugagcagcagagcucagccuugacugucugggaaauuuucaguaccuauuuguccacugccacgccuccacagccaucuuggaacauagcaauuaauaagcaaggucaucagagucccuguggccaaaggcaaggaauauauagacauagcugaaacaaaacaguuuuaugugcaguuggcuaugaguucaaaugcagcacaagccuggaaugaacagaggggcugacugaacagugcugucauuugucaagggugucaaccuuccucagccucucauuuauuugugcgcuguaaaauggaaauggcaauaacaguugaaugauuucuagaguugccaugggacacagugaccucaguagcacaaaauucuuuggaaauuaaacaccagaaccucaaaucacaaaagcuaagaaucuauacaaacguacaaauuuguugcccaugaaucaaaaccucuacccacaucaggacagcuuugaccugcaguuugagaaagcgaaggccagaggaaagaucaccuuuguccucugagugugaucuuagacccugaugcauuugucacaggcuaaccucucaggcacuucaugcagaggugacccuccagcaguauaguucaacagugcaaacuuauggucaggaaucuuuuuuuaugcauuacuaguuuucuagcucuagaagcccgagaggugacaggguuauauguggaaagguaccauguaacagacugaguacagggcauccuucauccugaugggugauuccaugcuaugcagggucugggcagugcaguccuggaaucuuguaugaauuaugcaucccugcuggcuguuuugauuuucauuucagauagcaauaaugauaguaauuuucauuuuccuuuacuguucuggaguccauaugggggauuguguacagaauaaaaugaauugaaauuccacagauguagugcuguggaaagaacacuguauaauuccagacacacggagcagagacugcaccaaacaggggacucaggacugggcagagaaaacugaucagcaggacagaagcaugauuggcagcuggccuuauagccuccaaagaugacuuugugcucuggggagugaaacugggggacccuaccccucaggccuaccuguaugugguggagagaacuagaccuguguggacaguggguuaccagcuuccaugcaggaccaccggaggacuucucuauuuguuauuugagugaauccagugcucuuugcuuguuuccucuauuaacuaaacagaaauaaaguucccccacacaauuccugaccucucaguacagugcuaugcuuucugccucauagcuaggauuuccaacaguuuugugagaaaauauuuugaauggaacaauuuuccuuuuuuccuauuuauuuauuuauucauuuuacaugccgguugcugccccuuccugcuccccucucacacagucccuuccccuaucuccccuuugucuccucugaggggauggaggccuccuggcuaucccccuacucugacacaacaagucucuucaagacuaggcacaucuucucccaaugaggccagaaaggcagcccacccagggggauggauuccaaagacagggaacagcuuuagggacagccuccacuccaguugcaggugaagaggacacacgugaggaucgaacugcauaucugcuacauaugugccagggagggggugggucuagguccauuggcaucuguuuaugaguggcuccaagcugcugugauagauggauagccuggcaaggcaggugucaaguggaaccaucccauagccaagcucaauaguguauacucaauggucuccagcuuggggcaggauaugaaugauaaugaucucuuugaaaaugaaaugauccauuacugcuuuguuuuuagaaacagugucugcagcaguuagcuagggcucuaucuuuguguaaaauaaaaaguugggaaugacaacuuuauguuuugaugagauaaaaaucuacaguggguggagccagccagggcuguccaucugggaagcaagcaugcacaggaccuacaagcuaucgaggugguggcucucccacugcugaguucuagaaucauccucccugguauucccaucccacucacgaaucaaaccaccucacagcagauucccagcagauucucaccagagcuuugagaaucccaugugccacuguaucacagugaagggagagcuacaucuauaggcagcuucucccagaacagcugucagauugccgugagggaggccgugcaucuguguggagcucgggcccuuuauuuccugacucagaucagaaucaaaggaaacuggaggguauccagagacagcaauucuuccuccauccacacuauccucccuggguccagaguacaaaagcaaaauguagcuaaggccugucuccuggaagucccucaaggccaccauuuuuaauacccauaaacccacaucaagauccugaagauacgugaaacaugauacuucucacuggccucccaaauaaacucacuguaagucuaagauguccuagguuagaauguauuuaauaccuggagaaaucuacgauaaacuuuuaaagaucuguaauuugaaccccggugagcuggaggaccauuuguaccacaauuguuuuccaucagauuucgccugccauuuaacugucuaagagcucuagccugggaaggccuuuguucucccugaucuuggucaguuuuuccgcugaugcaccauugcuugaggucuauacuugcagaugaucacgauaacaugaacaucagcaauagcaucuaaaacagcagucaggaagagccugcuucagccugguggcauuuggcuacuuuuucacugaugucccuccuguccuucccacugucucugcagagugacuacuccagcgacacagaaagugaggacaacuuccucaugaugcccccacgggaucaccugggacucagcgucuucuccaugcucugcugcuucuggccuuugggcauugcagccuucuacuugucccaugagguaaggccucuguuagcugguuauacagacuacagggagauguucacccaagcacaccauccccaaggaagcuuauccauugccaugaggggugucuguaugcaacaagcuggaguaccucagagugccaggcaaguuuguuguuagguugccuuaccuccuggugacucaguuuuggccuuguagugguggcauugccuucagaaacagaacugaugaccaaagcaggcauccaaccugccugagggcagauggccuuugcaggcuugacuuuuaaaugagacuuggugugucgcuguggggaagaacaucuggaccauauuagagauuacauuguaaacacugaaccuggccagaagggugaaaaugagauuuguuuuccuuguuaaaggcucauuuuaaaaaaauauucauauaacagagccugguccccagcaguccauguggacccgugcugagugggagaccccaaagguaccaauucccagcucaucuuacuauacugcaccccacuggaaugcaggcuuugaaagaaguuuuucuuagcaaagaaagagacagccuuccuauccuuaugcaucaaagagaggcauuuauauacacugggaaaagcaugaaauuaccaucaccaccuuccacugccauuguccaaagcagaacagggagagaggcagcuccauguagcacagaguacuagagacuccagugcauauggggauucuccaggugguagaugaccccugaggaugccaggauaccccugcuggcucauagaauucugagagugaggcuguaaacaacugacauucuugaaauagauuuuuccuaguuugaacauugcuuuccugccuaaaccuguaguuacuucuagauggcuucugaauugaugaaucuuggauggcuguggcaagggaacccuugaguggcucucucugcaccaccaacaaaguaggaggcagaguacacuggacaggguguguauguggacggguguaaggggcacauauggaaucagacaaggaggguggaacagggcacagugccaguucugugguguucuuuggucacauucuggaagauuagcacuagggugagugaucuuggaccccuaaggucauuguaagagcuuguucuagagcuagcccuagccuggagggucuguguauauauucucucuugugaauguguucugugaaugcagcagaccaggauuuccaaguaucaacuugaguggaaauccagaucccuggguccaggcaguuguuagaugagucaggcucagaugaccuuggcuaacaagguuccaaaggcauuacucauacaguaguacaugaggcuuuggagaaagaccuguuugagguauucauggugaguccagucugcuccugccuauagaagcaguaccauaagucugggguagguaauaagccucacuaauaaaggggaggucaagacaaugaagggaaaagaagcagcucgcucuuuacucuauaacggcauuguggcuuugucucaugagcuaaacaugcuaucaacugcauccaaacucugaaucuugcacuucaaaucugugacaucacagacuaggacguggcauaucugcucuccugggagcaggugcacaggcaacaaugaaugaaaccagagcuaagcuuugacaucacgcuuuggaaugggggugguguucuuaucuuauguuucacuggcagaggugucaccucuucccaggguacuaggaacccuagauaaaugacauaggucuaggaaugguggccuguguguccauaccagaggccagcuucaucaaaccugcuacggaucccaaccagauuccugggcuaguugaggcaggcucagaugagcuuggccucuaaggucuccaaagguacuguccagaaugcagaugaggguacaugaggcuuuggagaaagacuuggguuaggaaucuauggugagugccaucugcucccaccuauauaagaccacccuggaugaucucugcuucuucacauagucugcagugaagcccugucuucuucuagguagaacauguuguggccaaggagauuagagaauucagacucucaguucacauauuaagcugcucuuuaugugguaagaaucucuuagacuuagaaggagucaagauguuuaauaccuuuaguggucaagaugauuuuauugugcaccuucuguaccaccagcuucuagugaccuuuugauuuuauuuuauuuuauuuuauguuuuuggaaguaaggcucacuuccuugcacaggguggggguaagucugugcugguggggaaaggagagaaggucccugcuccucucccuccuccccagccucauuugcacuguacuuagauaauggguucacugcuguggaacccagagcuaugcugcuguuuccagucugguuggagucuccuuugcacagccuaugucccagugcuuuuuagauggggcuuccaugcugaaacacuucccagaaucucagcccagccaggaggcugcugugcauucuguuuaugccucugcagcccaaacugcagacagaaaagaaaucuccaggccauuugaggagagcaugcagcugccaagaggagagugcguggcauggaagagaacagacacacucagaaucagucucuaaauugaaucaacacuggccuggacauuaccagcugggacuucuaauccuggggccuggagggagaagcccagugccuucucuggagguucuuugcagauguugucaaggcccagagugcucagcuguggagccucucccucgagggggaggggcugggggggggggaagggagcuacagcccaucccagcucuauucugaaauuaugcuccccuaggcuguggcacugcuuaaaagauaucuuugacauucugugcgacuuuaguuguuuguugugguuucuuuuccuuucucacaaaaaacuaucucaguauccacuagcaagucaacugugccuaucaacugucaaagcaacaacucagugagauuauagaaauacacaggacuucagggaagcuaagcaaagaugggaguugggggagauuaaaucagaggugaaaagaacggauggcuggccugguccuacaaacuugggcuuuugggguucugccuucuucuaggcagagcccucuuuuauggauaaucccuccaugccuguuuccugauccacagcaugacaucaaaauaauuuccacacccacauuuucccagagggagcacauacagaaagcacaaugguacccugcugggguugggagguucaggauauagagucugacagggaugccuguccuugacgcucugaucuguaacaaaggacucgauauagaagcagagugagggccagcaaguguagcuuucagcucacgucauuuucauggugugaucugcucccuaaugagagccaguucuauaaaccaguuuauagagaaagguaugggcugugcagaucaaauuagaaacucguguuuccaaucuagguugagaggagacauaaucuccacauuuugcugagugucugcuguaagacaguuaaugcacacacuuuaucuucuuuaaucccuccaauaagucuaaaacuaaaaaaaguuaauaucuucauugaaauggaaaagaacguuucaagguuucaaacaacuuccagaucucauaaaggcagaaagcacagagguauguggggucaaauacugggcacuucuagccuuuaaaauggauccugcugcaugaaccccagccuccaccacaacaggggauuugugacccucguuuccaugagaucacuuggauguucacacugaaugcugaaggaaucagccaguaaacuuguuuuuaucugaguucaagcacacuccuaagaccacaggacuaccuccucaaucccuugcccccacaccccacuugaagaaugugugccacagggaucccaggagggaaaugguaguauuugacuuuguggcccuacacucuguccccugcaacagaugguguccugaaacuguaguuggacacauucccagggggcuuugggucuggaucuacgucacagucccuggguuugcaugaguacagugacuagcagaaucuucucuuugaggcauuuauuaugccuugauuucauuucauuucauaaaaugcuucuuuccuuuacuaacagcaacauuacagcaauaauuaaaugggagauggguacucagaaccagauuaggaacauuaugaauaggggcagcaaaaggaaccaggaaaaugaggggaaaggggaacucaugauccugaagaucuggaggaacgggaguccugcagaaucugucagcaucuucuugaaauguaccuaugugccugugucuauugaacacacagaaugugucagccaugcuccagauacccaggaugcugcaguaaauaagacaggucaaacucucccuuuguaaaguugaacuuccagugaaggcaggcaguggaaaaacaagaauaaacccagaggaguaugaaggggagagauaacauugcaaauugauuugggagauaaaauuuuaagaaguggucauagaaggggcugcuagggagguugacuguucaugacaagaggcacuuuugagaaauagccuuccuggcagaaacaagcaguacaaaggcucugugaugggaacucgcccacacuuaugaagaaugaccuggcaugacugaagccaggaaacuacugaguguaagaguuggaaaugcggacagaggaaagguuaugcuugugggagcaggccgaggaccuuugucuguaaaaaugaguugagaucacuugggugcaugaugagccaugugcuauuacaaaagaaggcagcagagccccaaaguuaaaggggcucugucucuauaaaccagaagaaagccaguggaccugggcuacuccagcuaccgggcucuuuauaaguagagagacugcaaugucuuuuggaagaaugcccuacgcgucugcauggugaugugaaaggacaggcaaugggguagauggagcauuacacagcaggaagguaaguaugucugaggagcaggauggggcuggagguuugucuuggcuucagcaagucuguuggcauggaagagggucacagggcacguggaauggauaugugaguuggggaucaggggagaagucuggauacaaguaugagucaaggcagaacuaagacuaaagaaccagagggacaaagggggaggcaggugaacauaggacaguccucagagacuagagugaccugcaaucugaggaguaaacuccagaggcaaugggauagaacccuucuagggccaacucauguuggccauacacugaaaacugcuggaaacacuugugauuuguccauuuuucuguaaguuuauugcacuucaguucaaaggaugcaaacauccauggaauauagcaguugaaugcagcacacagaagaaugcccuuugaacuuugcugugaaaggaauaugguaauauugaauguuaaugaagaaauguaaauggcaaacuuuuuguuuauuugcuuaauugauuuuauaaugcgaggcuuucaagggagggcauccagcauacuaggcagacuaccacucaacucaauacuagucucuguuuguuuugagauuaucacacauguauauguguaugcaugcaugcacauuuuauaccgaguguuugugcaauguuucuucagauagaucaaauagaguuugguugaucaucaaagagaccaaacagcauggaguuuccauguugacucugaugggagaagcuuucuggggagagccugugugaugauggugggcaagcauaagaaggugggucaucauccucagaaucccaggauuuauccuuaguugcaggcaaaacaaggguaggguagauguggauggaagcauggaguagaggaaccucuccaggagaggucuugcuuccugggacaaccugaaaucuuucucagaggaagaaggaagugugggcaguagauccugggcaagaaaagugugggcaguagauccugggcaagaaaaguaccagacaggaagaaaggacugggagcauuuaaaaggcaagcugcugagcagggauguguguaagggacaggcuuccuccagcugggcacaaggcuacagucucuuuagaagagagguauccuucugugacuuugcuaugaagagcacagagcucagggcaaggacucuguuccaguuagggaggcuaaggcacauaauaauggaggaagaagguagaggggguacuagagaaaagcagaggcugguaccagagcccuguccacagcuuccuuagccaccuugguauuagucucaguaagcucuuaacuuagagauugacuugauccacgauuaccauguuagaaguagcauaggucucacuuuggauaucucagagucauguagagagaaggacauugaaggucuauaucccuuuccucucauucucagugaaaugauaguccugacaggagccuucaggcccugugugcuguguucuucccuuucaaccuuguuuguuuuagguucugguaacuuaaaggaggcaaccaaacuaaaccaagugaugccauaaagucugugguugucauccuuccuaaugcuauaacccuuuaauacaguuccucaugguguggugagccuuaaugauaaaauuauuuucacugcuacuucauaacuggaauuuugcuaguuaugaacuuuacucuaaauguuugauaugcagaauaucuaauauacaacccccaauggggucacaacacauagguugagaaccacuguaaaagguucuaauauuuucucuggaguuugaauaucucaugguuugaauggaagccuaccaccagauacacucugcuggagaacaucaggagagaucucuuaaucuccaagugaaguaaguuugugucuccugucuuuucccagacacuagugcuaguuucauauggcuaauuuguaggauucuugucaaugauuucaacccauuuucugggggaaaaaaaaaagcaaagauuucuuuggaucuacaaccaggacauuucucagagaguaggcgugcuccucacaagcaccagaugaugccaaauaugguugugugcuuuuguccaugccuggcccaugcuugguugguugguaagccgauacauacaagucagauuugggagcuggggggaugugccacaucuguuaaguuguuuuuuuauguuuguuuuguuuuauuuuguuuuaaugggaaaaaauucaaguuugguaagaugccuugaaaaucuguuauagcaaauuguugagauguuucccuccauuugucaaacugcaggcagaauaacguagguuuuuauguugauguguucauuuugccaagagcuccauugaaaaucauugaauugaugccuccagugacaguauuacccuuacccuagaguuugucugugggaauuauuccucccuauuucuuuaguccaccccugucccauccagaguggcuuauauggcaucuggacaaguccuugcucaguccucagcucagucuucagccccauucagucucugccuuguaugugaggugucauuacucacacagcaccuacuugccuaaagagcagacuuugggaguggacgggcccagcccuugucacugggauacuaaccuccaaggaaacgugggagagucaaugccuggcaugaucauccucacuauagaagguucaaagagacccuuugugaucauuucccugcauucuccccuuuuucccuuuccaacccaugcugcugcgcccuccccuuuauccucucucuacuagcacacauuugaaaggauucucuagcauuucccccaggagacaggugauagaugcccgaaguuugagagaggaggcuuagagccaaggagagcugaccuuaugcucugggacgggauuacacaggcuuccugcucccugugcugauaucucagggcuuggcuuccuucccaggucuguguccugccaccuuacacuucucuguuaaagaucaaacauuauuaaacaggauaggauaguacugcauuuguucuuuuucuucugacaucucaauuuuuaccuugaccugaaauugaaagaaccuaguggggaaacccccacucaacucccgauucagugugcauccaagaauuacgaacagaacacaacaccuugauguaacaacacgagguauuuuaauggcagagcuccgggucaaaacguaucucacacaggagacaguggauuagggguuuuuauagaaaaggaguggggcugggggaggaauuggcgcgguuucacaugauugguccauuuaaacauuagcagccuguuaacauuuaacuuaggucagaggggugggagauagggaggugacaggccugccuuggcauguccuggucuuuucugcuauguucucagccccagguuucaaagcucacaaacaacucuuugggcuauuugacauacauuacaugaaucacaggucucaaguuuuauuuccuuucaaaaugaaauucuuucucagaggggcaaaguugaucuauagaagugggagcuagugcucaggcccacaauguaagaaaugaguuagaaauggugagaggaaggucucugagaccccagcuccuccagacccaucaaaacuguggcacuauuggagcacuaacgacuuauuuggaaaugcaaauugaggccaucuaaaugaagggcauugggaaugaagcuugggaugaaagaaagggggacaggaugcugccuuauugugaugggacugaguuucaggauagccugcugcuuccccucaaggguuucauuacaagcucaacagcuaagggaagagagaggagggaaaugcuuaucuaagucccacagaccacaucuaagaucugucccauucauacgggugcccuaggcucccagacuucauccucuggcuucuucagaaucaagagauuauuuaaagaaagaaagagggcugaaagggaguuaccacaaauacaauuaaugguauucuucaugcuuucuauauaugacaucauguuauggauugacuauagacauaauuauguaaaauaagaagcugucuguuuguuuacucauuauuugaagacaggaucucauuauauaccccaacccugccuugaacaccuacaaacuuucugcuucuauauccuauauucugaaaugaaacaacuauaccaucaagcuuguugauuaucuuaaagcaaggagccacauauucaucacuaaaguuaugaaauauaauccuccugauagaagaacuggguacuguuuccuagcuucugcaucaucaccauccugagcccauccaagcaccaguaaugaccccauuagggcucacuaucucuccucuuucuuguuuugccucugaaguuuguaucccugaacuuuugucucuuuacauuuccuuacugcacuuacaaaagccuguggguccccaaggacaucaucugccccuggagaaaguugccaccauuucauucuuaagaaggauuuuuuaagcccuuuuuagucauagauguauuuugacuuuaucuaaacauguuugugucaaugacaagugaacucugagugcuuuccuguccuaugcuaaugugguaaauguauggacugguuagaaagcauugagcugccuuacauuuguagaacacaaccccaggguaccuuucacucccuacacaauugugccuccguuugccuguauuucugcuucugacuucagguuguucucuugcuguaauuucuucauugaauuuugguguugugguugugcuucuugcagucuccacuuugguucuccucugcagcuuaaaacaaaucacugacuaguuuaaccuuaggugaaguuuacugguagaguugucuaucccuagugcuuuauucagaggaagaccucaaauuaaugcuuuaauuauuuuaauguugauaaggcuuguuggauauuuuuuucuucucacauuaauuuuggaaauugucuuuuuaagcuauguguuugugugugagagaaugugugugcuccuaugugccuucugugacagugagggcugugcacccuacaggacagaugcuuccaaggggcucaauacaacacucuggguuccuaaccauccucuuugagcucuuuuuccaggcucuguuguguaaugcucacuggcaucauugcuaaucugacugcuccuacugaccaguggauuggcugugaaaaagagccccagauguacuuuauaguaccucauuuuauuccagauccauagggagaaaauguauuuguggacucagaacauguagaaugcagcaacucccuuucuuguugcugauucucuggguaccuuucugagaacugcacacuucagcauccugaauuacugagccugucuccauccuacauuucaacaacuguccuaauugauguacgucacuuacccacauggccagggacacaggaaaugcuggugcagacaugacuggagcacugugaccucucuccaucagugcuuagccaugacccagccuccagcacucucuucuuuguuugaguaggaguguuuucaagugugcagguuuucuguggccucaagacucuauuugggaaacuugaaauuuugauacuuuauucccauuuuauuggcugaccauuuuuguaccccuaaauuggcuccucugcaauccucugacccuuuguccuggcagauuaacaugggaagacuaaguguauuuuucccuuaggggaaaauaagagguucauaaggcuuuugaaucugacuuuugccaguaucauauaaaucaucaauuucacuaaucuuuuccaagauaugacuuuggacuucucuugucuucuucuuuagcucaaaguagauggguguggaaauggcugggugaauagaacaacacguauguguccuuaaggcagcuguuguuugauccuguaggcaguacuuuggccuugucuuccagacgauuugauccucauccucccagagucuuugacucuucacuugauaguucccugccuacuuggaaucucccuuagagugaaucugcugcugcugaauccuuccaguguuguaccuuuggaaagauccucaugucacuuugauuuuugcaggugucauccuaugguguggaaaucuaguuuauagggcccucuuccuucuuucaacuucugccaaaccgucccaaguaaugaccuuggauuuguaugcuuuggguuuguaugcugaugagacuuaagaucucugguucugcuuccuuagaucugcuuuuccaugcuccacuuacguucccagauuucugagccaucucuugaucauaguuucuugaucauagugagaacacauuuuauagacuuugacuggcaggauucauucacuuuccuuuuccucacacugcuuagcucucagggaugccaucucagagcagaggcucauuuucuaacaucacuauuuuugguuggcucaaaacuuaaacuuggaucucucuugucucacaaaaauaguaaaagcauacucuggccuuucccuaauguuaaccuuauaaccauucgucuuuuuuuuuaaugcuugcuaaaaauaucuuuugauuucucuaugagauuuuagaugccaucuaucgaaagacugcuaguuuggcauuacucaaagcauaaaucuauauuuauguuucuuuaaauuauuuaaacgaauaauaucuuccuuuucuaguaucaguauuuuaauguagacugguaaaguuucaugugagggauuucaauuaucaguugcucaaauucgcaucccuuuuggugcuaguugaaauauaagcuauguugcacuaucuauugaggcugaauugugugagaaaucugacaaacccuguugcuuuucauucaaaagacagacagggaaaugucccuaguucaauaauacaggaaagcucuaagcccagggucuagccccuugugggggcucacuacaugcaguuguuuguaucugaugcagagaucuaaguauggugucugguuucuccuucugugaagaugaacuauacaguuucuaaguacagguaacacuaauugacuaagacacaggcacaauugagcagggcuugcuacagcaaagagcaaauccagccacccaaaugccuugaaugaaugccucaugaacaaggugggcaaccagcacucacacuccuggggucucuagagcuuucaacacagagccagucuguucucuaaacuguucccuaggagggcauaaacuucugcugaucaggugaaacuaucccaagcauaucuaagcccuuggccuccaguuccuguuuggaaauaagacagaggugaccaggguaggacacugacuugaugaggcacacuucauguggugaaaguugacggaucaaaagcuaagaagacagagugguaccugagagcccuacagacaaucuagacuuguuccaaugggcauaucauuuaaagcuguagagaauuccucuguaaguacagcaucagaaaacuagugugggcaaaacgggguucucugaaaaugacuuuccaggaaaucuuaugcauuaggagaaaacagagaguggggcccuaccugggcacuuuauagacuuaaagcacacuuagcuuugcuggagaugggugcuacaggagagaugcucaggcuauuagcaccucaccucauucuuuggcguuucuuuggcuaauacaauuauuuauuuuggauucucucaaacaucuaaacccgacugacaggauguuuccagaaaauaucaccuaugcaccuuccuaagccuuucuuucagaaaaacaagcugcuguguuuauguuuaccuuucuaaaccugaucacaaagacaggcuuaaaaucuuuauuauuuuucaacguuaugagucauaugagccugaaggccauaugcuaugcacacuggcuaguguauguaacagucacuuagaggccaauauccuaugcacccaaccugcaucuucugaccucgaguuuauuacucaucaaugucacuagauucggaguaaauuggauccuauggcugaaugcaccccauaagcacuagcugauuucaucagcucaagcuuuaauuuugcaccugagagccacagccauccaggcagagaguuggggguugucuucggaaaaccaggagauuguuguaaugggaagggaacaugucucaguucugagagggguggagaacaggggacggggcaacacugggagacuguugacaaggacagagugguagagagccugggauaugucagcuucccuaggcaagugacacaaaagcaaagcugacagagagggaacugcaguagccuuucaacucacccagcacgggcucuucaggcagguaaauugaaaaaccugacagaggggcaguauguccaguggauaaguugcaccugcaucaagaggcugcauucagcucaacaggcaucaacugugagcuuuuuuuucucucuucccccuccuucucuuccucccucucucccuuccucccccucucuccuuccuucucugucucugcuuuucuuccuuucucucucucuucccucccccaucucuaccucuuuuuccauaugaauauuuaaucugcugauuguagcaucugugaguuguuuugcaacuccugaauuuaaacaauuccacauaaauauuaaugucaggaugcagucaagacaagcagauuucugauccccaccuucuuccauggaaauccaugcugcaggugcgucacagauuuuuuuuuuuaacuuguuugggugaauaagugaauaaauccuguuuguuuguucccuguggccuauuggauuuguuuuuccaguuguaggagagcuucggcuggguaauuaguggugauuuugugauuagugguguauagaagagaacauccaugcguugacuguugaaagcaggguuggugcucugcggacaugucuggcacccagaguugaaaucucaauguuuuacauuguguauucuucugucuggauuuggggcuugcucagagucuguuucaagugugugaugcuuuuugguaaaugguaucacugaagcuauuuauuagaguguagaaugccuccaacagcagaguggcucacacaccuccuuugcaugucuuugaacacuaagcccucuguauggaacuuuuggucccaugaaggcacaguuccagaaacuccugguuuggagauggcaucacuggcuauuucuaagaguguuaggucccaucuggcuagggucugggacacaauuuaauuuaggagugcucuugauggucacaaacucccuucccaaagcauauucacaagugucuauuguauuacaugauggauaaccauaauagcacccaauagccuaugccuggucucaaggcucugucugucgagggacaugaugaugcuauuauagauagauggucuugccuucuaagcuaaguguggccagcaggucuggcccaccuugcuguacacaaugacucacaaacuguuuuguuuuguuuguuuuuaagauuuauuuauuuauuuuauguguaugaguguucuaucugcauauacaccugcauaccaggagaaggcauuaggucccauauagaugguugugagucaccaaugguugcugggacuugaacucaggaccuguggaagagcaaccagugcuuuuaaccccugagccaccucugcagccccacaaacugguuuuuacagaauccauuuugucaugaaauuuucagucuuagauuaugcuagcccauuaauguauuugucauuagguagaaccauaugcagaagcaauacaaaaauuaucaaucuuaucuucuaaauacaacuccuagaaagaggauccaucucccacccaaggauccacuucaaaugcaaauacucagagguacucacuuucaggauacucccacaggaguacacaaauuccgggaaaaaggauaguugggaggaagacacaaaauuuaaauaugccuuuuaugggugagccacugauuuaagacaccauggaaaccacauuuucuugugguaagggacgauuuucaggcauauccaaggcaguagaaucucaguggccaggugacuauuagggagacuaggaugaaaagcaucacaauuaggaugcaaagaugaccaggaguggggaaaauaggaauccuauucucucaccuacucccaaucugugaauuaaagcuaaggucggggcuggguagauggcucagucagucaacugcuugcaagacuugaggaccugaaucugaauccccaacauccacauaaaaagccaggcaagaggugggugccaggcucacauacacaugcauacucagcacacacgggaauaugcgaauauaccauccucauccacacaugcauauacacgcacacaggcaugcaugcuauaaucacagccuucuugacaauugaguuuuuacacaauuuuguuuuugguaguuggggugaggcuugguuguuuucaaguucuuagccucuuauucaaggaaauuaacuaaagcccacacagauuugcaaaagcaccagcaaguuuuaccuaagauagagcuuuaucuuagauaaaacaggaaagcucagaaagcucagagagggagcugugacugcaugagcaaaaacauuuaagcuccccaguuauuucugggggcuucuaaagacuuucaagaaaagggguuuaguuauuaauaggauugagcgagcauggcucucuguuuugacugauaaaauauaaucauuguucuacuguguauauucuucccuacaaugcaucucaguuuaauacuuugcuugcccaauuauguauagauauaaaaugauaaauaauaaacuauccuuaaaaauugacuucaaccaguucaggcuggauccuaccccugcuacucuguaccaagaugugucagaaguacauuugaauagaaacuuuccaaauuugauggcuauuaaggugggaacuuacccuggggcucagggaagggugcaccaauagcccaguggagguagggguccaagguugcuaggugcauuguucauagaggaggagguguacaaaguaccuuugguaauaggcuaccaaguccauugcuaguaaggggaaagcaguacauaaucuagaccaagugcagccccagauugcuaaacucuucccucugcuugcuuggcuugauuugguuugaaauaauuauggauuaauauuauaaaggaaaaucaaaucucaccccuccccaccccccagggucauaugguauuuuauauauguugagcauauugcuacuugccacucugugcuguaacauguacaacaaaagcuuguacccagguuuagcacucuuugcuccuuaauacucaaaguuccugcucuugcccguggcccccuccuugccuccuaucuuagcuuuaccauuuuccagcguuugagaguuaugaggaucucagaugcagagucuagcaaaugcugaauuuaaagaugagaaugcuaccauaccuuccacuucaguuuagcugccguccuuaaggcaggacacucucuucauagccuauacagaugguauaccaagaaguuaaguaauagcuucuugaagcccaccuuaagcauuuguuaagguuggucucuauguuuaucaucuaagccuuauguaucuaaucccagagaauagcaagcccuuuuauacauuuuaguuuuauuguugcuuuugcuguugcugccguuuuugagacagggucuuaccucauagccuugaauggauuggaacucucuauguagcccuggcuggcuagagacucucauggaugcaccuacagguagcaccaugagacccauuaaucuacuguucuuuugagacaacgucuuaaucuguagcccagguuggcacauuauguagccaaacugccucuaacuugcagcaaucauccugccuuagcuucccaaaugcuagaauuauauacaugaagcauuacacacaggccuaauucaacuuuaaaaucacucucugcuuucccaagauuuugaacauguugggccugauaacagugaaugugcaaaguguucuguacuccuuuagaauuguaugagaaauaaaaaagaucuuuugaugaugacucuccaucucccugccccuuuucuauuuaacaauucaagaugcauggucaaugggggcacauucacccauagaucucuuuacucauguggcaucccaaacaaaggacauaaguaguaauuagcuagaccuugugucacaucucuagcuaugacucuauaguuggguccuccagucacacacaucuccacaaaguuaacuuagauucaugcacugccugacugcccuggaccuuuaguucuuuuugucaggugauuaaaaauugaaugugaccaauuacaaaugaaugcuaagccaugagaaugagaacagccugcauucaaaugagggguuaauaagggaaggggagaaagauggggccuugugcuauaauauaugugccuauacccaaaaccugugucccuucgugggagggaggaugagauauggaaagaaagucagcuuuaaacaacuugccucauggaaaagauccucaucuucaucugaguccuccugucccuacacuugcaggccugggugaagcuggcaucuccuucaagucaggaauguuuaugcuuggguggcucugacaugguuucugaugagccauauggaaucuguucauuuccuugaagcuaguagcacucaggcuauacucugggugaguguccaucacugucaauggaaccaaugcuuaccuacagauaagguuccacacugcugcaccugucuuccuguuacucaacacagucccuuugaggagcuagguucuuacaaccaacuucuuuucagagccauaaaauucauguucuaguuaagaacccaguuucuagcacucuucacuucuacugugugucccagaguuaccaaguuaguaugcuuggggcagaaagcaucauccaaaaauuuacauagaugucugcagcuuccuccggucuccagcgaggguccccuccuuccuaaaagcugauguuucagugcaggccuagccauacucacaccccauucugugcaccucaguuccucuuuguaccuaugcccugcuacccggacgcacaagggacucauucuaccccuaaaggagcccugcugccugcccuccugccauaaagcuuccaauucacucaugacacuugugcuggguauuccccugaucuggcccucagaggccagcugugauagcuugccaucacugcaacaaaauagcuuaggcuauaaccuagggguggaggugucuacacuucacaguucagaguuucagauguuucagccauuggcccauuuguuuguuauuuugaggauuuauggcauauacuguguaucagucgcuuccagugaaaauaacuuuccaguuuggagagaaacuucauaaaacagaacuugaaaagggaagugaaaaacuuggauauucuaagagaagaugagacacuccauucucagagaagcucauuaagacagaaaguaaacaacucaaaauaguuccaggaaaucacugaaacugaccagauucacaaggcccccucccucuugaagaacaaacaauaauggcugcaaaagucacuuucagacaaacugagcugcuuagaagaggcucagaccaagcaaccuggaaggaacagagauuguggaaggagagacuagcccaacugcuuagaagaaauaaagaccaacagagcuuccauacagaggcucagguuaacugagacacuggaaauggacacuccacagcaacaacuuuuuugugaggagcagcuguuggcucaggaaucacagagauugccaccaguccuaucuuucugucaguaucagacaugauccccaagguugaacaacccuguacgucaucgaagacagccauugcuucugacuuagaaugacauguaguaacaagaguguucuuucuguguccuguucacuacaucaaugacaacuaugacauaacuucaugacaaaacaagaaaacgacuuccugauaaaccagacauaacuuauuccaaauucuacaggcccauguuuaguuaaauacagacaguuugacucauccccauccuugcauaagagggcuucaugagaauggccagucuguucuaaccccccacacucacaaaacuaauacacagagcaguuuuuaaagugccaucuagauccaaauccuaguugucgaaugaucuuuacaaaauaccauuauauacacacacauacagcaugcacacaugcuaaauacauaaaggaauauaauuuuaaaaacauuaaaacccuuugagacauuguauaccuccaggagaggggagcaugcugaccuggguuggaagggggaugguguguucaauuuucagaaagggguucuuaauacagaaauagaguguccaguugagaauauuguuauagcucuggccuccacagacauccaaaccacccuguuuuaaagaaggagaggagagaaucacagccucguuauccauggggugggacaucccaagcccaagcacuaaagcugacuuaggcaacaaggcucaaagcagacuuggcacagccuuucguuaaccugcggaaggauuaauuuuauuccucaguaacucaacagaauuagaaagcugugauacaggcuucaagagaaccacuucagauacauuucuaaauauagcguagcuuagaaauaucccuucucaaaucuagcacagaaugguaaauuguucaucaucaacagcaaauggaguucagcucccaguacucugagaucuugaggugugaggaaaucccugauuuagacagcauggugggcccucggggacauugaugugucauguagauauugaguaugugccuuagcuauaucccccuuuuccuugagcacuuacagguaccaggaaccacauuaagcuauaccucggguguuccuguucacaauugggaugagacuuggagggcuuauuuacaaagaaacuaagucucaaggaaagagaaaggaaaagauacaaagucagaguagugcuaaauucccccaccucaaagacagucagaagaacguaucagagccucuguuuuucaagugggaauagauacuuggauuggaacucuggguacuaccauggugauauagaacguaucagagccccuguuuuucaagugggaauagauacuuggguugggacucuggguacuaccauggugauaucagcucaagcugagaccauacgucaguuacuaugcuuccugggccucuaugaggagacaaagcaaaguauaaaaagcugacguugccacagagugccccacaaaacugcccugugcacaaugagagcaguaaagguguucugcccauuggaaggaggccauucccaguuggacaacuucuguuuuauccauccccuuuggaggaaaggggaagucaaccccucuugcacaagguguuguuauuguuguuaccagucucugcuaaacucagcugugccuuccacacacagugccauuuucuugcuggcuucagaccugccuauggcucccaagagagauuccuaauuuggccuuguauuucagcaacccauagcaucuagucuacaccuuguacccuuguguccacccacaugcagcucugaaagcugcaccucucagcuucaacaaggcauuuauuuucuuucacucucccgaagcugugccaagaguaaggacugaaacugcucaggauaccucuauugagcccccuccagacuaaggaaucccuucccaccccaguuugauccugcagcucaggggacaggggacaaucagcucuuuucugguuccacugaaaagacucagacauuucuaguuucaauuaauaccuuaaaggauuagguugucgauaauagaaagcaggauuugaguccaggagggcaugggaaaggaaagucugcaggaggaucagggauaggcagagaucaaguacaucacaccaauccucugcccgggguaaagaggaccacugaguacacaugccaaggcaugguuaucaggaaggacacaccagccaucagugagaccguuucacacacuaacaugcuauaagacuuuuuaguguuccuacagugugaugugcaacuugguaaaggaguacaaauauacauacuuuguguguguguguguguguguguguguguguguguguuuaauauguuuagaugaaaagcagagcggcaacaaguaacuaugaagagcugagugagugguuaaggucacuuguuacucugguagugggacuugguucccagagcccccguugcagcucacaaccacccuuaacuccaguuccagggcaucucuuauggccucugugggccuggcaugcaaauuguaugcauacauauaugaaaauaagcauucauauacauuaaauaaaaauaaacucuuggaaucagaaggaacuaaauuguuaaaaaccauuuuuuuuucucaaaauuucugcucauauuaguugugaagacagucucaggcgcugguuggaagaauuuuaaggcacaggcauuauauucugauaucugaagcaaagacuagaagaggucagucagaaauugguuuuuaauccccauccucugaaaaucugcucaugauauaaauuugacugaagcucuaaucauugacacauuacugucaaguaauaauccugguuugccuguguagaugcucaggguauauuuagaauauuuaugauguauaaauuaauguaauugaugagcuggggaauuaaaugagcugaguuuaauaacaccuccuaguugagaucaaguauguggaaaaguccuaaauugucaaauauuuuaguauaacauuauugcuuuuaaguacuuuuaccacauugcaauuaacuaacuuauaugucaagagguuuucugagaggccugcuuuaauaacgaaaagcucaagaugaaaugaagaacugauuuguacacauuuaucaaaauccuuaaagcauuucacaccugaggaaacuugggcacuuuccuugcugggauuugaaccucccugccuggaguugauucacauggcauuucuacacuaccguggccugucuugccaaugugauuuuuuuuucaaggacucuacugcccuaaaagcugucugauaaacccagagggaagacuccucuaauguuacagaagguuaaacugagagucagagguaccaacugcucaccagacguccacaggacagugaguguaaccuggagucagcccacauacuguguuugacugugaaaugcuccuguaagucccuguguuugaacauuuggcugauaggugucgaugccuuuuuggaaggcuguagagcauuugggagacaggguuucucuggagaaauuauaucgugggguaugugauggugaaugaugcuagagguuuuaagaccaagcuccacugucgguccauuccgugcuucuaggacugcccagaaacaaaaugugaccagccaccucacaccccaacucccugcuuucucaggcacaauagacugcaucccuuuuuaaaucaugagacaaaacagacccugcuuuucuuaaguauuuuuuaucaggaauuuuuuuuucuuuuuuguaucagaaaugacaaaaguuagguucugccccucuuccucucuguuguuuccacuccucugcagcaucagggacucaggugauagcagugcucacuucuguguaauugauugacaccucagugugguccgugggacacugggaggacauggcaguacgagggucccacgcuagaccugcuuuaucuaucucaugggccuaaagugaauagcuuccucauuccagguccuguccauacacaccacugcagaggaaagucaguacauaauuggcccccuguuucuucaaucucugaaaugggcauguugaagauggucagcaugaugcuuuucucucaucucccucucuaucccagagauuuggagguucuucaccuuuguccugucccugcucuggaggaagauucugaauccucaaggcaugaggaagcuuggguaggaaagcaguuacaucaguauuugcuuggugccugcuggaaagucucccuuaacuguuaccuuacaagacagcugagugcagcagaccuuggccccaguagaaaacacauggaacgcaggcggcuuccuuccuuccacauggcagacguggaaggaaccuaugauuucuuuguccggcacuacuauggaaacagccucacaugcuauuuucagugcuuuaguaauguagauaauauagccuaucuacgaauauacuccauuuauuuauuauuuucaguaucuuaaaauuuccauguuacuauaguuagcucuugcuuuaaaccuuucuguuuuauuuuacacauuuaaaaauauauuaauauauauauauguguguguguguguguguguguguguguguguguguaugcuuugucuucucacacaccagaacagggaaucagauccuaucacagauaguugugaaccacuaugugagugcucgaaauugaacucaggcccucugaaagagcaguaaguucucuucaccacugccaucuuuccaaccccuauuuuacacauuauaaaacacuguuuuggagcuaugggugugcgcaguaucaguuacuagcacugccagcaaacaaaugaauaaaaauuagagcaaauaaaaauagaaauuuggagcuggaaaguuagcucaaugguuaagagcaauugccacucguacagagaaccuggguuugguuaccagcacuugcuuggugucucacaacuaucccuuacucuaauuccagaguauucaacaccuucuccugaccucuucauucaccagguaugcauauggaacacacacauccauauaggcaaaauacacauacacauacaucuaaaauaaaaauaaauaaaucaaaacacaauuaaaaaauauaacucuaacaugggucugacacuggauacuacaauagagauguuccuacuagacacugugagaugcacgucuauccugcaguugccaucuucuuccuagcucaaucuugccucucuucauuugcacuucaaccucuucuggggcucccuuccuugaccuguauccccugccagcucugccuuuggggggcauuuaacucagaagaaucuaaugaugacaguguauaagccacuuguucuguuguccuccuuucccuucuguucacuaucccugccucuugggcuucccuucuucuacaucuuuucagguaccgugggcuaugcuguccucccugggucagagccaacccuucaguucagagcuacugaugucagcuucagagugcugagcacugguccaagccaggcacuuuuuuuuuuuuuuuuuuuuuuuuuuuccauuuuuuauuagguauuuagcucauuuacauuuccaaugcuauaccaaaagucccccuuacccacccacccccacuccccuacccacccacucccccccuuuggcccuggcguuccccuguaccggggcacacaaagucugcguguccaaugggccucucuuuccagugauggccgacuaggccaucuuuugauacauaugcagcuagagucaagagcucagggguacugguuaguucauaauguuguuccaccuauaggguugaagaucccuuuagcuccuuggguacuuucucuagcuccuccauugggagcccugugauccauccauuagcugacugugagcauccacuucuguguuugcuaggccccggcauagucucacaagagacagcuacaucuggguccuuucgauaaaaucuugcuaguauaugcaauggugucagcguuuggaugcugauuaugggguggaucccuggauauggcagucucuacaugguccauccuuucaucucagcuccaaacuuuguuucuguaacuccuuccauggguguuuuguucccacuucuaaggaggggcauaguguccacacuucagucuucauuuuucuugaguuucauguguuuaggaaauuguaucuuauaucguggguauccuagguuuugggcuaguauccacuuaucagugaguacauauugugugaguuccuuugugauuguguuaccucacucaggaugaugcucuccagguccauccauuuggcuaggaauuucauaaauucauucuuuuuaauagcugaguaguacuccauuguguagauguaccacauuuucuguauccauuccucuguugaggggcaucuggguucuuuccaguuucuggcuauuauaaauaaggcugcuaugaacauaguggagcauguguccuucuuaccaguuggggcuucuucuggauauaugcccaggagagguauugcuggauccuccgguaguacuauguccaauuuucugaggaaccgccagacugauuuccagagugguuguacaagccugcaaucccaccaacaauggaggaguguuccucuuucuccacauccucgccagcaucugcugucaccugaauuuuugaucuuagccauucucacuggugugagguggaaucucaggguuguuuugauuugcauuucccugaugauuaaggauguugaacauuuuuucaggugcuucucugccauucgguauuccucaggugagaauucuuuguucaguucugagccccauuuuuuaaggggguuauuugauuuucugagguccaccuucuugaguucuuuauauauguuggauauuaguccccuaucugauuuaggauagguaaagauccuuucccagucuguugguggucuuuuugucuuauagacagugucuuuugccuugcagaaacuuuggaguuucauuaggucccauuugucaauucucgaucuuacagcacaagccauugcuguucuguucaggaauuuuuccccugugcccauaucuucaaggcuuuuccccacuuucuccucuauaaguuucagugucucugguuuuaugugaaguuccuugauccacuuagauuugaccuuaguacaaggagauaaguauggaucgauucgcauucuucuacaugauaacaaccaguugugccagcaccaauuguugaaaaugcugucuuucuuccacuggaugguuuuggcucccuugucgaagaucaagugaccauagguguguggguucauuucugggucuucaauucuauuccauugguccacuugucugucucuauaccaguaccaugcaguuuuuaucacaauugcucuguaguaaagcuuuaggucaggcauggugauuccaccagagguucuuuuauccuugagaagaguuuuugcuauccucgguuuuuuguuauuccagaugaauuugcaaauugcuccuucuaauucguugaagaauugaguuggaauuuuaauggggauugcauugaaucuguagauugcuuuuggcaagauagccauuuuuacaauguugguccugccaauccaugagcaugggagaucuuuccaucuucugagaucuucuuuaauuucuuucuucagggacuugaaguuuuuaucauacagaucuuucacuuccuucguuagagucacgccgagauauuuuauauuauuuguggcuauugagaaggguguuguuucccuaauuucuuucucagccuguuuauucuuuguguagagaaaggaaagccaggcacuuuuagguuuacagaugauccaaaggauaaucugaugauggggagaagagaggcagcaccaucauugagcaaccucccagucaccuucucccauugcagagcugacaaacuaaugagcugccuccagaucaggcuccucuuccugcuugugguuccaccaaacuacugcuugcccuuccuuuauuaucauuuuccucaccucacuuuuauaaaaccauauaaaucggcauuugguacucacuugcuuucuugcuacacaucuugccauuacucuucuagagugaagaugggacccugggucuucuuuuacccuugugaagcuuggaguagccucuugaccugcugccugaaacaggucaccacuugcucuugcugaaacacaguagagauuucugaucagcauaugccgguaugccuuucugggcuguccuuccuuuacuucccauucaaguuagcugaggaacccaagagacaacagcugcuugaaauucaugaaaaucagagguguagucuuucaaucaugaugucuucuguauuggucuagauuuucuagaguaacagaacuuagaaugacucaauagauagauggauagauaaauacauacauacauacauacauacauacauacgaggugcuguggucaagguaaucaauacaacaauggcugccuaugaaugcaggguccaugaauguaguagcuauucaguccaaaaggccaaaugcuucaguugucuuuacuaaaugcuagaaucccagagaaguauguucaaaugcgagugaagcaguggacuuacuagcaaggcaaaagcaaucaggcaaagagcaaaaaguuccauuuuccauguccuuacauagacucccaagagaaguuguggcccagauuagagaagagucuucucaccucuaaagaucugcauuaaaggcauuuuuuccaucucaaagacacaguaagauucguaucuuuccccuuaaauuaagcaaacaucccuuagagguaugccccuccauuuuuuggguuuuauuuaauuccagaugucauuaauuugacaaccagaaauaaucauuacaccuuaggcaggucagcagcacuaguaucauagaaaugugacauuuacugaauucauaggcaauauuggagaucuaaagauucagcuuugaacuggaugcuccuuuucaaagaaaauaaaccccaugcuuagagggggaauaugucugacacucaagauagauggauuaagggaauggagggucuggaggauguccugcgauagaaaaguccaaggcagauuccaugguauaccuguguagaaccugaaggauguucaaagauagaaggaaugggagguuucccuaguauguggaccugagaaguguucuagaaagaaauaucuaggaggugcccauguuagagaaccugagggaguaguccaggaugaaagaucugagcagugcccugggauaacaggccugagcauaccccaggauagcaggccugagagacauccugugaucaaggacauugcuucaugcugcugggccugauaagugucuauugauggcuguccuaagacucccaaaaucauaggcuuaaggggcagagggauguagggcauagaaaauucuccaguauagggaacacaagaggacucacaaugauggaccuaagggaagacacauuauagaggugcuaaggucacauccuaaauaauggagggcuggagagggguacacauggcagaaugccugcaauaucuugggagucagaacaucgggcuuaguaucaaggcuacaucggcuaauagaguuccaauauuguggcgucauauuguucuguccucuaucugaugggagacuggcucacugcucuucuggcuuguuccucggccaacuugcaaaguucccaaagagaauaaaacaauaugucagcagugauuucacggccuuuauauguuauucucaucuuuugacgcuaaaagaaagauguucuguauuaaauuacuccuucccgcagugugcagugcuaaugccuuccacauaaucacacuaauggaauauuuuacacaccagaauagccacugugaccuuuucuucuuucugcaagagucucucguuuucugucucacucuucucaccuugaagcuggcagcugccuuuccacaucuuccucuauugcuuuuuccuuucccucccccuccuuuuccucuauuaucuacucuucuuccuucuccucucccacuucucuucuccauccuccugcuccccuuccuuauauucuuucgguuauuuaacuccuguaaccauguuuccagaucaucuucuaugaugaguuuccucaauggaaucaauaacaagaaaauacacaagaaauaucaucagauaugugaagggaagaaaaggcacuuauuuccucccagcaguagacuuuccaaacccucagauucuuugaugagaggauggaagucuggggggaaaguaggcuguaagcuuacccucagacccagaugacaagggugaggcuuuugagccugaaaccuaaccugcugaaaagcuugggagaagacuguguuguuugguugguucaucuuccuuagugaugggaaaaugaguuuggguccagucuggccaugugcuugguagauacuuuacccauucuucaccuugaagaucucagggauuauugauucacagugugacagaaagaucuggccagugcuugggcuauguguguguaugauccaaauaacccuaacagcacagugaccuaggguccucucucauacccagcggccauaguuuuauucccuucuuucuaaacuuccuucacacauggagcaggaagucacuuguugaacacuaagcaaguccccaucaauucaccuaugcauauuuaagaagucacaagagaaacaggacagacgugggaugcucacgcuggacucaaguaaaucucacucaggcagacauccugaaggauguggaacagagggaaagagcaccaguggguaucaguuuucauuacacgguguucauugacaaaggcccauguauucugagaauucugcuuauaacaaugagaaaagagcgaugggagcuuugaggcuuccaaaguggccgccauacaguaacaaagcaaagcagaggauccucguggagccagauauggaggaaaagcuuuuccucccuccaucuuccccaucuacacacacacacacacucacacacacuuacauuuauucuuaagugauucccauggaacagaggcuagugugucauaaacaagaucagacauuugaugcacccuauucaugugcacacuuauaacuuaaggaccuuaccaagacauugugugauuuuugacauugauaaaucuaaucaguguugucauaaacaacugcaaugauuugaaugugucuccuuacuguucaugugcugagaacuuaaucucaagucauauuuaacacuaucuggggguggguccuuugagaagugauuagugauuguuaauuaaauaaagucuggaggaauguucccacagugguauuggcagcuuuauaagaagagaaaucugaaauguguacuuguucuaucaccaugugaugcccuuggacauguuauagugcagcagaaaguccuagccagaugcuggccauaugucauugcuuguucuuggagugcccagacuccagcacugaaagcuagauuuacuccccuuuauaaauugcuuguucucagcuauuuuaaacaacaggacguugacuaagccaagaguaagcccuuaauaacuauagcacuuuauuuuauuagacugugaagguccccugaugaaagagaagucauuuccucaguagugaccagaucaugcaauauccagacagcagauaguaagacccaggugaauaauccucuguaaaaucauagcucagaaguuuccaguugagagcaucaaaaacacuuguaguaguuaguuaaucuugacugucaaauugauuggauaaaagaugccuagaagauuaauaaaugccccugaguguucugucuuuccagaguuguuuggguccugaaggccuugaucuagugaauggauuagcuccguuauagauugauaauaugaugucauuguuaguaaguaagagguaggaccuggggcuuagucagaggaagugucucauuugggcuuagccuugaggacuuucucugcccuaggaucuuucuguguccuauuugucugugcuuuuuugcuugaaugaugggagauuucuucucugcccuuccuuccaaaacaucaugguuuuccuacuuugaaauaaucacucaaacaauucuucccguucuuuggcucugucagguauuuugucaucgcaacaagaaaaguaacuaaaauacacgaugaaacuaagcccucuugguugagaaacugaaugaagcaaaguucauuaucaagcuuuucacagaucucgggccucguggacuuaccuacagacccagaaguccacuaauugcugaaaauacuuguuggcaugaagcaucacaucauuagccucauuguuucuguauauccaaagagaucauuggucacugucaggugggcuuaucucugaucuguaaaaucagaaacuucagaugggcagaaucaucuagaagugucuucuuaugauugguugucaguguuugcuauggguggaaaauuucaccaggcuguuugugagaguggacauucucuucccuuuccaaaugaucuuuuuacugggcuaaugugagcauccuuaccacauggcagcuguuucccaggagcugugucacaaguuaccuaggagcucaagcucuuguuauggucugacuuccaaagccauguagaucaauauuugcuagaauccaacuaguuaacauauucaugggaagcaacaaaaacacuggaacacuacaagaaguugagggauaggacccauuaucgcagcccuugggauucauauaaucugccacaagcuauauuuuccaggagaauagaaaguguugccaagauauauguccuauaagguauaugaggaaauaacuaaugacagaacaacuuuauucuuuucuuuucuuuccuuuccuaauuaaaaacagauguuuucgugccauauauuuugaaguuuccccuacucaacucucucagauugucucuaucaccacacccacccaaguucuuacuuucucaucaaaacacaaacaggcaucugaaaauaagagagaaaaccaagauaaaauaaaaaacaaacaaaccuaaaugagacaaaacaaacaaaaaauccuaaauaguauaaaacaaacaaauaaaaguaaacaaaaagcacaaugaagacauauaggugcaaugaaaacuagauuuucacacacauaaaaacacaagauugcaaaccauaauauccacacaaaagaccuauagggugaaaaauuaaaaaggcacagacaaagcauuaugagccuaaaaugccuccagaaauacugagucuguguuguguguggucaugugccacuuauacauauaaaaauggaaauugccucaaaaaaaaaaaaaaaagacaccaagggauuuguucaucuucagcauccaucuucuguguuauucugagcccacacugcugaagaaacuuauuauucuugcuuuugcuguuuaaguaaauaaggugugccacccaaaagugcaagugcuuuguugacuuuauuugccugguuuaaugccuggguaacaucauuuuggugugcucuccugauaaguggccauuuacaaagugcaucaucaucucagguuugcugagacacucuuuuuuauuugcaccugcucauucacauuuuaauaacaacucuccugccacuugauacaaagcaucuuuguggauaugccuaaggcauucuauuuguuccucucuauuuguaucuccaguaaaauggucuucagcaugcuuuugauaaggacaauaucuacucugaagaaaagagaagaugcguauugaacucauauaauuuucuauagugcacucaaagaccaaagccuacuacaaaggauaaaaauugaccagaauauacaagaauaccucucuuacuguaccaugccaucaugugaauaagccuccacaauaauuauagauuuuagcuggaaugguugcaagauauauauuauguuugacgaagaguauaucccuaaaccaaaaauggaaaggcauuguccccuagagaaguuagaagcuuuuggugccuaacuacaauaaaugcuauaugcaauucacuaccacuccugacaaaaauaauacucaugauuauuuacuuccaaauucacugucuacacaagacucacaaaauaauacauguaaaacuuaaauuaaaauguauauuguacuucaagagucuagauacaagacaaucaucauaauucacaucgaauaugauuccgauggaguuuucagggaauuuaaaacaaucucaagccaaaguccuagacaaagaagaggaagguaggcauaaagucccaacccuuaccgaggagcuauuggcaauuguuagcugaugguagagggagaaucaauuuucuuuaaagguguggccccuggaagguuagucacacuccaguggaagauucuuuauacaagaguguguauggucagcauaaauugaauaugaugguuucauuuuacuuuuuaagaagagaucauaaaauugaguagguaggacagcaggguggaucuggauuggagcagaagguaacugugauccaaauacauugaaugagauucacaaauaacuaauaaaaaauugugaaaauaaauaagggcauugucauuccauuuucuuauguuaucccauaaggcaaauaaagugaaauaaguaugaucuguauguucauggaacuaauggacaaacugagcaacauucaaggauguuggugguguuucuaaagagcgaaaaucuauaaaagaaaugucagaaaugaaauuauuaagaaaagcuaaguauuuuucuguugggcucacaggguaacaacacgaucaggagaccagagaauaugaagauaggcuugaagaauaaccaaagcaaagacaacagaucuggggagaggagaaccaacacaguaaagagccuaugggaugggaucaaguaguguaaugugcauuacaaauacuugaaggagcagcagacgagaugucugaagcacauuagacacauucaauauuagggauagacucaaaacuagugauauggaaaggugacugucaagcagaaguaagguaaaggauguaggugguguuuguaugagaaaaaaaaaaacuauuaaagauaugccaggaaugaaaauauuaagaaaaacuaaguauugggauaaacaaaagcuuaaaccaagugaacaucagccccuaaaaccuaugcauuucauguuuaaauuauagaaaguguaaaacaaagagaaaaucucagaagcagauguccucuucagaguuuaggcggggagacuaccuuaccuaaacagaagcaaggguggauauuacuaguacuguuuugccagaaacaggcagagaaaaauacaauguaaucuuuaagaaguugaaggaauacgcaaguaaauguuaaaaagagacuuuccagauuagaguuguauauuuaagaaaguacugaagcacaucccuuguucuucuagucccuaagcucaacccuaagacaaaggacuacagucaguuaaggcaugcugaaaaugagagaaauagucuuccuagggaauugcuuaccaacugguuauccaauaccgaauggccagccuugaaaacauacauacaaguaauagacugagcagguuauaguuauaaacauauauguauaagcauauauguaacaucaauugauaaaaaaugaggccauaaauuugcaagagagcacuaaguauaugagagggauuggaaggaggaaagggaaggagaaaaugguauaauuauaaucucaagaauaaauuaaagauaauaaauguuaaaaauuacaccaacuguaaaaauagaaaagaaagaaaaaaaaauccaucaaugucaaguacaaauucucaaacaagugaauugauugccagcagucuugaguuuauaggaaauauuaaauauuuuuuaggcagaaggaaaacaauauagguaaaagucuauagauaaagaauaguagacacuaauaaaauauauucauauuuauucuuguuauuuuuacuuuuuucaaaacaagaaucuagcauguggacagugagacauggcagucuaccccaggcaugagagcagagcacacuuuuagaaggagcuuuaaugauacauaaguagcaaggucuuaaaagaaaguuaguuuguauguacuguauauccuggaaaaccauugaaauauauguacauauaaagaagaauaaaugagucauuggaugaagcaagauggaaugacacaaaauguucaauuaaaacaaaaagacacuggaaaaaaaagaguuuuuuuguuuuuugaaaaaaaacaaagcaaacacacacaaaccacauuagggugguaccugccagugugauauuguuaaucacuuauguguggaucuucuaaggauauccacaaaggaaaaaauugucagaguagacuuuuaaaagaacgaaauccaacuauauguugauuauaagaaauuuuaaacauaaaggcacaauuaaagguaaagggauagagaaagauaaacuauuggaaauaaaucuaaugcaguguuccaguuuuauuucuuuuacuguuacaaacuaccuagaaaggguuuacuuaaguuuacaauuucacauuacagauugucacuguaggaacacaguagcagaaacuuuuaacagcuggucacauuauagccacacuugagagcagaaagaaugaaugcgugaacacucacuuucuugcuugcuuguucuaagucaguuucucuacucuuaguuaguucuggacccucaugcuuauggaguugugcuuccaucuauaggcugagucuucccauaucaacuaacuuaaaaccacaccccacacacaccccacaacacacacacacacacacacacacgggacaauacaagguagaaagccauucauugaucaucucuccccagaucauuuuagguucugucaaguuaauuaucacagauagcuauguugauuucaggcaaagaaaaaaauuuaagauaaaaagauaugugaugauaaagguaccaguucuuccaaagugauguacacccaaaaccuaaauauauacacaucucaccacagggagccacaugugaggcagaaacugguggaauugaggugcagaugcaauuacuauuggaguucuagcuccugucaauagcagacaaauuggagaggguauuaggaaagcuauagaugacuugaccaccacuaucauucacuuugaucucauugauccuuaacagcagaguccaaauuucuuauuuuuuuauauaauucuuuuuuuuaauuagguauuuauuucauuuacauuuccaaugcucuccaaaaagucccccacccgcuccccgacccacucccccacccacucacucccacuucuuggcccugguguuccccuguacugaggcagauaaaguuugcacgaccaaugggccucucuuuccacugauggcugacuaggccaucuuuugauacauaugcagcuagagacacgagcucugugguauacuggguaguucauauuguuguuccaccuauaggguugcagaucccuuuagcucugugguuacuuucucuagcuccuccauugggugcccugugauccauccaaauuucuuuuaaaguguacaggaaaugugccuaagguagcuucauucugggucaaagaaaaccaucaagcauuuaaaagaaaagaaaaauuguaaaggaugugguagauucugaaauguuaaugcauuauucagaaagaggaauagcacaaauguacuucagaugguagccaccaucuuaaugaauaguguuagccugugguauaguugaaaauuaauagcaacacuuacauauaucaucaaauaauucuuggauaaaaggagauuaauagagacugaaguuagauaaauuaaguuugcagaacuuuuugaaagugauaauaauuaaacccaaaauaugacgacuaauugaaaagcuggaaaaucacauacaaaaucaagugagaggaagaauuaacauaaguacaaagggaaauuaacaauaaauaauaggaaggcagucaagugaggagcaacuaaacaagcaauuuuacuacuuuugauugauacaauauauaacuaauacacaauuuuagaagagaaaagggagaagcucaaacacagaguaagaaagauaaugaguaaaaauaagcuaagaucaaaggauggacuauccagacacuaagccacccagggauccaucccauaaucagccacgaaacccagacacuauugcauaugccagaaagauuuugcggaaggaacccuguuauagcugucucguaugaggcuaugccagugccuggcaaacacagaaguggaucacagucagcuauuggauggaacauagggcccccaauggagaagcuagagaaagcacccaaggagcugaaggagucugcaacccuaaagguggaacaauaugaacuaaccaguacucccagagcucguaucuuuagcugcauauauagcagaagaugaccuaguaggccaccacugggaagaaaggccccuuggucuugcaaacuuuauauuucccaguacaagggaaugccagggccaagaagugggaguggguggguaggggagcagggcggggggaggguacagggaacuuucaggauagcauuugaaaugugguacauuuacacaauggaguacuacucagcuauuaaaaauaaugaauuuaugaaauuccuaggcaaauggauggaccuggaggccaucauccugagugagguaacccaaucaaaaggaacucacacaacauguacucacugauaaguggauauuagcccagaaacuuaggauacacaagauauaagauacaauuugcuaaacgcaugaaauucaagaagaacgaagaccaaaguguggacacuuugccccuucuuagaauugggaacaaaacacucauggaaggaguuacagagacaaaauuuagagcugugaugaaaggauagaccauauccagggaucuauccuauaauccgcuuccaaacgcugacacgauugcacacacuagcaagauuuugcugaaaggacccagauauagcugucucuugugagacuaugucggggccuagcaaaaacagaaguguaugcucacagucaucuauuggauggaucacagggcccccaauggaggagcuagagaaaguacccaaggagcuaaagggaacugcaacccuauagauggaaaaacaauaugaacuaaccaguaccccggagcucuugucucuagcugcauauguaucaaaagauggccuaaucggccaucacuggaaagagaggcccauuggacuugcaaacuuuauaugccccaguacaggggaacgccagggccaaaaagggggaguggguggguaggggaguggagaaauggguaugggggacuuuugggauagcauuggaaauguaaaugaggaaaacaccuaacaaaaaauuuuuaaaaaagaaaauaccuaauaaaaaauaaauaaaaucaauaaaaauaauuuaaaaaaaaaaaagaaaaaaaagaaaagaaagaaauucaauccuggcugggcagugguggugcacgccuuuaaucccagcacuugggaggcagagguagguggguuucugaguucaaggccagccuggucuacagagugauuuccagggcagccagggcuauacagagaaacugucucaaaaaaccaaaaaaccaaaaaaacaacaauaacaaaaaaccaugaaaagaaaaagaaauucaauccuuagggcuagaaaagggguggcugugguuccaaguucuuacuguuagaucgaaaaacaugagcucagaucccaguguccacaggguucagcucauaaaugccuagaauuuuagcuccaagggguaugacaauguuccguuuuugacuuccugguauacaccuccaucaugggaaauccugggccugugaguaaaauaucccagauaaaaacuucuagugccuugugaaacucuccaaucucagauaaccacaaagaaccuguguuuucuuaccuaagaaacauuggcccucuaggugcauaguguuaucuaggacaugcuaaaaccuauuggccccuggggcccucuccuagcauucuuucuggaauuggucugaaguacagguuuuagaacaccccaccugauugcccugcagauaucgauugugaaauuuuccuauuccaaugucccuugagaaaaaaaaaaaauucauucaaucuugguggaucuuucaauagccaaaacuuuuucauaguucuggaaucgagcccaauuuuaacacuaaaccaacuggcauuccggaaaaccaagaacaagacccucagugcucugccaccaaauauccagagaacgcauucaugcgcuaaggaauugggaacaaaacacccauggaaggaguuacagagacaaaguuuggagcugagacgaaaggauggaccaucuagagacugccauauccagggauccaacccauaaucagcuuccaaacgcugacaccauugcauacacuagcaagauuuuaucgaaaggacccagauguagcugucucuugugagacuaugcuggggccuagcaaacacagaaguggaugcucacagucagcuauuggauggaucacagggcucccaauggaggagcuagagaaaauacccaaggagcuaaagggaucugcaacccuauagguggaacaacauuaugaacuaaccaguaucccggagcucuugacucuagcugcauauguaucaaaagauggccuagucagccaucacuggaaagaggcacauuggacuugcaaacuguauaugccccaguacaggggaaugccagggccaaaaaaaugggaauggguggguagggaaguggggggggaggguaugggggacuuuugggauagcauuggaaauguaauugaggaaaauauguaauacaaaauauuuuuuaaaaaagaauaaggcaaagacgccccccaaaggacaaaugcuucuucauccauuccuugcucacuccuuggagcagauuccucucuucuccucuaacauauaaauguggcauccuagcgccagcuacuccccacuguguggcacguacauugacccuaaacagcaggauagcugugaagaauugaagagcaguccuccucagauugguggccaaucuguacaucuuuuauucaugacuuuggugcacagcagaugugaaaucaguuggaucauuuguacuuaacagcauucagaugcgagcaaaaugguccccacuaggaaggaggaaucccagugagaaaagcaggcacuaacaaguuguaaguagccuguucagccuguccuuacguaaggauucuccugaaagcuggagagguagcuuagucacuaauguguuugcguguguucaacccccagcauugucauaaagcucuagaugagguuacacacaauuauaaucccagcacagaggaggcagaggcaggugaaucgaaucccuguagcucacuggccaggcauauagucccccagugaucccaagcucccaacgaaagacccuaucugagaaaaacaaggcagggcucucuugaagaaucaugcucaugguuaaugucuggauauguguguguguguguguguguguguguguguguguguguguguguguguguguguguguaauucauaugcaugucucucucucucucucuuagaaaaaaaaugagggcuuaauuaacuauggcugccaaaaggcaaguagaaagcucucugacacugccagauccugaaggggcuguugacucuacucucacaagaaauaggguguccaugacauucacaaacagaaauaaugggcuuucugcaggcuggguaugacaauaacaccauaauaacagagaaaggagaauauccccaagugaauggcaccuugauuguuuacuggaggacagaaauaccugaccugauucuaggacuguuucuuugugaggauaaccuguaugcccauguauuuacaugguuugugugucaacuugacacaagcuauagucaucagggaggaagaggccucagcugaggaaguuguucaaugagauugagcaauaaggccuuuacaugauucgugaucaaagggagagugcccagcucaccguggguggugccaucccugggcuggugguccucaguucuagaagaaagcaggcugaacaaacuaugcaaaccuugccaguaaccagccuccaugaguacugcaccagcuccugccuccgaggguauccuugcuugauuuccuggccugacuucuuuuacugauggauuaugauguggaaauguaagcugaauaaaccuuugccucuccaacuugccuuuuggcccugggguuucaucagagcaauagaacacauaacuauucuuuccaaggaugauagacuaaagcugaagacuacuuucuguuccuugcugaaugaaaauacacauagaggugcccacaagcauagguaugggugacggaguaaugguuucaggggacugugcccucugugagccuguuaucauugugaaguuaagcacccauuacccacucuccuugucugugaccaugaaagcucuguacugcugaaccuuuccuuuuccuugaccuucuggagacagaauuuaaaaccacugugggcacaucagagucugcauacgaaauugagccuggucuauucacuuggcaaaucucagagaccuaauuucuaggauuccaaacagccagaagcuggggauuuagagggccuacuacguuguaagaaaagugaccuugucugugcugagggagggguuccagaguuuagagcucacauaggcauauauaccuagaaagagucacugggaaagaaucucuugccuuugacauggauggagaaaccaguccuggugauguaugacagacccaaaucaguugcacuuuaagacugaacaacauucauuuggcuucgaccuuucccaaagcacuucuuuccugauaccagccacauagcaaguggcuaugaccuaugugauccuuguaagcugacuuucuccugauguagaaugauggagcccuagaggaagaagguauacagauccuauggacugaggcacaaaccuucauagccuuccucaaaaagcucuaauaaaaauucaagauuaagaugaaacucauaaagcuaaaagcagaaacaggguacagauuaaccuaccccagcauagccaugcuguuccuaucugugccaguuccaugcauaugacucucugaggcugauggaaugaaaguagugcuuagaaggugguggcacacagcuaaccacucucaucacagaacacuuucugaagaaagauggcgauagccuuuuauacauaaaccacaccaaagcaugucucucaacuccuacauacuugaugacuauuccccacuaacacuauaaagauaguguuaguggcccgggugaccuucuaggaccccaggaaugaaucuuuaugcuucccuuggugggacccugaugggaaggagaaaaguccuauauggaugauacugcaauugaaaaugacgccuauuucacucucagggccuuucagggaguccaaccauggauaugcacucaguucuuucagcauccaacagcguugcugugucgcugcugaauaaacaugccaaagaaaggaagcaaagcacugccugugccaugugcacugugggaacacauagaaucugagcccuuccacauauuuacaaagcacggaggcuucugagcugggagugauuuacaacgcuaaccauggcaggcugccagcaaagagacgugaagaugauacagcuuuggcaaaauccuuucaaacauagcagcagaguugauggaugagagugaggaaugcaaggagcuuccaagagcuaagguguugucagccaucaugguagauacagaccugcuuaaagaugcacacuugggauguacacuuugaggccauacacaaauuccuguugccagaagcugguuccuaagcccaagcaugauagggguggaaguaggguguagucucuaaaaagcaguaucauaauacaguucaacaagagcucugaaagcuuauagaaaggaagucacuaguaucgaacuguacaucuucuggucuuguuuuccacugcugucaggcugagccacaaugguucuucauaccccagccaugaaagugucucugagucaagucuaugcaugaggggcagaagaacaccaaugagaaucaugguguauacaggaucccuucaugcuugaguuuagcacaugauuuaauuauaauacuaguaagaaugugcagaccuggaaaaguaggaaacauauuuuuaauuuuuuuucuguuauuucugggguuuuuugucuccccuauuuaugauuauuaccacugacuaagauggacuucuagguacaaacuuuguuuguguguguguguguguguguguguguguguguguguguguguguguauguguguguguguauguauugcuuguuuguagcaggaaauauuuuaaaaagucaccauccugcacuagugccaacuacucucuagccccagcagucucacugcaaccauggagagccccaugcagcaaucgcccaucuuaugguucuccugcuucagauucggcucacauucccaguccugguaaaaucaaaacucuagagacuuguaauuuauuagucagauuuauauuaguaaauucucaaccuacaaaacaaaaugaacucaaacuucaauuuauauaaacacaagcuacaccugaagauagggcaaacacacccuacuuauuauuuaaucaccuaucaagaaauccccaauacuuagggcucccaggacugugcgguucuggcucucuuccucuccuguaggcuccaucuuaucuuuuccucuccuucccuucuucuucccucuuuuugucucuguccuugucucuaaaauucccagucugccugcuuuccuuuuccacugcccaaucacaggcucucaccuuaucuugaaccugcccucaucugcauauagacaacaauccacauuuuccccuuucuguccaguuaaaaggcucuuuccuuucaaauauaaauugaauacaacuauuugcauuuuauaaauuauaaaguauaagauaaaucuaauauccaguccaucaucguugacaaguaauagaagacucuguuaucuauccuaacuuuaaaaaggcuuauaaaucuauaccuguuauguccuuguuuuagcuugaaugcuaucugaaagcuaucuucucaaauauaguuucucaguguuaaauggccuggguuggcuaugagacuauaacuagucuuucacccugucagaaauaggagaaugaccaacauugucugaaaauauaggaaguuuaacacagcuuccagaacugagacaaauuguagcaacagcugccuaccuauacagccccgguaugucaggaaguuggagcauagucuucagcauucuggcccacgauauucugagagagcuugaaaaacuagaauuauuaaggacuagcuuacucugucuuggcagaacuaagcuguccuaaucuguagcuuguguccucucaaggacgauggaggucuaugggagagauaggcaguuucugcgcaguggucacauagccacaauguacaaccucaccuggaggcagagaugcucagcugcuucuuugaauccacgaauggggagcugugaggagcagauuugucucaacaacaagugaauaaauaacauuaaaugucauguucuguugauuucugauguuuuugaaaacagacuaucuauguaaaguaaucuggacuguuguucguuaacuacgcuuagcuauuuauaauuaaaauaucugaauacaaccuaacaauaaacucaaagccaugaauuugcuaucuggcccuuaacucacaggcuuaaaccucucagaucuguuucuaauggcauuuauggacggacuggguccaagccuuguauuuuuaaaauuuuuuuguaucaauagaagaaauuuauaccaaugaaaaccuugauuaugcaucaaaacaaauucuauaccaaugaauaaauuauaacuucaacauagauuucugccaaaugagauuauggauacacaauaaauucuagcuauacccuccauguucaaauuauuaccauuucaaaauuucccagaaagacaacuuagaauaaccaccuccagccccaaagcccagggaauugggaugaugacuuuucauaacuucuucaugcugaauauggauguugaaauauuuuugaaaggggaaggguaggggaaaugggggaguuuguuugccuuaacaaggcacaccaacgauuguuauugucuuuuuuggcuguguccugacugaauccucugaaagugcgacagaucaggaguucaagcaggucagcucagcaugucugacgaugagacucaccaagacuauagauucuguaauauacaaaucucuaaacaaaguuuuaguaucaccgagauaucuguauggauugcauuagucuggguaggagauaucuguauggauugcauuagucuggguaggagauaucuguauggauugcauuggucugggcaggguguucagacucguuaggaugaaguuuuguuccaaucauaagucuucauugugccaugugaaggauggcacaaagaaucguuuuuguuuguuuguuuaauucgucugagucuauuuucaggugaucuucuuccaucauaucugauccauaaaacucuggaagguguauagacauuaaucaccuuuuuaaaaaauauauaaaaacaaaaccuuucucccaaaucagcauauccuucaguuggcaaccaggaaagcuucuauccugcccucucuuccauaagaauaauaaagcaaccaaaaaacccauaacaaacaaacaaacaaacaaaaaaaacaaaaaaaaccuauuccucuugaaaaucuguauucucuccuucuaacuauaaaagcaauuuaaucacacuucuauuaauaccuguuaauaagaagcaggcagcuagucaagccaggauuguaacccaaaauucccaaggagcccaggaacaaagacuauaaguuccugaagacuuuuauauaccaucuauguguuaugcucacuaccuggagccacagacuuccaucaauaccuguucacugcaggcaauuaucauugcucucuacuuggagucagugacuaauuuucccuauccuaguuccaaaccacggacaaaauuccccaccugauucagacaaagucuguauauaaaucuauccuaaaagcaaauaaucccaauuuuauaaauucacaguuaaaucaauaucugcuccaagaaguaggcagcuuccauucuccagcucucugaccuagaguagccaucuuaacucauuguacagccgaggaccucagagccuucuuucuuuguuucgagguucccgugccugaggcaucacaugauccgacucugcucagacucuuuuucacucagaucccccugauuaaucucuaacucauaggccaagaaucccaaauuuccaguggauuucugccccauguugguuuaccaccuguauuaggaaauauuaaaaaaacaaaacaaaaaacaaaaacaccaccauccugcucuccuucccuucuuuuccccucucugucucucuguccuuaucucuaaaauucucagccagccucucuuuuccacugcccaaugacaggcucucauuuucucuaauaucugcccccaccugcauauagacagugauccacacuuguuuguuugcuuguuuuuuuuguuuuuuuuuuuuuucagacaagguuucucugugaagcccugacuauucuggaacucagucuguagaucagauauccacuugccucugccucuugagugcugggauuaaagacaugccaccacugcccagcuacauaucuuuauuugaauuaauauaaaacaauuauaaagagugcagguuacaauguaacauaucaauacauguauacaaugaaugaucagauuugggucauuggcccaucugucacuucaaacacuaagccguccuugugcuucuucaaguuaacuaccagagaagaauuugaauguuuccuuaagaucuuaucaaaaugaugccagagucacccauggggucccgucuaguucuuuguagaaggucugggcaaugggcagauaauuuggcugugggaacugaguaggaaaagggucccagaaucuuuuucccuucuguuucugucuagugcauguuugaaggaaaagggcaguaaacagcugggacuugaagcaagucuucucauacuuggagggauccuggugugggauauaguccaaggaacacuggucucuccuuucuggaauauauuuggaagaagucaaaacacaacuugaaagaaaugaugacauuuuacagaggugcuggaggcaaugucccuugaugcucuggcuuuauuucucuuuugucaguaguguugccauugcuguuccagcaacacaaugcaaucuuuccuaucauuuccagucauucuucgcauucuauucaggucuucaucgcccucagaaaaauuagaagugaaucaacggugugaugugaacacaaggggguuugcuggccuuuggcaagcuuaaugccacacuaacuagucauggaaagugaugaggaggugugccuggaaguagucucuagccaaaauguucaucugcagacuggaauguccuugucccgcaaucaugugucacaguuuugagagccaccaugagaucagaguccacucccaagaucuguuaccuucuuugguacuugcuuuccucuccagugucacaccaaccccagagauuacacugugacaugugaccaccaugugacacccaccugguuccucugcucuggguaaagccaaaagacccagcaguucagaagggggcuaaaaaauaagcaugcgucaguauggagccgcuaccaucuuaauucuauuucauuauccuagaggaagaaguagcauaguuuaaucagccuguauuuuauuagcuccaaggguaguuuuccaaguguggacacugggcuagcagaaguggauuucuguggaauguccuaggaacgcaugcauacucuugggccuuccccagauccucugagugagacucuccugaguggugcacaagccucugaacggacaaaucuaugagauacugguggagcucauguuuaaaucuaaucuccuaggauaaagaaagccaaaguuggccuuuuccuaaugaaccagagucacuuucaguaggaaccccagugcacauggagacacagugcaugguccuccuauaccacaacucugaccuaucucuuccuuagugccaucaucagcaaccagcuccuguuucccagauccauuuagccacuuguuaacuuuucagucacguaaacaggccccacaauuaauaacagaagaaaugagaaagaaaauuaaaagaaccuguaucucuccauguccuuuccaaaagccagccuucccaggagacugagaauuuacaaacauguucaugaauaguuuuguugcaaguaaaagaacaucaugaucuauuuuaacuugaaacuuuauauaauauaaauacuuuuguucucacuacacuguucaguauugauauuuuuaaugauuuuguagcauuaugauuuaugaauguacaguacuuaaucaagccuuuacccccaaaaugaacauacaaauuucuuucaaauucucauuuuguauuccuaucagcaagagaaauuucacugaaucaaaaauuacucaugugcaauuuucaucagauacuguaaagcauccuucugccguauggauaaauuuuugcuucuaagaaacaaaauaugggaugcuauucccuagaccugcagggcucaguguucaacuuccaccaaaacaaagacuuuaagcugggcgugguggugcacgccuuuaaucccagcacucaggaggcagaggcaggcggauuucugaguuugaggccagccuagucuacagagugaguuccaggacagccaggacuauacagagaaacucugucucaaaaaacaaaaacaaaacaaaaaacaaaaaaacaaaaacaaaaaaaaaacaaaaauaaacaaagaccuuaaugcuuuucaauuuuuauucaaucggucacaauauuuuaaauauucacauuuauuugcuuuucauuauuuucauuuuuucuguaacuugcuaggucacacauuucuguauuuccaugggacuuuuauacuuuauugacuuguugauuuuuuuuuuuuuaauaucagcuacucacuuugccugaguuauaucucccauacuugcaguugucaaaagugucauuugcuacacagagaaauugucucuucuguagcauggagaggaaugugagcugacugugaagaaucuugguguaacuuggcagaaaucuggacugaugucuccuaggcaccauuagaagauccagucucaacaggcagccuggaugcgugagucagaaucuuucagggccacccagcuucugccagcuccaaauaggaagagagcauggcuuccaagccaucucuuauucuguugccauagagauuuuugagacaaggaaaccaaugucaauagagaccucuuuuguuaacucugagcuguggggccuagggauagcuucauggugugauucuuggacuaaggaugauguugcuucuuucaaccaagagaaaaggguagagaagaaauaguguguggaaccaaguccuuggucuucagguaaaagccacucuucucauacuacauagaaucucccacugaggcagcuucauuuuacuauuuuaaaaguuuucugacuuucuggguuuuccaguggucuuuuuagagugccauuggguuacguaaguuccucucaauguugaugucguaaagagugaagauuguugaugugcuaaagacaggccugagacccaaggggcacugccacuuauuccaaauagaauguagaguaagcagaaccugugcuauucaggccuuucucccaguuuucuuucuuucuuuuuuuuuuaaacugguaauuauuuaaguuuuuaaauuggaaauacaucuuggggaagaagccaaccaaaggaauaccugauuguaaacuuugauuuuauugcauuaauauaacacaaacuuuugcauaaccacaccaaugcaauuauucauacaagcuuuauauuuuauuaccaguuacccacuuugugugauacugggucuuacuaguuccauauacacgugguauuuggugcucaggugggugaccucuucugcuuacuuugaccaccauucuugcuauuuccaugaauguauacaaacacacacacacacacacauacuauauauauauauacacacacagagacacaucaaauauaauaugucaugcauaucucuccucuaggaaugugucaacaauucauuuucaugagauaggacauacuuucuccaucucaguauuuuugcucagaagacuguacuauacuauaauucccauuuuuuucuuucuaauauuuuuguauuguauauuuuauuuauuuauuuuuacuuuugaccuuucauacauguauaaaauguauuguggucauauuuaccaccauuauccucuuuauuucccuucuuuuccugccagugcccuucuucccaaguauuccucccucccuccuucucuuccucuuccucuccuuuguguaugugcaagugugcaugugugcacuuguaggcauucucagauuuuggacugauagcaacaguugcuguguguucugauauuucacaguuaacucauguguuagucuuccacuguguagacaaaugacugagauagucaacuuacaaagagaaaauguuuacucuccucuuuuuggaaauggaacucuuccguguugguagaaaauuagcucccuucaucuuuauagcuggaaagugacuaaguacuggggggaaaaaagccuaucaaaacuguguaaguauacuaggaugucucugagacacagguguaaauuauaagcuuucaugaaggccucuaaagacuauccagucacuugggcauuugcuucuaacagcagccauugccugguuguucuccuggagaacuguugaccaagaagaccuuguccuuucuaccuggagauauguguuuaucugcccuccucccuucauuggaacaacucuucuagguaaaauccaugaaacucgacaauagaaaagcaggccugcaaaggagaccucuguuuuuguccuccaaggucccagcuaauuugagauccuuuuuauggagcauauugcuaaccuaggaaauuccagcacaguauagaguccucagacuucuaucacaagaguuaucccaagugcugauuucccuggaugugaccucuuucaaacuauuaaauuucuguuauuuaaauggagagggcagacaucccagaaagaagacaaaaagcagagcaagugcucagccugcagguauucugcaaagacccagcauccauguagaggggugagaauaggcacagcuggcuauagaauaacaauaaaaguagccagcugguagaggucauuugacucccucuggaccuccuuauuuccaacuaccacucuacuuccuacugucaggacucuguggaugcaauccuagacaaucauaaaaacaccuuggaaacuguugugaccugcuuaaaugcuucugucaaggcaaaagaugguaaauggccaaggcuaaaauguccaaagaaguuuuacuuccagcugguacauugucuugccucaugcaguuaugaaagguggaagugaaugggucacuugaguaaaauagcugaaguucaccccucauuugaagcgagaaagcagaguguacauagcagcccuuccgcugggucccaaagccaaagacuccaugacugugcauggcuuaagaaccaucacagagcaagguaaagcagcagcagugauagggaggaaaaggauaagaagggcaaaauccaggagaaaauauuacaagugaacccacaguaccuacccugagcucaagaagacgaacacagauaaccagaguauagcugugugcuuagugcagcaggagugcucaaggggagggcacuuucuagguucugaaagguaaaugcaaacucuuuucuccuccauuaacacaggagagggggcaagucauccaugacaauacccuaucagagagucacacccuauuaucugcugggaauuguggaugaaaaacaggcuauucauaugaaaauugaaggaauuucuccuuggggcugcaaugcaagggcaaucagaagguuauggaguaacuccaguuuaccacaagaagacagcaggguggcugccuauagaguaagaccuauaucccuuaacuucagaaaccaugucaucaccauaucugucuauucuagguauggaaauggauuauucaaagaagggguacuaccugauaggcaugcagacaugugagaacaguaauacgguggaaacagaaaauaaaaucuguguguuuuaaaugcauguuaagaugaacaucagugcauaugguugcuacugaaaucaggaaaaggagacuagcaauugucaagaugagucacauuaauugggcaagcagaagcuaagacuucagcauaaagggcucuuggugacucucaucagggcccaugacaguuuccacuuccaacuucagaaugagaacugugucagugauggaauauaaguaacaaggagagccagaggcaucugugcuaagauacuacacaguccaaccuggaggcagcucuguggccaucuucuucauggcaauagugaagcgaucaucuuuggagaaugaucaaaucgaaugguaaguagaggcaaggaugcaccaccuuguggagagaccacagaggccuuaccuaggaucacagaaacauacauugucugaaacaugaacagaagagaugccauucuggaucagggaaagggagucagagaaaaugugacugagcuugugaccaacaaggugauaaagcagucaggauaagcugcacaccccaccagaaaucugugccauuuagauccagugcuacuaagggcuucccauagggcauugacaauguagguuauagacuugggggacacagcugggaauggagagaccaaggcacaucuguaccuaaggcagggccuuugcauguuaaggagccuucugaugccuucaggcucagaggaggguaugguauaacucuacaucagcuugcuggccugccugacagggacaccaugcuacuuguaggaacaaauugaaauauuguccugguacuguugaggacaaaauaccucucuaaaguuucaaccucaguagauuuuuuacucugugcaucccuauugaaguuuuagccaauauaauccauggugaauaaguaggacaaauuuaaggagcaauuaugugaaguguugcauuuuuauuuuauucuugccuuacaaucucuguugccuuguugcuuuggccauuugggauuauuugaaaccagacccuaugucuaacugacauccuuuccucucaagaguuugucuuuuuucacuauaaguaguugcuuccaguucacccaguauugauguacaauaauguacaaccucagaaucgcugaugugcaucuucccuguucaagcucuagaauuagcuguuucuucauagaaccuuagcuuuuacuggauaacaguguaagaaaccaagaucuggacaauaacugcugauugucagcccucccugugacaaaacuaggagauaaauguucauacuuagucaugugacuacaucuguagagaguauuuguaguuuuaaauauguauacauauuucuacauuuauacuuauuuugaauacaugcacauauuuacauccaccuuugucuauaucagucuaaacuugaguccauccauaguaaugccuccaacuccgugcccacuaucauguaucacaacagccaucuuuccuuguuuccuugcagcgcccugguucugcagugagaaucccucaguuguucucuuccauauuaacugggggcuucauauuauugacuaauaucuucccagaaaagagcccaaauacaaaacauguguggguucuuuucccuuaguccucaaagucaccucauuuccaaagcuacuuaggucaaaaccuucucucucaaacccuuuggugaaguugcuucauaaauuugaaagucaauuagaccccuugccauaaucugcauugcauccugguguccucugagcuucuacuaauuuuauuuauaagacucagucaguacuuaaguucccugagcuuuggcaauuauguacaaagcacuucguacccaccaugacaggauguccauacaagacuguuucuuagguuaccccaacuucaaacaagaagcaguauagcuucaaugugaaaucuguaaaaugugguauucaaaauauucacguuauagcuccccaaccccaccccguaacucuuuuccagauuucacaacagaaaauggacacaggaucaagcacaagagccauaguucaauccccagcacagagaaacacaaaagaauaaugagugauaauuaccucagguagcuugguauauuugaaaauauagaaguucccaagauauaagguacaauuugcuaaacacaugaaacucgagaagaaugaagacugaaguguggacacuaugccccuccuuagaauugggaacaaaacacccauggaaggaguuacagagacaaaguuuggagcugagaugaaaggauggaccauguagagacugccauauccagggauccaccccauaaucagcauccaaacgcugacaccauugcauacacuagcaagauuuuaucgaaaggacccagauguagcugucucuugugagacuaugccggggccuagcaaacacagaaguggaugcucacagucaucuaauggauggaucacagggcucccaauggaggagcuagagaaagaacccaaggagcuaaagggaucugcaacccuauagguggaacaacauuaugaacuaaccaguaccccggagcucuugacucaagcugcauauguaucaaaagauggccuagucggccaucacuggaaagagaggcccauuggacuugcaaacuuuauaugccccaguacaggggaacgccagggccaaaaagggggaguggguggguaggggagugggggggguggguaugggggacuuuugguauagcauuggaaauguaaaugagcuaaauaccuaauaaaaaauggaaaaaaaagaaaauauagaaguuagauuuuguauuccaaagaagauacagaaccaugcagacaagcuacauccugaugcccacagggacacagggaaauuaguggaugauuuuggguucaggacacuuuagauucugaacacauuuucauuuaaguguaugauuuuuagcaaauuaaucuuuuuuuuuaaccaaacuuccaugugcucauccuuaagcaaggccauuauucauccucguuccucuguagcucauauagauucugagacagacguaauuuaaaaugacuuuuaaaacauuugaaaaaaaacacugcagcaagcuguguguuucaaacaugaggacaaugaaauuuccauuacgcacucuguccugcaggguaacuuugcccguguucuaucccugggaggauccccgucucuucuucacucuagauucacuuaguacccaaugugucucugcaaggaugugggaaggaggaacugugugacuuacaauccuugggccacugauacccuuccucuuccuuaucaacagauacacauaacacuuuuaaacauucaagaugcuauucgggcaaucaggcccugugaaaccacuaugcugaaagcaagucaggccccauagagaggccacuggcauuaggccuucaaaucaucuuagcccaggcuauacaugucuaaaaagauuccaaauuggacuuucaauccauuuuccaugugcacacaauugagaaucccuugcugaacccuuucuguacucuggcccacauuauucaggaacauuucuugacuuuucuaagccucuggccuacuuagcugcagcgauggaucaucagaauagucacuacucugccuuaguuacuguucaaaaauugcuuauguccaaguucccugagacuccaugacacagugacucauuucagcugagaggggaggagaacaaauugcagagagggaaagagucuugcugaaagccacuguagugccaagcagucacaauuggggagacaugcacuugggcucccaaaacacuuguagacauuuuggaaaggaacuauuggaaaauuaaaacugcuuggugugccugcuagauuaaacuauggcuauauggaagaggacucuuaucaccacucugucuuaacugguguacuaagacuccugagaggccuuaagacccuucaccaaaguuucuuuauggauuuugcuguacuuccaggggggggugcuuuguuaauuauguuuaucuuauuauuuuucaacugaaauugucugcaccuccuagguuuagaugaccugaauuggaaugacaguccacuuacccaaaacucaagaugagcagaccaaaacuaaugagcuuucccagccauugcugagggauucaugcuucuagguaggacauucaacugaaucagcagugucuguuucuauggcuacagcucccacugaaguagugcagcaaggauaaugaguguaugcuccagaaucagaagugaagggagauagaacaagcauagauggaacugaugauagagagaaucuucuucuaugugccaaaggauuggcacuucucucugagcucugugggagacucuacccucugucucucuguccuucuugcccacaaagacaacacugagauuacccucaaguaagagaggaugaaucaagaagaaccucaugcaaaaauuacuacaauuaaggccacuuauucauccauugcauauucacaagguagaaaguucucagcagauuuucaggaaaaagcauccaaacagaacccagauacuugacauagaagggcucccucuucuacuuaagauguuugcagugagaguacuccaugcuggcuagcuccagaaauuuucuaacauaaauugaaacacccucucaccaggauagaaccaaggcugagaguuuaccugagcaugcuaacacauaaccucaucccuuauggagaaacucuacuuuggguggaaagaagggggcagacacauaccuugccucaaggaguucucauaucuaugucugagcuacuccucucacaauggugauaucaguggagagaacuuuccuuucuaaucuagcaucucacuugaaaccccuaaacaguucugagcaagccaugaaugccuaucagacaccaagaggucuauaagaagacuauaguguauucacauugagccauauacaguaccaccccaagggacagggaaccuuacccuuuuaugucauucuuuugaguuuguuagaaguaaguguccuaucuuuguuuaugaauuuauucacaacaagaagauucuuacgagcuugugucugccagguggcacuuaauuagaugcuuucauaaagaaguugauauaggcauacuuguaguuuugcacucugcuuccagauagggaacucaggagacuacgcagggaaggagugcugugcauauaggcagaacaaaugguaguccucucugcauggcucagcauccauuaacuugagcagaaacagagcacacugcagaaucaugucuguuuugcauacaugucacauuaaaucaugccucauaaguuaagugucuuuucuggugaggaugggcaaugcuagagaaacagguauguccauaggcacugucuuacuuaagguuucuauuucugugaccaaaagcacuuuggagaggaaaggauuuauuucaguuuacagcuuucuaucauaguccaucacugaaggaagucagagaaggaacucaagcagggcaggaaccuggaaucagaaggugaugcagaggccaugaaggagcacuaccuacugguucuggagcuggcuuucuugcagcacccaggaccaccagcucagcagugguaccacucacaguuuucuaggacauccacauuaaucaucugaagaaaaugucucagaugccaauaugguaaggggauuuuugcaauugagguuccucuuuccaaauaaguagcaugugucaaguugacauaaaacuaucuagguuagcaccuugguaucgucuggguaugaaauagcuucuauaggcuugaauguuuaaacauuugauccauggcugguagugauguuuugugauaucauagaaccuuugggacccacuugaaggauaugaguccuauguccuauguggaaaacuaagaugcuccuaauugcucauuuuccuauaagggaauccccuccccuccucauugagaaaggggcgucagcauaaggacccaaugggaacacaaacauucaaucuauagcauuuuggcacacagauauauuucaguggaauaaaugggcaagacuaacuuuacuaaaucucucccuuugaagugaguaagagaugaagcuuauguggguuccugauuuacagccuuuucucuuguggauguguccucaccagaaaucuaagacacaaagaacacugugcuuaccagaggauugccuucaguuuuauuucaccugucaaauaaauucuggugccugacucccuugcugcuaguguaucaucacacauuugguauuaguuuaagacaggaacucuugcugcaagaaaauaaagacaaacaugaggcccccagaagaguugauucugagagguacaagccaagauucugccaccuuuagaaaacacugaggcccuaggaaagaaaucagagacuagauaugugcccagcgccagcccaacauaaccuggcugcagguacaaagcaauuaaagaaaguuaaaaucuagcaccuuugcuaagcaagccaguauaagaugagccaaauaucucauuacuauuacuauugaggauauacugaaaacagguuuagcaacauagaaaacaaguaacuagugacaaauuccauuuccacagucagcuccaggauacucauggcugauaaaggucagcaucuacucuauucauaucaucaccauacuguuuaacucauguuggaaaagauagcuuagaugauuuaauacagcuauaaaauaagagcuugggaaaccccuucauuaaaggaauauuguuuagugugacccacuagcaaggugcuaugcuaacuauugacaauuaaaaugugaauaaagaaguagaaugaccagaaguacuggauaaggaagaauucacuuguuugagacugggagagauuuuccuggggagagaggcuaaaaacacugcagauggaugaggauccuagagaaguggccacugaggcuggaagaaaaagaacugggacagggaugggugaaacaagacuugaaggucuuggaggcccccaaaauugaaaagguuuuugagggauguucugagaagaggcgagaaauguagaaaaggaaaugauuauaggguguguacauucuugcaguguucuccacugcagccagagugaggacaggacagaggaaacugucuaaaugaaucugacaucagagaaacaaagaggagucugaauuuaaagcucuuggucacugugacagaucacuaagugaaagggugaugagcaagacugccuauauugccaguuaagauaauaaguuuagcugugguuuuggcaagguaaucuaguagugguacccagcuguguaugugugggggcuggaguuaggaagcagagguugaguacauggacaugguagcucaaucuauggguguugaugaguggucaacaguaaaguaagcauagggaggccuuugaacugagccuuugaugauuuguucugcuuuugcucuguaguuccacucugcugucuccaugucuucacucuuguuuacucuauucaggacuaagugagccccuccaguucacauagaacucaucucucgauucaguuuggauagucaccagcuauugcuuugaauauuuucuacccugcucucuccaaucucucccuuugugcuauaucuccuuaaacuuucuuaucucuguacuuuucugugcuugccuugcugauauuuuuaaaucugucuuccagaacauaaauucuuucuucauccaugucuaaugacaucugguuugcaaccauagugguucuauuuuuuuagcuuugaaaauucuugcugcuuucuacucuagauuuguuucaugucuuaauauaaauuaauuauagcuuuguguccccucuuaaucacugaaaacaguuuaauuguuuugaacauuagaucaccauagaccucuaguccaguuucugcaaacucuacaacucuacucucuuagauuucuccagcuagauuaaaauagaauugcuuugaaagggcaugauucuggaaguaacaauucugcuuggggugguguucucaccuaccucuugucuaccccgcagcuuauaauuucccacugugggucuaaauagagccagguucauauuuuuuuuucucugcuggaaaccuaugagcuguagcuguggauugucauuguccuuagagaccaucuuugucguuuuauuuuuuccacuugagugcugaauccauuuguauuuuaauuucucagcagggcacuugugccuugaauauaauaagcagagagcccacaccucugauuagccuggccuugguuugauugcuuacucaagggccagggcaaacagagagcuugcagauuucucuaguauaggggaagaguuuugaucccuuugcauagagaagauacucuuccgaauuucugguuuuacguguggccucucuccucaacaaacacuuucucuucucuccacaucaaagcaucagaaacucagccacagccccgagaccugucuccugaaugcacauuaccuaccagcuacaugaucucuguuggaagcuagaaaguuuaucauauuaguggaacacaaacuggguucucucacaggugaacaccaaucuaaguaacaguggcaaaagauccuggaaaacagaaaacucuucgaaaacaaauaaauacaaacaauacaauucaagacaugggagaacuugggugagaugucuuuaaaaguaaauagucauuccuuucugugguauacguucaucuuccacauacuuuaugcaggaggcacuguugugcuauccuggauacggaagucuccagauagaacuccccgccagucaucugggccaugcaauugcagucucuacuaagccaguauggaguuaguauggacagggguaugagcaggugcuagugucagcagcacaaguauuacucucagaaauuccugguucuguaacucucauauuuuuuucucagccuccauuugcuauuugauggcauguaaaaaacaauuccacagaggcuagacauuuuuauaauguugcuucucucuucuagaggacaccacauuuaaaaauagaaagauacaacucugucugccacguucagcugaccauuacugucaaaggcccauacgcauuguaucuaacuuugggucuccauuauggcuccugaauugggacuucuucaauaguaggugugauaaaaaagugucuuugaaacacaaacacacacacacacacacacacacacacacacacacacagccugggggaacuacauccuuuccacccuuguuucacuugaauuauaaaaaaaaauagaaaauaaaaaauuaaaaaaaaucagcucugaauguuauaugaauucuccaaguaagaaaaaagguuguucucuagcauaagcaguggaucuugggacucauacucuggcgugguugccaagcugguaccggugacugccuuagcaugcugaagucaaccaaugucgguaaguaguuagguugcaguuuauauuuaacuuggcuauuucauaauaugaaaacaauuucaaguuccuugaaacugcaguacaccuuguaccucugagagauuacauugcccucaaggccauugagcugacaugcccugacucuuauuucuuguauucuauucacauuugcuuuuaaugugucuccuugcuacucuagguucuuuguauuugaucacgacuuuaaucaacaugcuacauuuuguccauuuugcuucccuguagagaaguucugcuaaaagcuuaaaugucucaaacaccuugagaacgugaccagagcuauacaaaaugucacaaaugucuuucuucauuaaaaauaaauaaauaaauaaauaaauaaauaaauaaacggcaagaaaucauggguugguugauagaauauuuccccacccagaacguaucuaaaugcccuaaguguagcaggcuacacugcuccugagugacaaagaauaaaaccugagccugagugaaccacaguaacgauagcaugaggaaagaaacaggguuuuuaaaagaaucauuuauuaaugcauaguaauuagaaauccuaagguguuuuguaauagcauacuuuugugcuuggaguuguuuugacauauauuuaaaacaagagaaacuuacucagcuacacaaauuagaagaucagcaaugagcugggaauacuuuuucauagauaaagacgcuagagcauggccauauauguggaaaggugauacggaggaaggagaccaucacugugggugauucuugacauaccucccagcuguguccucuuccguagaaucuguguuggcuccagugacuagcuuguaaccaaaaggacacagaagacuggcuucaaggcagcuaggaagaggguuuuaaagcccauggccagagugacauaccuacucuaacaaggccacaccugcuucaaaaaggccacacguccuaauagugccacagcaugguccaaguauauacaaaccaucacgccaugccuucuuugucucugguccuacaccagcccuuugcuuaccuuuccugccucuacauucucaguggcuuuuugggggaccuccuucacauugcugucugcacuuaauccuggucucaccaucauucagggaacccaaugaugacauuuacaauaaaaggaaagauuuucagugucacaugcagcuaaagcacugccacuaucuuaguucuguccuaaaaacauuuuaaauauuacaguaagaggaaaaauauacaaagucauaaaggaacagaaaagaggacauggagacacaggugacacucacaaaugaugugagcagaccaaagaggguauagcacaggcagugaggccuaaaaggcucccacuaaaaucccaugaccaucagucccugucagccuugugguguucuuaaaugcuaacuaucauccagcaauggccugacauuugagaaagcuucuccaaaccacauucgagcccaaaaugauaccuaaaccaaauggaggaccccuuacaauggaucugggcuauaggcacaugcaggguaaagaagagguuuuuuuuuuuuaauuuuuacaaauaauauuuucagagagcuaaaagugaaauuaauuuucuaaggcaaaacaaggaaguggauauauagcaaugagagaacaagaagaguccuuggaaauacaguaguaugauacucagaauaaaaucccauaaagggcuuggagaauagauaaggaaaaaaaucuccuaaaagguaacaaagagcaagagguagacaauaguacacacacacagagagagagagagagagagagagagagagagagagacagacagacagacagacagacagacagagagaaagagauggaaauuuuguucaacaguuguauagcaaagacuuucacuucagcauuuuagaauaccaggaaaaauggugcccuuaaaaguuccuagagagaaggaaacagucacagaaauaaacugagugucccugaugcugcacugauaaguacuagaaaugagaaauguaugagaaaagauguaagaauuaaagggaggaaaaggucccaguucauuuauauauccagcuaaacugucagucaaauggaauagaauguagcaauuuacagguauguacagucacaagcauguauuucuaggcaacuucuggagcacguguuucaaggauaugacuuccugaguggaggcaggaggcccugaaaauauaacugaacugaagagaguagcaggaaguccaagugugguggcacuuaccuuuaaucccaguacucaggaggcagaguuagguggaucucuaugagccugagaccacccuaaucuacauuguucaagagguggaaugugggauuuccaugagggacaugugaaaggacaggaggacaggagaaaauugcuucaaauuuugaauuuagacuuuuucccaggccaauggucuaugguacaauucuuguuaauggugcucgucaagcaggcaugaaucagccagcacacaaaugggccacagcagacacucuccaggaugcagucuggguaccacagccaggauggugagacauucaggagaugucuaaacuucuuggcaucccggucaaauguucaggaucucaauguacacagaaaacaacucugagcuucuaaagguagugaaugucauggaaucauggccuaucacagaauagaugagcugcuguuauuaggcccuucucuaggaaauacaaaaaccaccacaccuuggggugcacucaacaagugugagaccuugugggggucuuccuccacacagcagcccacaugaagguaguugcuauauguuccuaaccugucauuaugcuggcccuggacuugugcagaugagccugccaaugcauaugugcaugcgugcuugcuuacguguaugugugugcgcgggcgugccguggaaggugcugugaggcaagcugcccuuaagagccugcccguggaaugugggaucugguguucuauauucaaagcauucucaucucagaagcuacagcugaggccgccuucuuacucacuuuucuuuuacuguggccucugucauucaggccaaaaugagguuccaaaaccaguuuauaccccaaauugucucagagccuguuagugaguguacucugcucaggacauccaaggugaccuuaauuuggcauguuaagguaaaacaauacugaagaauguaaaaacuuucacuguuagacgggacuuggagcuugagcguggacauggggauaaccacccaauuuucagaucuaagcaguggcaaauggguagauauuuguagauaggcuuuucaucugcccuucauucuucuuaaacauuguauauaugccagcuaagcuuggaaugaaagcugauugccucuaagggcccccaccuugcagggcucagauuagauucacuguacugauuccacuggaaguacagcucuuggugccuugcacagugaauguuagacggcaauaacucaugggcaugacugugauaaugcgaagaaauguaaagcagucagguccucacgcuagaagaaacaugggcaguuagaggugccuacagugcuaauaauuuucagagaaaugguuacaauggcugcacgagcuuguuguaaaucaaaggagguggggaucuaguguuugcugccaaggcccucaugcugugcaugagccaggccucuccaugcacagccagcaugcuggguggaugauguggaacauggaagcgucuucccuuacugccucucuccccuuaggauaauaacuauuggaagaacagagcagcagggcagucuuuuggagaaaaauguaguuuuucagaaaccucaacuuaaagcaguuucuagccaaaggaaacaaacaccagccuguuaguauuuuaaucuagagguagagaaaccucagcauagggucggucacuggcccacugaaagaccagugaccaggcacuuugaagaagauaguuuccucacagcaagugacuggguguucucaaggagagaucuuuccuuggugucgcuaaugucagggucucaggaugucugaaucgccugugagauuuuaaauaugaacacaggucuguggacacauuggaugcagaaaugcuaggaccacugaguuucugcagauaucaggauucuuuuccugacccaauagaauugcuucaauuuccuucauucuguagcuguuucacucuguccaaaugcagagccaacacaaagccguaugaccugacuuuaaaccuccuaggaaacuuccaacugaagugccuguuaaaaagcaagccagcaaaugcacuacagacagaggagaaaccagagagagaaagguggcuauuccagccugugaagcuaugcugacucuguugcauaacccaggggccugggucuucagcaaaacggcagacauuaggcaagcuaggugagguuuuagauauugagaucuggaaaugucuaggcccacaaggagacucugcaggaauccuggaagaaccacccugcuaccccacagaaagcuugucucagcugaaauagcacuucauucaugcagaagguggacugcucucuugaaucuaaauggcuacuuuugcucucagauuuucuuuguaucuuuacaaccaggcaaaagaagggagcucuuuaacucaggaaacagaguauuuauaguggacucugcaugcccagccccucaugauuuaagugugcucucccucccccucccccucccccuccagcugugucuaaaacacugagcuugcagcugugccugcauuaugguuugcuuauuauuucacacuguacccccaugucucucucucucucucucucucucucucucucucucucucucucucucucucgcucucugugugugugugugugugugugugugugugcgugcaugugcaugugcacacacaugcaugugugcauguaauggacacacauguugauguguauugcauauauuuggacagaaacuuguagaaacagaaaucaguauccacagucucccacaagcacuuuccauuuccuuuuugagacaauaucucccugaaacuagagcuuguaauuugucuagaugguuagucaccaagccccagggauccuuugguuucugucucucagcacugaguuuucaggcacacacuggcacaguaaaguagggguugaacucagguccgcauguuaacacagcaggaucuuuacaaacuaagcuaucaucccagccuggcuucuuuaucugugggcugaaauccacaugugcagugcucaagaguauaaagcuagagcugcugaccacacuaaagacuuuccuugugcccuacuccugcagaugcaaaggugcacacacagcaagccacugaaacuccagacuaaugaacuggcugcacucccuguuuuaugacagacauuuuucacaacauauuugccaaaggguaggaaaagaaauacccagacacaagaauucuuguuccuaauccccugaagaauguucaguuggcagcuuucccgcaauguuuagggguagacuaaccaggcuucucgggacuuugugaaucauauuaccuuuguggccaggaagguguacguagauaggugaggguauuucuuaguuacuauauuguucagccugauggcuuucaauguucugaguucuaaaguggcagaggaagaacugaagaaaagccaccugagaugguccucuagaggcucaaccugaauuugguuauaguuaaaaggguaagguuauauucuguuccauauagaagagcccccaaguggacagucuguguaugccucuuacuuucucccaaaaaccacaugggagauucccaguggcuuuagggauaggggggcaacucuaugauuugaaccuccuacaagaaagauccugagauacagugaaagugaacaaauugucuaucgggaaguugauugggcaagcaagaccugaaggaagaaucaggaagaggaugccaguagccacugaaggaagaugggaucugaguacugaauucagaagaaagacuaaagaaucagcacaaggaaggaucuacagggguggggacagguuuugaguuuuuccaggccagauagcagacaaggucuauagaacagugaccugaccacaaccaaauccaaaucagaacugccaagccaauucuuccagaccucuagacacagaacugcgggccauauggaaguagucuugcuuauggccaaagagauuggagaggacauguuucuuaggaacugaugauggacagcagcacagauuucucaacugugaaggcugaggccaagucugggacagagagcaacaguucaagucagguauccguuaagcggcuaguucacacacgaucaagaaguguuuccacacccauaggauaucuugaggccagcuuaauggugggcuuucucaauacucacuuuugccacaggaguuucuuguguagaacagagcguagauaaaucaggguuccuaguuauucuaggcacuguucauuccagcuaacuucccuucccgcaucuugucucuguugccuguaggcacugguuuccaucugucacuuguuccuuuucuccuccuuccucuuccucaacagaguggucaggagcagcuggauuacuugaccugggucaacccuucuuguggggaaaaacaaaaaaaucaaccacaacaacaaaacacuuucacacagucuugccuccacaaccugcagauagguagaguccuccugcuucaauacauaguaauaaacaugucauacagccugacagcuaggagaguggcauuucuuccaggcuuugccucucaaaaggacaaaaggaagggcaguaaccacaguuaucuacauucugagacgaagggacuauuugcauggcucugagaccccaggaacucucuggcucuagaaaaggcaaauguugagugccuuguugaaguacagccuuaccuuaccaacuugaugcucugaccauuucuacuauacuguccucuucucacacacccugaguaccuguuggaagaaauaaauguucaagaacugaagaaaaaaaauagggagugaguucuucuaaggcaggcuuugagaaggaaggaguaacauugauucucagacaugaagacuuugggucugagagcuuuggcucccuauggggagaaccuucagaacaggagcagagcacgaguguaaggauggguaggucgcuacucccuucuuuuacccuuggaaaaacaaagaucagcuacuaagggcuaagcuaugcauggcuuuugagggugauauuucagccccuacacacuuggucauacauuaauacuuaucgauggcccaccaacaucaccacuaccaccuacgggcauacucuggguuuccaguugacgacagaggacaaggaaaauacagacccuggucuauaauaaguacucacaaguucaacccuuaugagauagagaaguggcacucaggagauucucuggaaauuuccugguuagauaaauagguucacccuccucucugggcuuccucugccuccccuccucuguccuagcacaggcuuaccaggcugggauaagaccagacaguggcaagcucugcagcuugcugaugucccagggcuguuugggguuaaugccaagaagggcaauuacagugaaugauguuauagggcauuggaguguuugggaguauugcuagauaaaaugaaacccagcuaauuauagcuuaauuaauuaauuacugcuguccuuagaggcuucucauuugaaauuccccccagcucugcgucacaaaaauccuuguccaccguuagcuuccaagcucagugccaagacaagaaaugaaggaagaaauuuuuuaaaaccuagcuguaaaaauaauuuuuaaauuccaaguuuuucuuucccagucccaguucccagaaugaugacucugagacuaauaaguuacuauuaaaugccuagaucauaaacuuuggcucauucccugacuagcucuuaacauauuuaaccauucaauccauucuaugucuaccaccugguugguuaccuuuccuucaguccuggcccacaucuuucaauuauuccuucuagucuccucugcauccccucggugucucuaaguuccucuaccugcugguguucauccuucuccucaggcugucucccagucuucucucccucauuuuguccgcugauucucccauugugucucccuuuauucucaagauauucccccagaacccucucaucuugccagugucccaccuccuauuuccugccucagcucauuggccaucagcuuuucucucucuacaucuagcuuucaagauucagaagucaguauccagagaagacauucagaggcagaugugaguucuuaugaacacaucauagauuuuccaucucacuaaaucagaaucaggacauugugaaaaaugaaaacucacaaguuaucuccaagucugaccaccuaaggcucauggcauguguuauuauuuuuagguuaagugaauaguauggucucuuguacuuacauauaaugcagaaauauagcagauuuacccugaaaaggggagccacugagaaacuacagauuuuuuuagggaugauuaugaaugugaguuagggaaauccguagaacagugggcucuacuuuuacacugaccagaguguccucugcuacaaagauuuaaucuuccugggcaucacugagagcuacagaggaucaugugucuuggcaacauucauuccacuagcccaugagccaugugacucagccauuucccuccauaaugcuacaaauuaaaccaacaucacuccacuuccugaaucaaggaguguguguaguuuaguaaagugugucccagccagccagcaaaaucugaacacaaagacgcauguuccucagcaguucuaguucucagggggcuucuagaacugacuuagagguccuucaguacuuacacgggcuucugaggucaacucugggauuuuuccuagccucaagacacccauuauagagauagcucuguagcuacaucuccagacaagaagaaggacuauguuuuacauagugauuucuuauaacaaaacaaaaccuuuuccagcguucuuauggagauuaaugagaccuaccuacaauagccaacuucccucccuuggcuagugaaucuagucuuaacuucagagaaugacaaggaagggaggagcuagaaaaaacugcuucaaaacacuaacucugagccaaugccuacucucuauauuacuuuuuaccucaugaccccaagaaguguaaaucuaacuaacccccugccucauuauauaaccaaauacucaagcacaaagaugaaggccuuauucagaauacuuucaccagcagaugaaugucaccaguccuagcuaugguacggguggggacagucaggaaucaagggugccauagcacuccaaagagaggugccucaaggcuucugggauacaguuaacaauaucacacacuaauuuucucucuuggaaacgagaaauaguuuccuucuccaugcuuuauuggguuauaggaguugaaaaugugcuuuagaaauuguuuuccuagugaaaauaauagcauuguugaguaggaaggacugcacuagagaugagagccacacccaucucugauacaucuauuguuccuaagacccauguggcgucacauuaguggucuguccuggauaguucaagacaugacuuucuugaaacaugagagaaggaggacuugccauguggggagcagugacaaacaccaacgcuccauuuauuuauucauuuauuuauuuauuuauuuauucauuuauucauuuauucauguuagagcuuaccuggagucuaaucuuuaugagaauaaauccuguuccccuguguccuggccuguauuuguggaaccugucuguaauccaguaaaguuaaacacugggaacaagaccagcagagcucucuacucgccauucuuucuaacuuguucacucucuucuuuuccucuucuaacucuccagacaaacaaagcuguggccaaaggagacuuccaucaggccagcaccagcucucggagggcccuguuccuggcaguccuguccauuacuauuggaacuggcaucuauguggguguggcuguugcccucauugccuaccucuccaaaaacaaccaccugugagcuucccaaaugcuggcaugaaggagggggagucaagccagcuguacgagggcagagaagagacaccuguguguuacuguacaguacaagugauugccaaacaacuccaugaugcccuggaaucuucuacuccuggaguucuuucauuuuuauccuucaacuucaucuucagcacugugcagagcaccaggcagccagcguugccgauucuuccacauggaaguuccaaagauuccaucccaguggcugacccugaaugaauucuauuggauggaugacaacccagcucugcagccugccagugccuggaccaacaccccauuagcaauauacaaacaguuaaaauauguuuauuuuuuauggaauauggugcaauaggcagaaugcaagagacaugucaccacuagcuuguggcccgcuuaaauccucuauguguaccccaucuuuguggcuuccuugucagaaacaaguggggcugagaagggaaagaaagcaccugcugggagaucuucugucucuguccacagauggauccugccugagaaugcagaauuagaggagcauaacgccugaccuggcccugcucagucccagcacgcugccccagcuuggagcaucaggcuucuugcagauacccagcaauacacauuuguggggccucacuaaucuuaaaggagaagaagccacagcuccucguaaaaacaaacccaguguuuucccccaggagccugggggaaaggagcugugaagacacaccagauguuuaacuccuggacacucauccuggccaugaacaccacugauguuggagauccuggaaaugagaugggccuuacucuguccacuaaaugaauggcuauuuucuugucauuuuuaaagugcaacucuugcuucaugcugcuucaguugccagaugaaugcugagaaauaaguaaucacagauguuuuaauaccaugucacugcuguuuuacgaguguucauuauuuaacaaaaauuaucuuuuagcuuguuugcuuacgacuuuucuuucugaugaauggugauguuuggacucugc

SEQ ID NO: 1154 - RNA, 36522 nt, Mus musculus
guuuuuuauauuacuguuuauuauuugucucagcccauuauaauguuuguuuuucucaugguaucccuggugcuuggcuagguccccaacagugggagacaggggagagugcugaggcugaguuucuuccuguuuguuggucagggucaucuucaacagcaaucgugugugugguguuuccucagugcaaucauguugaccuucagggcuaucagugugguugaggugauaacaccgggaucuuucaacgaggcucuaaugacccuugacuggagggggaccuguuucauagagaacacaaaguuuauaccaaaaauguuuauaagcccuuuagauaccguugagauugucuagcaaccggugguccucgaacucagggauggccucugccaguauguuaagcacaaugcaggguaucccaaacauguuuuuaaagggugugaaucccauaugguaaggggaguuucauacccagcaggaaggagaguuacucaaucauugccagucucguaagucaauuuaguuaagguuucuuuuaagguuuuguucacucucucuaccuguccugaacucugggaucuauauucacaauauaguuuucaaucaauccccagaauauuggcuauuggcuauauuggcuauauuaccagggacacagaagcugguccauuucugacccugucaucugagaaagcccauaccuuggcaguaugccuuuaagagcuucuuugucacuguggauguaguuucacauuugauggggaaagccucaguccaaccugaaaagauaucuauaaacaucaguaaauauuuuuaucuacauuuuuuuucuggguuuacuugugugaauucuguguuuuaguagacucuaggccuugagucucacugacaggcuuugcaggucuugacacucucagcaaucugugaguuggcaucucuaauucugauauuaacaugucuuuucaaauccuguguucuccugaccacaggugggaagagugguagaucuucugaaguauacacagucccauaucuucuggcaccaugaguuuguaaucugauguucuucaccaucuauuauuauauugggacaugggcaaauuccuaguccagauuagcucaucuuuugaauacuuaggguggucagggagcacaggaucccccagauccagagaagucagggguagguccaauuucuagggcaacaugaugggcuggauacaagcaguagcaaaggcauuuugucuuuucccagcucuaaagcauugguuagaguuaccaguucagcuuucugggcugacaucccugccaggaguggcaccgcccauaugaucucgguguuugggacuaccacuggccuagcauaccucugacggaccugaaugaagcuguuggcauuggggaaccauguuaacucuguauccaucauggggguauccuaaagaucuggucuggucccauggacaugggccaaaaugaucaaguagucaugcagaggcccaucaaagucugggucaggcagcaauguagcugggcuuagggaagcuggggccugaaagguuauccuggggcauuuaagaggagagaccaguaaugagucauucuggccuuggugaugguuaggcuuuggcucaauggcaguuugucaguaucuuugaccaggagguccauggcaguuaugauguacaaacaguugccucugucaacugggucuaauuucuuugucagguaggucacuggcuaaugccaggauuuauagucuaagucaauaccccuuucacuaucucacaucucucauucauaaagaaaugaaagggcuuagucaguucaggcaaccccaaggcugcuauaguaacuuuucuggccuaagaaggccaccucugacauucacuuaauauaucccccagaucuaggaaggucacccgugguugcagaagagggccuucuuagaggaggcuuaauagucuaaauuucucagagccucaaagagguccugggucucuucuaggcauuuuguuugguuucugcugcuaccgggaggucauuuauaaacuguggaauucagucagcuauuggauggaacacagggcccccaauggaggagcuagggaaaguacccaaggagcuaaaggggucugcaaucccuuuagguggaacaacaauaugaacuaaccaguaccgccagagcuugugucucuagcugcauauguagcagaagauggcuuagucggccaucacugggaagagaggccccuuggucuuguaaacuuuauaugucccaguacaggggaaugccagggccaagaagugggaguggguggguaggggaucgaugguggggaggaggguauaggagacuuucgggauagcauuugaaauguaaaugaagaaaauaccuaauaaaaauuggaagaagaaaaaaauaauaaauuguggaauuauagacuuuuucuuuagguuuuaucaagacagacuauugaguuauauuaagauuugaauaggcuuuuuuguuuuguuucuuuuuuuguuuguuuguuuauuccuuggcccgggagcccuuuuuuuuaaaaacaaaaacaaaacaaaaaguacuuugguacuuuuccaaaugagggcguuuugaucuuuaggggucccccuuaccucuuuuucuagaaaccauuucuuucagacaucuccuaccuacacggguaggccacugacccggugccaggaccuuugguuucuagaagccauuuguuacagagaucucccacaguucucugauucagcugaggcugccaacaugagcuuugccagaucuagagucugucccuucuacucuuuucaacugucuuuccccuauguguuucucugccuucaucugcuucuccucugcauuuuaaaaaacaaacaaaccaacccuuuucucugccacuaucacuaagucucuuagacacuuuuucuuaaccuuucaacccucuggaccuuuucuuaauaucugaugcugccucacugauaaaagccagugcuauugcugcuuuuguuuguugucucuaugacccucucuaaaaaaguugcagagcucucauuauuucccugacuaauaugucauuuaucucuggccaaauuggucuuacagccacuuugagacccaccaacagagacugacuuagucucucuuuaucuuuagcaguguugaaguccuaaucuagguuuaaggggaaagccagccucaauagcagacugguugcuagacagacucagacagacauaacuggugggaucccccugggaacaagaaccaguucccuggccucuguccagaauuucucucucucuaucucucucucucucucucucucucucucucucucucucucucucucucucucucucucuauggugaggagaaugugcaaaacugcuggcagucaucccaaguuugcugguggguuagguuuccuugaucaccaaucggcucuucugugcacaagggcaggacuacagacccaggcucaaaaggcaaccagcucucugaggcuuucuaucccugcagcugguaccuccuccuccuccugcugugggguugccuguggcagagcugaaggguugaauaagguggaguugccuguuuucuggggagaaaaaguuuuccuaauggcaacagaaaguuucuguccucuaauuuuaacauuguuuaaaggauuuauuuauuuacuuacuuauuuacuuauuuuauguauaugaguacacugcugcagucuucagacacuccagaagagggcaucagaucccauuacagaugauuugauuaugaaccaccaugugguugcugggaauuguuauuuugucuuuuuuuuuuuuuuuuuuuccccagagcugaggaccgaacccagcgccuugcgcuugcuaagcaagcgcucuaccacuuagcuaaaucuucaaccccgguugcugggaauugaacucaagacuucuggaagaacaguuagugcucuuaaccgaugagccaucucuccagccgucuaguuuuaacauuuuaaaaauuacugagaacuaauucuaguggaguugaaggugucugucccauguuaauacauccaucuaagucacccuguaaggagaagcacaaacacaaaacacaccaaaaguuuguccuuuccucuccaucaggcaggaaaaaggaacaauuagaagguggcacucacacauaagagaagacauucaucucuccuuucugaugggagagaaacuaaaguaaccacaucagcgggugcccuuggcucucugagcccacacagaccagaucaggacucauaaugccuuccggccuguguggcugagacccccuagcauaucugcuuuaacugccucuguccacacauacagauuuaagaccccuuuuucagaacagaauuacagaugaggcaccacucaaaguuuaugaacagacaaacauagagaggaauuagcauacauaaacaccuggauagacucacagacucagacagacauuacugguuuugagacacucuggguuggaugcuggaggccuuggagucacaugccucgauaaagcaaggagguuuuauggguuuggaguauggggugaugaucuugugaacgaggagcugugauuaugcccauaugaggaaaacaaaaacaaagagucccuuggugggcacuccugggugaguaaugggaaggcagagacaggaagagaugaagugguagcccaggauauucucuuuuugagguugcgguugggaaaagaagauagagagagagagagagagagagagagagagagagagagagagagagagagagagagagagagagagagagaaagguuucugagcuucugcaggggauaagcaaggguuccaagcaaacaaaaacaccugaguccuuuguagucuaggcaacugcaucgcgaucucaagacgauugggaaggaaggacagaguugacauuugcucugcuagaauuuggacuugcuuggaucugauucuucuucgggugauagaaauguuuccaccaauggcauuguaugaagaauuccaccuauguagaauuauugaauguagaauaauagaauguagcuacauuguaaaguuuguucugcuugagagauuuuccuagggaauacaagcuaugagagaaaaaaaauaaauuuauuagagcuuggguuuauccacugugugugcgcgcgugugcgugcaugggauuuuuuuuuuuuuucuguuuuagcuagccccagagagcauuuuucuggccuuagagaauuaaguuucucucccucagagaaaagucagcuaaauaauuaauugcugacucuacgcucauucucaauuuaccucaccugucgaagcuggccuuuggcaguaggaauuaucccaauauugaccaaucaagacuacgaagaaagcgguggugcacgccuuuaaucccagcacucuggaggcagaggcaggcggauuucugaguucaaggccaaccuggucuacaaagugaguuccaggacagccagggcuauacagagaaacccugucucgaaaaaccaaaaaaaaaaaaaaaaaaaaaaaaaaaaaaaaaagaagaaaagcagcagcagccacccugcuaagaguauucucuuguucgucuaauaucaaagaggaaacugccucuucuguagaagacuaucaugcuaggaaugaugguacaauggcacaggauuaaauauauacuaaaacuuaaagauccaauaugugauauucauuauagugugcacuuaguaaauuaagcuagggucucagcuaggguacuagaugaaacccuaucuuaaauuaagaaauccaagauucuauagcagacaauggccuugucagccaucacugggaagagaggccccuuggucuugcaaacuuuauaugccccaguacaggggaacgccagagccaaaaagugggagugaguggguaggggagcagggcagggggaggguauaggggacuuuuggaauagcauuugaaauguaaaugaagaaaauaucuaauaaaaaauuuaaaaaaagaaauccaagagucaauccuacauucacuaucuuuucuuuucuuuucucuucuuuucuuuucuuuuuuuuuuaugcccauguguucuagacuuuucccuacuuucucaucuacuagauucaguguaucugguuuuaugugaagguccuuaauccacuuggacuugagcaauguacagggagauaagaauggaucaauuugcauucuuuuacaugcugaacuccaguuaaaccauuacuauuuguugaaaaaugcuguccuuuuccaggcuagaugauuuucagcucuuuugucauagaucaaauggccauaggugugugcguucauuucugauucuucaauucuauuccauugaucuaccuaccugucacuguaccaacaccaugaagcuuuugcucuguaguacagcuugaggucagggauggugauucccccaaaaguucuuuuauuguugagaagaguuuugcuauccuggguucuuguuguuguuguuguuauuguuguuguuuguuuguuauuccaaaucaauuugagaauugcucuuucugacucuaugaagaauugaguuggaauuuuguggggauugcauugaaucuauagauugcuuuuggcaagaauccugccaauucaugagcauaagagaucguuccaucuucugaggucuucgauuucuuuaaucagagauuugaaguucuugucauacagaucuuuuacuugcuugguuagagucacaccaagauauuguaaauuguuugugacuauugugaaggguguccuuuccuuaauuucuuucucagccuguuuguccuuugaguauaagaaggcuacugauuuauuugaguuaauuuuuaaaaucuggucaacugcugaaguuugguuguuuguuguuguuuuuuuuguuuuuguuuuguuuuguuuuguuuuguuuuuuuuucgagacaggguuucucuguauagcucuggcuggccuugaacucagaaacccgccugccucugccucccgagugcugggacuaaaggugagcgccaccacgcccggcuaugcugaaguuguuuaucaacuguaggaguuuugugguggagcuuuuggggucacauaaguauacuaccauaucaaauagugauauuuugacuuuuuccuuucugauauauaucccuuugaccucauuuuguugucuaauuucucuagcuagaacuucgaguacuauauugaauagauagagagugggcagccuugucuaguaccugauuuuaaugggauugcuuuaaguuucucuccauuuaguuugauguugguaaaugguuuucuguauauugcuuuuacuagguuuagauaugggccuuuaggccuuucuaaggcuuuugaaauaacuccuuuuucuuuaaaagauuuauguauuuauuuauuuauuuauuuauuuauuuauuuaaugcauacgaguauaccaucauugcucucuucagauauuccagaaagagagcaucagaccccauuacagauaguugugagccaucaugugguugcuugaauugaacucaggaccucuggaagagcagucagugcucuuaaucacugagacaucucuccagcccuccaagacuuuuaacaugaagggauguugaauuuugucaaaugcuuuuucaguauccaaugaaaugaucaugugguuguuuucuuuuaguuuguuuacauaguggauuauguugauggauuuccucauauugaaccaucccugcauucauggaaugaucuugaucuuguugaaugauuauuuugauguguucuuggaaucuguuuuaaagaguuuugaguauuuuugcauaaauguucauaagagaaauuggucugaaguucucuuucuuuguuuggccaucuucugauucauaugcagcuagagacaugagcucgggguggggguauugguuaguucauauuguuguuucaccuauaggauugcagaucccuuaagcuccuuggguacuuucucuagcuccuccauugggggcccugugauccaucuaauagcugacugugagcauccacuucuguguuugccaggcccuggcauagucucacaagagacagcuacaucuggguccuuucaauaaaaucuugcuaguguaugcaauggugucagcguuuggaagcugauuaugggguggaucccuggauauggcagucucuagaugguccauccuuucaucucagcuccaaacuuugucucuguaacuccuuccauggauguuugguucccaauucuaagaaggggcaagguguccacacuuuggucuucguucuucuuuaguuucauguguuuugcaaauuguaacuuauaucuaucuauuuucuucauuuacauuuccaaugcuaucccaaauguccccauacccuccccccccccccacuccccuaccaacccacucccacuuuuuggcccuauggguauucuaaguuucugggcuaauaucugcuuaucagugaguacauaucauuugaguucuuuugugauuggguuaccacacucaggauaaugcccucgagguccaaccauuugccuaggaauuucauauccuuucagcaaaaucuugcuaguguaugcaauggugucagcguuuggaggcugauuaugggauggaucccuggauauggcagucucugguggucaauccuuuccucucagcuccaaacuuugucucuguaacuccuuccauggguguuuuguucccaauucuaagaaggggcaaaguguccacacuuuggucuucauucuucuugaguuucauguguuuaacaaauuguaucuuauaucuuggguauucuaaauuucugggcuaauauccacuuaucagugaguacauauuguguuaguucuuuugugauuggguuaccucacucaggaugaugcccuccagguccauccauuugccuagcaauuucauaaauucacucuuuuuaauaacugagugguacuccauuguguaaauuuaccacauuuucuguauccauuucucucuugaggggcaucuggguucuuuccagcuucuggcuauuauaaauaaggcugcuaugaacauaguagagcauguguccuucuuacccguuggggcaucuucuggauauaugcccaggagagguauugcuggauccuccgguaguacuauguccaauuuucugaggaaccacuagacugauuuccagagugguuguacaagcuugcaaucccaccaacaauggaagaguguuccucuuucuccacauccucaccagcaucugcugucaccugaauuuuugaucuuagccauucugacuggugugagguggaaucucaggguuguuuugaauugcauuucccugaugauuaaggauguugaacauuuuuucaggugauucccagccauuugguauuccucaggugagaauucuuuguuuagcucugagccccaguuuuuuaauggaguuauuugauuuucuggaguccaccuucuugaguucuuuauauauauauuggauauuaguccccuaucugauuuagguuagguaaagauccuuucccaaucuguugguggccuuuuugucuuauugacagugucuuuugccuugcagaaccuuugcaauuuuaugaggucccauuugucgauucucgaucuuacagcacaagccauugcuguucuauucaggaauuuccccccuguacccauaucuucgaggcuuuucccuacuuucuccucuauaaguugcagugucuaugguuuuauguggaguuucuuaauccacuuagauuugcccuuaguacaaggagauuggaauggaucaauuugcauucuucuacaugauaacagccaguugugccagcaccauuuguugaagaugcugucuuuuuuccacuggaugguuuuagcucccuugucaaagaucaagugaccauagguguguggguucauuucugggucuucaauucuauuccauugauuuacuugucugucgcuauaccaguaccaugcaguuuguaucacaauugcucuguaguacagcuuuaggccaggcauggugauuccaccagagguucuuuaauccuugagaagaguuuuugcuauugguuaggacacuauuaaagacugcuucuauuucuuuaggaguuaugggaaugcuuagaugauuuaccugauccugauuuaacuuuggcaucugguauugaucuagaaaauuguccauuucauccagauuuuccaguuuugaguauaggccuuuguaguagaaucugauaauuuauugaauuuccucaguuucugauguuaugucucccuuuucauuucugauuuuauuaauuuggauauugucucugugcccuuugcuuagucuggcuaagguuuaucuauuuuguugguuuucucaaagaaccagcuccugguuuuguugauucuuuguauaguucuuuuuguuucuauuugguugauuucaucccuaaguuugauuauuuccugcccucuacuccuguuggguauuguauuagacaggguucucuagagucacagaacuuauggguagucucuauauaguaaaggaauuuauugaugacuuccagucugcagaccaacucccaacaauggucaguagcagcugugaauggaaguccaaggaucuagcaguugcucggucccacacagcaagcaggcaaaggagagagagagagagagcaccucucuucuuccaauguccuuauuuagucucaagcagaagguguagcccagauuaaagcugugugccaccacaccuuuaaucccagaugaccuugaacucagagaucucacugucuuaaucuuauggaauccuuagccacuaugacccaagaucuccauaccaagauccaggacagagacuucuaucucucagccuccagauuagggucacuggugagcguuccaauucuggauuguaguucauuccagauauagucaaguugacaaccaggaaaagccucuacagguguacuuguuucuuuuuguucuagagcauucaggugugcugucaagcuucuucuguaugcucucuccaguuucauuuuggagacacuuagaacuaugaguuuuccucuuagcacugcuuccauuguguccuauaaguuuggauauguuguacuuucauuuucauuaaauucugaaaagucuuuaaauucuuuauuucucccuugacaaaguucuugaguagagcauuguucagcucccacagucaugauaaaaucacauaugguauugguacagagacaggcagguagaccagugaaauagaauugaagaccacacaccuaugguaccuugaucuuugacaaaggagcaaaaccauccaauggaaaaaaagagagcauuuucaacuaaugaugcuggcucaacuggaggucagcauguagaaaaaugcuagucggcacauucuuaucuucuuguacaaggcucaaauccaaguggaucagggaccucuacauaaaaccaaauacacugaaucuaauagaagagaaagugggggaaugucuugaacaugugggcacagguaaaaaguucccaagcagaacaccaauggcuuaugcuuuaugaucaaauauugacaaaugggaccucauaaaauugcaaagccucuguaaggcaaaggacacugucaauaggacauaauugcaaccacagauuggaaaaagaucuuuaccaacacuacauccaguagaggguuaguauccaauauauacaaggaacucaagaaaauagacuccagagaaucaaauaacccuauuaaaaaugggguacagagcuaaacaaagaauucucagcugaggaauauuaaaugacugagaagcaccuaaagaaauguucaauauccuuagucaucagagaaauacaaaucaaaacaacccugagauuccaccucacaacaguuaaaauggcuaagaucaaaaucucaggugacagcagaugcugacaaggauauggagaaagaggaacacuccuccauugcugguggaauuacaaguguacaaccacucuggaaaucaauuuggcaguuccucagaaaauucgaaaucguacuaccugaggacccagcacuaccacucuugggcauauacucagaagaugcuccaagauauaacaaggacacauguuccacuauguucauaagcagccuuauuuauaauagccagaagcuggaaagaacccagauguccuuaaacagaggaauggauacagaaaaugugguacauuuacacaauggaguacuacucaccuauuaaaaacaaugaauucaauaaauucauucuuuuuuauuagauauuuucuucauuacauuucaaaugccauccccagagcccccuauacccucccccggcccugcucccuaacccacccacucccgcucccugguccuggcauuccccuguacuggggcauacgaucuucacaagaccaagggcggcucuucucacugauggucgacuaggccauccucugcuacauaugcaacuagagaaaaagcucuggggggggggguacuaguuaguucauauuguuguuccaucuauaggguugcagaccccuuuaguuucuuggguacuuucucaagcuccuucauuaggggcccuguguuccauccaauaaauugaaagauccugacagaauguuaaaaggucacagaaacccugaaauugguaaaauagauuccauuguuaguagaaguagcuucacugauuuagaaaaauagaggugcacaaugcucuggccacuccuugaacccgugugucugccaauguuuugaccauuccuugaacccaugugugugcccacugaugaagcccauggccagguguuugugauauugguugcugggguagaguugguaaaucuccccagcaaccacagccgggccaauccuaaguugcuacaccugcaccagacucuuuccuuguaccccucccauacccauuucuugagaauagacauuguuuagaucuggaaauccccuacucaccccuucuccuuuucccccugagggccuauaaaaacugggaccccuuuccucucaaggucgacuccucuaccccugcgugggauaugagacguccccagagcucuggcuuuccccaaauaaagccuugugugguuugcaucaaguuuggucucucgugaguucuuggggguucgcuauuaucccgaggccugagagaggggcuccucucagagucuuucaagaugacugugagcauccacuucuguauuugccagauacuggcauagccucacaagagagagcuauaucagggcccugucagcaaaaucuuuuuggcauaugcaauagugucuggguuuggugguuguauaugggauggagcgaauggauggaacuagauuauaucaucgcaaucacaaaagaacagacaugguauguacucacugauaagaggauauuagcccaaaagcucagaauacccauguuacaguucacagaccacaugaagcuuaagaagaaggaagaccaaagugugggugcuucagucuuucuuagaaauggaaacaaaauacucacaggagcaaaaccagaggcaaaguguggagcagagacugaaggaaaggccacccagagauugucccaccugcggauccauucuguauauaguuaccagacccagacauuauuguggaugccaagaagugcuugcggaaaggagccugcaugguacugguacagcaacagauagguagaucgauggaauagaauugaagaccuagaaaugaacccacacuccuaugaucauuugaucuaugacaaaagagcuaaaaccauccaguggaacaaaggcagcauuuucaacaaauggugcuagcucaacuggcgguuguuaaaauguauaaaaugugaauugauccauuuuuaucuccuuguuacaaagcucaagucuaaguggaucaaggaacuccacauagaaccagagacacuaaaacuuauagaggagaaagugaagaaaagccucgaagauaugggcacaggggaaaaaaauccugaacagaacagcaaugaugugguuugugaauaguaucuuggguauuccaagccucugggcuucuggacuaauauccacuuaucagugagugcauaucguguguguucuuuugugauucgguuaccucacucagucugauauccuccagauccuuccauuugccuaugaauugcauuuauucauuguuuuuaauaacugaguaauacuugauuguaaauguaccacauuuucaguaucuauuccuauguugagggacaucuaggcucuuuccagcuucuggcuauuauaaauaaagcugcuaugaacauacuggaacauauguucuuauuacauguuagagcaucuucuggguauaugccuaggagugguauugcuggguccucaaguccaauuuucugaggaacugcaaaacugauuuucagagugguuguaccacuugcaaucccacuaacaauggaggaguguuccucuuucuccacauccuugccagcaucugcugucaccugagauuuugaucuuagccauucugacugguaugaguuggaaucucaggguugcuuugauuugcauuucucugaugacuaaggaaguugaacauuucuuuaggugcuucucagccauuuggcauuccucagaugagaauucuuuguuuagcucuguaccccauuauugauaguguuauuuguuucucuggagucuaacuucuugaguucuuuguauauauugaauauuagcucuauauuggauguaggauuggugaagaucuuuucccaaucuguugguugccuuuacgccuuauugacaguguccuuugccauacagaagcuuugcaauuuuaugagguuccauuuguugagucuugaucuuacaggacaaagucauugguguuccauucaggaaaauuuccccagugcccauauauuugacgcucuuccccacuuucuauucuauuagauucaguguaucugguuuuaugagaagguccuugauccaauuggacgugaacuuuuuacaaggagauaagaauggaucaauuagccuucuucuaccugcuaacugccagugagccagcaccauuuguugaaaauguugucuucuuuccacuggaagguuuuagcugcuuugacaaagaacaagugaugguguguggauucauuucugggucuuuaauucuauugcauugaucuaccugucugucacuguaccaauaccaugcaguuuuguuuguuuguuuguuugguuuuuuuucaauaaguuuuguuucuuuauuaucauaggaauugcucuuuauauaugaacacagcccauagaacaaagcaaagaauaacguaacgucuccccauccuaaguuuacaaaacaguaugguauuauaaauaauauacucauggaagaacauggauuuuuuuuccauuuuuuauuagguauuuagcucauuuacauuuccaaugcuauaccaaaaggcccccguagccacccacccaauugcucuguaguacagcuugaggucaggaauggugacucccccagaaguucuuuuaucauuaagaagaguuuucacuguccuggguuuuuuguuauuccagaugaauuuggaaauugcucuuucuaaaucuauuaaaaauuaaguugaaauuuugacagggauugcauugaauagguagauagcuuucagcaagauggccauuuuugcuauauuaauccugccaauccaugagcaugggagaucuucauaucuucugagaucuuugauuucuuucuucagagacaugaaguuaucauacagauguucuacuuccuuaguuagagucacaccaagguauuuuauauuauuugugacuaucgugaaggguguuguuucccuaauuucuuucucagccuguuuauccuuuguguagagaaaggccacugauuuguuugaguuaauuuuauauccaguuacugcacugaagcuguuuaucagguuuagaaguucucugguggaauuuuuagggucacuuauauauacuaucauaucaccugcaaauagugauauuuugacuucuuccuuuccaauuuguaucccuuugaccuccuuuuguugcuaauuacucuggcuaggacuucaaguacuauauugauuaggcugggagaaagugggcagccuugucuagucccugauuuuagugggauugcuuccaguuucucuccauuuaguuugauguuggcuacugguuugcuguagauugcuuuuauuauguuuagguaugggccuugaauuccugaucuuuccaugacuuuuaucaugaauggguguuggauuuugucaaaugcuuucuuagcaucuaacuagaugaucauguggauuuugucuuugaguuuguuuacauaguggauuacguggauguauuuccauauauuaaacgaucccugcaucccugggaugaagccuacuugaucaugaugaucauuuugauguguucuuggauucaguuugagauaauuuuauugaguuuuuuugcauugauauucauaagggaaauuggucugaaguucucuuuuuuguugggucuuugugugguuuagguaucagaguaauugugguuucauagaacgaauuggguagaguaccuucuguuucuauuuugugaaauaguuugaggugaauuagaauuaggucuucuuugaaguucugauggaacucugcacuaaacccaucugguccugggcuuuuauuguuugggagacuauuaaugacugcuucuuuuucuuuagggaauaugggacuuuuuaaauuguuaaucugauccugauuuaacuuugauaccucguauuugucuagaaaauuguccauauuuuuuuuuuuuuuuuuuggagaagguaccaugaggugcugagaagaagguauauccuuucguuuuaggauaaaauguuuuguaguuaucuguuaaauccauuuguuucaaaacuuauguuaguuucaaugugucucuguuuaguuucuguuuccaggaucuuuccauugaugagagugggguguugaagucucccacuauuauuguaugagguacauugugugcguugagcuuuacuaaaguuuccuuagugaauguggaugcccuugcauuuggagcauagauauucagaauugagagcuccucuuggaugauuuucccuuugaggaggaugaagugccccuccucgucuuuuuugauaacuuuaguuuggaaggcgauuuuauucgauauuagaauagcuacuccagcuuuuuuuuugggaccauuugcuuggaaaauuguuuuccaacuuuuuacucagagguagugucugucuuugucccugagguaggauuccuguaugcagcaaaauguuggguccuguuuauguagccagucuguuagucuaugucuuuuuuggggggaauugaguucauugauauuaagagauguuaaggaaaaguaauuguugcuuccuguuauuuuguuguuagagcugggauucuguucuuguggcuauauuucuagguuuguugaaggauuacuuucuugcuuuuucuagggcauaauuuuccuccuugugucagaguuuucccuuuauuauccuuugaagggcuggauucguggaaagauauugugugaauuugguuuugucauagaauaccuugguuucuccaucuuugguaauuuagaguuuugcuggguauaguauuuugggcuggcauuuguguucucuuagggucuuauacccuauguccaggaucuucuugcuuucauagucucugaugagaagucagguguaauucuaauaggccuuuauauguuacuuggccuuauuuccuuacagcuuuuaauauucuaucuuuauuuagugcauuuguuguucugauuauuauguguaguggggaguuucuuuucugguccagucuauuuggauaccuguaggcuacuuguauguucaugggcaucucuuucuuuagguuagggguguuuuauuguuuauuuuguugaagauauguacugguccuguaaguugaaaaucuucauucucauguacucuuauuauccauagguuuugucuucucauuguguccuggauuuccuggauguuuugaguuagggucuucuugcauuuucuuugauuguuguguccauguucucuauggaaucuucugcaccugagauucucucuuccaucucuuguauucuguugcugaugcuccaucuaugguuucugauuccuuuccuaguguuucuaucuccagaguugucucccuuuggguuuucuuuauuguuucuacuuccauuuuuagauccuggaugguuuuguucaauuccaucaccuguuugguaguguuuuccuauaacucucuaagggauuuuuguguuuccugauuuaaaggcuucuaguuguuuaucuguuuuccuuuauuucccucuuaaaguccuccauccucaacaugagaagugacuuuagauccauuucuuguuuuucuggugugauguuauauccaggacuugcuauggugggagaguuuguuucugaugauuccaaguaaccuugguuucuguugauucuguucuuacucuugccuccugcaaucugauuaucucaagugcuugcugcccucaauauaucuaauuggagccuguccuuccuauaaucccaguugauucaggacuccucagagugaguccagcuuucucugugauccuuugauugugggcuccugugaaccugagauucugggugugucagaguuuuuggcagucaagcuuccucugagacccugaaauacuggugugacccagcuccuacuauccugggauccuguuguccuaagauccugggcguguuacagugccuggaaguggugucuccuuugaggaccauaaagcugucuggucagugauccuaagaucucguggaguguacuuuggggacuguggcgcuguucgucaauuccacgcccaagguaacucggugcuggugccaaguggaagggacuugugccccuggucaagccgguuuucuacuucccuucugcugucucagguccugcacgauuggauuggaacagguguuguguuccacucaccagugauccuaagaucccgaggagaguccucuggggaacuuaagggugucugaggacuccaugcccuaggugaccuggugcuggcacugaccggaagggagaagcuuuauuuuuaauagccagaaaguggaaaccaaccagauguccuucagcagaagaaugggugaaaaaaaguguaauuuauacaauggaauacuauucaauuauuaaaacaaggaaaaauaauggauugaaccauaaaaaaucagauagaccaaugaaguaaccuagacacgggacaugcauaguuauguacuuaauuauauguggauucuagccacaaauuauaggauuuucaugguacaauccacagagcaaagaagcuaaaucacaaggagggcacaaggaaggaugcugacucucauucagaagaggaaauaccagucuucagaggugaauggggggagagaacugugugggagaugggaaggugaggggacugcugggggacaaugugugggaagagaggguggagagcugcagcucuagcuauagguggaggacaucuguaggauaugccagagaccaggaaugggggaggccccagggaaucuaggagggugacuguagcugagauuugguccuagcagugggugauauggagccugaagugacuaccuccuauagcaagcaagacccccagugaagaaaugaugauuccaacucaccuacaaaaccuucuugcccuacaggagguguauagacaaagaagauggggagucugagugcauggccuaccaaugccuucacauccauagcauuaacaagaaccaaacccugguaauauuaaugauacucugucaugcuuacgcaccagagccuaaccuaacuuuccucuuagagccuccagacaucagcuauccaaaucugaaguugagacugaccccccaaacauuggaggaagcuccaaaagucuuguggaggauuuguaggagagauuggggaacccagaggggauaaaaacuucacaaguagagcaagagagucaacugaccuggacccuuggguguucucagagacugaaccaccaaucaaaaugcauucauggcugguacuacacuccccucccacacacaagcagcuugguauucagacaccauacccaagaaauggagcaggaagagucccagacuauguugccugccuguggauacuauucccaaaacuaggcugcuuaucuuuauggaaaacacaauaguugaaaaugacuucuuguuuacaguaugaaaagaagaggauauuuuauugcuguaauguuucugccaauuuuauuuuuacgucagugagauggcucaguaggaagugacuacaguauacaaugauagcaaccuaaccuugaucauugaauaaagauggccaaaauagaugcuauaaugcugucaccaagucucugcuuaucugacauugucuaaaaacccauaaucacauuacacacacacacacacagacaccccagaaacacuuuauuuaaaaaaaaaaaaaaaaccuuccguuacaucaucuaacauuucuagauaauccuguuuggugggauacuuccagugaagugccaaaugguaacuaaugggaacaugaagaagcauggaacaucaaaugauauguacauaucugccaaugaagcauugcaguaggauauauaguugagugcugauuauccuacuccauuauaucucuggcagguacaugaaaaugcaauuuugaaaacacacgaggcauuuaauguuauauucuauuaaacauuuuaauauuagaacuguuaaaaaguguugacaacauagcacacauugugauacauauucuauucuuuaauuuguacucaagagacuaacacaugagaaucaagagauaaaauguagccuugacuaaugacugacauccaaugcaggcuggauaacauagcccagaauuuaaagggaaauugugacauuagcauugucaauuucaaggugguccaauccuccuguuaaaagacaagccaaauuaaaauauuuuauaaugucuuagacauuguguuuuaucacagugagagaaaagacaugaauacauacccauaguuuuacaccuggauaaguaauuucauguaauugaagaguauugcauuuacaaguacaaacaaaauaaaggggggcaucaucgccuuuguucuucccuguaagaguuccucaccccauccccccuacccuuuuccucuuaaaagaauguuccccuacccacaagaauccccugcaccccaccccaucccacggaaccccuauccaugggguaucaagucacuacaaggucaggugcaucuacucccagaggcuagaccaggcaguccucugguaaaugugucuagggccacagaccagaccauguaugcucuuugguuggugucuuagucuuugggagcucugagagguccaggguaguggauacuguuguucuuccuaugugguuggcaucuccuucagcuuauauccuuccccuaacucuuccauauuggacccaaccucaguacaaucguuggcucuaaguauaugcauuugucaguugcugguagaggcucucagaugacaaccaugcuagacuucugucugcaagcacaacaugggaucaguaauagugucaggguuugguacaagcccauaggauggaugccaaggugggcagguaacuggauggccuuucagucauucucugcuccauuucugucugauuccuuuacacaggaacaauucugaguuaaacauuuugaagaugggugggugacuccaucucuccacugggggcccugucuauuuacugcagauugucucuucagguuccagcucccccaucuugugcauuucagcuaagguuaucaccauugaguccugaaagccucucacaucacaggacucuaggacauccuggaguuuaccccacaccccauagcagcacacuuccuuucauucuccaggcaaucuaagcuucucuccugcuccccuuuuccucugccucccaccaagaucccccuacagugauuauuucauucaaucuuucuuuguuguugcugucuuuuguuuguuuuucgagacaggguuucucuuauagcccuggcuguccuggaacucacucgguagaccaggcuggccuccaaaucagaaaucugccugccccugacuccuaagugcugggauuaaaguugugagccaccacagcccagcucguucaaucuucuaagugggauugaagcauccucacuugggccguuauguuaaacuucaaaaggucugaguuuuaucaugggugguuugaacuuucugguuaauauccacuuauuaguaaauacauaccaugcaugucuuuugggucuggcuuacagaacacccgauauuuucuaguuccauccauuggccuggaaaauucauaagauccuugcuuuuaauaguugaaguguaucucauuguguaaaugaaacacauuuucuguaaucauucuucaguugagggacaucuggguuguuuccagcuucagccuauuaugaauaaagcugcuaugaagguaguggagcacguguccuuuugguauaggugagcaucuuuuggguauauguccaagagcgcuauagcuggaagauugauuuccaauuuucugaggaacugccaggaugauauccagagugguuguaccaguuugcaaguccaucagcaauggagugguccucuuccucuacauccucaccagcaugugcugucacuugaguuuaucaucuucaccauucugauugguguaagguaaaucucaaggucauuuugauuugcaauucccugaggacuaaggauuuugaacgauuuuuuaagggcuucucaccuauucaugaucucucugucaagaaucuuguuuaguucugucuccauuuuuuaauuggguuuuggagaccucaacauaaaaccagauacaaugaaccuaauagaagagugggauauugccucgaacacauuugcacagugaaaauuuuccaaauagaaaaccaaugacugaggcucuaagaucaacaaaugacaagugggaccacauaaaacugaaaagcuucuguaagacaaggacacugucaguaagacaaaagagcaacuuacagauugggaaaagaucuucaccaacccuauauccaauagacagcuaauauguaaaauauauauagaauccagaaaaauaaucuuguguaacugaauaugugugucagcuauagauguuaccaaauuuagucauaaauugccuucaacaugaguucguuagguucucaaggacuacuuugauaugcaaaggcuuuaaaagauggauuauacauaaaacauuuuguaugaagauaccaugaagugcaaguauuacaccccugauugcaauuaugguuuccuuugcaguaugacucuuuaucuguucacacuacuacaugcaaaugacuuacaaacuguauauucauaagauuccuauccacuauauguuguuuaugaauuugugaauagcuguguugugaaaaaucguuaucacauugauuaguuuugcuggguuucucuccaauguggauuuuuuucuuauguauucaaaaaugacuguaguaugcaaaucuuggaaauaagcaaaugaaucuuguccuaagaauugccuuuuuguuaucggcaucaauuuaaucauaagaugaaccuaaggucaaauuuauaggcccuagaggagcuggagacuuacaaauaguggaccagcuucaauuaugcaucuuugguucauaaaaaccaugacuguuccuaaccauuucuuuuucuaugcaucuuuuauucaucaaaacaaugucuauuccuaaucacaaaacaacaaauugauaugauugauuagauuguagcacccucauucuguaucagcugacauagaagacuacaugaggaaagccccuaucauuaauucugaguggugggaaaauguagcuguaauuuggcacaaauguuucugguucucaaacauaaaaacucucuauauaacacucugguucaguaucaaggugaguguggggacugucacaguucagcuuucaaguguguucucuagcccuguuccaucaguagcagcuucguuacaauaaauucuagucacuugcauuacaugaguuugaguuguguuggaucucagaggacccuauuacacaaaggcuugaccacauugcuuacacucacagacuuucucuacaguaugaauauguucaugaugaagauuauagaaaugugcaaagguuuaaacauacugaauacccucauaggguuucucuuucaugauuauaaagacuugugacauuugaaaaggcuuuaccauacuacuuaguauguguucuaacaugcacucggaguuuauuagaauaugcaaaggcuuugccacaaugcuuacauucauaggguuuuucuccaguguguacucuuuuauguuguaaaagauaaguguuuugugcaaagcuuuuaccacauuggucacauucaaaggguuucucuccaguauguguucuuuuaugcauuugaaaauuacugcgauguaugaaggauuuaccacauucauugcauucauauggucucucuccaguauguguucguuuaugauacaggaauccacuuggagacgaaaaggcuuuaccacauugauugcauucauaggguuucucuccuguauguguucuuuuauguauucugagacgacgagaacaugcaaaggcuuuaccacauuguuuacauucauaagguuucucuccuguaugaacucuuuuaugguacugaagagaacugggucuugcaaagucuuuaccacauuggucacacuuauaagguuucucaccaguauguauucuuuuaugucuuaggagaugacucuuaauugcaaaggauuuaccacauugguuacauucaaaggguuucucuccaguauguguucuuuuaugacuucggaguuuagaugaacaugcaaaggcuuuaccacauuguuuacauucauaagguuucucuccuguaugaacucuuuuaugguuuugaagagaauaaguacuugcaaagucuuuaccacauuggucacacuuauaauguuucucaccaguauguauucuuuuaugucuuaggagauaacucuuacuugcaaaggauuuaccacauugguuacauucaaaggguuucucuccagcaugucuucuuuuacauuguuuaauacaacugugauauacaaagucuuuaccacauuggucacacuuauaagguuucucaccaguauguauucuuuuaugucuuaggagaugacucuuacuugcaaaggauuuaccacauugguaacauucaaaggguuucucuccaguaugugcucuuuuaugucuucggagaacaguugaacaugcaaaggcuuuaccacauuguuuacauucauaagguuucucuccuguaugaacucuuuuaugguacugaagagaacugggucuugcaaagucuuuaccacauuggucacacuuauaagguuucucaccaguauguauucuuuuaugucuuaggagaugacucuuucuugcaaaggauuuaccacauugguuacauucaaaggguuuuucuccaguaugucuucuuuuacauuguuuaauacaacugugauauacaauggauuuaccacauucauuacauucauauggucucuguccagcauguguucuuuuaugauacaggagaccaauaugacauacagaggcuuucucacauugauugcauucauaggguuucucuccaguguguacucuuuuauguuguaggagaugaguauuucgagcaaaaguuuuaccacauugguuacauugaaaggguuucucuccaguauguguucuuuuaugauacaggagaccacuuugaccugcaaaggcuuuaucacauugauugcauucauugaguuucucuucuguauguguucuuuuauguccucggagaccaguugaacaugcaaaggcuuuaccacauugauuacauuuauaagguuucucuccuguacgaacucucuuaugguacugaagauaacugggacuugcaaagucuuucccacacugguuacacgcauaggguuucucaccaguauguauucuuuuaugucuuaggagaugacucuuucuugcaaaggauuuaccacauugguuacauucauagggugucucugcauuaugaauuuuuucuuuucuuugguuaugacucugaaaugcaaaggcuuuaucacauuggauaaacucagagagcugcugugcaguaugacuucuuucaugccugcaaagacaauuggcacaugugaaagcuuucucacaccauuacacugaugaaucuuuucauuuuugugaauauguuuuaggauuuggucuaauuguaaagaacaaccugauuuuaauguacuaucacuuuguuuacacucauggaguuccccuucauuaugggugguuuuguaucuucgaggauacuuggacuaagaagagcauugauuacauagcuuauauuuacagcaccuuucaacuauaagaggugguucauauaucugaauagaacaggaagaacuuuaccacacugaacauauaaauuuugcuauugugaaaguaauacuauauuugcaaaccaagacaaauauaagaauuuccacauuccuaauauuacagagauaguccacaguauuaguuuguagauguccacaauacaguuggaaagccaauuauuuguaaacuuguagcacauuuagaaagccuacccaaaguggggaggacuacauaucuucuaauugugcuggaagauaagagagguguguugcuucuuucaauauauuccuauugucccauggcuuauauccauuguaacauaugacaucccuaauaaaagaauaacaaguaaaaggcuuccaaugaacuaacaguuugguauuuuuccacauacaauuuuguuauagggauuaagguuucuccagcacagcacucuugacuaucauaaagcccaucuuaauaaacuuagcaauguuuuuacaaguauacgacugacgucaguuuuaguauggacuacauacuuauuagaagguuuuguacauaaacuuaccaccuauucaauguguauauuuuacaaugucuaaguguaggagguuaaacacacuggcaauucuucagcauagcccuauugggcuaugauuuaaaugguaaaucuguuaacucauuguuuguuuuuguacuuagaggaaugguuugaaaacacaaaauagauuccugucacugacauacacaguuuaucauaauucaauaaucauucauaacuuaaagcagugcuuccaaggcauauucuuaucaguuugcacaugaaaauuaccuuucauaucuucuagaaauaugaagauguucuuccguauuauggucuucccaaacguagccuaaaauauagaggccauauguuagacuauugggaauuaggaaaguuuaaguuacuaacuucagugaacuuuacaaccaagccugauuaauucaccucauucuuccgcauucucaacggaaauuacaagaacaaguaacaauaacaaagaaacaguuguacugacauuuucaaaagugaaaagaaauucacugucuuaccuauagcagcgagauuccuguaggucuccagcaucacaucucuguagagauucuucugagaaggauccagcaaagcccacucuucccgagugaaguucacaugcacaucaucauaggucacucuacccuaaaauaucccaggcaugugugcaugagaaaacauauuacugagaacacuguaaauacauauuucauugagaauaaagucauaucauucugguaauuccugcacuuaauuccugacacaaacaccuuaauguaaucaaggcauuuacgaaggaaacugaauaaugaaugaacuucaccucugucauuucuacaccccuugaagaggauaaaacccugaaagaaagugguaauuaauagacauaaacccacaaguaaacaguucaacacuaccgagcacacaguagaaaaaauguauucguaauuacuaagaaaaugaugagcaugcuggguguauuacuugugccuugaaucccaacacucagaaggcagacccagguguaucuccuugaaugguaggguaagccuggucuaugccaugaguuccacgacaucaggagguccauauuaagacacuaacuccccuguacaaaucaaacaaagaaacaaaaaagauggaaagaacucagaggucuucacugaagcuccuacaaagaauuauauauucacugcaggucuguauucaucuuccaaaagccucaagugaccgacccuguuucaacaguaaaauuaauaagugcuuauuaauaagguaugcauguuuaaacauuuacaaauagacaaaugaaaauauuagcaagaaaaagagaaaauauucacuauauaagucuuuuuguuuguuuguuugacuguuuguuauuuuguuuguugagacaggguuucucuguauaguccuggcuguccuggaacucacuuuauagaucaggcuggccucgaacucagaaauccgccugccucugccucccgagugcugggauuaaaggugugcaaccccaugcccggauucgcuauauaagucuugaucaugaauuaggaacauagggagggagaggaggcucaccacagguguuuccuaugucgcuuauaauuggagcaaauuaccaguauuuacauggaggcgcauaacuguccauuggaccaauucaggaguuguuaggccaucuucugccuacugugagcaucagguacacaagauaaauauauucaugcauacagggaaaauacucauauucacucaaaaauuuaaaacaaaucccacagguaguaauaaugccacacacucacaauccaauggaacauccauguaguaguaaucacaggacauccugagaaauauaauauacugucugucaaguuucaaaaucugagugugccuaaaguucagcacaucagcuuauggaugcauauacaaaauuuacauuccaagcuaaucagcuaauaacauaaaaacaaaacaagccaggcauuuuggcccacaucuaaucccacccagcacucuggagagagaggcagguggaucacuaaauucaagugcugccuggucugcaaaucuacuuucacgacagccagggccgcacacguauacauugcauucaaaaucaaaaauaaaaacaacaaaaccaaaaauauaaaaauaucagugaaauaccuuagcacugaauuacaguugcuucuauugugucuuauaugacuuagugauagagucuauaaugaugagacuaugacagcagaagaaagaaacugauaaguuucaaccacaacauaguagacauauuucaacguauugaguacauggugacucuggucacuauagauucauggucauucucucaugaaaauauauuugucuaaauucaauggcuauaacagccccugcccuuuucaaacuuccaaagacuccuuugacacugaaagcaaucuugugacugccacaccuuguaaaaucaggaaacaaauuauaucuuucaaauauacaauggcauaaacaacccuuuacauuccaauauggaagaauguguacauuggaccaugacaagaaacccaacagggcaaacucuaaauccuguagcucugucccagccacaugacacuucaguuuuaaagugcuuagggggcucuaucccugauauuucucauacaucuuucaguuucgguacuuccacucccuauaugcaucucuccauggcagauucucauaucauagguaucucaacaucuuguggucucaaaauacagcuaggcaucaucugcacagcuucauaacaugaacacucacaguauccucacuggggcugcaacucugacaaauauagaaggcuggaauagugcugaacugaaacuagaaaggaagaauccaugaccauaauuucacaacuuucuugauuucagaaugagcacaauaugggugagccugagaaauuuggcuccucaauugggauggagcauaccaugcauauaccuuaguuauagcagguuuaauauguaguuccauccugggagugccaacuccuuccauuaauugaaggcauagcagaagaaauuauuacucuuagggcaccuucuuaggcugcaaauccagagcaaugggcuucacauuaauggugauaaucucuuaguugcuaaagcaccacaacacaagaucagggaaagcuuucugucccaguuuccauggucccaauaaauaccacagauaauccccaaaugcccuucuuuuucugcuccaucuaugugucccagccccuacucacaaagaaacaccuucucaaccauaugcuaugcuuggcagaggaccacuuaggcuguccauagaucugccacaguuacccuagaugcaauuuucaguuuucuauagcauuggauuagaacacaaaaugcagcauccccagaugagugugguggcacacgccuuuaauccuagcacucgggcgggagaggcagguggauuuuugaguucgaggccagccugcucuacagagugaguuccaggacagccagggcuacacagagaaacccugucucgaaaaaaccaaaaauauauaaaugaauaaaugaauaaauaaauaaaagcagcauccccuaucuucugucaagugucugucaagauuacuaagagcaucuuuuccuugagucucuucccgaaccucccaaaccagcaaucauucccucuugaacacacccagaaaccacucaagcaaaccagcaaauauucccucuugaacacacccacaaaacagauaaguaacugaggccacacucagccaacauacucucugaaaagucaaagagccaacagaaauccaggcucaaaacucccaccaaaagaagacaacccagaaaucagcagguaggccuauaaagaccacaaaccuagaugccuagacaccaacuuaggaacacaaugacagccaggaaaauaugucaccaauagaacaaagcuauccuccaacugcauguccugaauauuccaaccuaacuuaaagcaccaaaaaaaaugaccuucaaaaagcaacuguaugaaggugauagagguccuuaaaagggaaauggauaaaugcaggaaaacacaaucaaacaauuggacaaguccaagcaauucuauaaguauagcaagaaaaccaaacaguugaagaaaauguaaccauucacgauguauaaauggaaauagaaauauaaagaaagcacaaaagagagguuggcccuccccuacaccauguccucacagauuuccauuauucuccuggcacucuggcuucuuuccuaucuuccccuauaacugauccugaccucauuuuccccucuucccccuauauccagaucccacuuuccccuuuuccuuuccucuccuacccugauccuucccucugacuuccaugauuaauuuguuccccuuucuacgugggauugaagcauccuuguuugggccuuccuucuuguuaaucuucauacugucuguaaguuguagcauagauauucuguaauuuugggcuaauauccacuucucagcggguacauaaccuacauauccuuuggaucuggcuuuacucccucaggaugauauuuucuaguuccauccauuagccggcaaauucaugauguccuuguuuuuaguggcugaaagucccagagaugugggaugugagaggcuuccaggauaaaaaugccaaacaguggggauagggagccugcaaagaccaacuccagauauagacaaggccgccaguguugagaugggggcacccacuuaccuucaaaagguuugacccagaaaugcagggacgaacaggaacagagacugaaggaaagguuauuuauugaccuaacgaaauugcgauuccucccaugggcaggcaccaaacccugucacuauuauugcugcuaugugaugcuuacagacaggagccuaucuaucauggcuguccucagagaaguucuagcagcagugugccugagagagaugcagauacuuacagcaaaccacuggauugaggucggggaccaugauggaagaguuagggcaaggacugaagaagucgaaagggaugauaagaauaacaguaucaacuaacauggaacccucagaguucccagagacuaaggcaccaaccaaagagcauaggugggcugcuccaugaccccagacacguauguagcagaggacugccuggucuggccucauugggacuggauguguccaauccaguagagacuugaugccccagugaagggagauaugcucugagaaugagguaaggguggguggcuacagaggcuauaugagaguggaggagcaucuucucagaggaaaagacuagacuggauguggugaaggacucugggaguaaguaaggcaacauuuggaaugcaaauaaaugaaauaaauaaggaaaaauuauauuuucuagagaaaaacaugacacguaucaacaaucuauucaagcauuaugauaugaugcaccucuuuauucucuuugcacuucuaaauacauauuuuuacaugaaauuauauccaggaguaaaacuuuaaucgguaagguguugcgggggguagagguuuaugugggggaacaccgaggaaaaggagugggaugggaugaaaacuuuaggaaggggagacugggaaagggggaaacauuugaaauguaaaugaaagaauuuuauaaguaaaagaagaagaauuauauaaaagauagcaaaaacuaagggaauucuguaaaucagauuuuugggaccgcuaagaggaacuaaacagucaagguuaacccacagaauagagauggaugagagaaucucagacaauagaaggaaugguuacacgggacaguaacaauuuuaaaucuaaaaguugcaaaaauuuauaacaggaaaguugauuccaaggcuauaugucaugugggaaaacucagauugcgcuauaguauuuugaagaaauaguauacacauuggcacaguguaaauucuauacuuauaacaaagauagcauaaucaagaauguguacaaaauuugugaaagaauguggggaagcagagaaaaagcuaaaaacauaagccuaaaaugcuauucaaguuuucaucaaaauaccuaauggaacuacuccaggaaaaauugaacuugaccaauguuaccugugauuguauguauaaagaaauuaaauaaaccgagaauucaugcucugauaacaauaacucaaaguuaccccuaaaguguuauauaucuguuucuccagcaacugcugaugugucauucaaacuccccauguuccagaguucucucuguaaauaaagaugaugagaaagaugggcuaauggcucugcaaccccucaugaccccuugggauuucagguaaaacuagccccacugaagccucacagagaacaauguugaaaaauaauuuaaugugugcugccugccacauggauuauaucacaagaugugcaaucugucuuauccaccuacccaaaaccaugcacaccugagaaguuaugcaucauagagacgccuuuuguccucuggaacugaauuuccaugaauaccauuguaaauggaggcaguggaaagguaagaggauucuaaucaaauacuacugaaggaugaccccuaucacuuucuuucuacuaauuccuaaauuauuugucccacauaacugaauguggacguuucugaaauucuagaaaccagaccuucauucuuccaaugucuuccuacuacguaucaaaagcaaugcuugcauguacacacugaaaaaugacaguaugaacaccacagacuuccacuaccagcgcucuacagcgccccccccaccccaauuggaauucaggcucgggaaggucagaggccaagggccucugagcauaucaccacaugaaccaaucaauccauagucugucaaacaguccauuucagucucagcauggcauggcuuguggucuuccucccagcuugcuacagaugcaucggaggggaauccuggaaagaaccugcaagcuaccuuccaaugcugcuccugauuauuaggccuacccagggucccuccuuaguuuacaaaacucagauagacucaggccaacugcagcccuucuacugggggaauaggagagcaaaugccuuggccagcugaaaccuuuccagaucugccuuuccacucuaugugcacacaaagcccuggucuggagaaauuguauuuaacagaauguuccagucucccagagcacuuguuuuccuuuuuccaggcacaggguccuuuguuugcauauuccuuuacacaugccauguucaguacagccaugucugcuucauaguugggaaguccugcagccaaacugcagucacauuagaacaguagcaauaguuaaaagaaaaagugccuaugaauuucuuaacaaggagugcuuaaugggaggugaauaaaaaaaaaaagaaagaaagauuaaguaaaggauacaaccgcuuguauguaugguagaacagaaaguuuauuauacauaaaagagagaacauaaucaaagccaggaauaucuaggagaacagaguacaaagugaacaugacucuaaaccauguggagagaaggagaaaagcaagauccugacaaagagaucaagaugacagauuaauaauaaugacagauuaauaauaaaacaaacagguaaucaaaaagguuggauugcauaaggaauggcagcugggugaagggcagcccuaccgcugggcuagagggugagguaugccagccauaugacauaauagguagggacugaggucugcugacagccuguucugcugugacuuguuaaauaagcuccucaaccaauuguccaagggguucagacuuauuugcagggagaaagaagaaugauaugauugaauuauacuugcaaagauuauuuuuacaaguugaaacacacuuuacgguccaauauucuucagggacuaagcauaaguacuagagcgcuccaagucuuuucucucacaugcuggauuuucagacaggaaaauuaacauucccguuaggcacaccacaucagauugucuagaucuuguguucuuugaacuaguguaaauauggaaauuugguuucuagaaauaaguucaguuccucgcccaguuuucugagugcccugcucugggaacccaccaagaucaccgguuuguacuuuuacugauugucuaaaauugauuaccugacuacucauugcuauugucaacuacugucaaagcagaaaggcccucaccuuccuucuucuccuccuuuucucugcugugauuacaccagcuucaaaauuggucagagaacucaaugcuuacacaggucccucucuuuuuguaauccccucaccccaaaccagagagguuggaggacacccauucacuggucuauaucucuucucauugaccugaguccagucaacaccaugccuuaguauuuguugugacccuauaaugccaucuugagcaccuuguuaggugccuguucuuugcuaucaagaugggccuuguuguugauaguaaaggagagcugucucuauuuuuauaguuuggagacaaaugucuggacaauccugguaaacaaacacacccauacuguucucuagcaggccggguuagcaugcuauguaccugggggggggggcguuuuacaggcaguccucucucugcuacuuucuacuuggugccacuuccuacuucccaauuaagucuuuagcaucaucaauucuacucuucuacaucacagcuuaauauugaagugcuacucaacauaugauagggcuuuuacagccuccacaauauuaacuccaaauggaucuuacaccuccauauuaaaugcuacaggcagaacuuacagaaaauagaaaacugcgguucucaggguuggcauccugcuaaguauuuuuugggcacacaagccccugccccaaaugcuuuguaaaaauacagcucccauaauaagcuucuucagaggccaccgccagguacaaggagagacuagaaccacaaaggaccucacacguggccauaucugucuggccgcugcuuacaguccagcugcugggaaaacccaccacaugugcacccuuuacuaaaccgcuugcuccucccuuugugggagaugauccugcacuuaccauguccggaaauuuuaagcuuuucagagcucccucacagcacccagcagaggcacucagaacacacaacagagaaaccuucuuucaggcucagauucagaca

SEQ ID NO: 1155 - RNA, 1032 nt, Mus musculus
uuccaaaugggauuucugaggucagaaaccucaagaauuaauuagagaggugucacagcucuguuaaaauguuuucuagcagcuauccagagaaggcugucagagaagaaaacacagcucuuuuagaauguuuuuuuguuuguuuguuuuguuauuugcuuucugauuuugauaaccaaaaauuacuuuuagaauuuuucuacuggacacccacacagugggucuauguuaaaaacauggcugcgaccagucuaguggguauuuguagaagagccccagcguuccugaaggcugcuugcucccuaguaaaucccaaggacccuucucacucaggucacaggucuucucuuaguuuguugcauaagaacacaccacaugucacaucuuuucuccaguguaaauuacuucauaccacacugccaaggagaggacuagcagaauuuuuugaugauccaaagaaugggggaggagggagaaaaagucaaaucuggagcuuuauggaccugccagcagcugagaaacaaaagcaaugaaaacuuacagaagcuuugguaugcgcuucugaaggaaagaaccaugcuucuaacucuagaacaggaggccacgugaugagauugccaaugccaaguccagagugguuagaaaagguuguugauuccauggaugccuuagauaaaguugucuaggagagggaagaugcuuuaggcuucuucagauuggucaagaaaaaccaagaccugaugcuuggaaaagcaucuuuggacgaaucgucuggcacaaauucaagcacuggccuauacuuuggugccuaaauaaaagauacaacaggaggcgguucuucgcagugccuuauguggaucgauuuaucagacuaagcauugagaaacacacccguauugaagcaagaaagggaaguuuacagaaaaagaaagaaagaauucuccaggaaaaaguucccacaucucucucaagacuagaaaucaaguaccgucgaagaugagguccagaaguccgguuccauuuuuucuuaaa

SEQ ID NO: 1156 - RNA, 2276 nt, Mus musculus
uuuuuacaaccuugcauuuaauaagccugaaaccauucucagcacauggcauuguacacuggcaucugugcaaacagauucauuuaacaggucauaguuuuaaaaacucauagauacugugaguucuguauaaaccgguggacggcaaguuaguuccuuuuuauuuauaagccucauugucaccgcagaauaaagaauguagccaaagaaagcauuaucggucacucauauaggacaguguuguuucuauaauuugaagcuuucugaauggacggguucagaccugauccaaguguaaaaagaucacucagugaauagacuauaugggaacuguacaaaaugucauuaacuuccaucauuaauagcuuacucagcacuauaccacuauugcuaguuaaaauaaccugcuucugaggccccacggagggaggcggccugcacaggcagccucaaugcccuggccaccucaugcccagggcgugccauacaguccaacagaaacuuuggcuuuaggaaggagucacagacauugaaaagaauggcuuuaaucguuauuaaaugugcagugggagggagugugcuucagauagucugggcagggcuggcggcaggcaggucacuccugcugccacagcugcagacacuaguuuguauaugacagacaaugagggaaagcagucccuuucaaacaaacuggaaaaaaaaauguucagagugguuuguaucaacagaaugcauuuaugacaauuacauguagagacucacgcacucuaaggcucucuuuauauccuaaagaaaacaggcauuuacauuauucaugacguauacuaaauuuaaaaaagaucaauuguacacuuucuccucagacaggauaaccugcuagaguguacagcuuaacaccaucaucagagcuguccgcaaagggaacagagauucaaaacaaaacaaaaugcucucuugagaaugaagugcuucgcuugcugcuauaaccagcaagugccagcaguaaucaaauggaggagggcccgacagacaggucuaccugggcaagcugaccagcacaucacaguuuaaaaaggaagguuaugaacgcuaaguuacaagucccaaccaggcagugucaagcgacaucuauuucuuugcucgcuuugugaucauaccccgugguggugugacaggucucguggcguugggcuucuuuuucucugcaggcuuuaaaaucuugaaggagugugagaguccauccacacucaucauagcaccugcauugucaaacucgccacaguaguugggugcagaaaacagagugacuaacugccucuuugcaaaaaauucauagccaucuucaaccaccugauggacucuacauauaagauccaaaucaugcuuaaggagaaauuuugcaaccacuucugcaccaaaugugaagaaggacacuccucugucauuuuucaccccagccuaagacaucuuuaucggggugagaccacaaaagaucacaaagaagaccuugaucugguacaucaguuggucucauaauucgccgaacugcuccauagauugaagaucuggugauaaaccucuaugacagcagaauaucuucucauccacuauggcugcuaucaguaagcaguuaaggcccaucggacacacaaacuuuauaugccccaguacaggggaacgccagggccaaaaaaaugagaauggguggguagggaagugggggggaggguaugggggacuuuugggauagcauuggaaaugucauugaggaaaauacguaauaaaacaacaacaacaacaaaaaaaaacaguccguggacguuuuccacagcuuaauguuguaucuucuuuuacacucaucauaaaauccguagauccuauugaugcuggcgcacucgugguucccucugagaagaaagaaguucuccggauacuugauuuuguaggccagcaagaggcagaucaucuccagggacugcuugccccagucuauauaguccccgagaaacaaauaguugcucucuggagggaagccacgguauucaaacaggcagagcaaaucauaguacugccuguggaugucaccacauaucuugaguggugcuucaaguucuaaaaggaugggcugacugaggaagaucucccgagacuucaggcggaguccucggaucucguucuucuggagcuggacauucuugccuggcuuggacccucucacuuccagcagccguugggugaugcugucgauguugaguuugucgauaucugccauc

SEQ ID NO: 1157 - RNA, 1075 nt, Mus musculus
auuuuuuuaagccuuuuugaauguuuaauuuuguuaaaguuauguugaaugcuauccuaggcaugacaucacagccacaaggcuuacagaauugaucaucuucauacccauugaguuuccucagauaauucagcuuuaugccagguuauuccauuuugacacugucccagaacauauugagguacaauucauucagaaacugugcuuugcaaaggagaugaucagcauuucaacaguaugucuuccuggaaggguagacucugcuaugccuuccuugucggcaucaaaagacuccagaggaauauggacacauuucauaucccacuuguagagcaagccuucaagugaccagucagcacuucggaccugguauguagaccaaaauugaacuuuuggauucuucugcaucaggaaguauacuguggcuaaauugcuuucaaaaucuggggagggguggggugguuuuuuaagugaguuuucuaagauacauccagccaaguuugcuauaaauuauacuuaccuucugguucaaagaacacaucagauccaagaaugaugucuugugguggcaaagacagaauguccuuugauauguggccccauguuaguccuacaacuuagaccuguggcagguuauucaucuggcaacuuugcaugcagauauccagacagugaggaaacucugagcugucagauaguauuacuuuagcaccacauuuggcagccaaaaucccaggaaggcucacuccagcuccaaccucuaagacagcuuugccugguagagaucuucugugaaaccacagguagugggccaggacuacagcacagggccaaacauacauuccauacuggacaugcaggaccugcgggacgcggaccuccagcaccgcccgaucgccuccgggaccuggcuccucccggaaccgaaagagcugggucccggccaugaggccaggcucgcacggaggggaguccagggacgccgggucaggaggcagugcccaaggagcgcggggccggacacuguccacagcaaacacaggaagccggaggccgcagcggcccggccggaacc

SEQ ID NO: 1158 - RNA, 1075 nt, Mus musculus
gguuccggccgggccgcugcggccuccggcuuccuguguuugcuguggacaguguccggccccgcgcuccuugggcacugccuccugacccggcgucccuggacuccccuccgugcgagccuggccucauggccgggacccagcucuuucgguuccgggaggagccaggucccggaggcgaucgggcggugcuggagguccgcgucccgcagguccugcauguccaguauggaauguauguuuggcccugugcuguaguccuggcccacuaccugugguuucacagaagaucucuaccaggcaaagcugucuuagagguuggagcuggagugagccuuccugggauuuuggcugccaaauguggugcuaaaguaauacuaucugacagcucagaguuuccucacugucuggauaucugcaugcaaaguugccagaugaauaaccugccacaggucuaaguuguaggacuaacauggggccacauaucaaaggacauucugucuuugccaccacaagacaucauucuuggaucugauguguucuuugaaccagaagguaaguauaauuuauagcaaacuuggcuggauguaucuuagaaaacucacuuaaaaaaccaccccaccccuccccagauuuugaaagcaauuuagccacaguauacuuccugaugcagaagaauccaaaaguucaauuuuggucuacauaccagguccgaagugcugacuggucacuugaaggcuugcucuacaagugggauaugaaauguguccauauuccucuggagucuuuugaugccgacaaggaaggcauagcagagucuacccuuccaggaagacauacuguugaaaugcugaucaucuccuuugcaaagcacaguuucugaaugaauuguaccucaauauguucugggacagugucaaaauggaauaaccuggcauaaagcugaauuaucugaggaaacucaauggguaugaagaugaucaauucuguaagccuuguggcugugaugucaugccuaggauagcauucaacauaacuuuaacaaaauuaaacauucaaaaaggcuuaaaaaaau

SEQ ID NO: 1159 - RNA, 4581 nt, Mus musculus
cagaauagcccccuucaagagacaagaaacuaugcuguccgggucugagggguuaucugcaggaaagcuauucauacuuuccaaaguccuugggaggagcauuggcacguggcuucugugccucaaacaggagcucagcaccgugagagcugagauacugaucauggcccacucugggcucaaagccuucuaaggagaugaaauuacguagacagaggucugauucuggccaugccucuacuuucagcccaugguuuggaguggguaccuauacccaguuaucugaaucugaaucuaggcuuugcugucauuagacuaggaacagcccaugcaccucaguuaccucuggggacuugugaaacauuggaguuucuuuugcauaaaggcucaggguaggaggaaagcaagcuguaaucggcuucaguguggagagguauauucgucucucagaacuaggcuaggaagguaguguggaaggaugccuggggucuuacuugcccccaggagacacaugggccucccaggcugccugacauacagauauagucagauccuggaugcucggggcagcgguggagggggucugagccaggugaauugugcuggauccuacuaaauuccaaacagggcagauagggucugcgggacauggacaaacuauguaaucugaggucccaauagguuucugggugcugcagguaguauucaguaaguaguagcuguuaugacaaccccccaugguccuuuccuguuugaucuugggauccuuauuuuuggcugcuagggucugggacacaaugucuucaguauaaaugggauagaguagugcccgcuucaguuucaaacauccacugagagguugggagucagaacauaauccacguguuguauuucuagcaguaaccagagcaucaguagucuaggugggagcaggagauggagcuaggcuggcugcuuggucuucaggccaguguggugcaguacaaagauaauucagggauuugaauuccccgccucugugcuacauaaagucugaaagcuucugcggagucccuaaggagaaccucaucuuguauaguucuugagauuguugaaaauaaaaugcagagucccauccuccaguuauccggagagacguugaaguccagcuuuucaggaagcuuugggagugagaacacugcuugcaaaagaaugggauccuguacguuggaauggaagauuccagggaagcagggguauugagcgccugaauucucagugaaagaggugguguccucagugggcuaauccuggguucugagcaugaguuaaggucagcuguggugaagucccugagguaccuaaggacugugccuguccuuaggucagcauguagacagccccuggguacuaaggaugcauuuuggccagggugggucaucuccuacuugcuggagcuacacaugcauagguugcagagugcaaguggucuuugagguacugcccuuguccucaagccagauuguggcacagggcuugaaguggcaaauguaugagguaccccaugguacugggcuuuaaguagacuagccuggaauuguuccuuuggauacugggccuuccauuggaugcauugugcacauggccaccuggguauugacucuaaccugaaaagcaugcagaugggcucacaaguaccagucaauacucugguggacaguucucagcuggcccccuggguacuggggccuaacauggaguucagugugcuaguggcucccaggauaagguaccugaauucagcaaugaggcaguucccauagguaaugggcuagccuugaggacauacguggauaacccucuugauauugggucugcccuaggagcaauguaaguucaacagcauuguuacugguccucacuguuuccagcaugagcgcagcccucagugugcuuguccuuccuuccaugaaguaaguauagaagucuucuggguacugagccuacauuagggagcauccuguuuaucuggucuuccuggauacugacccuuccaugaccauuaugauacgauaaacccccuuugguaaaggcuuguccuagggggagggggacuguauucaagcagguuccuggagaugagccuuuucugggauccucuuacaagaagcccccagagaacuggaccuauacugugagcacuguaagggaugucucugaguacugggaauguccuuaggaugucacuguaggcagcugcuuagguaauguuccuguacuugggacagcaagugugaugccacauggguauggaccugacccuguccagcaaccugagggaugucucuaugguggguuagaagcccagaccccugugugcuacacucagaucuaugguaggcacccagguuguucuccauuucacuguggaccuucuuugaugugucacuggacuuuucaggcuguauugcuuagugucagcuacuacacauuguuucccuuuuaguuuugauuucucacaagaucugaaguggagaggagugguggugguggugguucugucuuuggguuugacagagacuuucucucuucaucuagguggacuuauuuacucaggagucagggugcuggaagcucaaggucauacaaaacuuucaguggcucuagguucuugugugaauuugaagaaugaaauucaugggacagagagggugaguuuuagaaaagaguuguauuacuggcugcuuaggagagagaaggcagagcuacuggauaacaggagcagguuccaggaauagugccaucaagggguaccaucaagcaccugcuagucuggcagcuuuuuauaggaucaacagcaggaaguggggugaggcaugagcggucacacaguuggcacugguuacacaaagaggagagaagaugacaggaaaccaggacuuccuucuggcauuucuggacucuggccaaggacagaacugcagauaggaucgcagaccuucugggaacugcuguucuuuaguguccaugcccuaaaacugccuggcuaguuuuacuucacauuuucaucauuccagaccagccuucugaagaggucaccccagcugcucuuugcaguguaggugauggugaucuuacuguuuccugcuugaguggaguuguuuggugcggcaguuggagugucccaccauggaccuuucuaagggaccuugauaguacaucaccaaggcgcaucaaacugagagaagugccugcuguuaccugugccaaccugagauccuccuugaccagggguacggguugccaacuguugaaagccucugccggcaggcaguaaguguguacaugcaaaguggaagcagacaaucugaagaaucaagugaguguccuccucccucaaaagagaggaauuucaggcuaauacaauguuggcuauuuccagcuagaucccaugcuuuccauccuccaggauaaaugugaccaggcucaagugcacagaucugugucugguuucuccuuugucuuuccaucaucagggaacccccugaugguucucccuucauuagccaccuugaagaaaggaagugccucguuccaacuccccuucccaaucauguauguaucauguacaauuagagauaacuaacauuuuuggauauguuagagucuuagaucauguaaaaacaaagucuuagauccaaagagagccaugagcuagaacugaucuggauacuucuucccucagaacuagccuucaugguaccaggaggugcauguaacuuccaaaaaagggaaggaaccaacaguuguuccaaacuaugacuacaacaauaugaacuauagcaacaaucagcaugacauugauaacucuaaaggugcgguaguacaugcauacucuggcagucaucaacagcucucuaaucuggacuuaagacuucccugcucaaccagagagaaaccaagccugguacuggaaaccuagccaaggacacaaagcuagucauggaucuuggaguacaagaaccuaugucugcuacuuuauuaaacuagcauaaucccuaacauucuaaauuuuuguucuuguaugcacaguuaaguauagcccucauccuuccucaaggaaauuucucuuugcaacagacagagaccauucuagaaaacagcaaccaaucaaaaugcaaggaugugaagcucagccccaaauggguacaccuacgaaacaacuccugcaccuauggcucaggaaacauugcagaagagggaguggaaagauugaaaagcaggagaaucaugcaguuugcuguaaacugugucuccuauaaaugguggaagcaacaccuauaaaaaaucaucagcauugcugucuaaacaugaacugaacaaggauuccaaguccaggcaugcuguuguagguggguaaaaacucauaaugugccggucgugguggcgcacgccuuuaaucccagcacuugggaggcagaggcaggaggauuucugaguuugaggccagccuggucuacagagugaguuccaggacagccagagcuauaaacagaaacccugucucgaaaagccaaagaaaaacaaaaccaaaaccaaaca

SEQ ID NO: 1160 - RNA, 12455 nt, Mus musculus
ugaccgugggcccgagaacgcucuugaauaaaaauccucuugcaauuugcaacaagaccguuuucucguuggugauuuuggggugucgccucuccugagucagaacgugggggaguccucacguugugggucuuucauuuggugcguuggccgggaaacgcgaccaccccucacacccgagaaccgacuuggagguauggggauccccucuugugugugugccggccgguguaucuguuuugagugucuguuucugaaacgaacauuggaacaugugcuuguuauguuggguuguuugugucuuguccuauguuucugaagcacggcaaagucugaguuuggauccaucugaguuuauugaauuugugucuugguuucaggguugcgagaucguggguuccagucccaccucgugcuuugguuucaggguuacgaaaucguggguucgagucccaccuugugccuugguuuuacaccuggcagagugaggaacaagugugcuucucugguuuuggucgucuaaguagaaguggacgacgguguuuguagacgauggggugaugggguuuucugaaaugcgcgcgucuguauuugcagcuguccuuuugggccguaaggaccggaggacuguggucggcagacgugcuaggaggaccacaggcuguggcccugggggacgcccugggagguaaggagagccagggaugccuggccgucuccggaucggucagagggaccgaguucuguugaagcggaagcuucccccuccaacaucgucuaauucuuuugccugcuuguggaggacaagaaagggucgagugugucuggaucuguugguuucuguuuuauguguuuuuguguacguguuuagagcuaugugaaaaucuagagaaacaaagguaauucucauaggugcuuuauacccugacuagagauaguuuacaccugagaugugugaaaauggguuuugagaaaagcaguacucuccgacuaucuggagauaauuugguaauaaaaaaauaaaauaaaauaaacaguauuaauuggucuuuggaacccugcaccuguaguuaggaaucuaguguggcuagagaagcccugcuaggcacugauuauaaaugcuguucuuauagggaccagcagcuucucaaaguucuaugguaagggaacagauggcuguuuuuccuacaaaaauuggauucaucaggugacaaggugcuccucucuugaaauuacagcuagaaaaaaauuaagaauuuuguuugguuuaaaugggcaaauguauauggccauuucauuuuuguuucuaaauaguuucaaaaguauaaauauguuuuauaugucuugguuauagauuaguggcucauaaguuauugguuaugauuaaaaauuuguaacauugguaacaaaaaguugacuuaaaacugguaacucuggguuagaguaauuuagaacuacaacaugcagcaugagacaacccaugggaacaggucucuaaagauacgccugaauuggguaauauucuguguaauucuuauccuagaaaucugauuuauaaaagauaagauuuaggguagugucuuugagauauauuggcggcuacaccuucuuguguuugugugcaggaacggacagccaaacuuuguagcaaguaauguuuuuggaguucauuuuuaaagaaacuagauuguuuacacuguuaaaauuggguuuugcuucucaaaauugugguugugcucucauguuacaagagaaauugaaggcuucuccugaauuggagccaccagcuaaaucggcuccucuaaaaucuauaaagccuccugaguggccuaguccacaaccuuccccuuauccacagccucgaccccagccgccgagggaaccccaaaccccucggggcguugagaggcggaccgcugugaguacauagagccacagcgacccacagagcagaguccgggcggacucugguggacccgcccaaacuuuaaacccuucaguacuggucauuuuccucugcugguauuuauaacuggaaaacuaaccacccccuuucucaggauccccaacgccucacaggguuggcggaguuccuuauguucucucaucagccuacuugggauuacugucaacagcgguuacagaugcuuuuaacaaccgaagagcaagagagaauucuguuagaggcuagaaaaauagccugggagccaacgggcggucuacacagcuacaaaaugagaucgacaugggauucccuuugacucgccccaguugaaacugcaacauggcuaaagguagggagagcuuaaaaaucuaucaccaggcuccggucuccaaggugccucaaaacgggcccacuaauuuggcuaagguaagagguaaugcaggggccgaucgaaccuuccucuguguuccuugaaaggcuuauggaagccuucaggcgguucacucccuuugaucuuaccuuggaagcccaaaaggccucaguggccauggccuuucauagggcagucagcucccgagaucagaaagaaacuucagagauuaaaagguguauuacaagaaggagacaguuaugcgaucuaguaaaagaggcagagaaagugugugugugugagagagagaggcaggaggcaaaagaaagagaaaacaggagggauaguagacaagaaagaaauuugccacagugguaggagaaaaagaaaagacaggaucuagacaggaaaccugggcaacugaagaccgagccucagcuaaagaggcucagcugugucagacugaagugacuuauuugggauacacccuucgaggugaaaagcaguggcuaaaagaagccagaaaaagacuguaacucagauccccaccccaacuacaccaaggcaaguaagaaaauucuuagguacugcuggcuucuacagacucuagauaccuggguuggcgaccuuagcugcccaguuguacccccuaaccaaggaagggagguguuuguguggaccccagaucaccagaaagccuuuaaagagauuaaaaaggcccuacugauggccagccuaugccugaccuaaccaagccuuucacucuuuauguaaaagagagagcaggggucaccagaggaguccuuacucagacuuugugacuuugaaaaaggccagugacuuaccuauccaagaaguuacacccuguugccagcgggugguuuucuugccugaaagcuauugcugccauaaucuguuugucaaggaugcugaugagcucacucugggacagcaaauaacuguaguggcaucccacacucuugaaagcauuaccaacgcuccugugacacaucagagcuuuuuguugucuaaaugagugaucuucgcuucauuccaccugcugucccacugcgugagacugcaccuacucaucacugcgcugacauucuggcagaagaaaugaucugaaggaucagaucagccuuggccugaggacaguagccucgagguuaaagguaagcagaaggcggggacagcaguaugguggugaacagaaagcaagugaucuaggccagcagccuuccugagggacgucggcccagaaagcugaacuuaugacuuuaagacaagcucuaugaauggcaaagaaaagucuacacugacaacagguaugcuuuugccacuguacggggcaauauacaaagagggcuguugacaucugcagaaaaagaccuaagaugcuguggcuaaaaaaaaucagguggcagaucuaaccgccaaucagguggcccaaggagcaaugauccuggcagucaaggagccuaaagauuauuaugacaucagagagaccagcuuuagauacaccgcugagcacuaucaaguuauggacaguauuugacuuggccugggggccaagaaauucaaaggugugguuagguccuuugacuacuauguuacaggacucucugacuuggcagaagaaauagucaaaagcugcaaggccugugcuaugacgagguagaauuucuaaaagaaaccuucccaagguaauuggauccaauaaaggaccugucuuuguugcccagguaaaucagggacuggccaagauauuagagaucgguuagaaguuacauugugcacgcaggccccaaagcucaggacagguagagagaacgaauaaaaccauuaagagacccuuaccaaauugacagcggagacuggcacuaaugauuagauagcucuccuacccuuugugcucuucagggauagaaacaccccuggacaguuuagacugacucccccccuauaaauuacucuacagggggccccccuccacugguaaaaauagccuuuguacauggugcugacaugcugcuuucccagccuuuguucucuaggcucaaggugcuccagugagugagacagcgagcgaaaagcagcuccagaaggucuacucaagaaaagaagaccugcuacauuagacaucuccacgcaaaaaaccuugagacucugguggaaaggcccuuguacucuuaaccacccuacuuucuaccuuuaugggaccccuuuugauuuugcuucugcuuuuaauuauagguccauguguguuaaauaggcaagucacccuuauuagaacaaaaauuagugcagugcggcuuuuaguuuugagacaacaguaccaugccauaaaggaucaaguaugucaggaaaaagauaguaucuaguucuaagauuagaacuacuaacaagaagaaggggggaaugaaagaguaguaaacucagugcuccaagguaugcuaaucauaaaacagauagugacauuccuccacccacccacuuccugaguucaaggaguauucauucaaagaaagucacccuggccauuaccggaagcugcaaugcaaaugugcuauuguuaggggcucuuagaaacugucuugagaguuaacaauuaccagguauuccuugugacaccugugacuuuguacuuccuugugacucuuaucugguauuuuuugguauuuuccaacaacgcccuucccaccuccuugaguugugguuuuucuccuuuaaauacccccuuacucagcuacucggggcgccacaguccucuaccccugcgugguguaugaccgugggcccgagagcgcucuugaauaaaaauccucuugcaauuugcaaccaaaaaaaaaaaaaaaaaaaaaaaauuagguuauuuggcauucuggagucuaacuucuugaguucuuuguauguuguggauauuagcccucuauugaauguagaauugguaaagaucuuuucccaaucuguagguugcuguuuuguccuuugccuuacagaagcuuuccuguuucaugaggucccauuugucaauuguugauguuagagccugaacuguugguguuauguucaugaaauuauccccuguagcaauguguucgaggaucguuuccacuuucucuucuauuagauucaguguaucuaguuuuauguagagguccuugaucaacuuggacuugagcauuguacaaggagauaagaaugaauggauuugcuuucuucuacauucagacugucaguuagaccagcaccauguuuugaaaaugcuuucuugcugggugguggcagcacacaccuuuaaucccagcacuugggaggcagaggcgggaagauuucugaguucgaggccagccuggucuacaaagugagugccaggauagccagggcuacacagagaaacccugucucauaaaaaccaaaauaauaauaauaauaauaauaauaauaauaauaauaauaacaauaaaauuuuaaaaugcuuucuuuuccccauuggacaguuuuagcuccuuugucaaagaucaaguuauguggguuuuuuugugggucuucaauucuauuccauucauguaccuaucaauuucuguaccaauaccauguggauuuuaacaccauugaucuauaguacagcuugaggucagggaugaugauucucccagaaguucuuuuauugguagaauaguuucacuauucuggguuuuuuguuauuccagaugaaguugagaauuccuccuucuaucucugugaagaaucgaguuggaauuuugauggggauugcauugaaucuuuagauugcuuuugguaagauggcuguuuuuacuauguuaauccaccgauccaugagcaugggagaucuuucugucuucugagcucuucuuugauuucuuacuuuagagacuugaaguucuuguuauacagaucuuucacuuucuucguuagaguuacaccaacauauuuuauauuauuugugauuacugugaaggguguuguuucucuaauuucuuuuuuggcucuuuuauccuuuguguagaggaaggcuacuguuuuauuugcauugauauuauauccagucacuuugcugaaguuguuuaucaugugugggaguucucugguagaauuuuuggggucacuuaaguauacuaucagaucaucugcaaauagugauaccuugacuucuuccuucccaguuugcaucccuuugaccuccuuuggcugcauaacugcucuagcuagaccuuauugagugaauagggagagaguggcagucuugucuuaucccugguuuuagugggauugcuucaaguuucucuccauuuaauuugauguugucuguugauuuguuguauauugcuuuuauuauguuuagguauuggccuugaauuccugaucuuuccaaaacuuuuaacaugaagggguguuguauauuaucaaagguuuuuaaagcaucuaaugagaugaucgugugauuauuuuucuuugaguuuguuuauauagaugauuacauugauggauuuucauauauugaaccaucccugcaucccuggaauaaagccuacuugauuguggugaaugaugguuuugaucuguucuuggauucuguuuccuagaauuuuauugaguauuuuugcauuaauauucguaagugagauuggucugaaguucucuuucuuuguuggaucuuuugugguuuaaguaucagccuaacuguggcuucauagaacgaauuagguaguauucuucucuuucuauuuuguggaauaguucucaaaguauuggucggauagaauucugcacuaaaacuaucuggcccugggcauuuuguuuuuuuguuuguuuuuuguuuugguugggagacuuauaaugacugcuucuauuuccuuagagguuauggaacuguuuagcuaguuuaucugguccugauucaacuuugguaccuauuauugcauuagaaaaucacccauuucaucuagauucuccagucuuguugaauauaggcuuuuguagcaggaucugaugaugcuuuggauuuccucaguuucuuuuguuauguuucccuuuucauuccugauuuuauuaauuugcacacugucuccgugcccuuuaguuaauuuggcuaagaguuuaucuaucuuguugauuuucucaaagaaccagcucuuaguuuuguugauucuuuguauuguucucuuuguuucuaauugguugauuccagcccugaguuugacuauuuccugccaucuacuccucuuggguguguuugcuucuuuuucuuuuacagcuuucagauacacuguuaaguuccuaguguaagaucucuccaauuucuuuaugaagguacucagugcuaugaauuuucuucuuagcacuguuuucauuguuucccauaaguuugggaaugugugucuucaguuuuguuaaauuccagaaaaucuuuaauuucucuuucuuucuuucuuucuuucuuucuuucuuucuuucuuucuuucuuucuuucuuucuuucucucucucucucucucucucucucucucucucucucucucucccucccucccucccucccucccucccucccucccucccucucucccuuccuuccuuccuuccuuccuuccuuccuuccuuccuuccuuccuuccuuccuucccucccugaucacauuaucauugaguagaggguuauucaguuuccaugauuaugugggcuuuaguuguuuuuguuguuauugaagaccagccuuaguccuuggugaucugauagaaugcuugggauuauuucaaucuucuuguaucuauugagacuuguuuucugucugauuauauggucagcuuuggagaagguaucaugaggugcugagaaguagguauauucuuuuguuuuagugugaaauguucuauagauaccuguuaaaucaauuugguucaugacuucuguuaguuucacugugucucuauuuagauuuguuuccauaaucuguccauuggugagagugggguguugaaaucucccacuauuauuauguaauguucaauguguguuuugagcuuuaguaauguuucuuuuacacgugugggugcccuugccuauggggcauacauguuuagaauugagaauucaauuuggauuuuucguaugguggguaugaauaagauuucccaucucuuuugauaacuuuugguugaaagucuauuuuacuggauauuagaauggcuacuucagcuuguuucuugggaccauuugcuuggaaauuuuuuucagccuacucugcucuucuccaaguauuggggaagaaggcggcaggcaagggucucaugacuagggaaggaagagacaggcugugugggugcagagaaguucguacugguaauaaacagggaaggagaagguggauauagacucaaccuuggguaauuucuuucagcuucuuccuuuucuggggacagcucuggguuguuuccuugccuguuucuuuaagaugggaccccuggcuucacaugcugugaacucugccaucuaguuuacaucagagaaugccuuccuccucaugccugacccuugccccagcagcccucaaaaucucaaccuccccccuuuuuuuuuucaaagcuagguagcccaccaaucccccuuuuuucuuuuuguucucuuugagaagaugucccucuuuuauugacugaaaugucccuugccccaacacauccaccuauaucucugaaaggaaagccagaccaaagauggucaguagaggacuggcccagucaucugcuuuaggcucuccacuuagacugacuccagagccucuacuuccacaggcagagcacccacuuuuccuuccauuuugcccccgccccaucucuucacacauuucuuauugugcucuuguugugguagcuggagauaauagcugacaagugcacaacucggaaccaaucuaccugcucccuucaggacaguuucaucacauccuucagcgaacaggagccccacaagugaugaguagguacaaugugcucaaugguugcaauacacgaugucacuuguaccaaaugcucccucccuggacauguagggugcucugugauggagaauuggagcacucagacguagauccagagggagaagggucucaaaacuguuucugcagacccagcugcaucucaucauuccaugugucacauuugcugucucaucccaccaacuaguuuucuucuccuuaaauuuguucugauugguccuuacacuuccaaauagagacaccuugacaauuuuaugugaaggaaauuaucuguuuuacuuuuuuuaaaagacaaggucuuauguaacacaggcagccaagaauggcucugcacuccugauccucuugucugcauccccagagugaugugaguacaguguguacuucuaugcguggacaaggagcccagggccucaugcaugcaaggcaaauacuauauaaaucaguucuagccccuugauauucuuuuuuuaaaaaaaauugugaauggauuaaauagaaccauccguagaaaugcuggauaaacauucuuuuuaaacucaccauuuaucuugcaacauuuaagggggauuuccgggaccaaacugaaggugaaaaccaggguggugaggaacugagagcgggcucuuccuugugguccuuggcagcuuugggaaucacacuuugccuuuuuauuuuaagaaagugaacagaaaguacagagaguucccauauauacacccuaagcccccuucagaccuccugucauuaauaucuucgguaauuacauguauucccuauaaucaauuaaucuauguugggccauuuguuaggaaccaaguccacaaucuagggauucauuggauuauaaauucugagacugacaacugaaguaccacaaggcuuucacugcagaaugucccccauauacugccuguuugucucugccuccuacucauccccuggcagccggugaucucuugagggucccccuugcuuugccuuuucuggaacgucauauguggagucacacugugugugccuuuuucagauugguuuccuuuacugaguaacaggcauugaggauuucuucguaucuuuacauuuucauuucuuuuguuucuccccagggucucucuauguagcucuggcuguccuggaauucucuauggaggucagacugucuugauuuuuguuuuuccugagacaggguuucucuguguagcccugacuauaguccuggaacucacuuuguagaccaggcuggucugucuugaacucauagagauccacuugccucugcaucccaaguucugggauuaaaggcugugccacugugccuggcucuuuucauuguuuuaauaacagaauaucccacugccuguauguaauacaguuuguguauuucuuagugggugaaucagguuguuuacuuccagcccuggaguguuaugaaaagccagcucugagcagucacuuugugagagcaugauuaccaacacaguguuugguauaaauaccaaaaaaauaugaucauugcauggugugguaagaucaugugaaguuuuuaaauaaauggacaaacugccuuuaaauguucuuucuguguauuuggacacauuuuuuaugcagucaugugcuuugugcaucuugucuccaugccuguaguucguccugucaacuuugccauuugugccuuucauagaauacacaguagguuucuauacagcuuuuccaaacaaauuuggccucugcucaaauucccccauuauccccuuucuccaucuccggucuguuucuacugugccccuuuccuuauccucucuucuaccauggaccucuuuaagguuuuuggcuucuacagguauuccaauuuaaauacacaaaucuagaagauagaaagcuaugaucuaucuaugagaaagaacauuugacauuugucuuuuugggccugaacuaccucacucagauggcuuuguuuguuuuauugaaguucuauccauuugccugcagauucuauaauuucauuuuucuuuauagcuaaauaccauucuauuauguauacacaccacauuuucacuaucacaggauugugaauugagcagcugugaacauaggugagcaaggaucucuguagaucuagaauauguucacgggugcuauagcuguuccuuuguaugauuucuagucuuuuaaauuucuuaaaauguguuuuacaauccagaauauggccuaucuugaugugugucugucugucugucugucugucucuuuguguguguuucuguuguuccuuaggcaucacccauauuuuuuaaaauaauuucuuuuaagacaagaucaugcacuggccuggaguucaccaagcaggcuauauuggcuacccauuaagcccugcuucuuucuacuuccccagugcuagaauauaaccuuguuccucuguucaugacuuuuuuacaugguuacugggguucuaaacucagguccucauguuugagugguaggcacuuuaccaacugagcccuuuccccaaccuccaaaaucuuuuauaguuuaaaaaauauuuacuuucuuacuuagcuaauuguuuuugcuuguuuguuuuucaagacaaaccuuguuucucuguguagucuuggcuauuguggaacucacucuguagaccaggcuggccuugaacucagagauccaccuacuucugcccuuaagugcugagaguaaaggcauguaucaccguggccuggcugauguauuuauuuuaaaaacauucucucucucucucucucucucucucucucucucucucucucucucucucuuugugaccuuuguaaacaaaacuucaaccuggacaaaguagacucucaagaugguuacuuggagccaaaaugucugugccaauggggacacccaacaaucuacuucugaaguugaggaaccuacuacagagccggucugugaaaguucuauugagucuuuuuugaagagaaguugaaguucuccaaggaaaguggaucagauaacaacccacaguucauggcaauuuacccaggacucuuucacucugugccagguuuuucaugaccuuuucugggaagacaagaaaaaauggcagugauuacagaccaaagaaaagaauuccac

SEQ ID NO: 1161 - RNA, 2484 nt, Mus musculus
uaaucagaucuuggugguuuuauuaaagugagacaaggcaagguccaaugagcugcucacaugcuguuuacaauaguuucgcgggacuaauagcgauugccaacccuacucucacacaguauccccgcacucugugguuagcauccacccacucacucccugaguaccccaucuuuucauuagaaauccuugcuuuuaggcuuucccagccgauagacagggauguccuccaggaacaagaccaguguccugcaccccaauguauagaugccaucacgugggcaggaagaagcggaguccugguucgguggggaaaagacaacuugggagauauucagacaaaugaauuagggacauacauccagagucucgcugcaguuaggagcugacaaccuuguggcuucuaggaagacaucagaaaauauggccaaggauaaaggacgcuugauagcaccgcauucucuauugugaaugcauauccuaucacgaauucccuugaaaguaaaagaagcaacucggguguggagggaugcaggaggaaagccuacagaaggacgaggugauggaugagauugaaguaacuccuacucuagucaagacaaggcucuguuccucccacaccucaggacuuguuagaaggauccaagauaagcaggagcuccagagcccccuacuggcagaaagaaaaauaaacacccaaagagcacauggcuauugcgccugcguggcuggcaaacgccauggcacacgcgcaucaacgccguccugcccacccggugacgcaaagugcacguaggcggagacagcuucucggcgucugcugggguuugcuuccacgcguuaaggcucuguugacgcggaccggcgcuggagagcugggcgcgcgguguguggucgcugucugccuccggcuacgccacuaccucuccugcggggccgagggagccgugcaggguaagcggggccagcgaaaugugcuuggcccggaggacugacuacgguuggucuccccacgcgcgcgagggacgggguuccccguggugcaguuccaaugccugauaccucccugggcccggagacagcuccggggggaggccucggggucacuugcgcucucgguccauucaacuggcugucuuuccgacccugcugcguagcccucgcacgucuacaacacaccgugggacucgugagcuaugcuguaggccaagcagcaggggucucugcccgaguguagcccacagcccugccgcguccauucauucugcuggcuugugcugacccgcccccagcagaaccaggcccaggcgccuccccuucugcacuggauagcccaacugggaggcucaggaaaccggggaaacccuguguucugauuguguggaaggugggaacgguggugacauggaagaacuuaccaggggucagggugguuccaccugaguugguguguggccacaggugcuucagguuaaaggagagagaaagguccagauguagacacccagaauguaggacagggagucagugagaacacauuuuuauuuuaaaagcaucaggaaguaauugguuuugagacaacauugcugaguaggucacaguggacacagcccuucacccugagaguauauccccccccccccaaaaaaaaaucagucaccugaaaauaccugguccuuuugugucucugcagauccuguguggugaggggcguagggaaugcucauagccagaauaggaaacucucagacagugaggaaggagcuucccuagggagaggcagaggaaugugauuacaggaucucuccuggggugcugcagagccaugaagggggcugaauaccuagcguugaggggagguuuccccaucccuguuaccagcguuuuaacaauguccuugaaaauaaugcagcaagcauaaagguaagucugaauauugcccgccccccuucuccugcccuggaagaaguguagacuaagaugguguguaucugagucccaucuggagccucauggacagaacgaaccugagaguuacacagcucucucucuguguacuuaggucuggaagaaccuacuggcccaugcaggcauagcacccugcaaaagaaucaggaggaggcagucuucaccggacuguucaucuaucuauaucuauaucuauauacauauagauauagauauagauauagauauauguguuuuuuuuucuuucuacaacuaccaggagaaauacaugaugcuuuguuaauaugcuuuauuuuuggacacauguguagcaugugcagcagucauuucccacauagcuugguuccugucuuuuaaugcaaaccugaaaagaucuggcagcugccaguuugaaucagauggagccuauuucugagaucuagccuccccuccucgcucgcccucuaacauucucugacucccgcaucuaccugacaggagguggaccuccccaagucaccucugcuugccucugug

SEQ ID NO: 1162 - RNA, 873 nt, Mus musculus
uuuaaauauucaggccauuagcucuaagaggaagaggccgcguggacucugccaagcaguaggagguacagugugaaacaggauagguucuuccauacccuucacagcaaacucuuccuggaacuggucccaggugacuuuuuuuuaucuuuuuuggacccaaguuauauacuggcuacaagccccucccagguuucauuuuggggagacuaccaggcucacuuugcucagguucaagggucucccuacugccuuggaauuggggucccacugacucccucgacccucccaggacuguuaggucuuauauaggcuuccuccuacccauuaccugcccugcgacucucaggcuccacugugcagggaccuagcuucuuuauggacacgugaccgccaugaagcugcugugagcacuccgggcggcgggcgagauccucuuggaguugcuugaguagcaggggaaaggugucagagaagugagaugaggaaacuggcuccuuggagccuucccugcuccuuuugccuggagaacucugucccucugcacuggccaguccaaguggaauucuuaguguaggaggagggagguagggaguguuuuucagggccaaaccuugugaacccaccacaggcuugggggaugugagcaucugggguaucagugggcucacugucuuuccccugguaugcgaccccuuuggaacuaugccagaaucaaaccaaaucacuguugagcgcagagugaccuagaggugauguacccagagcugucccucgucaaacugucagcuaugucucaggagagggaggagcuucauagaaagcugggacagggacccccucaaccagaaacagcccaggccucuggguggc

SEQ ID NO: 1163 - RNA, 6261 nt, Mus musculus
uggagagugguuugguggugguuugggagacguggacuguggugauaauuuuggauuuggauacugguaacguuuuggacucagauucuggcaaagguuuggacuuggauacuggcaacgguuuuggacucggauauuggugaaccugcuuggacuuugacacggugagcccuuuucucacuuuacugcuugagguuugcagguacugguuuuaauuuuccuuuuuuuuuuuuuuuaguuucucuuugauuuuagauuuuauuuuuuuacaucguuuaaauuaucaucauuaauuaucuucaauuuguguuuuucuaccuacuaauuuucauggcuguuuacuuacuucuuaaagcuuuuguuaauaaacauuaagcauaaaguaggacaguucccuaaaacauuucugaauaugcacauaaugcacuuuaagaauauucaccuaaucuaagaaccuguaucccagucccuucuuucuucuuuacguuccuaaugaaucccuuuuacuacaggcaccuugcccuaacuaugcuucagcacuugagagccagcaucucuggacuggcuugucaaacacuacagggugauuuucagauccauguucuucuuuuuaaaugaaaauuccauucuucagcugagcaugugauucuugcccuuccauuuuuaugcgucguugucaaucguuggaaguuguugcagcccuggcaugacuggaugaauccaucuugaucaggaaguuugguucuuucaagggcuguugaauucugugugaggcauuaagcucucagacuaaagauuauugugucuguguucacaguuguugacucuguuacuaugacucuuguuacuguguccauguggccucaguaucugcauaauacauucucuaaggaugaaucuugauugcuccugcuccucuuucuaguuuaaugaauaguuucagaaguacuggugugggugcuuuaaagauuugauggaaaucaccaaugaguuugucuggucuggccuuuuuuguuuucauuguuguuaagaaauucuuuuaaauuacuauuuaaaucuuguugcauuuuuguuugagauuagauuuuugagaauuuuacaugauauuuugguuguauuuauccuuuccccuaacuccucccagauccucugcucggcauuuccuacuauccuggcuuaggucuuuuauuuugugucuggccaucaaguacaguuucucuugucuuuauccucucagguauguggccuuccacugaaaaguagucuguccaaccuuauccuuaaggguccacauccuuaaaauugauagcucuccugacagcuaucaguuuugaaggguucaucagcuagguaugugauuucuuguccaccuccccucuucaugcugagauuuugacugacuugagccugagcaggucacaaugcugugaguucauaugugcaacucccuccuuuacccagaaaacacuguaacuuuuugccaucaacugccucugacucauacagucuucaguuuagauguuuucccucuuuuuaguuuuaguugguaguuuaacguguaucuagagguucaucaauuucuucuagauuuuuccauuucauuggaacauuuuuaagagauucccuagugauuguuuggauaucuggauuccauuuguauuuguuguauacugcauuaucuucucucuaauauuguuaaugcguaucuuccuauuucuaugaguuaucuuggugaagauuacuuguuauuguuaucuuuagaauaaacaagucuuuguuaccauaugcuuggcccagggaguggcacuauuaacagguuucaccuuguuggaugaagugugccacuguccagguggguuuugagcuccuacuccuaacuucuaagaagagacagucuucucuuaacagucuucagaugaagauguagaacucucaucuccuccugcuucaugccugccaggaugcugccauauucuuacauuggugauaauggacugaacuccugaaccuguaaggcagcuccaaauauguauuguccucuauaagaguugccuuggucacggaggcuauucacaccuaagaauuccaaacuaagacaguuacuuuggucuuuguauuauuuuugucuccauuucaucaauucauauuuugaacuugauucuaauucuuuuggauuuugcuuguucuaguauuucuauaacugugacaugcaucauuagaucauuuggaccacuauuguguuuguauuagcacaggaauuuaaggcuauaaauguuucucuuagacccacaucuacuucccuuuuaucuugcaucccuagguguuguggacacugaccacaaaccaacugaccuaucagcgaagaugaagagauggcaaguaugucaggaccucaggucuaacaccuuugaagaagcugccuuaacagaacacuaugaaauauuaacaacucuuggccaaggaacauuuggggauguaaaacuggcgaaccaucucgucacccagacuaagguagcaauaaaaauccucccccaaaacaggaaaaacccccuuguccaaccugaaauugaaaucaugaaaucccuugaccauccccauauuauuaaacuuuuacacauaaucgacaccaccagaaacauuuucaucguucuggagcaugcugugggaggagagcugaugaacagaauugaagaguuuggcuaucuagcagagguggagugccacaggcuguuuaaacagcuggucuaugcccuccaguauugucaugagaaagggauuguccacagggauuuaaagccagaaaacauuuuauuggaccacagaggaaauguaaagcuuacugauuuuggauugggcaccaagauaaucaugggccagaagcuggucacguucuguggaacccucccuuacugugccccagaacuguuugaagauagaggguaugauggccgggccacugaugucuggagcuuggggguugugcuuuauuuuauggccacagggugccuuccuuucaauggauauagcuaugaagcaauaaagcagaagaucauugcaggaaaguacccuaggaguuucagucugucaccagaacuuugggaggugauagccaaguugcuaacugucaacccuggagagaggccaacaguccaugacauugccagauuuaaguggcuaaagccugacaacgaagcuucucccgcuucuuugggagagaacauugagagucacccggaccccucuauaaugguacucaugggugucaugggauacaauccaggagagauaagagaaaguuugcgggagaaaaaauucgaccaggugauggcuacuuauuuaaugcucaaacaacagucagccugggaaaacaagacaacaaaaaaaccagauccaaggcuaugugauagaauguugagaagcacagagccaaccauaaaaaaccaaacagcuguaaggagggcaucuagugugccuacacauuccacuuucaguuugcccaaugaaucagaaagucuugaaaagggaaagagaacuacaaugagccacucuaugccacccacgcggaacugcuucaacgaggagacaacuccacuccacaguaucugcccccagcuuguccagaaggcucacuacaggaggagcaucuggggggagacagagaucagugacaccucagaagaaagcucuacuggagagucuuuggaacauccaucacugaaaauccacacccuccagacauccauggguguguccaaagcuggaucuaccuauucaaagagcaaggggucuucacaguguguuucuucucaucauaccucuguggaagaagaccagugugagggcaccaacauauccagagagaucaacccaccucuuucaccagucucgccucaggagaaccucaugggacagcuccacauugugacuacagcugggucaauggacaucaugaacacacaaguuacaucaccuccauucuccaggaaggaggccaagggugaggguccugcuauacaacagagagaguccagaccauccuccccaaauacacuccagggacaccuccauggcaggcaucagacugcgccccaggcccccuuucaaagacgggucuggaggacccugaggaaugguuuaaucagaggccugcgaacuuuauguugcugccugccaaucgaaaagagagugcacccgaccaacaacagagaccuggcugugagucaaaagagccagggagguagccaugguaucagguaaguggagagacuacaaugcacuucuaccucuagguuuuuuguuuaaaauaaugucaauuucuuuaaaaaaauauuuauuuacuguaugugcauggaaguuaaccggccagagucaguuccgucuuuacacccuaucuuucuuggggaaugaauuaauguccccucccuuggcagcaaaugcuugcacucacugaaagaguuuccuggacuaaaugauaugcuuugaaauaaacagguuacaagaauauacauuuuagggguugccuguaauguauuaucacagcuaaaucuaaucccacaguaucuuugugaguaacuucaccacauguagagggcagaggacagugucuggagccuggccaggguguuggaggagggugggugaagggaucaguggaacacuggagaagaaucagccugacggcccaugccagcacagagccaguagagugaagcagaaguccugaagauuucuacuaagaucucccuuucuuaugucuguuugaagagcauuuagaggcacugugcucccugaaaaaugauaccagagagcgaagagcagccuacugaggaugcacacagguacaggagagagccagggaggaauuucccaugguugggugccgggggugggggcaccaugucuacaccacaguaugaaacuaagggcaaauucuuccugugucugcagauuaacagagugugucuggcuugugugauacccuucucagguccuuugcgaccuaaggacagcauggauugugggaggaaggucugaacucaugguuguccugacuuugcccucuagguugguucauguuggcuggugauuccacaguuuugccagccaagcaaaguacuccauagaucucaauaauucuggaaacaagguaccaugacaugcaggucaucaucggaaaaccaaaccucagaggaacuuccaggcauguagagaucaucagcugccugucuccagauguacccaugggacguuagaagagcaaguggacacuggaagcagaguucgaccccagagugucugaccugaucuacuugugcuucuguccaagaugacuggugcuuaccgguuuggagccagaaacagagcaaggagagugcagagaauguccaucuuguguucauaagcaagguagaguggacaugaacaggugagcccauugcucauggugcaguucauaaaaccauccuggcuugcuagacagcuugcuucuaacccaccauuacucagauacccucaaaacucacccuauuuggacagacagggacacacacacacaaacacacacacagagugagagagaaagagagagaggaagagagagagaagagacgagagaggagagaggaggagaggggaggagacgggaggagagaggagagaggaggagagaggaggagagaggaggagggaggaggagagaggaggaggaaggaggagagaggaggagggaggaggagagaggaggagggaggaggagagacaggaggagagaggagacaggagagaggagagaggagacaggagagaggagacaggagagaggagacaggagacaggagacaggagagaggagacaggagagaggagacaggagacaggagacaggagacaggagacaggagacuggagacaggaggagacuggagacaggagacagacaagagacaggagacagacaggagacagacagagagagagagagagagagagagagagagagagagagagagagagagagagagagagaggagagagcauuccuuuggcauucuuguugcuauugaaauuuuguugaaauggagagaaucuguauuccaaaguauugucauauuuuuugugugacucuaguugucuuuccaaauuuguuuugucuugucuacacccuuuucugaaacauuaaccaguucaucuucauaggagccaugugaagccaaaucaugucauggugcacacuaccccagggcauccgagagcuuaaaaggu

SEQ ID NO: 1164 - RNA, 1437 nt, Mus musculus
cugagaacaguuucaucugcauggugaacagugcaggagaugccugccaagcccuaacacaguagacugaagauggccacacagguuaugcuuccuugcucaugccaugggaaaggcaugauuggcuaacaauugguaaucuuaccaaaccccuguuuucaggucucauugauggaagaguguccugcugauugguagggaaguggcacgggagacagagguggcaucagcagccagguggacugggagcaagaagagaaggaaaacguuuucucaucucaggaacacccagcaccuuaccaugacccucuguugugcaagaagauuauaagaggcaacuuggggaacuuccucacuggggcaaaguuccucucucuccagcagaagucaagugaucaggguaagguguagcucaaaucccuuccaucuaccaaguacacugcuguguauaugggauaagaggugucagcuagugugcuguccucucuguuaccuaggaauggacaccacaucccaaguaaaacgucuaaagaaacagugucauuugcaugacccggaccccagacauauacaacacugacaggcauuguacaguggagagggggaucccuuuuauugggucccuucuaaagcaguggcaucaaucaauaccuacagaaaugaaccaugaagauggccuuuaaaaaagguccuggaaggacuauccagagacugcuucacccagggauccaucacauauacaaccaacaaacccagacacuauugcuuaugucagaaagauuuuauugacaggacccugauauagcuuucucuugugagguuaugccagugcuaggcaaauacagaaguggaugcuuacaguuaucuauuggauggaacacaggaccccuaaugaaggagcuagagaaaguacccaaggaguuaaaaaggucugcaacccuauaagaggaacaacaauaugaauuaaccaguaccacacagagcuguguccuuagcugcauauguagcagaggauggacuaaucagccaucaauaggagcauagguccuuggacuugcaaagaccauaugccccaguacaggggaauuccagggcaacgaagcaggaguggguggguuggggggcagggucuugaggagguuuuaggggacuuugaggauagcauuugaaauguaaauaaagaaaauaucuaauaauaaguuuaaaaaaagguccuggauacugaagggugaaugauuucugauuuuaggcauuguguggccgagugaauaucaaccauugaggauauccacagagaucuggguguaagaucugcuuaggcaguagugucaccaagaguaucauauacuggaaacuggacacaaauugugugguuuaaacaacucggaauacacagacaauuuuguauguacaguaaacuuucuguguuugaacugu

SEQ ID NO: 1165 - RNA, 7386 nt, Mus musculus
gggugggugcagcgaacuuuauugaugguauucaagagaguagggagggcucccuaggccccuccuguuauuaugggggucugggauggaaauugugagggagaugcucaguguugggggccgaauugggauagggacuccucagcaaccgagggacucucucuugcucucaguguccuugcuggggugggugguccaggguuucuuacuccuuggaggccauguaggccaugaaguccaccacccuguugcuguagccauauucauugucauaccaggaaaugagcuugacaaaauugucauugagagcaaugccagccccagcaucaaagauggaagagugggaguugcuguugaagucacaggagacaaccugguccucaguguagcccaagaugcccuucagugggcccucagaugccugcuuaaccaccuucuugaugucgucauacuuggcagguuucuccaggcagcacgucagauccacgacagacacauuggggguaggaacacggaaggccaugccagugagcuucccguucagcucugggaugaccuugcccacaaccuuggcagcaccaguggaugcagggaugauguucugggcagucccacgacccucucgccacagcuuuccaggggggucauccacagucuucuggguggcagugauggcaaggaccguggucaugagcccuuccacaaugcaaggaccguggucaugagcccuuccacaaugccaaaguugucauggaugaccuuggccaggggggcuaagcaguugguggugcaggaugcauugcugacaaucuugagugaguugucguauuucucgugguucacacccaucacaaacaugggggcaucggcagaaggggcagagaugaugacccuuuuggcucuacccuucaagugggccccagccuucuccaugguggugaagacaccaguagacuccacuacauacucaacacuggcaucaccccauuugauguugguggggucucgcuccuggaagauggugaugggcuucccguugaugacaagcuucccauucucggccuugacuguaccguugaauuugccauggguggagucauacuggaacauguagaccauguaguugaggucaaugaaggggucguugauggcaacaaucuccacuuugccauguggagagcagauggcagcccuggugaccaggcgcccaauucggccaaauccguucacaccgaccuucaccauuuugucaaugggacgaggcuggcacugcacaagaagauguggcugucucuggaacaggaaggagcagagagcagauucgccucuuaucugaguaggaaauuggucagcuaaagcagagcaguuguccagaaagcugcuccuccagauugccaaacucaacagcacucgacuggaccccauuaucuugggggacuucaccuccuggaucaccaaugccuucucauuuuuuaaggaaugggugggaauguugacugggggccagugguccuccucgguugugucuuuuguaucugacuguugugucgauucaaaugagagcacacucaauauaaggcagugguguaccaagcauugauggugauuaaagauggcgcaucucccaauguuuggcuggccucuuuaaaaaauuaagaguucgcccuaggucaucuggcaguuguagucacacagauccaugguauucagugacaggcaacuuuccuuaugcacagaccaaccuaagacauggggccuggaggcguuaggguaacccuaggacggguaaggcugugacaugaaaagaucgaccuaagacaggagcuguggccgauggacagacuugcccagaccuaguccagcaucauauuauuaaacaaaacagggggagauguaggcagccgggcgccuaaaagauggcgcuggccuccgguacacagucuccguaaacaacgccacugugcaggcacuagcccgaaucuggcgccaaccccucccgauugggugcauacaaauuaaagugccggcagacugaccaaucccaggaggacacauagcucuccccaaugaugguguguauauaagcaguccuuccuggguuucccggguucccguagcaucgaggcauuccaggaauaaagcuguugagaagaauccgaccguguugcauuuuuccuugcuggaugaggugggcacaacacccacccaucuugggauucuucacccaccuuggcaccaugcaguaacuuuauuccuuuuucuaauagguauuuaguugacaaguucauuuaugaguacuguauuuauaaccuguauuucuuuuucucauccuuccaacuccucauguguuauccccagcccauuuacuuucaaauucauaguuccaaggauggagaaauggcucagugguuaagagcaucuuuuuguucauacagacaaugcaguuuuaguucccacgacccacaggguggcucauaaucaucuguaacucuaguuccagggaaucugacauccucuuuugaucuucuugggcaccaggcauucacauaguacacaggcagacaugcaagaaaaacacuauacacauaaaauaaaauaaaacaaaucuaauuuaaaaguuaaaacaagcaaagauauacuacaaccucuuaaaacacaucagacaacuaacaaucuaacuuaauuggaaaagcaguugaacaguucacugaagaacacaaaucaaaaauaaguacagggaaagauauucagcacccuaccccuagaggcauuguagcuuuggcucuguguuccauguguaucaguagaaggcagagaagagagaggcuagucuguauucagcacucugaccuguaaacauucuguaucuaauucuugguagccugacacuccuugaaaaggaaauguccuucugucccagacuggcuuccaggguggggagugagcccaagacagacaauccccacguuggcccacuuugauggccuggaucaggagugaguacaagaugauuaucgguauagccccacggaucccagacagggagcugaccugggaugaccaccugggggagcagacuaugccagaggugaagucagaggaguagaucugguccugcagaucuaagcuacagggucuccauggcacaagguaacagaauuauguggggaaggauaucaggaggucccagugagaauaaaguuaauuuugugguagaagacagaagcuugaggggacacaugguauuuagaaaguguauaaauauaaccaacagacaguggaugacccucuagcauugguucacauugccacucucuuugcuggucucuguugaguuuugcugacccuggucuucacuggcaaugcucuggcacugguuugcuuugccuucuuuaccgaucauuacuugucaugacuuaguagagagaaaugcaccaaagaacuuauugugauauuucgguggcuucuugccacuuccuuggacuugggcagauuugcagagccucaagguuucuucugaaucaaacugccauugcugauucaugaauggcagugcauccagcugccacuaugauuuguguaaacugaacugcugcuauccugacgacaacaacuggaaucccaucaaagaacuguuucuaaucaaucacacuuguaaaguaaauggcuuacaggacaaauaauuuucuauuuucauucuacuuauuaaaaaguauuuucaauuuauauuuuuaucagugaauauuucauuacacaaaguaaaggaauucccuuugauauuuccaugugugaauguugacugugaccauauucauucccuccacuucuuucuuauuuuucuuuuccacgcccuagaagauuccuuuccucuuaaaagcaucacuuagaacuuuauaauguauuuuugaaacuuaaaaaauuuauucauuugagugcucugucugcauguauaccugcugccagaagagggcaucagaucccucuuauugauggugaugaaccgccauguguuugcugagaauugaacucaggaccucugccagaacagccagcgccaucucaccagccaaaaccagauuuuuaauuaaguaguauuuuuaaaaauuacuacauauuucuuuguggguccacacagucauauaauccuuucaggcaagcauuaaggguagggguaugcuagggcacugaggcaggaguggguggaugggugggggagcacucucauagaggcagggggaggagggagagaauaggggauuugugcaagggaaacuggaaagugguauaauauuugaaauguaaauaaauaaaauaaccaauaaaaaaugaaaaauaaaaauaaauuagaaaaaaggcacuaccccugacacuauuaauaguauucuggaauauuuguauauaggagccuagcauaacuaucgugugagagacuucacccagcaguuuauggaaauuuaugcaaugacucacaggcuaaauuagacagagcuuggaaaucuuguggaagagaauaagaauuugaaggaaccggagagaucaaggauaucucaagaaaaccuacagaaucaacuaacuuggaccuguaggggcucacagggacugaacugcuaaccacagaugacguauaggacagaccuaggccccuauacauauguaauaggcaugugaguucucuaacaucaggagcagggacugucucugacuuugcucucugccuuuguauaccuuuccccugacgggcugccuaucuagccucuauaggagaagguuuaccuaguccuagugcaacuuaauauaccaagggugguugauauccuuaggaggccucccuucucuaaagagagagggagguauggggggagagaaaaugaggugagauugggaggagaggagggaggggaggcugugaucuaguaaauaauuaaugaaaaaagaauauuuaagguauugccuuuuuauauuaaaccucucauugucauuauuucuaccacacauaaagauuauagcuuauuuaaaaacaguguuuuuguacaaggacauucaucucugaaaagaguauuacgaagggagagauacuggcacaacuaauaauaucauaacaaauacauuuaggucaaacuuucagacaggcagaacuaaagagaaauauaacauuauaugcauuauuugauaaaauggaaaauugugaguauuuuuauugccauuucccuaaaauauuuuuauugaaaauccuaaaaucaauuuggaaaauauuacauuaaauucuccuuauauuaggaaaacuuucacuuguacuaauuucugaaaaagcuucauguguuuuauauucauguaauucccuuuucugugucucccaacucaaacccaugaccucuuuuuaauuauuuuugcuacauguugcaagaauguaucuucuagggagcuuaaccauaacucuuaacaacaugguuuucuagacaagaucugauugaugacaacccaaguugcugugccagcauggucaggggaacucucacaaguccacaacaugaaauguuagaggcaaugaaugacaaccaagagagggaaaaucaguguucucuaggaaugagcccucugauggguuauccaauaccagguggucagucagcccuaaaaacauuuacauaugagaaacacuaaacagacucagccguuuguauguauauauuuauuuguuuauauauaaaaauaucaacuagagagggaaacucuucagaacggagugagcuuucccagcgccuaccaugcaggugugaggccuuacucuaagcccugugcauguuguagccucauuggagguggguuucauuuagguguuauaaagaaguacaaagcaggacaagccaggucccuuguuaaggcccauauaaugcucucuggacaggccugaaugucagucaaggauucuggcuccacagcuguuggagacaugcugugucagcagucuuuauccacgugcucguaugccaacaauagcagaugauuccaaaucaaucuauuuaugguuauuaucgguaaaaaaucgugucuggauguuccaacucuuucugggaauaaagacaauaccuggacaauuuuggaauucugcuuuccaugaacuagguacccuucguccccugaaaaagggcugacugggcauaauucauauuuuagguauuuaucugcacuucaguacuuacuuagcuauacuguacuacauugccaauaguucauuuucugucacauauaaaacauuuccucuuuccuagaaacuaaacagcugugcaacugacacaucaggaauucugaaggaccuugggauacacagcucuucuuaaugggggcaugaacuucauuacaagucaccaagguucuucaggaagccaacaugacaaacuuaccuucuccacagggaaagcugagauucacugugugcucauugccaccuccagccuuucugucugaagggaugacaguuuuuccugcaauugggucuaggacaaaugggccuugcaggcuuucauucccuuuugcugccuggggcccaaaggccucugggucaagcagcuggcgugcauuaaguuugagugcaaaggcuucugggugaagcaguugccaagcuuugcuacugcucuugcacaaagguuucugggugaagcaguucuuggguggugcugcugcuugguuagggaggacuccgguugaucccgagggugugagcucugagacgcuguuauuucaguagaaaaaggcguuaaaugaaguaaaugucuaaaaucuuuaacuaucuaaaauguagauacuugacuagaaugucuaaaaucuacccaauacugcaggagacuguuacuguauguuuuuugcuuucaugaacuuccugugugcacaucuuguuuuuuuuuuuaaaguauuugacagugccacacagucucauuuacuuacuugcuuuguaaaguagcuaacagcuuugccugccuguuauauuuuuguaugucugggcucuuuguguucacacucgcuccuucuacugcauuucagauaauuuucuuugggauuuaaaucaaguaggcauucaugucuacugauaauuuuguugaaguugcuguccuuuaggccacagaugguccacuuacccucuauuaaauccacucaccaguuccuagcccucaccuuguaugcgaaggaucgugccugcuuugugacacucccuucagcuuccgcagugugucuacccucagcuuuagcuuauggcuuuggcuuucuguguguccugccaguguuuccugucugaucugaugcuuugguuggaaguuuuuugauaauaucauuucuucaacauugucucggugauuuuucagucuuguaaaguuuaguuucugcaucauu

SEQ ID NO: 1166 - RNA, 17131 nt, Mus musculus
cauugggcggagccuacgagcaggcgcccagcggcuggacgcgguagaacggcgggcggaacgcagaccugggguucgggcuguugcaguguccgccggagcgguuugggaagugcacggggcgaagauggcggaggagcggcaggacgcguugagggaguucguggcggugacuggcacugaggaggacagggcccguuucuuccuggagucggcuggcugggaccugcagguagcgccgcgaggcgggccgcuucggacgggcuggggaauacggagugcggcgucggcucugcgaucccuacgcggccgaagcgcacagucaucccugcggggcugggcccugccuggcccaggccucauggugccuggggucgcuugccacgcgucaccggccuggcuuggaaguucauggaggcgggcgggcccugcuuugcagggccucuguuuuccugcgggcucgcaguguuggcgagacuuugggcgcugccgcaguccgcguggagucgucgccugggggcguggcugccacggcgagugccugcggguggccggguggaaucgagugcccugcuuccagauggagccccaccgaggucgcgguggccuuccgauuccgcuucugcaaggaugcugugcuggugggggaaacccugcaaggcaucagcccacgccccacucuugccuaauugcagggagaaacuaccugugggauuguggcgcacguuuggggucucugcacauuucguaguuaacuguaaaaugggaauuucuuaggacuuacugucuuguucacuggcauguaguaaauagucacuaaggaauuaauuuagaaggcaaagcuccaccaggcauaaaauguugcacacuucugaucccuagagcaacacccaucucuuauugcucagaaacacaguaauuaauguuagaaagaauugauugcauaaauguccuuggccagccuacaucuuagguagaugacgaugacuaauauuucuugaguaccuacaacaagccaggcacuguucagcauuacagaaugucucauuuacaugucucacauugcagcugagacuuggaggauaaauaacuugcugaagagcuaacuacuaauuaaacagguaaagacuaacccuaucuuauggauaaggaauuggacccucaaagggacaccgaaugugcucacugugugagcuuucugauguaaccaugucuacugacuguaauauuuagcuucccaaacauuagggaucuuuauuccuuuaacucuuucagcacucuggaggcagaagaucucugaguucgagaccagccugaucuacauaguuccaggaguaaauagucccucuuucaaaaacauaacaaacagaaagaugcucuuaaaggcgcugugaagccucugugcugaguggaaauacauaagagaaaagcuucuaucccaguagaucauccgaacugaggcucuuaccugugugguaacuugacuagcagugccaggacuugaaugcagguucucuaaaugucaguuuaguacaacuccuacgauggcacaugacuucccagaagcugguuauacuacaugaagaauaccuucagacugauugucccaugacagcucauuuccuccuagacaguugguuaccuuuuagacaggaggugccuccuccaucuccgugggacuucauuguucugucuucucucuuuguguggagaaugugugauaaaucaaugccuucucauugaguuggcgacagucacaaaugaccaaaggacucauaugaagggcuuucacauguguaaagcuaaggugacugcguuaacuuuagugauuaucuccuucaguuuuauagguuugguggaacagcauccccauuucaaacaggaaccgggcuucacaaagaaaggaaauguagcaucugucccuauacucuucuuccucuuagaacauaagcuugagggccugagcaugcugccugggguugaaccugaccccacuucuuaccuccagaagcugucuucauuuugcaguccauuugugccagcuauaaagugagacaauaaugauacuaauuacgaaauucugaguagauuaaaugaauuaauauauaguguacagacgaccugacacauggauaaauaauaguugguggucuuccuuuauguuuuucauauuaauuuuauuuaguaucuuuguuucccuugguggguggauuucccccugaaguaauauauccccaucuucacuuccaggcuaacaugucuauugccuuuucaucuaaucuucuuugguuccagguguaggaaccaaaguauggguuuugucuucauguuuuuguuccauugugagauaugugucagaugaaagccuggagggucccaaaguacucugucuguguguuuuagauugcacuugcaagcuuuuaugaggauggaggggaugaagacauugugaccauuucacaagcaaccccaaguucaguguccagaggcacagcuccuagguaaggaccaacuucaguugcuacaugaauguuuccagaaaagggacuuuccuuucugacuugacagauuaugaaccaagagguuuaaagaucaacuaaaaagaacugagggauucaaaggucaacuuacaaggguuuuuuuguggcuugguuuguuuguuuguuuguuugcuugcuugcuuccuuguuuuuguuuugaaugugaguggguguucugccugccuguauguuuaugcacuguggggaccagaagaaggcauuggauuuccugaaacuggaguuaauacaugauugugggccaccaugugggugcugggacuugaacuggggcuucugggagaacauucaaugcuccuaacugccaagccaucucucuagccccuacuuaagaucuuuaagggcuguguuuaugaacuuuggggagucacuugucuuauuucuggacuaggagugccauaguagagaugagguuaauggccugucacacuaguaagaugaucauggaaauagauaccucuucugaaguugacacggggaguuaacuaacauuuguguuaugccaccuucccuagaccuuuggccacagucaaucacuuuugugauuggcucaugaggagaauguuggccuucccagauucucucuacagaagcgucugagcucccacacuucuuucauacuuuuagucuaauugcacuuacuccaggguauauguugucagaaaauuuugcuggguuugaauucaacuccaguauguagaaaaaaugucucucuacuaugaagugguaaauucucacagagggucucugagcuuuaaacuacauuuuuucccuuugagaaacacuaacaccaaaucucauugguccuucaugucuuucccugccucccacagaagggggggggggucacaggaaagugaucuuuucaauuauuugcagugagauacugaugaaauacuguaauguuauugccugcgggguggguuguaaguauaugggcugcuggcaaagguggcaaauuugugauccaaccucacuuuggguuauugacaugucagaaguaccaaggaggagaaauugaaauguagccucuaaugcuagucauuugucccuccucucuucuuccacaguccagaauaacccuuagcgcaucaaggguuuauuaguguagggccagggaggcuaacuacccagguucaggcucagagacucaugacuugcgacagaguauuuaucucaguuucucaguuuucaucacugucaaauggaaauuguaauagugucugcuacuuagcagagucagugaauuaacccaagccaggcgugguggcacacacuuuuaacccuagcacuuggaaagaaggugaguucaaggccagccugaucuauauaggacagccccagcuaugcaaagagaccuugacucaaaagcaaaaagccagaccucagagcacacuuccuuuaaucccagcacugccuaggcagaagcagguagagcucugccacccugucucaaaaacaaacaaacaaacaacccaacuuuauguaguacuuagagcauaauauguugccuacuaugacugacacuguacccugccucauuccacaacuggcagguggguguggguggguggaugugagagagagagagaaagagagagagagagagagacugagaaucuguguguuuuacaauaacaguaaagaacaaggagcuacagcuuaacaucagcauuaaacgugaaaggaauguaagacuggccaggaguugaggccucuuagccuuucuuacuguuuugcuuaagcccuagcuuugacugugggcuucugugaaggacaaaagaggacggaaaggggguguggcuuuucauugucuuuguuuaggaggaaaaugcugacuggauuuucucagaagaaacuaaacuguacuagcaucccaaaggaauuuggugguagucagggagcagcugcucuccagccuuugaccuagcuguuacaggacacuuagccugcugcugacugaccccuguucaccugucaucuaccuuucauguugucucugacgccaagugagaacagucacucuagaauggagcauuuaguguggagcccuggagcuuccaggaggagucuguagaaagggauaguggaaugucuuuagauuaaaauuacuguagguacagguuuaacuauacuuuggcagguaucuucuggcaagagagucuauuagauucccauaagaagaaucuaauaagguguuuugcauaauuuacugugggaggaagucuuaagcucaauauaaaccauuaucauugcugagcacucagugcaucuuuuuuugucauccaccuugggugaguacuguacuguucccacuguaucgaugcagacacaagagcugggcuucuucccuagaucacacaagccagcaaauggaggguagaaguccgagcucuucugcuuccugagucucaguuuucugugcagcauguugcuucucauggaugcucagaaguccuccaaagucuuuccugaaucugccuuucucaucuuaaccccuuuccuuuucuuaaauccuuuguuccaaccaaacuaguuccuuugauggcccaucucugugauaugugugguucugucuuuguugguguccucuaaauugcuguaguggcugucuugcuuucugccugucaaucucaguucacaucccacacccauguuugccuucauccuugcuccucugcugagcagcacaccacagcccuauuccucagaacuccaguugcaacucuaaaucuguuuauaaguaacaucucucucauguugucuugaacccuuuuccugauaauuuaacuuuucauauuaauaaaaugagaaguaggagaguuuuugcacuagccaucugucugcugaagccagagauaaccccucaaacuucuccuccacacccugugggguucacccaaccccacccccugaauauuaggaauaggacuuggcaggagaagugccucaugccuauagucugagcaccuggaaaacaggcaugaggaucuaaaucuaaauaaaagaucuaaggaaacuuuuuaaaaauuauccugcaguagaaauaggcugagagcucuaugcucccugccacccacacauugauucugcaggacuccuugaccuuucucuaguguguagucucuugucucugcauuuacauaaguguuuuccauaaugcuauuuuaguucccauuucccacuaucuccaccauccuuuuuucacucagucuccuguucaccgguuccuugguaaugguccaauugugccuuuuuguaggaagccuuucccucacgggagacaagaggcuuuguguucauaaggucaugugcacugauacagccccuguugugcauccuuauaguagauaguugcuuaucugugccacuagccuguaauaccagugucuaauuuuuaccuuuauaaaucuaacauuuaguuaaugccuuauauguuaaaaguuacauaauaagacuauucaguaguaaaaaaaauuuuuuaauuuuauauguaugaauauuuugccuauguguauguauuugcaucguguuugugccugguacccacagaggucagagaggguguuggauuccccagaacuggaguuacagauauuugugagcuacuauguguguucugggauccaaauguugguccucugcaagagcaucaaaugcucuuaaccacugugcauucucuccagcucucaguaguuuucuuuaaaaacagugaauaacucauucccccauuuccagaacagcuuaaauuggauuccauuuuaccucacaguagcauucgcuaauuuauucucaguccugugugaccuuaacagacaaaugccacgcccuuucuuaucuauacuuaggucagucuuuucaucuguguugucuucauaccacagcaucucacucaagugugcaacucaccaguugauacaggcguugccuuucuuuaacucuuccugauauaauuuuugcuccuuccugucuccagugauaauagagugacauccuucagagaccucauucaugaccaagaugaagaggaggaggaagaggagggacagagguaaggcuuugagagggagcacaauuuaucaaaguacacagugguguuuaagucaccuaggauaaggcgugagacacauguucacuauugccaaccgucacugcugugcauagggguauaauauccuaagagcaguuugcucucgguagguuagcaguaauucccaucucauugcuauaccccccuccccacuuugucauguacuggggcuuuuuuuauuucucucucuaauuguuacagggagguauuuauagaagaauauuauaaagagggaagcaaaacuucuaagaaugagaaaguuaccaaguuacccauaauaccacaacauagaaauagccaaguaucuucuugugguauguuuuuauccauauaaauaacuuacacaauaaguagaaaaauaggguuguaaauguguguccucccaacaccaucauacuguuuuuacuuuuaggaaucuuguaauagaauuauuguuucauuguagaaaaugagacuuacagaaugaaaguauaguguuuauccuuugauaauuaccauuaauauuuuguuauguuucuaugcaguccuuguucugauuauaacauggugaagaugauuaguuucuuguguuggauuaagcaaggucuuagauacuucccugcugacacugaaauuccuguuuuccaugacuuugcuagcccauaugucccauaguuuuggugagucugugucuauacuacuguaaaugucaauucugugaacaccguuuauguuaaucuuugaccaguuuugaauuauuuccuuacaguaauuucucuaacagaaacaccaggucaagaacauaauacuuuuaaggcuguuauucacuggcucccaguuauuaaacuaagacuuaaaguuccuucaacuaagacuuuucagcccaggcagacuguauuuacguggauugaacaagaauaaucuggcuauagccucauuucucagguguuuauucuccauggguccgcuuuggucuuucaagcauuccucagggagaugagaagauaaccauuguagaaauguagugacuucucuguagagaucugaggagucacauguucauguagugcuucacacuaccucagaacuuugcuuuuaaauauacuggagacuuguagauauugguaauuuuaagguucuguacuccucaaguagaagggcacuaauuaucacagccccagccuagcuuccaaauaccaccucuaucuucuccagccuggucacagcuuccauugugaccuuccacuauuucacagcccuuuagcuuccuugguuacuuuagaccccacucacuuuagaccugaaacauucucagccagggccuaaguguugccuccuguuaagacuggugaggaagcagcuacaugauagcaccuucuuagauccaaauuuuaaaaagugcugguuuaaucucaagcugaucuuggacuacuagaguacuacuagguaucuuggagcuuauuucugagauuggagcuuuccuggcuucuagugcaucucuugaggcucccaauguacaucauaagaauggcaggugaagugagucuugggggaauuaugguguggugucagucagccucacacguacauugcucugcuugcucuuuugcauacaucugcugauuugaaccucgacucugacuuaaggagcagguagguagggcauguaauccuucuuucauuuuaaagcaauaaaguaugcaaagcagugcacuggcuuacuauucaggucauacaauugcagagccaggacuggauccuagcugcuuguacuaacuacaccaccaacauuaauccaaaacucuuagaguuagcugcuucugacuaggaccacaguugccuccuggaaaggggcuugcagaaggaugguuccugcugagagccuccuucauuaauguguuguugugcaugccuggaauguuuuucccccaucucuuaccugauaaccucauccucaagagaucccaggaaauagcagccuugguuguugucccugucuccccaucuccaugcugccaccaccauugucccugagacccucacugacuugauggcugcucccuuugcaucauaucugcuugcacccuuauguguuuuucuagcuagucaauaaguuucuuaaagacaauauacccuuugcuucagugcacccagaaccugguacaucuucuguuuauuuuugguauguuuggcauuucacacacagguuuuaugcugggggcucagagagaaguggacagcagauuguugguccuccccggaagaaaagucccaacgagcugguggaugaucuguuuaagggugccaaagagcauggggcuguagcuguggaacgagugaccaagagcccuggagagaccaguaaaccgagagugagcauaaggguuguuguagccaaaagaauugaguuccacaguggagagggaagccugcuucucucuagcagagauuggcuccuuuguuucuucacuuggcuauuuguucuucuguguagaagacuaaugugucugugagcuagaucagagcucagaaaccuaccuauccaaauuggccagcuuaguguuuuccuuuauuucacuguaauuaaauucauuacugaauuuaaggagggaggaauuuuuuguuguuaacaauuuuuuuauuaaauauuuucuucauuuacauuucaaaugcuaucccaaaaguccccuauacacuccccccgcccugcuccccaauccacccacucccacuuccuggcccuggcauuccccuguacugggacauauaaucuuugcaagaccaagguccucuccugagggaggaauuuggggguuuuguuuauuuguuuuuugcuuuuucaaaacaggauuuuucugugcagcccugucuguuuuuagaauucucuguagaccauguuuguugccucaagcuuacagagaugccugccucugccucccaaguuguggggauaaagcugugcuccaucaugcccagcuucaucaccaguuuuuauguaaagauuucuguccuuaggaaaaucaaaacaucauuguuacuguccuauacccauauuccugcauagccauuauuauuaugaguuuauacugagaauaguagcuauucccuuuagcuggguauuccagcuuucaccucuuauccugccccuggaacaaggggcaaacacaagcaaaccuugucccuguguuugcuauucaguaguuaacaagcuugaucagaauguuacuucucugccucauccuaaaaaugucuuuguaccugaguaauuccaccaccaaguguuuaugaacuuguccuuuauagccauuugcaggagggggcuaccgccuuggagcagcaccagaggaagagucugccuauguggcaggagaaaggaggcggcauucaggccaggaugugagugucccuuccucagagaugcuuguggacuguucauugugcccauuucaaaagggacuaguuacgugugugaacgagcagccucuaaaagacgagccugcuguggucucaauggggacuuacauaaaaaugacaguuuucacuuggugguuagagggccagggcaggaauggggaagaagauggacacaagguuucuugaguguucuuuggaucacacacaagggggcagugugguggggggagugauucccugguauuuuggggauaguugaagaaccuugaaaaugccaaagaaggccugaaauauggauggauuugguugguuuuguuuuguuucguuuugcuugaguuuucuuuauacacacacacccuccaggcagugauacuauauaauuuugagucuuuaaaaaaauuuaauaugcuacaaaauaauuuggucuaccuuuauuuccauucauuucugugauguauauuuuaaaucauuuuaguuuuauucccaaauaaagucaagcaggaagacaguaaaacuuuuauagacuuguagcaguggccaccagugcauuagcuguuagccuuucaaacuuuuuucuguaaguguguauagaaaguugacaaauuguggauauguucuugaaauuucuuucuuuuuuaugugaaggggacaggggauaugcacaugaguacagaggccagaagaggguguuuagauuuucaguaaugagaguuaaagacaguugggagccaccuggcauaagugcuaggaacuaggaaccaaaguuggguccugucagggcacuacaugcucuugaccaccgagucaucucuccagcuuccagauaaucauuuuuaguaacugcaaaauagggagccacagcugggauugagucauuucuuauauagucaccucgauagcaaacucuccuuagaacaaugcccacuucuccuaaccugcgucauagcaugucccuaguuuagguuggugugauguauuugguugauacuccuugucauguguguauuugucugauuguugauguuuuuguaguaauguaagauagugaaaacucacucauuuauagguucaguugcauuuucuagguuccugucauuguaacuccgugcuuauuaccuccuguugucacagguucauguagugcuaaagcucuggaaaacuggauucagccuagacaauggugaccuuagaagcuaccaagacccauccaaugcccaguuucuggagucuauccguagaggguaagcagaaaagcccauguuagucucacuuucgugaaugagcugucaggugggaaaggaagaaaaguuauuaaaacagauuuagcacaauuugacauaaagauucacagaucacuccaaaaaccuuguccauuuuuagcuguuuuccuugaggcauagcuaaguagccaaauaagcaggccgugcugugacugagaagguggagacagacacuuccauaaccagacccuggugacagagagucucucuccucucaggccauuggggugaaaaaugcuaugguggcuuugggggauggaauuuccuucaucuccccaguuccuguccucaugaaaagcccucagggauagagaaagggagagauggagacaaagaggaagaagugcuugagaaagcaaagggauugagagguuuggucucaucuugugcacuguucucauuugcuuucuguugcugggauuaaacccagaaugaaagcaacuaaaggagaaugggguuuguaacaagcugcuuguuugcucacugacgccugcucugcuggcuaucuuaauaacuagauucaccugccuagacagugucauccucagugggcuuggccuuccuacagcacuugucaaugaaaacagucucuuagagagauggccgcaagccauucugggaaaagcaguucuucaauugagguucucucuucccugaugacuacacaggguaucaaguugacaauaacaacuuaaucagguuuccauccaucucaaaauaaacccaccauugccuuuuuccuuagggagguuccugcagagcuucggagguuagcgcauggugggcaggugaaccuggauauggaggaucaucgggaugaggacuucgugaagcccaagggagcuuucaaagccuucacuggcgagggccagaaacugggcaggugagaagcagugucaguuggaccaucagucccaucagccaguccuguguucucauugugaggaucucagugagaguaguggcagaguaguugaguuguguuucacagaagggagaguauagguucuggaguaugcagaccugagcuaagucucugcuugucuuuccuuuacagcugagugaucuuagacugcacagccuccguuuccucagcuguaaaguaggguugcuaagaguccuugcccucgggguucuauagggaggaauaaaggagccagugcauguagaacuguuuggcaugagcugugaauggagcauagcugcugcuuugacucagaaggauuuccuggaugcuguaagccuacacuaagcaugcugggguuaagaaauuuucaacuuccuguccagcaccgucucccaggagugcugcacaaggacaucauagcccuuggaaaggcuacugcuccuuaguguguagcccagucaagacugggauucuguugccuacagcuggccucuaccucagcauccuccugccacaaagugcuaggguuagacgaauguacacccaucacaccuaggcucauuaucacuuugucauccaaaauaauucaaagcuaaaaucugaauuuuauuuuucagguuuaucuuaaauauaaaacaaaccucagauuugggggguuugcuuuucaaguuauauauaaaaaaaaccuuuuuauauuaaauagugaaugggucauuuacuuuaaaggcacugagaaaauucuugaguuguguugaauaucuguaguagguuuaggcuucacauccauucauuugagccacuuaccugacaguuugauaaagacugcacauauuucaguuugaaguguaaacaguagaaaugugcucucagaaaacacuucccagaagaugucaccucaacgaugcuggucucuucuuaaucaccgcuaauuucuuagcuccaacuaaccagcaucaauagucccaauaaugcaaagguuuugcuuuaguaguucugguaucuuguuaaucgcagcugauuucagccccagcuaaccagaaccacagaauaaucaaacuccaaaauagcaauggaccugaaaagagucucuaauuuuccuccugaaauuucacaagccaggccuccauuuucugcacuguucucaacauuaucuucaaagcuccuacacaacaucugacagagcucuuaacaacgaaugaaucuucuagcccaaaguuccaaaguccuuccacaguccuccccaaaacauggucagguugucaagggauuccccacuaugcugguaccaauuugucuuagucaggguuucuauuccugcacaaacaucaugaccaagaagcaguugggaaggaaaggguuuauucagcuuuacacuuccauacugcuguucaucaccaaggaagucaggacuggaacucaagcaggucaggaagcaggagcugaugcagaggccauagaaggauguucuuuacuggcuugcuucccuuggcuugcucagccugcucucuuauagaaccaagacuaccagccccgagauggucccacccacaaggggaccucccccuugaucacuaauugagaaaaugccuuacaguuggaucucauggaggcauuuccucaacugaaccuccuuucucugugauaacuccagcugugucaaguugacacaaaacuagccaguacagugacuuuaaccuaacuuugguccccauucuacauauaagaaccauagcuuggagagucaggccuuucccuagggccaaaguacugaccagugccagacuaggcuccuucuagucucuguucuuacugccaacacuacaggaauccuagauaacuuugaacagguuuuguaccucuaguauaugccaagugcaacauguccuuugagcuacuuucucaacuuuucugggaaauguuuguuuguuugcuugucugucuuauugagauccucaaacuccugagucauaagaaaccaugccuggcuguugcugggaauugaacucaggaccucuggaaaagacaaguagcaugauaauugccacugucccaggcucgggucuuacaggccaggagucugacauaaaagcagcuucucacagguguaugguugguacucuuugggcuccacuuuuaauucucucagccccuaucucuucacagaagaggaaguccauuucuuggacugaaaguugggcaugguaguucaugcuuguaaucccaccacuauggaggcuauggcagaaagauugcaacaugcccuagggcagugugggcuacauaguaagagucugucucaauaaaaauuaaaaaauggaacuugguuugcccaaggccacccagcuaaugagugaauuuggauccugguccaucucaugcuuaaaaugugagcacaaauaacuggcagaagcuccauccuguucauugugugacuaaccacuccacuaccaggcucauagcugaccuuuaggaauccuuacuucaccaccaccauaguuggcacauauaaaauaaaugcccgugugaguucauuaguagagcaucaguucucaaccuauggguugugaccccuuuguguguaggggagggggugucaaacagcccauguacagaauucaccuaaggucauuggaaaacacagguauuuuucaauucauaccaguagcaaaauuacaguuauaacguaguaacaaaaauaaucuuaugguuucaggucacuacaacaugagguacuauaauauuaaaggguugcagcauuaaagguuaagaaccacuguacuggagggugccugccugaagaacauaacacagccagucacuugcaguuuugccaaggcugccucagucacagauuuggaaugcauccucuagccaugucagugaaguugagccauccugaucuguggguucugugccucacaacagucucaucucuccaacuacaagcugucuucuuucuagacugucacauagggcaccuagauugauacagguuugguacauagcaguugcucagugagaacccagagauuucggccuuguaccucugugaggaccuuguuucuuucuauacugcccugauguucuucuuucuccucagcacggccccccagguauuaaacaccagcucuccagcccaacaagcagaaaaugaagccaaagcuagcucguccaucuuaaucaaugaagcagaaccuaccacgaacauccaaauccggcuugcagauggcgggaggcuggugcagaaauucaaccacagccacagguaccuucucuaucuggacuaccuucugcuagcagugucuggucccagagucuaggauagaucugugggaagcaggcagcuguucuccuucauguacacuauccagcaauccaugccuucccuggaggaagcaguggguugggaugauuaauguacaaguagcuggaucugucccaucuguaggucucauuccuccucauuaggauuaagccaccagguuccuuauucaaaggaagugucucugguuuuaaacuuagggaaacuaaggcaccauagaaugaagagacuagcagaagaggugcuaggggccuauuaccaguaaagauacuuggcagcuccuuucucucaaagaggaugucuaaguuucauccauagugugcuagcuaagccaggacucagaugugggccacugaguagguaggcaaucuuugagugcugaccaaauguuccuaauguuggugcuucccucugagagaguuguaacccaucuuaccaaccaguuacugcuuuagcuucaccucacuaguuaaccccacccaagugacagccuguacagaguguggaugaggggucuaggcugcaucuuauaucuccagccucucaugggccacuacuacauaguggcagaaagaaacuucuguugauaggguauaaggaagaauucuguugccaguggcucuauccuugugauucccaggugcaagaaugugccuggaggaggguuccuaggacuaagaugaugcuggcauacaguugagaagugcccccucugauaccaaaauaagaugugucuacccugcugggauucauggucuauaaggcauaggcuauagucagauggccccagaaguauacaaccacuucuguggcaagaugggagcaauagaagacagccuucuuuugugaagagucccaaaguagaauagaaugaaagaaggcugacuguggaaggaagaaagaagagagauaaggacaaggaaggagagcaaaauaaagcaggcuuugggacuccaggaagauuguaccugccaggaauggggggcuucaggcagaggaggaaaugagguugaugugcuuccaggugacagcuuuggccacucuguagagaagggacacagggaagcaggcaugguaagaaggagccuucagaagcauuccucuucccaaaggccaggguugggggcaauagcagagagcccuauucauuaccuccaacuuacccugcuccuccaggaucagcgacauccggcucuucaucguggaugcccggccagcuauggcugccaccaguuuuguccuuaugacuaccuucccuaacaaagagcuggcugaugagaaccaaacccugaaggaagccaaccuucucaacgcugucaucgugcagcgguuaacauaaccgcccagcuguugccucaccucccuaagugucucccaugacuguggccaugcccguggggauuuccucccaccccguacacaccuagcccuuccagugccacgucucguccguagcucuggauucuuagacuucaguuggacauuuguuuucucuuuaguuguauuuccuggguuuuugugaugaucaauggacuuuaaagaaaaaaaaauaaaaaacacaaaaauuugaagaaauacuac

SEQ ID NO: 1167 - RNA, 32553 nt, Mus musculus
ugcagccaccuaccaguucuuccugcuaccuugugcccuuaucuggcaugggcccuuuuccacccagguagucaggggcuccugggaggccagggaagccucucccuccugcucccugucucagcuucucccagaacucccagggccaacugggacccuugcugaugaagguaagucuacagaaacaagggaagauggaccaagggaggcagagagaacuuuuaguccagagaaucuucucacuucuucccauggguggaagauucuggggacaggaugaauagaacacagccaggcccuuggaggacuuacagacuucuagggcagaagacauagcuuagcucuguucuuucaauguacuaauaaugccuuuuccaaaugggcuauugagaugcagacuuuccgaggcacagaucauccuuagcugaggugggaggaccacagcagauguaggauguccugccugucccagcagucaccaguaagcaccagagccacuuccuccgaauucugucauucacuaccugagggcuuuccauaauucuaauaaguagcucuuaccagagcaaaacauuaucccaguuccccaguccugaguugaaacaucucugagaucuuucacucucucuccucacugcuugccagcaagugugaguuccaacugcucucagaggcuuaucagguaccuccuuuagcccaauccuccugcucggcccugggagcagcucucaaaugagccacucaagcucccaaugggaucaccuguagccuaggauggccuugaacucaucaccaauaugagauuggccuuaaacuccuuauucucuuccccuagguccuaggauuacagacacaagccaccauaccuucaguauuggcuuuuaggggaagccccauuaagauaggcaaugguauauaaaagaaaagggaaaugugugagcugcaagcuauaaucaagggaaugcaagcuaguguggaaccaaggggccggggugagagcacugguggcuuaggaggcaagaggccucguuacaaaaagauaaaacaacagcaggaaaaagagagaguaaaagaaaaccuuaaaagcacuaauaaagcuggccaaaaguccagccuguguuuugcuaucaucaugaaccagcaagccuaaccuacuucagugauaaaauucucagcccuucuggagcugauagcuuucucuguugcaugccugcccccuuggcacaccaccaaacuccuugagcacaguguggagcagugguucucaaccuuccuaaugcugcgguccuuucauacaguaccucauguuauagugacccucgaccauaaaaucacuucauugcuacucccuaacuguaauuuugcuacuguuauaaaucacaauauaaauaucuaauuugagggaaaucugcuaugcaaccccugggggucaugacauccaggcugaggacagguguggagaguaguuaaagaugaggaagagaugagaggggcaguguugagucuccaguuacacggggguagcuacauuucccaccuuggugccuucacguaugcuauaugcuuuuacaggaacauuucuucuuuauucuuccaugagaguucugugcaauuggccauuucuuaauccaagaaacccuuccugauccuugcuuggaacauaggcuuccugugggccuuguauagcucucucagcacccccaaaugacagauuucauacuggauugcuuuuugucuauuaaaaagaaacacuacaaaguuccaucagggcaagaccuguggcauguuaaccuaggcaugagagcugagagaagucaaggucacuggagccaaggagaucagagaaugaaaggacacuuggaggugauaucagaaaggcacagggccuguggagugagagggugacagaccuagagugaacuucgccuuugagguguggcuugggccuaaggaacauggucuucccuguguuuuaacagaaucucucugguuguagggugaaaccaguguagcauacaaggcugaugccaggcaaccaagaaaaaaaaaaugacaaugguuugggucaugguaccaaccaacauggcaaaauuuauuugucuacaaaaaaguauuggacuucaagaaacauggagaaacaacaggugguuaaaaaaaucuugauggagauuggggcacaaguggcuagcauuugucaguuaucucugggcucuagauguggucaaaagcuguguuuacuugggugaagucauuucacucuuucugcucuuuauaucacucgcaaagugaggauggguaauaaaauauaccccaugaauuuguugagaggggauguaaagguuuuggcacaggauuuagcaugcaaucaacauacauauaaaugcuauccuagagaccaaauuaccaguucccaggggcaccucuauugcucacuggcugauugugacacgauuuccaaaucuauguaguggcagaguacugucaucaauaccaacuguauaauacuggaucuggaaauuuugauaaaugcauuaaaguuuagcauguagaauaaagugcuaucaggcaagaaguacugcaggcaugcuaauaaauuacgaugaaaacaucuaagacagauugccuaaauuuucccccggccuaguacacacuccacuucgcagaugagaagucuacuguaguugguagaaggcagucucuccccaggaacgaacagccuggcacucagcagucgccugcugcaggcaaaaaggcuuugagaagauaagcccuagccugcgcgcuucuuaguggaaccuucuaguucggugcagguguuuccagcccggagcacgcacaaagucaacaaguauuuccggugcgcgucucugcguuuccgcguuuccacuuuuccgcgcaggugcggacagagccgaaagcgaaggcggcaucaaaaggcgucgcugccgcucgcggucccgcuucucuuaggcggagcggcuuucugcauaguccccuccuuuucuuccuuucccacagaagccgcaaacauccauggcgggucucgagguucucuucgcgucggccgcuccauccaugagcugcccgcaggacgcacucgucugcuuccugcacugggaaguggugacaaacggcuacuaugccuugggcacgggcgaccagguacgcggguggaggggagucugcagcccgaggcccaaaggccugcccugaccgugccaaagccagggcccgagcgaggcuucugaugccgcacuuuagcgcgccuggugcuggugccgacaacgggcacagcgugcguguaaacucgggaacggacguguaaaggcguccccgacacagccgggguuguguggaucugacugagacaggcuaguagcuuccucaagguccucauccaccaguuuacccaaagcaucugccguagaauacuccgugcuacacccucaacuccaagcaucuggauucaagcacugguguggcagugaacuuugaccuacucagccauauucuaggaccccuucuucgaggggacaguguuuggauuucagacuugaaugcugcguuugauucuugcuguccguucuccugaaguacuuucugggcucaggcugcccuugccuccauucucugcugauggguaugcguuuucaggguagaagccaaaaaaaaauuuuuuuuaauuaauuaguuaaaaauugagaggccauuaacuguuaauuuaucuacuagagaguuuuauuuuccagccuguggccagcagauuaguaaugcuugcuggacucagcagguauuuguguugguccucuagcugccuccugccacccuccuucugugggugaugagaggaacaaagcacgcacuugacuggguaauaccaacucagcagcuaaagagucaugcugcccacuuucucuuugcuuuuuugccuccagugcuauagagcugggcuuguaauauuugaucucaagaacauguuuguugacuugaacaaacaggcauugauuggucuccuuauugagggcacggcuacuccccaugagagcucuguagccgugugagauaaggucaguggagggccauggagauggccauagauacgaguuagaaaaauuggcauuguguugugggagucugaagauuauaaagagagaaugaccuguuuaugugugcaguuuugguugguugguugguugguugguugcauucuagcccagaggcacuagggugagcccaguggccauuaaggaauguuucuagccucaggauuuugucuauagaagacagcuagcuuuaccuuucuuuaccuuaccagucugucuggaagaaucuccagccugcccugcucuaaccuuucauaggucgcagccacucucaggccuuugagucuucaucugaggaaguuacaugguacaaacauaugcuuucguuaucugccaaccauagccuugugggacacuugauauuuuauaucaaggugcagaggacagccacaugauguguugggccugucuagcuucuguuuucuguggaguauccguuucaccuuaccacagugaggcugugagcuuuaccugacccuagcgauuauuucuugcuccggaaugaaggugucgagguggggagcagagcagguugucuguaagucaagagcgccugcugguagggccagugcuguccauguaggacaggagagagucaaaggucuugacugaacacagguaaggucugccagcccugccuuaaacacccgagucacccuugaaguccacaccacacuaggaaguuacccagaaaggcaagaggguuucucaggcuguggcuagcuucaguuuuguuuucuccuuacucuccugucucugcugaggcuaccagucuccuugucaccuagccaaguuugauugugacuccucuggcaaaggauuuccaaacaccagggguggccuccccugcacuugcuguguaaaguccuucaugugugggccuuugucaguguuguccaucgccccacuccuucccaucccaucccauccuaccaugcucucaugaacacagcuucuggucgugcuguuuuguguugaaugugugcuuuuuaaaggguuuuuuguuuuuccauaaaugguauuggaccauaaacuuuuucuaacuccucccacucccccuguaaauucccacuuugugacuucucccucuguaccccacucauaaccaacagaguccaguuagugcuuccugacagaauauugcuuauuuuggugacuugcucuuacgaagaugguauucaugggugcucugugcauguguccagaggggagaguuucauagaauuacuccuccuccugguucuuuacugccaauacacacacacacacaugacguuuucucuagaauacuauaauuugaucuaguguguuccuucugacugcaguguaaugugccacugucagcauagugugcacuuuaccucggcuucagcuguucaggcucacacuggaaugaagguugacauugcuuaucaggcucccacauguauccacagcuuccuucuaggaggacguuugagucuuggcucauacaaaccucauagagcuaaguacugcuagguggacucccaaagggccuguguaagucugaauucccagaaguagugucgaagguucacucaugcccagucaaacuaagucuuaggcuggugguugggugugaccuucauucauauaauauauauauauauauauaucuuuucugguuuuuuuuuuuuuuuuuuugguuuuuugagacaagguuucucuguguuccccuggcuguccuggaacucacucuguagaccaggcuggccuugaacucagaaauccaccugccucugccucccaagugcugggauuaaaggugugugccaccacuacccggcucaucucauuauuuuagcugcccccugauaacuaguaaauuugaaaaaacaaacaccauuugugaugguuuguauauucuuguaccagggaguggcaccauuuggagguguggccuuguuggaauaggugugaccugguuggaguagguguaucacugugggugugggcucaauacucucacccuaggugccuggaagucaaucuuccacuaguagccuuuggaugaagauguagaacucucagcucugccugugccaugccugccuagaugcugccaugcucccaccuugaugauaauggacugaccucugaaccuguaagacagccccaauuuaauguuguuuuuauaagacuugccuuggucauggugucuguucacaguaaaacccuaacuaagacaccauuuauacgguuagcugcucuuuuuauuuguuuuccaaaccuugccuuggucugguuauuaauucuugucauuuguuccuuuuggcuauagugucugugccuggacagaagcucuaggguauggguggccucacaaguggcauuguguuugcuuuagugguccugcuuaagaacuuuauuuccuaccugaaaggcccugcuuguuuucacuaugacuugagauuauucucauauuuuaaugugugaaagggaauguccugguugcuugaguuuguuuguuuguuuuaauuaaaggguuggggggagggacuuugaacacaaacuagaguuauaugggaagaggaaucucauuugagaaagugccuccaugcacuuaagaaugacaguaagauagguaagucuguaggccauuuucuugacgaaugauuaaugagggagagauggcccagcucacuguuuaguugguccugggguauauaugaaaucaaccugagcaagccagcaagcaguguacuuccauagcuuuugcuucaguuccugcccccagguuccugccuugacuuccuucuaugauauauugugguguagaaaaauaaauagugagguaaauaaaaauaaacccuuuccuccccaaguugcuuuugauuaugguauuuuaucacagcaauagaagucauaauuaagacagggaaaucuuagaauuauuaaauagggaaaggaaggagauuaucacaaugaauacacagauauauuguacagucuaccagauuggcaaaaacaaacaaacagguaauggcagccugcaggccauguguagaaccaggagcucacauauugcaaguguaucacgauuugguacacagauugcuucuauucuaugaaaguucauccucugagcauuccacaugugugccagauauguacaacaacauagcagcauuguauauaauggggaaaaaaaaucaacuucuaaugaacuucuaaaucguagcacauucauuuggugcaacacuguauaguuguguauguagaucagccacagaaugcugaucaccuucccaaaacaacacuggauagaagggaaagggaaaggguggggccaagaagauggcucagagggugaagugccuucccugucuuaauuacaugaguaccugcguuuccauuccuagccaggaguaguguugaguagaggaagaggcacuucccuggagcucacuggcuagccugcugagucauugagcucuagguucagugagagacuauguuucagaaaauaagguggacagcaacugaguucaaaagcauugggacggauggauggauggauagauagauagcuuauauuauauuugaauauauauuuaguuuauuuaauauuuauggguguuuuaucagcauguaugucugugcaucuugucuaucuggcacccacuugggccagaagaagaugccagaucucuuaggacugggugaugguugaaagccuccguguggguacuaggaguuagauggguuccucuagaagaguagcuggcugagcugcauguguagugauguaaugugaaggaaaaguaaaaaugauacaaguacaaaaguaaacacacacacacacauacacacggaauauugguugugcacaggcuuuagugauaaugcuuacugacugaugacacugaacuugcuaugcuagugaugacuacauaaguaucuguuuuacaacuuuuaaaucuuguuuguguguuagauuuggggcauacaguaaugauuuuuaucgguuggagagucuguuaggaucugugcuuucagucauuuugugaugcuauuacagagaacccaaggugugaacuguggaaaauacugcuuuuaauuucacacugaucuuauucuuguuaggaugauagaguagagagaugauuauuaagccaaggcaguaguuauuuuaauuuuuguugguucugggaauuagguccucauacaugcuaggcagcacucuacuacuuagcucuauuccuagcccguagccuuagcuucuugacagauuccuccaguguuguccucaaggcaggcaaauagcugaauaagaguguuaguuguagaccucuaacuaggugcguaucccugcacacgugugaugggagggaugagaucaaguuauggguaauaugguccuucauaguuuuggguucugaggccaagaucuuccuguuuuuaagccugguaucuucucagccaggucccagugauaagaaaucagaacuacugccagcuaaguggaacagcaauaaagaacuguaugcccuccgguaugagucuaaggauggagccagaaaacuccuucugaaagcugucucuguggagaacggcaugaucaucaacgugcuggugagucugagccaggguucugcuaauggugugggaucgagauaccuguuuagaaacucauuuuaacagugaacucagaaaugaccccaaaguuuuuaccuagcaauuccacuuugggcaucuuucuccugagguaaaaacccacaauauauguagaagaguuuugugcacaaagguguucauuaggaacccccuguccacagcaguacucacucucugacaacacaggagauaaaggcuucuguaguugcagccucucucuuagcuucguaaguaagagguuucacugccuuggacccuguacauuuuguuucuugcucuggagacuaccaccuccaucacaucacacacacacacacacacacacacacacacacacacacacacacacacauauauauauaccuucugccaucauuccuuuagccugccccccucccccggugugugugugugugugugugugugcccugacuauccaccccaccugccagacaagucuaaaugauagcuuucuauucuauuuuccaucugguacauaccauguuugguauuuauguacuuaucugugcuuguauuuucacccuggacugugaacaccuugagguagaugacuuucuuucuguuccauuuugucuugguugcaugugcacaaaagugucugacuguauuauuuguacuugacuuuuuccauaccacguguuugaagggcuuuacauaacacagauagauauaccucauucucuuucauuacucuguauuacuucacuguccuugcccuuacugaugaacauuuaguucuuuucuaagaacuggguucuuaggugcaaacaauuccuuuggguuaauuuaaacauuaaaagaauggaguuaguucauuaaaguagguucaaaucuaggcuuccaaaagcaguaccccaaacccuagaaaccacuguugcuuggccccucaggcuggguguggguugguauucagucugcagugcuccaugcugugugcugcucccuuccugagcaagaugccugcccuuacugggccuguguuucuauguugcuccagguuaugguuguguauucacgggguacuucaguuccuugcccaccuuccccuguuaccaguaaccugggaaauauaccccaucucucauuuucuguuuucacuuuucuaggaacuuggcacacagcagguggcagacuugacccugaacuuagaugauuauauugaugcagaagaccugagugacuuccacagguacuucuaaaggaagucuuuccaugagaaaaggcagagggacucaguagcaagaaauaaggacugguaucaaaguccccagagacaaguacgguugacagaagaacuugcccuaggcgcagucuguucucaguucccuccuucuuacauaucuguuuguuugaagacaagacucacauagaaaugucucauuaaguaaaaucaugcauuuaagagugcacagaggcuaccguggcuauagucuuggggcgaggcuaaugcuucagucaacaguaagaucccuggggccagcaaguggcucaguggguaaagaugcuugcugguagaggugcuugugcacagacaugacaaccuggguucugucccugcgucccauagucagcaggagagaaccaugacugcagauuuguuuucugaucacacaugugccacgugugugacacuuuaaaaaaagaauaauuccuuauugaaaguaugcuuaaaucaaguacaucuucauuucacucccagcuuuuuuuuuuuuuaagagucaaaauuuagaucccaucugcucaccguucccacucuugugugacaccagagagguuccucagucauaagccauauaccuacacccacaucaccuccauuuuggggucacucuuaguguugugugguaugcgagguuggacauacacacaguggcauaugcaguguuucagugucauaggccauuguguuacacuguaagcauccuuguguucuuccccucacccccacccccuguccuuggaagcauugguccugcuguugucuccauaguuuuaccucuucagcaugucaugguuggaaaggaguccagacaaacugucuuccaaagcggcugugcugcucugcauuccugcugucagggaauaaggagagcugcugcugcccagcccgugcccugucagcauucagcaguguaaugguggcuuugcauuguguuaagugaggcagggugugagucgucuuucaugggcuuauuucccuguguaguucuuugaggaggcuguuuagauccuuugcucaguuucaacuucgcuuguucccugucucacucgguguuaagaguugguuguguaguuuggguggcaguccucauuggccgcuucuccauguguucucucccuguuuguggagacauuccgcugacuuccuaauuuugaaauuugaagagagacaguuugcaaaaauacacaguagauacccauuuaucuauuaccgagauuagccaauuuuuaacaguuguuuuauauucuugaaccaucugaggguuauuuacuuuguucuuuaaauucugcagcauggaacaacuguguguguguauguguguguguguguguguggugugugugugugugugugugugugugugggcgggggagggagagagagaggggguaggaggacagccucaggaguaaguccucauuuauaacagggucucucuguuguuuugcacgguguacacaaagcuagcuggccuacgagcuucaaggauuccuauuuuuguauccucuuuggcuguauggucacuagaauugcagugcauguuacugggccuggcuuuauagguccuagcguccucacacuuagugacaagugcuuuauccuucuuccaacaccuccaccuuagacuagcaauuucauaggaauaucaucugucucaacuuugaacaaugaucacacuugagaauguagcaucaguauaucauuuaauaugcagucuacauucugauuucugcaccuaucccaacaguguucuucagagcggaucuuuuagguuuuuuucuuaauccaccuaaauauuuccuauuacauuaauuuuuaugucuuuuuaauuaauuuuaacuagcacaguuucuagacauuuuuuucauuuucuuguuuuuucaaaacuugaaguaaaugugugugucugugugugucugcgucugugccuguagggaccuugcuaaguaggucaggauccuuggaccuccauggcaauuuguucuccauuucuaaauuuuuucacuugaaacauuuuauauaaauagaauuaauauguagucuugggcuuggcauuuuuacuagcauaauacucuugugauggauccaucuaaaguguagugcacuuuaacugugccucuuguuuacugaguauacuuuauguugcguguacaacaguugauuugaucacucacuggucaaaggguaaguuaauugacuagauugugucuaguugggcaaucacagauauggaugccauagcauuugagcacaggcuguaugcagcugugcuuuuuauucucuaugggggaccccagaguguggugguaaggucauauuugguuuacuuuugguguuuucugaaucauuuauauccacucauuaugagugcacccacuucucugcaucuuguccuagcauuuuauuuuauauuauuuguugaaugugaaguugucucucauugggaucauuaauuugcauuucccuacuagugaaugaaauuuugagguguuuuguuuuguugaggcaggauuuccuuggaaauuugucauaggcaaaauguuucauuccucaccuuuuaauugcugugauuuucuucuuuucccuuuucacagugccuguagcugccaguguuguuaaauuagaauugccacagaguuuccuugucauguucccacaguuagggguagaggaugcaguuuccaucacugauuguauuguuaacuaugggcauguggcagaugcucuguaguaagcugaggauggucuccuauauccuuaguuccuuuguuagugcuauuuuuuuuuaccaugagugcauuuaucauguuguuuugugcuuuaucaguuggucuaauuaucugauguuuauuuacuuguuagaauaguggccagcauugauuugugaauauuaaaccagccuugcuuaccuagaauaaauuguuuaaggucaauuuuaauauuuuugaaagguuuuuguuuugaguugguaaagaaauucuggucuguaauuuuauuuguuuaguugucuaguuuugauacuaacuagcacuggcuuccuaguugucuaguuuugauacuaacuagcacuggcuuccuaguugucuagcuuugauacuaacuagcacuggcuuccuaguugucuagcuuugauacuaacuagcacuggcuuccuaguugucuaguuuugauacuaacuagcacuggcuuccuaguugucuagcuuugauacuaacuagcacuggcuuccuaguugucuagcuuugauacuaacuagcacuggcuuccuaguuaucuaguuuugauacuaacuagcacuggcuuccuaguugucuagcuuugauacuaacuaacuagcacuggcuuccuagcacugcuuggaaaugcucccaccugggcuucugaaaaugacuuuuuuaacagugaaaguaaaauuuugugacuagacuuucuuguauuguauuuaugucuugagacgugucuuuggaggcaggcuauguauuaguuacuuuuuaaaauaccaugacuaaguaacuuauagaagaguuuauuugggcuuauuguuccagaggacuagggguccaucauggacaggaggcauggcuacaagugcaggcuggagcaggaugcugagggccuacauacugaaccacaagcaggaauccaagagaauaaacugagaauagugcauggcuuuugaaaccuugucaggugacacacuuccuccugcaggaccacaucuccuaaaccuacuccaauacugcuaccaacuggggaccaaguauucaaaugccaagaccaugggggaacauuucauucagaacacuacaguguggguucugccuuuuccucuuugauccuugcauucuuuggaaaugauugaguuccacaaguucagaggcguuuguuuugagcucugaugugguuccauauggccagggaacacacucuguaggacuucagguacggaguuugcuuuauggaccaggacuuggcucauuuuuaaggagccguucugcccacccucugcugccugaccuggccaccacaccucagcuguagcucauggugcuaauuucucuuggugagaagagacaccugguagagacauucucccagaaucuggcuaaacugagccucaggcccuaccucugugguucauccucccacagagccuuuuccuuccaugacaugugaugaacacauaaugaagcugagggagggguggcaugggaacagaagagcagccaguccaggcugugccccuacucucaucucuuucugauggggugguaaaugaggaggggcaacucagaugccuaagaaacuuaggcccaaaucucggagacagcaucaggcuguugccccccucacccagguccgccggacggcccguucccaccauaguaaacaggccaagcgcaagaccaaggcugcucagggccgccgccgccgccgaccgagccaucagaauacuguacaugagacucccagccaacugcaggaagcuaauuucuugucucaauccugcaggaccuauaagaacagugaggagcuucggucucagaucagaucuggaauuaucacaccuauccaugagcagugggagaaggcucgugcaaacaguccuccgagggaguucccaccugccacugccagagagguggacccacuccagauuuccucacaccguccucauacuagcaggcagccugcuugguaaguauggaguccccaaaguucagcccauccugcuguugccccuccccuggucuccaagugucuccagcagacguguugaaaguauugguguacagagguaaaaaaguagaaauggugauagauuugaguucuggugcuacugauaguuacucugacuacagcauucuaagcugccugucuccuuucucaagcucacacagcccucugugugcagggguuggaggcugcuguccaggugaaucccaguuacucuguagaguugugagccagacuuggggaaugcauaaggacagaaugccauccuggaggagaugcagccccagugucuucuccauucacugcauuuuguuguauacccucaccucugacagcuucagaagauggacagaauagcugcuauaugaaugaaugaaugaaugaaugauguccaaggucuuugcagauuaguuuagcagcaguaauccuggagaauucuacucugaugaaggagacaaaggccaggaaacuguagucugucuagacagcauguccuaguaugaagcugacaguaugguuaagucagggauuggcauuguaauagggaagcauucacugugugccguauaauaagcacucagugucaacuaccauuggcuuuuuaugucggcuaggaguuguaaacuuuugguuaguugacaaagguaaucaauuaaauucuuauaauuaauaauuggcaagucaguuuagugaaucuuuuaaaauauuggcuccuauagagagaaugaggaaaacaaaaaguacuugagaacucuaggaacugcuuguccuguaaaaccuacuuauuucauggaagggcacaggcaguauggccugccuaaggucacuagcggagucaagguugggguccagguaucuucauucccaccaagugcucuagccauggacucaguaugcuuacaagacuuaagacuaauuucuggacaguuaacaaaaugggugauuuuaagacccgaagcaguugacccccauaacugaauaguuuuaaacagugcuagaagccucugccccuucccacauaaugcagacccguguuucaccucucaccuuccaugccuucauuauaccugccccacaccugaaccaccacucugcccucacacguggaucugauuucugaaguguggaguggccugucuauauucagcuauggauguaacuggagaggucagucuacuguaauggagaaucuggagaggucagucuacuguaauggagaaucuggagaggucagucuacuguaauggagaaucuggagaggucagucuacuguaauggagaaucuggagaggucagucuacuguaauggagagugccagguggauagggaccucgagcuccugaaggcucuggguuacuaacuuguuccuacuuaauucuguaccugcauauucacacacacacacacacacacacacacacacacacacacacgaagacauuaaaaagaagauaacuaguuccuuuccccuccuuuccucucuccuuugucugauaaagggaagcuuguucguuuuguuuuguuucuuuuuuuuuuuuaaaucuaagccuaacuuuuuguuggucuuuucaaucuaacccacuuauguuagcuccaucugucugcaaauaggaaauugucugccucaaaucauguccauuguuuugaaaacaaauuuugcuuugcuuauccagcuucccuaaaagugaagcuuuaguauaaaggccuuauuuaggucauucuaaauuuaucuuugauccuuaacaagcugccuuuacaugugauuuuuacaguuuguguucuacaucuucuuaauaagccuuguuuacuaaaauguuaacaugucuuuuuuuaguauuugcuaguuuauuuuacuaaugugcuaugauuuuccugaccucuauguaugcauagaauauuucaagcauuucagguuuucacugaaaguguccauaaauauuccuucucuaauuguguacccaucugugcacagacacauaauaagaauuaaauacauuuuaaaaagaagauaucuugaugccuuuccuuuccuuuccucucuuuguauucaguuucccccugccccuuuuccuuuuucuagugcuagagauggaacuaaaggccuucuacaugcuaauaugugcuguaccacuuagcugcacuccacuggauuccuugucuuuaagauuuauuuauuuauucauuuaauguauaugaguacacugucgaugucuucagacacaucagaagagggcauuggaucgcauuacagaugguugugagccaccaugugguugcugggaccucuggaagaacagucacugcucuuaaccgcugagccaucucuccagcccucagguggauucuuauuucugcuuguggauucagucauuaagugauguggauuuuauguaagguggcacagguuuggggaauaaagaguuacaguguugcagcucuaguugaaaauaagguagauuaaaaucucaugcaauagccaacuuuauuuagauuuuuuuuaaaaaaaauuucuuauuagauuuauuuaaauuuauacucaggguuaagaagaaucauauguaugguguucaaucacgaggauaagccauacauggcaaaaagguguuuuuccauggaggcuuaugaauaacaacagcugaaguaagcuccugucuguuaaaccuacauugggaggagcacagaaacacauuccaaaaccaauucugcauuucagauacacugaggucacaagacucuuguucucuuagacuuuucucacaagcucuccgaauucucacacaacuccauucuggugcuguguucugacaguagagucaaaacacauauauucuuuccaaguauccucuguagcuauucucugcuguuauacuaagcacugauugacaaguaguaauugucuuuaugacuuagcugcaguacugcauuuucauguguuaccagugaacuuucugugugucugucuguguaucaugucaagcucugugaauggaucuuuucauccauuagauugaaagaguauuugaacauuuggaaaacaccaauucugagauacauagaucugcugaaagcucauauauuuuauuuaaaaguaucaaaaaucgcauucaaaacuuaguaauaucaaaaaggacuuggauuuuuuuucacacaaaugaugaauacaaauuuccaauuugcuaguuuuuacuuaaauuuuucauuuucugcugggcaugguagcacaugucuuuaaucccaguacacaggaggcagaggcagguggaucucugaguuugaggccagccuggucuacaaagcaaguuccacaacagcuagggugguuacacagagaaacccuguguugaacaaaaccaaaaccaaaaaaauauuuuuuucauuuucuaauugguaacauauacugcauauuguuuuccuugaguuaaugucuccucuuuugaggaaaguggcaaggauguagucacaucugaauacccacaguuugcucuucuuucagguaaaagaugguuuucaugaaaauauaucuguucuauuuauagcuaaaaaaguagcacacuuuuucuacaaaggcuuugguacaugaucucuuccucagugaaucacauagauuaaagaaagccauguucaaagauagauauuugugaguauaguuaauauacccaguaagacuccauuggaaaaaaacuaauuuuuucuuuacaagaagauguaagugaagauagcuucuugauuagggguggggguuguguccguuucccccuugcugugcugggaggacccugucaagcuugaacuuguguguaggcccugcaugugcugccacagucucugaauucauuuguacaugaguccuacugugucaggaagacacuguuuccguggugucauccauccccucuggcucuugaaaucuuucugcuuccucuucugcauagcuuccugaaucccaaggacagauauuuagugaagauagucuacuuagcacugaguauuccaaaacuucucacucucugaacauugucuaguugugugccucuguucaguucccgucuacugcaagaaacugcgucucugaugauggcugagcaaggccgaaucuagagauauagccaaauuucauuuuauugcuuuuuguuccuuuaacaaaacagucauucuauuugguuuucuccuaggcccuuggccuauuugucucagguucuuggcuacccaaccaugucaggcaugggucccaucuugcagaguggaccuuaaauccagucagagaaugguugguuacgcacacauuuguaccacuauugcaucaguacauccgauuaacuuuuuuguucuuuuuguuuuguuuuauauuuuguuguuaauuuagaaccagagaaucuugaauacuuugaauuuuuuucuaauccagggauagcaaauuuagugcaauaauauucuuauaucgacuaguggcuuauucuauauauuccagauaacauacuguagugguuuguauaugcuugacccaaggaguggcacuauuagaagguguggcccuuuuggaguaggugugucacuguggguguggacuuuaagacacucacccuagcugccuggaagugaauauucugcuaguagccuucagaugaagauauagaacucucagcucuuccuguaccaugccugccuagaugcuaccacacuaccaccuugaugauaagggacugaaccucugagccuguaagccagccccaauuaaauguuguccuuauaagaguugccuuggucaugguguucacagcaguaaaacccuaacuaagacacauauuccaucuguuuacccucuuagaucugucauucauguauaauaugcaauuauucauaaccaagaagagacagaacuccuguguuauaguaauaggauauugaacacugcuuauuaaacucuuuauguaccagguaucgugcuguaguaagcacuauccuuuaaucuguauggcaacccucagauacucuugucuguauuuuguggaagaaaaucuugggccuggagauuuuguggcuuacccuaggccauacagcuguuaaauggugaaacugcaguuugaacuugagucucacuaaaaaggcuuggcuuuuucuuaucuguaaguuacucuguauccauuaucugucaggcacugaacuaagcucuggcagugugugaugagcugugccccaaucguuaagcagcuuccagcugguaaggacuaauugcaccuuucacccuuaugauguccuuaaaacagugacaguaugccgagguacacugaagcaaagagagcagugauugaacugaagaacugagagcaggaaagaaccagaaacuucacaaaggccauacuuuaguuguaauuuaaaaguauauggaacugaagagaugucucaguaguuaaaagcacuuacugcucuuacacagggcuggguuuaauuccuggcaccuacauaauggcucacagccauccguaacuucaguuccaggggauccaguguccucuucuggcuuucgugggcacuaaguaucuagauauauauauaacauucauacacauaaacuuugucuauauauuuuuuaaaaagaucaguauaaacuugaugcuauucaaagugauuaguuuuuaaggaaacaguagagccaauggaacagugaguccucuugggugugaguaaccucuacuagugcuagcucgugcaggaagaggugugugugaagcacacaguagacaggcagcaugugccuuggggcuggauuugauccugagaucauaggagccaucuaaagccuuaaauguagucuggucguaaagcccuuaaacuauugauuuuguuuuuuucacccuucagugagucuuagugagaauaugacaauucugauucuacuaacaugguuaauauuuacugagcccuuacuguguccucaguaaccauacuaaguguaaagauauuaucagacauaaucucuuuaauugccaaauaagagaaaagggggucggcacuguuauuccugcauagaaagguggcccagaguaaagcagcucaugaguguuggaucgugaugcagcccuucugggcuccucuuucugacaugugcaucagcagcuguuucagaagugaugauaaugaucuggauuguuccaacaacaaagcuugguuacuuacaggagcaugagcuguguacagcuacucugccugaagaaaaccucuaccugucuccuacuucaguaacugauagcuguuauuucgccucaggaaaaggaggaguccuguguguucaugcuuucuuacuaggaagccucuugagcagugcuucucaaccuauggguugcuacugcuuugaggucaaaugacuuuuacagagucacauaucagauauccugcaucuggcauguuuacauuacaauucauaacaguagcaaaauuacaguuaggaaguaacaaugaaauaauuuuaugguuaggagucaccagaacaugaggaacuagaaucacuccucuugagcuuccccucucugugaaggaauguugguuagcacaagcuugugggaauccuuugaguaaugguagcuucugagaguucaaaugggccauagccauaucaugccaaaggacaguaagaggcugacacaggcaggaaaucagggaggagugacaguuucugguagaguguaugaagcugagauacucauuuggaagcuugacugggacuagaaaccaagggugauggcaagaaugauacagguuuguuucuagcuuaaucacugcuguccauucuuugaggcugauucuaucagcaaguccuuucuuguccuaaaguaugguuuaccaucauugagucuucuuggguguuacuguuagacccaggcagugguagcauaugccuuuauucccagcacucaggaggcaggcaaaucucucucucucucucucucucucuauauauauauauauauuuuuuuuuuuuuucaaugccagccuggucuacagagcaaguguuccaggacggccaagacuauauagagaaacccugucaugaaaaccaaucaaucaauaaacuagcagaauuuaaagaaaaaaaaaguuggggaugcagagauuuugugacaggcuccugccagccugcuauaaaaucuuuuacuccaaguccagaacacagacacaacucugacugcccuaaggugcacacgauuaugugaugcauuuaaaaaggguucccaggucucacagaguaaguucuuaaaagugugauugccuuguaguaaggcuggagagcacuugcugccugccggauagcccuggggauagcccugacggccugaguauguaugggaugggaugggccuagcaacucccuccuccuggcaguuuugaguuguuuagcgggccuugcagcuccccccuccuuugcgcuguuuuguuuccccuccuccccacauuguucuggagaguugguaaccuuuaguuaugcucuguacucucauucucagguuuauucuggcgcucuggcauucgcagagaaggaagaacuuaauccuuuggagagaaagggggaacacuagagauugcagagguuuauagccaguggccaccagcuggcuguggugcagagauucacaguagacggugggguugaaagugugcacaggccaugauggauagaaggccgagaagcacacacuacccucuggcucccaggcuucugucuugcuccaccugaguagcauuuacacuuuagcugccagguguugguuuugaaguaauauuucauguaucaaguucuugacuuacauaaacuauaagaauuuuagcaaaguaugaauacaauagaauauauuuggaggcuauuuaauaauuuaucuuuaucuagacuuugcccuuuauuguuuuaccuuuuuaaagauuaauuuuuuauguguuugugccuuuguggauguguauguaccucaugcaugcaagcggccauagaggccagaagaaggugucaaaucccuuggaacuggaguuacaggugguugugagccaucugauuuggugcuaggaaccaaacaugucuucuaaaacagcaguaugcucucuuaacugcugagccaucucugcugccuccguuuucacuuuuaauucuuuauuuauguauauauggguguuugggcuguguguauguauguauguguaugccauagaggccagacaagggcaucauauguucuagaacuagaguuauggaugcuugugaaccauuaugugaugcuggaauugaacccagguccuuuggaaaaguagccagugcucuuaaccacugaguugucucuccaguuccccgcccgucccccgcauccacccaguuuuaccuuucguucagcucuucauauuauuuccaguuuaaugugaucaguauuaaucucugccaaggaccacuuucaaguauuccuuacguugugaucuuaugaaaguuucuuccuugucugguguucggugugucucuucugcaucagcuucaagccccugggagcauaggugcuuggcugcucugggaauugugguaauuguccuuguuuguuucaggcgugauccccugagcccauuugcugucgggggagaugaccuagacccuuuugggugaguauuucuggggaggcagcaacaguauaauuugcuuaguggcuugcagcccagcucaucccauuuuagagcuuucgucagccuccccucccuuuggagugaaggagguagugaugaguggcugaggagucacugcuacuuucuguggucugccauacccagagcaguucagagaaagaccugggacccuccugggcaagagucauaaggaugcaaaaggaaaaccacacaaugggccacaggcuguagaguaacagcucaggcuauuuagugguuaccucauuccacaaagggaguauccucugauucucauccuguauccagcagagguucuguacccucagcucugcaguguucucugagugagucagaugagguuuaacuccugcugaagagugaccccacuuuuagcaucucaguuuuagaucauaggacucacuuaacucuucagagcggcucagacagugaccucagcauguaagccuauuuaucucagcuugagugcaugaagucaggucuguggaacucagugagggacagagaauggcaggagccaggcuugggcaacccacaggcaguuagcagcugugcugaggcccuuaagaaaauagcaaacccucggccaggcgguaguggcgcacgccuuuaaucccagcacuugggaggcagaggcaggcggauuucugaguucaagacuagccuggucuacaaauugaguuccaggacagccagggcuauacagagaaacccugucuugaaaaaccaaaaaaaaaaagaaaaagaaaauagcaaacccucaucaugguauugacgcuauuacuccuagacuuaggauaaacucugcagagcuggagaguucuguauugauccuggccaauucuagcucugguucuugaccaguugaucuuacuaaauguaagaugugucagagaucucuguccugugggcucacggaauccuuacagaacuuccucugcugcugcaggcccuuuggcuccaguggugcacaacuuugugugcucuuuguauucuuguucacucugacuugcucuccugucuuccuggacuucuagaguagucaugcuggucaauuuuuauucacuauaugccugucucucuucuucaagggcaguagucucuguaacaccugcuuacccagcuuccuuccugucucaggugucagagagguggcaugauuguggauccccugagauccggcuucccaagaguacuuauugacccauccucaggccucccaaaccggcuuccuccuggugcugugcccccaggagcucgcuuugaccccuuuggacccauugggaccagcccaucuggguagguauucacucagguaugcugagaggugggaccugauggcagcuccgcuuagcuuaguccagcacugcagccgagguaucugacuccaggcacagcugccaugcugccucccuggaggccuagggggucucuccucaccuucuucccuuggugucuuaguuggaguuaucauugcugugaugaaacaccaugaacaaaaaggaucuugggagagaguuuauuugacuccauaucacggguucaucguuaaaagaagucaggacaggaacucgaagagagcaagaacuuggagacaggagcuggugcagaggccauggaggagugcugcuugcuagcuuguucucccuggccugcucagccugcuuucuuacagaacccaccagcccauggguggccccagucacagugggcugggcucucccccaucaauuaaggaaauguucuacaggcuugccuguagucugaucuuguggaggcauguucucucaaucaaaguucccccucucagaugacuauaauuuguaucaacuuuauguaaaacuguccagcacgcuauugacccugcaaggacaacacaggagaagaaaugcuuaugucaauaguucuuuuauagaugagaagggcaaggccaggagacuggguguuuaagccaugguaaaauuuaguuccaggccaucuggcccuagaguucaugaucuuaaacuccaugucacucugugggccuccuccauacggggcauguuucuugcguacucagccucauucuccaauucauuagacccucuuuacauugcagaccuaacccugaccaucuucccccaccgggcuacgaugacauguaccugugaaggccucaagaauguaacagcucagccucccuuuuacucuccaggagcugccaccacuggccccaucagcgucaguauucuugugggcuuggggcagaggauucugcccauguguuugcaggccugcugggguugcauccccagcccuugucagagccgaggugccugcugcagcaccccaccaagcugcauauaggucccacggagaaauuagugugucucaaucaccagcuccuccccacuugcaaggaagacuccggcaacaucagcccuccacccgaugcagucgcggucacagcgcuauaagaacagaacgcauuuuggauguuauuauuaagaaccaaaugucaauacagaauacauguugccagucuuccacgcuccuuuuuguuaaugcacaaacucuuaagagugugauacugcauaggacuacgggauuccuacagggcauucuucucaagcacccucgagucacaaguuacucuugcuccugacaucacuaagaugagccccacccaggcuuucuggguggaagugugauuggaauccaugagccacaaggaugauuucaccaaagcaggcacacuagaaaaacugccaucuccucccaagggcaugcucaaccaguugcucugagcagccuguugacucucccugggcugcaguggccuguaaguagaggaauaaacagaacagaccuguaggcuaguuucauagugacccuaaagaaguccuuucucuuaggagccuaguaacgaccugugaaaucagaggugccuucacuggagcucuguagugagcuguguggaugggaauagcccuagguacuagagaagagaaaacgaagguacgcugugucuauuaccugcucuucauguccuccugggacugacaagagcauaggaacauggguccagccaggaggaaggggagccuuugucuuuggaagccuguguccaagcucucccaaucuguagaauuaucuagauauuugaagccccagcugacaggcacuggcagugcucuaccccugugccauaaagcuggaagagcacaauggcguacuguuccaggagacaccaaaucaaguaccaagcgcuucguuccauggccggcagcccaaccauguguggcuccaggauagauggggagauagacuggacugacaggaccagggccagucucagggaggcugggcuuggggcucaauccagcaugagcaggcucccuagcuguugaaggaucccaugggucaggcacugaccaccuugaagguguaggccauucugugcucugaggccacagaccaugcagagacaaggacaagacguccauugugcaucaacuucauccuugagggcuggcagguggauguuuggguucuguugguaacuggguaccugcaaaagagcuuaggacacuuugcucauuaaagcaucccuuuuuuaugcaaggaagcauuaaaggaacaguggcuagaauucuccagauagguuugggaauguagauaacuuggacccugauuuaaaggaaaagguaaaaguugaaacauucuuccauugggcuuuuuaguagcaaagauaaaaaauauaaucauacauuaguucuguuuucuacagacaaacugcaguguuucuggagaaaggacugguuugguuugguuccuauaagucuuauauaguaucucuaagaaacccaguaucauagaugugggaagccuugaauggugccuccaggaacuugucaagcagcuggaacuugucucagucucugucacuuaaccuccucccagcuguguacggccaacagcaagagggaauguuucaguguaugucccauagauccuccagacuggagccuuugcaguaaauaaauagcacuuuauaaccuguuuuuuuuaauagcuuuauuaagagaauuuacauaaccaugaaauucacuauuuuaaaguacacaacucaguggguugggagauauucacagugcugugcauccaaccccagauuccuccaaaagaaauaucuucacuggcaaucacucccauuuucccuccccugggcaggcaacccuccagucuguuugccuauuuuggauaguuuucauaagugacaucacucaguguguggucuguguguccagcauuucccacucucuguccucacuguucaugugauuguagcaucgacauuccccauggcuguacaaucauagcauggcuaugucauauuuguuaauuuauaaguucauggaugcuuggauuguuucuccuugcuuguuauauugaaugcuguuaacauucauguacaaaguggguuuuguuauuuugcgugggcaguuuuuaagucauugaauguaucuggaauggauuuucagggucccauaauaacacguuaaauuuuuugaggaacugccaguguuucccaaaacagccacgcuauuuucauaccagagguagugcuccaguuucucuguauccucaccaauccuugcuuguacccaaacuagugaugucaagucauaucuuguuuguauugucccauuugcuuuuguuuuuuaauggaaaaauuugaccaagaccaugcagagcagaguccacaguagcuugcccuguuggcuuugauaacagccacggggcaguggcuaugaccccauggaguugggguugacuucugggcuggcugugauauaagaaggucuuuucucugggggaaauuccugagaccuucggacaucuaauaagauucacaguaucauuuucacuugguuugaaaucucauagcucaucuaguggcuuacaaauagaaucaaggucuacuucuaaaucauugucuuuuggugcuaaauaagaccacucauacuauuucuaggcuacaccggcccacaucccaccuucucuucuuggcuugcugucuuuucuauucuuagagcuggcugaguuuugcauugcguuucucuccucagucaugagcuucaagccaaccuccaaucuaaaccacgagucuccuaagaccucaacuccaggaauguaccaaguauuaaauggagcuacauuccuguuagaguucuuaccuguugacacacagcuggaaaacagguaacacaucuguccaaccucccuccagaacccagcuuccucaugacuuucgucuugucauuggugacauuuuaucauugauccauagcugucuucuuugcaggaggaaaacaaauccauggaucacuucauguucucugucaccugauuuuguacauauacuucggugcaguuccaauagagacagguuccaccaccaaugacaaucccaggcauagccccacuuuugcuugucaguaauacuuguuugcuugcugaccacuguucaaaacuagaacagaugcucagaggcaggcauccuagccaccagaucuaggccuuguuugcccuugggaugccacacccuaaaucacuucucuggacuugaccaggaaucugagaacaggucaaaaggcaagcauggcagagagugaggguauaagcaguagacuggcaaggcucugguaacuguccagguccgaggaugcaucaggaagucuaaguaucucacuuguucuuguggaagcggaaggcccauccucugcucccaacaaaggacccuggcuaaccacaugcacgugucauuccaaauaagcuacauaaagcaagugcuaggaaagucacaguguaaugguucagagcaacugaggaggaggggccagucuggaaguuccgggcaguaaauacucauuuaacuuagccagagagcucaucaccauggucugagaaguaggaacuguacaguagcagcuguccaagucugcaucggaaaguguaugccuuucccugucaccuugugcccaauucagcucacauucagguuccuaguucaaagcuaaauggacugacuucaccugguugugagaaccuaucaccucagacucuagcaacaagagguccugggaagcccucgugcacuuuuccuaucucugccauugggaagguucaguggaacagaucugcugagccuccuaugaucauauaauaacaacaauguagaaggguaccacacccuugcuugccauggccucaccaucuccuaagacuccucaggaguuuguauacaguacaucccgagccccaauccacaguucuaagcaaagaccuucaaggucuuguuugcaaagucccguuguaauucacagaucacaagguuggagaauggugaagucauucuauucaguaccaccacuaccaaagucuugcuggaaaugaauacucucaggggccaccccagacuuaccacuuuauuuuuauguguauggguguuuugccuguguguauguauuuguauuagaugcaugccugguacauacagaggccagaaagggcauuagagucccuggaauuggagcuacugauaauugugagcuguguugggcauugaauccagguccucuggaagaacaguagcugcucugaguauugaaccuuaucuccagccccagugaacuugccuuuugacaaguuucccaccuuccaugugcacacggaauuugagauguucaaguguagaagcccuuuaccuucaccugcauaucaggaacaaagaacugagucagucagccuuaguugauggcaugcaugauuaaugaauucauauuuucauuuuuucccugguuguaccccuaauauauacuccauccccuuagccuuauggaucauucaagcauauuuauuucauaaauaucucuaaacauuugggugcccuugugagguaacaucauccucaguucauuagucauucugccccacuucggagaggaaggucugacagaaagcaagcguggaaauggcuccagcacauuacugguacagcuuuccuccucugugaaguggugucaccccugccuguguggcuacuggagagucucacuaaaugugucuuaucaaagguagugggagcucagugggugucagcagccgccguggaagucauauugguaagaauggagcuuaaagacaaaggagagugacucugggccaaaccagugaaggagacaagaguuuaucugguucccacugugugcacagcuucuuaugccagacgguacuuacuacaaccugaggugaagauuaggagcauuaguccuggacauaucccugagggauggcugaacuaaaucugcccagcucuagagcuuuucaguagagcuguacccaaacuucacaugagcauggucaccagacaaaauccaucccagaaucuggaaaaaagucaggaccugucugagaaagaaauucuaccuaauuccaaguaugggcagagacugaaacagacuguuuucuggguguuccucguguuccugagcgcuagcagaacccagauuagaggggggcaucugaacaccugccacaaccuccacucugcaggagacaggcccaguaagcuccuuugagggugagcuaagggguucuucugggucucauggcuggauuugggaucugcuaugcuuugccacauagccccagcugcugcucaccuugguccucugggguuggcaguauagaugcuacucugaaguaaacggaugaaaaagcuaguccacaucaugcaugagaaagauuuccucagcaucacagaaacucugucuucacacccaaggcuucccugcucaguguggaccaaaacagucccgggguccuuagucacaagaacaggccaguucuuccuccuagcuagccuguauggaagcaccauugucgauucagcacccuggucagcacccacccucuguggugcuggggagaccucuaacuuccuaagcuacacugucuuccaagccaggauaacccaguucuggagguaggcaggcaucucagaguggagaaaggaccuggcccucuccaugaucccugacaucaccaucuccucaagccagugcuuuucaucuuggaaauucuccagauaauaauagaccugaacuuuagaagacagucaguauuccuugggcuuucauuucuugaaugcuaaagaaagcucuagaacuggauauagcagcuauucaaaccuggugaauggaugaacaaggguucuuggguggaaaccaugggguucauguagucccuggccugcagucaggaacugcccacguucuugaaggcacucaucucugugagugauuuaguaagucccagagaagggaauugugcaucucugaccccagcaaacgacaucucauugacuguucccuugacuucaccacagcgcucaccuugccacauccuuguacccacagcguccagcuguccaguugcaauugaaaaacuugggauucuggugaccacaaagcaacagcuggccagggccagaacagacacuucccccuuuaaucuuaucaccacugucauggccaucuacuguguucacugauguuaccugaaaaacucugcaggcauuugcacuuggguuccugcuuuaaucucugacgggagagaauagggacugcugggagagugacagcaauagugacagcucaccgccgggcacccaacccccggcaaguaacuccgaugaaagaagauguggacacaggaaucaggugaaggagguuagaagaaaggaaagaagaggagauagaguuugcugaaugucacuggcccuggcgucaggacugacccagaugccacaccucccaggaagagguuggcauggcagcugccuucuuuucccaucucuguuccucugggccagaagaaugggugagucucuuuucauuuucugcuuucccuuaaggccaggagaucagcagcuaccaccuuaacccuggagacucagaaaucaagugggggagggcugccaaguugaggcacagagucaaagccaugucccccgacuggaguaagaagggccguaaaggagagccagggugugcugcaguguugccuccacagugcaucuguuauagaagauucuuccagacaaaccugcaaguauaggg

SEQ ID NO: 1168 - RNA, 2606 nt, Mus musculus
cuccgcccaguccagccucccuccugcaagaaccugaagucugacagccagcucccacccgcaaccagccagucccuccgccucgcucugcgcuuucucgggcagccgggauggacugcaggggccucggcugcugugugcggugaggggguagggagaggcgacaggccgcucggaagacggcugagagcgugcggggcgaccgcgcccugcugccucggccugggcucacccgcgcgccccgaugaccucggcucgcgguucccacgguaccugcgguggaagcggcagcggcaauagccgcgcuccccuagcuucacacagacaauauggcggcggcggaggaggagacacacggcucggccgccagccgcagggaccagagcgaggcugcagccuccgcugccggaagcggaagcccccucccaaccagaggcggggcggagccggaaaaggcggaggcgccccgcccucggaggcucugacuuagcgcagcccccgccgacuggcuuuauaucaucugggagcguucggugacuuggaagcugaauggaaugcucuucguaagguuuaauaggauucuaacagagaagcgcauuuaagucagaaccugugauaggugacuagacaaaacuucagcgucccaucaggcauacaaacgaugguuugacacagccgaagauggcguguuuccugcacuacgccuagcgagagagcgaccagccggcaagucccgaagcaugcgcgaccuuucgcgcgaagcauccugggagcugaagucucucaugcccggaccccuagucuaggcuuagguuuccagcagcacuuuuuuuuucaauccucaaacuugggaguuuagauuaacgaaaguuggguaccguagagggcgugacucuagaguuuagaaucuagaaaaagauaguaauaacccucgagagaacaaggccccauuccuucuauggaauccuacccagaacugucaauucagaauaucauaggauuuucuaaccuuucaaucugcccucauccucacucuugcgcucuuuuccugcuccaaacagaaacggggcacuuucugcuaugcauacuggauuauguucuuuuguucaaauuucuccuguggauucucaaaauucucucuugugcaaccagagagaauucuauuuaguacccaucccacccacccucccaccccaaaacuuagccagaucucuuuuuagucucuugccuucucuaaaguuccugauguuuccacucacugagacugcaaauaacccuguaucuuggcaguaucgccuccccuucuuugaacuguuacaauuacuuuguggauuggauaacuuguaugcauuugucggauuuauucggggugagggugggguguggaccugcucugcaacggaccaucacuuggcagaaugaggucucuagcugggcuccuccaucagacugcgagcccccuaguaaacagggggcacugcugaacgcuauucaguguuggccucaccucugggagggcagaggugugagggcugaaacaagggugaggaggcuggguuauuucuguaccagccauuauccccagcugccucagaauaacugucuauucggggauaggcuuuccacccucuccagccccccuuuuacaguuugucagcugacuggcaccucugcucccaaagagacuuuccuacccccaccgucaugacaugggaaugaugguggcuugcauuauguacggauggcuuuagagauguaguggcuaccuuucaugggucacucucagacauaucugugauauuuggucccaauuaccuugaguauccacaauuaucugggugucugagucugaagccacucucuucucuggcccucaguuuucccaucuguauuagucaggguucuuuagagucacagaauuuaugcguacucucuauauaguaagggaauuuguugaugacuuacagucuguaguccaacucuccaacaacguucagcagcaacugugaauugaaguccaagaaucuagcaguuucucagucccacaaggcaagcaggcaaagaagaaagagcaaaucuucuuucuuccaauguccuuauguaggucuccagcagaagguguggcccagauuaacgguaggugccaccaagccuggaucugggauuugcuuuguuccagauaaccuugaacucagagaucucccugucuuaaucuucugggauucauagccacuaugccacaagaucuccaugccaagauccagucagaaacuuguaucucccaggcuccagaucaggaucacaggugagccuuccaauucuggauuguaguucauuccagauauagucaaguugacaaccagaaauagccacuaaaccaucugugaacugaagugauuacaaaaggagaccugaagguugcccagcaggguguggugauggauggacagccaguggaggcaguggguuagcaguuugaggccugccuggugugcuugagaccagucacaaaccagaggucuaugucuggggguguagcucaauugguacaauguuugcauaacgugcccuaaacucucagaucaauucaauaaauugaaccugau

SEQ ID NO: 1169 - RNA, 16432 nt, Mus musculus
ccagaaccaacagaucaccuucagguucuguuccaagcucuccagagcucaccauccugccugugugguacccagccuaggacauuguucccucaagcaugacaccuuucccuucugggaaaaccacuuuaauucacuuaaagaggaggaugcagagcugaaccccaugggcuguuuccugacuuaccaaucuaccuaggcccuggauggauucacaucagcuuuaagacgugcccagaaagccagcaaggcaaaggaugaggcugugguggguccucagggagcaagcucagggaaaauagagucacucagagcacuagccagccaggccuuaggccaaggccguguuuaauuaaggcugguggcuaguaagggucgggugucuagugcagggccaugaggucuggucagccagaagcaacagaggcagugcgaaugacaucagcucagcuggguccuuguaacacagcaaucagacugcaguacagcucgggcuuucucccuuaccaagccuaaagguauggggccaaaccaggccagucccuugccuagcccugcuguucacugcuauacauguggggcugggucaguaugagagccaccaucgucgacuuaguggcaguuuugacagcuuggguggcauggaaucccauugacccggcagcggcagccaccacugguguccccugggcccuaaaggauagagaaaagaggauaucagguuggugaaaacaggcuaugccccaaagucacucuaucagcccaaggcagggcccaucuaaaggugcagugagguagccaugaaggccuuuaacccccaucccaaccucuccagcacccuuaaacuccauggucuuccccaggccagaaagagaaagggauucagcuguaggaggaccagcacccaggcagaaggaaaauguacagugccucugcauccaccaguacugacugccaccacccaggcacucacagccggugacucgcauccacagagcacuugucuacuacuugugucugacaauccgagacaggcccuggcaaagaugugccagagggagggacuggcaagccuccuuccaacuccaggcugaccuugacuuauucuccccucgagcaggacagcaggcuuugcugcacagccaggucaaagccugacagaccuuagcccccgcaaagcacagaggcagaagcagggggcugguguuccagaacuauuuucgugucucucugcacuuccaaacaguagccuuugagaaccuccaaacaauguuuagauguaaacaauucuuaacccuuaagccuauaaucuaaggcugaggcaggaggacugccacaaaucccaaagcaacccaggcuacagagugcaaagcaguauuaaaaaaauaaauaagccagcaaugguggcacaugucuguaaucccagcacuugggagacagaggcaggugaaucucuguauuuaaagccacccuggucuguuccagagaaacacugucuuaaaaaaauaaaaauaaaaucugagcgcaugcgcucucgcucucucucucucucucucucucucucucucucucucucuccccuucuccuucuccgucccgcucccucucuagcaugcacacaugggugcauaaacaauaaaaaacaaagccaggcaacgguggcacguuccuuuaaucccaguaccuugggggauuagaagcagauggcucucagauuuggaggauagccuguucuacauuaugagacccugacucaaaauuaaauauuaagggcuggugagauggcucaguggguaagagcacccgacugcucuuccgaagguccagaguucaaaucccagcaaccacaugguggcucacaaccaucuguaacaagaucugacucccucuucuggugugucugaggacagcuacaguguacguacauauaauaguaaauaaaucuuuuaaaaaaaaaaaaauuaaauauuaaaauaucaaucuuuccacuugagcuguacaugguaggcuggacugaguucauggcugaaguacugagucccacuccaguuacuaaccccccucagcucuccaggaccccgaagacucaccccugggccccagcgugggcccuuggugacccagcagaucucaguguggcagacuguacagcggauccagucacagccguccuucuucugcaccacaauccggcacugugggcagugcauggccucgcccugcugcagcauuaccuggggaggggagcuacugaggcccuggccuugcucucugcaguguacacucccucagccuggcagcgcuagccaccacuucguuacagagggcuccccaacccagacucuuccuucaguuccauacaugacacccuacggaagucacacccugcaauggggguuugaccaggaggaagucuuggccuccaagaacaugugaccucagaagcaucuacgacauauguccccaggcccuugccaagacugugccuuaccuuuagcaucucugucgucugccgggcagccacaucauucugagcccgcagggccaggucgucuugguacucccugcaauucaugugcucauggauggccuggagggcaagaagcucuugagugagacauuccccaggggcucaagcugugaugagcagaaggggcccaaccccagcaaugggugccaucagugaaagcccucacuuagaaagccuauacccauuuuacagaagaugcaggguucaggaagggggagccaggaccaucaguaggagccuaauauaaaucccauuuuagaugcugauggguauuguaaccccuaaagcagcuccccacuaggcucagacggcagccccugcagcugccacagacaguccuagcaaggcccagcuagaaggucccugucucaccuugcagagcaggcaguugacacgggugcacacaggacaggugaacucguugacaucauccucaaagaagcaccaaccccugcagucgggggucuugcagugguagcucaaggugcuucgguucucugcgauggacacacccagauccaggaaacgcugguaguccucaggggacaggagcugcacauacacagcuuugcugcugggguucaggacacccagcagaugcccuccuccuaucaaauggucccaggaaaccaagcacuucaauccugucccaagcuccucuucccccaccuaugcaguuuuuugggggguugggggucagggacaagguuucauguaauaaaugcuggccuuuaacaacuggaggguuucuacuucccaagggcgggcauuacaggugagcuauaauacauaacucaagcucuguucuucacagagccccuugagcacuuaaaaccaccacuuagacaguccaaauggcacaaaccuaucauccuagcaccugggaagcuguggcuagaagugggcaaagcugacagugcacagucacgguggcuauaaagcuuaagugacagugccucagaauuacauaccuaaggacuuaacuguggacaaacagccaacaguucaaauucaauaaggaaaacaagggacacgagugacgggggacaaagagguucaauuccuaucuaucuggaagucaugaaacccaguccuuugaaggcugagacagaaggaucauugaagaguucaaagccagccuggacuauauauauagcaagacaugucucaaaggcaaaucaguauccagguacacuacauucuacaaacaauguggcaacauccuagaccugaccaucuucuggugcuucuacuccacacagaagcagagcuagggagcugcaccucccagcagguaaagcuaagcugagaggagaggcagagaaggcgugucaaugagagcugagaugcuccuuaaaggauccuuggcaaacagcaaagcaagucagugggagacccaggccucugcucuguaugguggugcuuauggaaguuacauauugcaaaauucacauaccuauacaccuagaagguauacauucugucuugugugaaccacaauaaaugauguuuaccucaaaaccucagaauuacagccuggaaccaaugaaauggcauggcaggcaagggugcuugcugccaaaccugcugaccugaacuugaacucugagaagcacaugguugaaaagacagaauugauuccggcuaauucugaacuccauacaugcuggguguguuacacacuugauacauacacaagaaaaugcaacuauaaaagaaacauaugggggugggcaguaguaccugccuuuaaccaugcacucaggaggcaaugucaagugaucugugugaguuaagccaaccaagacuguuagauaguugaaaccuugucccaaaacaaccacaacagaagucaucugccaagaaagagggaaacaggacaaaaugcuacuagaggaugucaggaugucuagggcucacagaguugaaggugguuuuuucucuuuuauuucuauuaccugccgcuuauuaaaagcaccaccaccagaccacucuacugacaccuguuuccucuugcugccacaccugaggcuugagucagggccugaggacaucuaggguguccugcaugcauuccuuauauauaaauauggccuucucaggaaaccucugagccagugacaagggcuagcuaguuauaggucucuccagaccuguaaggauaccucagcaaugcccagaacugauccacucagaagccccuagacaagguuaaaacacagcugcuuggaauauagaauugaaacuccccaaguucuacucucucagauccccuucccaccucagaagggccccuugggcuagagaaucguuucauaauauuuugggagacuucagaagucagaggagacgggagugaugggaaggaaggggagucugugcaugccuggagucugccaucuggacccuggccacugccauccuuuuuuaagccuacgguagaacucaggugcugcgagugcuguauucuaccuacuagcccuuagcuuuguaaaacacccgagcuaucugauucaagcuggccucaagcuuuucaccugaugcuucggcaaugcugagaugacaggguguacugucauaccaacccuugaauggccauaucaccacaggaugucacccgaaugguucauguugaccccuacagggaaucggccugagcauguagucuguccgcacugauuaacaggguuacagcugagcagucuuugcacacuuacuguugugucugaaacacugaaaccucacuaaccacuagcaugcgauaggccuguacagccuacauguggaggggacugcaguagacggcucuucuagugaaggccaucagggaccagcucauaccacugagcagacaauccaggauccaacucugaaagacuccccagcuccaccgaguggaaguacagccucgcccuuuacaaacuacagagucuugggacaccaggccuggagugaguggcuacaaagcaaaagcaguugacacagcagcugcacacgccugcacacacuagcagaugccaucugugguucugauagcggacaaagggcagaggcugagugucugccauaaggucacacagccaagccccaggcacagcucccacccacuguaacugcagcccuugcugcacuggugaugaagcuaaagcagcugagguuucaccuacccaacacccacuguaacccgcagcccuugcugcacuggugacgaagcuaaaguagcugagguuucaccuaacccgcccccaccgucacccccagcugcccugcguaggccccaggcccucccaaugaacucuugggugaugucugcuggggaggcaaagagcugaugcacuugagcagugccuguugcaagcuccaggccaguucccagggcucagaaugcuuuuccaccuacagccuuaccgcccggaucucucucuccagcagcuugccggggcaugaguaggugcugucaaugaaggggcaagccaccuccgccuccuggcuguuucggauggugcccugcaggcacucccugggcaggggaggguggcaguuaggcucaugacaaccuuugcagggacuccggcccucggaugggagggccugaucccggggcccuuucuucccauuccucucagcccaccaccaagggccccacgcuucuauucaccccaccaucccuguggcucuggucuggggcacuggcaucccugcccaggggacugcaguaaccuccuucuuggccucugucucuacccaguccaagugccacugcccagcacugccacccaaaggggaccagacugacugcugcuuggagagugucaccugcacaggcacaacuauccugucccacaauacccaccaucccucugcucccuggucucacagacagcuuuccagccucuacuccagcaugacuuuugaggggugccuucccuaguuacuuagccuggggugcuguauacauuaacacagacccuacccuggaacacaagcuagaaggggcacuccaccaggguccaccauggugaaugaauauacuuccccagcucgggaaagccgacgcagaggguggaaugcuguggcuguuagagggcacuagaacgacgccuguuucauuucugaguucccugaaagcuguguggcuuggcaacaugggugcuuggauucucugagccuagucuuucuuuuuucugauuuuggagacaaggucucaagcagcccuggcuggcuugaacucacuauacagccgaagcuagucuugaacgucugauccuccugccuccagcuccugagagcugggauuucaggcauaagccacaauaacucuugcauaaacaguguuuugugggcauccaaugagauaaggaacaaggccacagacauuuuacucugguaacacugucacugggugggaguggggccgcaccugcagaaggugugcagacacucacgcagcaccacggccucgccgggugccagcacugaguagcacacagggcacucaguagguucgguguucagcaccaggcuccucugcuccagcugcacgugcugcagguaguuccccuccugcugcugcuguuuccgcugggcacaugggcagggcggggccaccaggagggucagggucucaguuggucagauaagaagugggacaagguugggguaggaugggggcaccaagguaguagugggcugggaauaugggcaggccaagagagccgggaggggcuacagcagaguaagaagccagacgaggggacaaggacgaggagacaaggacaguagaaaaagacaagguucaggguacaagaggaaguggagggggaggggguccacagggcucaaacucuggaaaaucagggcagugcuggaggagugguuagaggucaaggcuggggacagagugaggcugcagaaagcuugcuagguaugggguuguggucaagguggagcaggcuacacugaccccaaagggaaugacagagggcagagcaugcucuugaagggggagcaccagagagggguguccacggaaucaguguuugugauggaacugacuacucuagggaaaugagagcagacagagucacucccaagcagcauaagaaggugaucgaugcgagaggaagggacaggagguggaguauguauguaacaggagccagggugagguuacaggccacggggugaggaucugacuaagaaauagcacacuuaagagucacagaugaaguacggcuaaggaugcuuguguacaugggaggagggggugucaaagcgaggacgcggagcaggugacgagccuagcugugcaucacaaccagagagugagcaucagccagagaaccggccucagagagaggcagcucucagucaaggccaagguuauggcuuagcaguguggucacgaggugaguggcaauggccaggagcacagcaguaugcaggugguucccuuucuggcucaggccuuccucaaacagccuucaggugccugucccuggaccugugugcccaccugcugguacuggcgcagcgccuccuccucgccggccaggcgugcucgcucuuccucgucaggcugguaugaagcagguaucugguaggucucaggccuugcacgacagcacaucucacacccaggccguguggguuuguugaugaaagugcagccagggcacugccagcccaccugggugcagacgggcugugagcuuggcuguugagcuugacagggagggcagggcacaggugcccucgagguaaggcagcuuaccgguggugacuccggugcugcaucuggcugucccggcuccugguugguccugggcuucggaaggacagguuccaagggcccccgugacugaagggugagguccuugaagcccaaaucugcagaaggaguaugugugguaucuagguaaccacaugcugacaacccaccuggagucaacucccaacucuacaguguuucuaggccccucccgaaggagagccagccucuguccaaccacccacugcugcaggcuaguggggagccauaguccaggaguacauuuggggguaugguggggguaggguuauaguuugaaaaguaaaauaccuaccacuugggauaccccaugucuaaggcuuuacuucauaacuggcuucaugagcucugucccuuuuaggaggaggagcucccaaacacggacuccaccgugcugaaaugcccaccaaggagaaagaggacugaacaugauaaccagggaucaaaggggaucagggcugggagggacugagauguggcagcugaaugccauaucuuuugccaccaaggacacugguuggacaacuggcaaaaacccaaaugagacugacuuuacuugugucaaugucaaccagagagagggcucagugggcaaagccacuugccaccacgccugaugaucugaguuugagcccuugaaccacacagugaaaagagaacuggcuccugcaaguuguccuccuuccuucccauguacucuauggcacaugcauggcuacauacacacacacacacacacacagagagagagagaaacaagcaaacaaauaaauguaaucuuuaaauuauuuacuuacuuugugaggagguuguugguuuuuguuuuuugguuuuuuuccaagacaugguuucugauaaaguuuuggcugcccuggaauucauuauguagaccaggcuggccuugagcucaaagaucugccugucucugccuccuaaaggcaugugccacuaugcccagcccccaaaaugcaauuuuuuaaaauuaaaaaaaaaaaaaagucuauucuacauugauguuaauuuccugcacuggaggguaaagcaggaaaauuaccuuucuuuuuaagaaacuacacaaguauucaggggaggaagagccuacuuauaguuacuucuaaaaugucuccaaagacucugcacccagaaaauuaacaacaacaacaaaacacaaaccagcagccaggcagcaguggcagggccuuuagucccagcacucaggaggcagaggcagguggcagaucuccgaguucaaggccaguuuggucuauagugugaguuccaggauagccacagacagcuauacagagaaacccagucuugaaaaaaaaccaaaaaacaaaacaaagaaggaaaauguuucucuguacaacucuccgacuuuucuacaggucuaaaauacugcaguaaaagcaaccauacuauaccuuaguuaucucaccaacauacagauagaaacacggaaaacugagggacagacagaaacagcagugagcuugccucagcucacacggcuagcaaaugccaggccaggacuaaacggccccucccuucaugccagccaugcucaggaguucuauggagagcucccucccccaucugacauccucguucauagacagggcccuccagcacaucgcugacagggaagacuucaccuuccaacauucgcaguugccgcugccgcugcagcucuuguggguugagugacguguugcgggcugacagcagguagagauaggcaccgucuccauuccgccgaaugccgugugaaugcaaggucuccuggucucgugccagccucuguccaaccacccacugcugcaggcuaggugggaagccauaguccaggaauaccuuuggggguguagugggggugggguuacaguuugaaaauugguaaaauaucuaccacuacacucacauuugaucccagguggaggcacuguuuucugagaccguggaacuguugcuggggaggccuggcugguguaggugggccccgaaagcuggcuuugaagguuagaguuuacccuguuuuggccccagcucuuuacuccuuggccuuaugaaaacccacaacugaggucuagcacagcagggaugcgcaccuuuaaucccagaacucaggaggcagaggcagauggaucgcuuuaaauuagagaccagccugaucuacaaaguaaguuccaggccaccagaguugcuuagugaaacucuaucuacaaaaggagagagaggaaggcuggagagaggccuagugagucagaacacuugcucgugcaggaccuggggucaacuuccagcacacacauggugacucacaaucguccacaaccccagugccacaggauacaaccggcagacacguggaacaacacucgagugcaggcaaccauucauauacauaaaguuaaauauguuaacucuaaaaaacauuuaagggugaacagaaauaaacaaaacaaaacaaaacccugcagccgcaaguuccugaccccuagauggaguuucccaagcacagccuugcugcggugaugcacaauauccuggccugcgaacaaaaaugaaccucuccucaggcugguugucagguacuugaccagagcaacaggaaauaugguuggggggagggcagagagaauggggaacgccagagaggagcccaccucccuccaccuucacucaccauguccuuaagggaggccacugucauauccgggcguacugugagccaaauggugacggugugcauguacgcauccuccacacucacacagagccuguggaaaacaaggggaggcaaggacuggggcugccggcaggggacuguucaagucugcacacgugcagaggcuaucugcugguuagaauuuuugucaacauauacaaguuagaaaagaaaguaucaauugaaaaaaaugucuccaucaaauuggccuguuggcaagcccgugggacauuuucuauccuuuuuaaaauucaaauuuuuaaaagauuuauuuccugugugugagugacugccugcacgaacacauccacaccacuugcuaccuggugccugugcaaaucaaaagaggaugucagacucccgggaaucagaguugcaaagaauagugagccaccacgugggugcugagaaccaaaccugggacuuccacagaguagcaagcgcucuuaacugcugagugacaccuccagcugggcugggggcagugccaccucugagcagauggcccugaguuguauuaaaaagcaaucugaagucaggcaugguggcgcacgccuuuaaucccagcacuuaggaagcagaggcagguggauuucugaguucgaggccagccuggucuacaaagugaauuccaggacagccagggcuacacagagaaacccugucucaaaccgcccccccccccaaaaaaaagcaaucugagcaagccuggaagagcagaagcggcauuccuccacagacucggcuucaguuccugucuccggguuccugaccccaccucccucagugauagaauagaagcugggaugcauuagccaggcuuuuuccuucccaagcugcuuccggucaugguguuuauuccaauagaaagcaaaccagaacaaccugcauggacagcccacacugggagacucccucuggaucuccacccaacaggaagcccugccuaugcucuaugcuggcucacaguggcugaagggacagcagcaguacuggggaugagccagggccuugcacuaggggaguguucuacagcugaccugggucucagccccuuauuauucauguguuuuauguaugugaguacaccguugcugucuucagacacaccaggaggagguaucagauccaauuacggaugguggugagccaccaugugguugcuagacauugaacucaagaccucugcagucuguucucuuaaccacggcgcuaucucuccaacccagaaguuuuuuguuucuguuuuguuguuguuugucuugauauauauuuucuagcccuuuauuuuuauuuugagacagggucaguaaauugccaaggcaggcuuuaaacuugucaucuaucuguuucagccucccaagaagcugucaccaaguugggcaaauucuuucguagggaaaggaagagucuuuugguuugguuugaaacagggucucauguaaggcugguccugaacucccucucaagcugaagaugcccuugaacuuccgauccucuauuccaaugucuaaguguugggauuauggucugcucuggcugcacccguuccucucuucugcccaacgagcaacaucugguguugaacacacaccugacauuagucauuuaauccuuuccagcagccugagacaggccaggccauagcuuuuuccagauacacacauacuaugguagccaugcugcaggagcaaucaguaacugccagagcgacuuaaguccaaacuacaucauuccaaaccaugucuaacuuuauuucuggugcugggcacuaaaugaagagccucauaugcaccaggcaaucacuccaccaccaagggcaugcguucuuacucuagucuauaagcaucaguuuucucggggaucugcaagcuuauuuuguuccucuguuuguuuugagccaggaucucacuaugcagccuagacuagccgucauccuccucuaccucagccuuccaagugccaccuagcauuacagaugugugccaccaugccuggcuccugaaacauugcugaaagaccaaaaaagcaagaaaaauuagaaugcaaaugaagaacugagcugaaccccaaggaaaacagauaaccuacgccacuggacccauguccagccuucugagaccugggagggccaugggaaacagugcaucaucugagcaaagacagccaggucaggcagugcacacccccgaucccagccucaggaagcugauuucuggaggaggauagccccaaguuccaggccagucuggccuacauaaaaaacccuugucucagcagcuccuguucugaaaaaugcuccaggaaguacccaagaagcucuuccagaaaaugauuugcuuuuuuagucagaucucacuauuuagcacugccuggucuggaauggaccacguaaaacaggcugaccuuuaacucagagauucaccugucucugccucuugaaugcugggauucuaggaauauaucacauguccgaggcaggaaaaugauucugauacccaacuauugguaaaaaaauaaauaaauaaacaaacauacaaagacucaaaguuuucugccuauguuuucauacgagagggguuuucguugucuggguguucuugugagacaugguuacauguauucaggauggcucugaaacuucugauccuccugccucuaccacccaaguauugggauuacaggugugcaccaccacacugggcuaagaccauauucuuaaucuucaaacuaucuuaggaguuuggaaacaaaagaaugcaagcuuuacacucuauuacucaugccagaaggagcaacuccauaguaacaauacuaacggggguucucaaccuguggguccugacuaacucuuucaccggaguugccuaagaccaucagaaaacagauguuuacauuauaauucauaacgguagcaaaaacaguuaugaaguagcaacaaaaauuuaugguugggggucaccaaacaugagguccuguccuaaaggguccguagcaucaggaaggcugagaaacacugccauaaagaaugcuacacauguucagaaccaaagaggggcaaauuauggaagccuuguaguaacaaaacaaaaucuguaaguuacuuuguaccuguaaugccaauacuuccaaaauagaacugucuugaguugaaagcuagccauggcuacacagugauuuacaggccaacuuggauuacagaguaagacuuggucucuaaaaacaaaggguaaauuaaaaauuaaaauauugguugaagagcugucucagugggugaaagcgcuugcccgugcuagcggaccuccagauccuauugugggaaggacagaacugucuccuuaaaguugcucugacuucaacacauuugaggaauaaaccccaugcuugcuucuagcagcagacacuaacuccggaggaucugcauggccccugcaccaaaggacaccuauugugcaggguccucuuaaaagaaaaaaguaaaccccagcacagccuaccccauagcucacagcugaugagcgagcgauuaggcuuugaagcgcaaucuccuacaagagaaccugccagugagggccuggguuugauccccaguacuguagggggaaaaacagauaaccugugcacagacugucaagaggccuccaguccccuuuaaugcaaggcacacucaccugauguccuguguuggggagaccucggguuuuacuugcacccugaggggcacccucugcucugccagccagguggcauacuugauagcagccuguucaucuccgccagccacugcccgggcaaggcucagggccaucuccucugcugaaggucggcagagagcaagcagguuagcaucaguuuauguggggaggcuggagaggugacccuuggugcuugcuuugucuugcuucucuagugacugacuguaucuucugcacguggcuauguuaaaaguucuuuaucuuuaagggggaggugauuuuuccgguccucacuccucuguacccuguacucacggaguccucccuccccuguacccucuuuccuccaugcucacagaguccucauacuuccauucauuuaucugacaagcauuucuugagcucuccuguaugccacccacuauuccagaaaguagacucuuuuaacagcgguuaagucgaagagcauucuucuccuuauaaaacucuuuaaguucaacaagaaaauagaaaauuaaaacuugaugagaaaaucaggcugugguccauucuagccauaacugaguaaggggucaggggagaccucuaggaaguaagggaaacugaggccugaaggagcgguugcugggcauuccaauauccaauaaggaagacgguuccaagaggccagagagugggcaaaggccuugggcaagaagugguugggacaaaacagaaaagccauguacuagaggcauagcucagaaauagagcauuugccuagcaugcaugaaaacccggguucaauccccaguaguaaaaaaaaaggggggggagauucagacaagguuuccagcaaacagaacaguggcauuaucggaguucccccaguucugagugaaagggccagggggagggauggauguuccccucucgguccuacucuggacaacuuaaguuuguuuuccuaacaaccaggagcucuccaacuccguucacauagucuccgaccccuauuuuugcacugacuaggccuaggguccacuuccaccagcugcaaucggugcccaccuuucuuggucuucucguccaucuggccuggcugcgcccauccccucagaaagggcugcugcuuccggaaaacgcuacuuugagguaaccugggagagagcgggaagguagaagcaacucugcccuagccggccucgugcguguguuccaguccgcacucgggcagcaucacacugcccagggcccgaggccgggcacugggaaccaauggggccccgcgagggacacggacagcgaaggaggccccgagccaagucugcaaagggcgaugaguaaccacgacccaaaagcgagggacggagggaggccggccagccagccggcgcgggcgcccuagcguccggaaccccagcccggaggcucgcgcuacccggaagacagcgcgagcagcguccccggaagagaaagugaaaguggcagucccggaagugcugcagaccgaacggaaaacuguccccucacccgagacucugcagggucaccaacuggggcagaccucuagacugcuccuggcacuuucgcgccacacuugguugggcggaccagagucacuuggucuagggacccaugauccccccccucucccccacccggccgacuccaggcagcgccuagcucug

SEQ ID NO: 1170 - RNA, 16432 nt, Mus musculus
cagagcuaggcgcugccuggagucggccgggugggggagaggggggggaucaugggucccuagaccaagugacucugguccgcccaaccaaguguggcgcgaaagugccaggagcagucuagaggucugccccaguuggugacccugcagagucucgggugaggggacaguuuuccguucggucugcagcacuuccgggacugccacuuucacuuucucuuccggggacgcugcucgcgcugucuuccggguagcgcgagccuccgggcugggguuccggacgcuagggcgcccgcgccggcuggcuggccggccucccuccgucccucgcuuuugggucgugguuacucaucgcccuuugcagacuuggcucggggccuccuucgcuguccgugucccucgcggggccccauugguucccagugcccggccucgggcccugggcagugugaugcugcccgagugcggacuggaacacacgcacgaggccggcuagggcagaguugcuucuaccuucccgcucucucccagguuaccucaaaguagcguuuuccggaagcagcagcccuuucugaggggaugggcgcagccaggccagauggacgagaagaccaagaaaggugggcaccgauugcagcugguggaaguggacccuaggccuagucagugcaaaaauaggggucggagacuaugugaacggaguuggagagcuccugguuguuaggaaaacaaacuuaaguuguccagaguaggaccgagaggggaacauccaucccucccccuggcccuuucacucagaacugggggaacuccgauaaugccacuguucuguuugcuggaaaccuugucugaaucuccccccccuuuuuuuuuacuacuggggauugaacccggguuuucaugcaugcuaggcaaaugcucuauuucugagcuaugccucuaguacauggcuuuucuguuuugucccaaccacuucuugcccaaggccuuugcccacucucuggccucuuggaaccgucuuccuuauuggauauuggaaugcccagcaaccgcuccuucaggccucaguuucccuuacuuccuagaggucuccccugaccccuuacucaguuauggcuagaauggaccacagccugauuuucucaucaaguuuuaauuuucuauuuucuuguugaacuuaaagaguuuuauaaggagaagaaugcucuucgacuuaaccgcuguuaaaagagucuacuuucuggaauaguggguggcauacaggagagcucaagaaaugcuugucagauaaaugaauggaaguaugaggacucugugagcauggaggaaagaggguacaggggagggaggacuccgugaguacaggguacagaggagugaggaccggaaaaaucaccucccccuuaaagauaaagaacuuuuaacauagccacgugcagaagauacagucagucacuagagaagcaagacaaagcaagcaccaagggucaccucuccagccuccccacauaaacugaugcuaaccugcuugcucucugccgaccuucagcagaggagauggcccugagccuugcccgggcaguggcuggcggagaugaacaggcugcuaucaaguaugccaccuggcuggcagagcagagggugccccucagggugcaaguaaaacccgaggucuccccaacacaggacaucaggugagugugccuugcauuaaaggggacuggaggccucuugacagucugugcacagguuaucuguuuuucccccuacaguacuggggaucaaacccaggcccucacuggcagguucucuuguaggagauugcgcuucaaagccuaaucgcucgcucaucagcugugagcuaugggguaggcugugcugggguuuacuuuuuucuuuuaagaggacccugcacaauagguguccuuuggugcaggggccaugcagauccuccggaguuagugucugcugcuagaagcaagcaugggguuuauuccucaaauguguugaagucagagcaacuuuaaggagacaguucuguccuucccacaauaggaucuggagguccgcuagcacgggcaagcgcuuucacccacugagacagcucuucaaccaauauuuuaauuuuuaauuuacccuuuguuuuuagagaccaagucuuacucuguaauccaaguuggccuguaaaucacuguguagccauggcuagcuuucaacucaagacaguucuauuuuggaaguauuggcauuacagguacaaaguaacuuacagauuuuguuuuguuacuacaaggcuuccauaauuugccccucuuugguucugaacauguguagcauucuuuauggcaguguuucucagccuuccugaugcuacggacccuuuaggacaggaccucauguuuggugacccccaaccauaaauuuuuguugcuacuucauaacuguuuuugcuaccguuaugaauuauaauguaaacaucuguuuucugauggucuuaggcaacuccggugaaagaguuagucaggacccacagguugagaacccccguuaguauuguuacuauggaguugcuccuucuggcaugaguaauagaguguaaagcuugcauucuuuuguuuccaaacuccuaagauaguuugaagauuaagaauauggucuuagcccagugugguggugcacaccuguaaucccaauacuugggugguagaggcaggaggaucagaaguuucagagccauccugaauacauguaaccaugucucacaagaacacccagacaacgaaaaccccucucguaugaaaacauaggcagaaaacuuugagucuuuguauguuuguuuauuuauuuauuuuuuuaccaauaguuggguaucagaaucauuuuccugccucggacaugugauauauuccuagaaucccagcauucaagaggcagagacaggugaaucucugaguuaaaggucagccuguuuuacgugguccauuccagaccaggcagugcuaaauagugagaucugacuaaaaaagcaaaucauuuucuggaagagcuucuuggguacuuccuggagcauuuuucagaacaggagcugcugagacaaggguuuuuuauguaggccagacuggccuggaacuuggggcuauccuccuccagaaaucagcuuccugaggcugggaucgggggugugcacugccugaccuggcugucuuugcucagaugaugcacuguuucccauggcccucccaggucucagaaggcuggacauggguccaguggcguagguuaucuguuuuccuugggguucagcucaguucuucauuugcauucuaauuuuucuugcuuuuuuggucuuucagcaauguuucaggagccaggcaugguggcacacaucuguaaugcuagguggcacuuggaaggcugagguagaggaggaugacggcuagucuaggcugcauagugagauccuggcucaaaacaaacagaggaacaaaauaagcuugcagauccccgagaaaacugaugcuuauagacuagaguaagaacgcaugcccuuggugguggagugauugccuggugcauaugaggcucuucauuuagugcccagcaccagaaauaaaguuagacaugguuuggaaugauguaguuuggacuuaagucgcucuggcaguuacugauugcuccugcagcauggcuaccauaguauguguguaucuggaaaaagcuauggccuggccugucucaggcugcuggaaaggauuaaaugacuaaugucagguguguguucaacaccagauguugcucguugggcagaagagaggaacgggugcagccagagcagaccauaaucccaacacuuagacauuggaauagaggaucggaaguucaagggcaucuucagcuugagagggaguucaggaccagccuuacaugagacccuguuucaaaccaaaccaaaagacucuuccuuucccuacgaaagaauuugcccaacuuggugacagcuucuugggaggcugaaacagauagaugacaaguuuaaagccugccuuggcaauuuacugacccugucucaaaauaaaaauaaagggcuagaaaauauauaucaagacaaacaacaacaaaacagaaacaaaaaacuucuggguuggagagauagcgccgugguuaagagaacagacugcagaggucuugaguucaaugucuagcaaccacaugguggcucaccaccauccguaauuggaucugauaccuccuccuggugugucugaagacagcaacgguguacucacauacauaaaacacaugaauaauaaggggcugagacccaggucagcuguagaacacuccccuagugcaaggcccuggcucauccccaguacugcugcugucccuucagccacugugagccagcauagagcauaggcagggcuuccuguuggguggagauccagagggagucucccagugugggcuguccaugcagguuguucugguuugcuuucuauuggaauaaacaccaugaccggaagcagcuugggaaggaaaaagccuggcuaaugcaucccagcuucuauucuaucacugagggagguggggucaggaacccggagacaggaacugaagccgagucuguggaggaaugccgcuucugcucuuccaggcuugcucagauugcuuuuuuuugggggggggggcgguuugagacaggguuucucuguguagcccuggcuguccuggaauucacuuuguagaccaggcuggccucgaacucagaaauccaccugccucugcuuccuaagugcugggauuaaaggcgugcgccaccaugccugacuucagauugcuuuuuaauacaacucagggccaucugcucagagguggcacugcccccagcccagcuggaggugucacucagcaguuaagagcgcuugcuacucuguggaagucccagguuugguucucagcacccacgugguggcucacuauucuuugcaacucugauucccgggagucugacauccucuuuugauuugcacaggcaccagguagcaagugguguggauguguucgugcaggcagucacucacacacaggaaauaaaucuuuuaaaaauuugaauuuuaaaaaggauagaaaaugucccacgggcuugccaacaggccaauuugauggagacauuuuuuucaauugauacuuucuuuucuaacuuguauauguugacaaaaauucuaaccagcagauagccucugcacgugugcagacuugaacaguccccugccggcagccccaguccuugccuccccuuguuuuccacaggcucugugugaguguggaggaugcguacaugcacaccgucaccauuuggcucacaguacgcccggauaugacaguggccucccuuaaggacauggugagugaagguggagggaggugggcuccucucuggcguuccccauucucucugcccuccccccaaccauauuuccuguugcucuggucaaguaccugacaaccagccugaggagagguucauuuuuguucgcaggccaggauauugugcaucaccgcagcaaggcugugcuugggaaacuccaucuaggggucaggaacuugcggcugcaggguuuuguuuuguuuuguuuauuucuguucacccuuaaauguuuuuuagaguuaacauauuuaacuuuauguauaugaaugguugccugcacucgaguguuguuccacgugucugccgguuguauccuguggcacugggguuguggacgauugugagucaccaugugugugcuggaaguugaccccagguccugcacgagcaaguguucugacucacuaggccucucuccagccuuccucucucuccuuuuguagauagaguuucacuaagcaacucugguggccuggaacuuacuuuguagaucaggcuggucucuaauuuaaagcgauccaucugccucugccuccugaguucugggauuaaaggugcgcaucccugcugugcuagaccucaguuguggguuuucauaaggccaaggaguaaagagcuggggccaaaacaggguaaacucuaaccuucaaagccagcuuucggggcccaccuacaccagccaggccuccccagcaacaguuccacggucucagaaaacagugccuccaccugggaucaaaugugaguguagugguagauauuuuaccaauuuucaaacuguaaccccacccccacuacacccccaaagguauuccuggacuauggcuucccaccuagccugcagcagugggugguuggacagaggcuggcacgagaccaggagaccuugcauucacacggcauucggcggaauggagacggugccuaucucuaccugcugucagcccgcaacacgucacucaacccacaagagcugcagcggcagcggcaacugcgaauguuggaaggugaagucuucccugucagcgaugugcuggagggcccugucuaugaacgaggaugucagaugggggagggagcucuccauagaacuccugagcauggcuggcaugaagggaggggccguuuaguccuggccuggcauuugcuagccgugugagcugaggcaagcucacugcuguuucugucugucccucaguuuuccguguuucuaucuguauguuggugagauaacuaagguauaguaugguugcuuuuacugcaguauuuuagaccuguagaaaagucggagaguuguacagagaaacauuuuccuucuuuguuuuguuuuuugguuuuuuuucaagacuggguuucucuguauagcugucuguggcuauccuggaacucacacuauagaccaaacuggccuugaacucggagaucugccaccugccucugccuccugagugcugggacuaaaggcccugccacugcugccuggcugcugguuuguguuuuguuguuguuguuaauuuucugggugcagagucuuuggagacauuuuagaaguaacuauaaguaggcucuuccuccccugaauacuuguguaguuucuuaaaaagaaagguaauuuuccugcuuuacccuccagugcaggaaauuaacaucaauguagaauagacuuuuuuuuuuuuuuaauuuuaaaaaauugcauuuugggggcugggcauaguggcacaugccuuuaggaggcagagacaggcagaucuuugagcucaaggccagccuggucuacauaaugaauuccagggcagccaaaacuuuaucagaaaccaugucuuggaaaaaaaccaaaaaacaaaaaccaacaaccuccucacaaaguaaguaaauaauuuaaagauuacauuuauuuguuugcuuguuucucucucucucuguguguguguguguguguguauguagccaugcaugugccauagaguacaugggaaggaaggaggacaacuugcaggagccaguucucuuuucacugugugguucaagggcucaaacucagaucaucaggcgugguggcaaguggcuuugcccacugagcccucucucugguugacauugacacaaguaaagucagucucauuuggguuuuugccaguuguccaaccaguguccuugguggcaaaagauauggcauucagcugccacaucucagucccucccagcccugauccccuuugaucccugguuaucauguucaguccucuuucuccuuggugggcauuucagcacgguggaguccguguuugggagcuccuccuccuaaaagggacagagcucaugaagccaguuaugaaguaaagccuuagacaugggguaucccaagugguagguauuuuacuuuucaaacuauaacccuacccccaccauacccccaaauguacuccuggacuauggcuccccacuagccugcagcagugggugguuggacagaggcuggcucuccuucgggaggggccuagaaacacuguagaguugggaguugacuccagguggguugucagcaugugguuaccuagauaccacacauacuccuucugcagauuugggcuucaaggaccucacccuucagucacgggggcccuuggaaccuguccuuccgaagcccaggaccaaccaggagccgggacagccagaugcagcaccggagucaccaccgguaagcugccuuaccucgagggcaccugugcccugcccucccugucaagcucaacagccaagcucacagcccgucugcacccaggugggcuggcagugcccuggcugcacuuucaucaacaaacccacacggccugggugugagaugugcugucgugcaaggccugagaccuaccagauaccugcuucauaccagccugacgaggaagagcgagcacgccuggccggcgaggaggaggcgcugcgccaguaccagcaggugggcacacagguccagggacaggcaccugaaggcuguuugaggaaggccugagccagaaagggaaccaccugcauacugcugugcuccuggccauugccacucaccucgugaccacacugcuaagccauaaccuuggccuugacugagagcugccucucucugaggccgguucucuggcugaugcucacucucugguugugaugcacagcuaggcucgucaccugcuccgcguccucgcuuugacacccccuccucccauguacacaagcauccuuagccguacuucaucugugacucuuaagugugcuauuucuuagucagauccucaccccguggccuguaaccucacccuggcuccuguuacauacauacuccaccuccugucccuuccucucgcaucgaucaccuucuuaugcugcuugggagugacucugucugcucucauuucccuagaguagucaguuccaucacaaacacugauuccguggacaccccucucuggugcucccccuucaagagcaugcucugcccucugucauucccuuuggggucaguguagccugcuccaccuugaccacaaccccauaccuagcaagcuuucugcagccucacucuguccccagccuugaccucuaaccacuccuccagcacugcccugauuuuccagaguuugagcccuguggacccccucccccuccacuuccucuuguacccugaaccuugucuuuuucuacuguccuugucuccucguccuuguccccucgucuggcuucuuacucugcuguagccccucccggcucucuuggccugcccauauucccagcccacuacuaccuuggugcccccauccuaccccaaccuugucccacuucuuaucugaccaacugagacccugacccuccugguggccccgcccugcccaugugcccagcggaaacagcagcagcaggaggggaacuaccugcagcacgugcagcuggagcagaggagccuggugcugaacaccgaaccuacugagugcccugugugcuacucagugcuggcacccggcgaggccguggugcugcgugagugucugcacaccuucugcaggugcggccccacucccacccagugacaguguuaccagaguaaaaugucuguggccuuguuccuuaucucauuggaugcccacaaaacacuguuuaugcaagaguuauuguggcuuaugccugaaaucccagcucucaggagcuggaggcaggaggaucagacguucaagacuagcuucggcuguauagugaguucaagccagccagggcugcuugagaccuugucuccaaaaucagaaaaaagaaagacuaggcucagagaauccaagcacccauguugccaagccacacagcuuucagggaacucagaaaugaaacaggcgucguucuagugcccucuaacagccacagcauuccacccucugcgucggcuuucccgagcuggggaaguauauucauucaccaugguggacccugguggagugccccuucuagcuuguguuccaggguagggucuguguuaauguauacagcaccccaggcuaaguaacuagggaaggcaccccucaaaagucaugcuggaguagaggcuggaaagcugucugugagaccagggagcagagggaugguggguauugugggacaggauaguugugccugugcaggugacacucuccaagcagcagucagucugguccccuuuggguggcagugcugggcaguggcacuuggacuggguagagacagaggccaagaaggagguuacugcaguccccugggcagggaugccagugccccagaccagagccacagggaugguggggugaauagaagcguggggcccuugguggugggcugagaggaaugggaagaaagggccccgggaucaggcccucccauccgagggccggagucccugcaaagguugucaugagccuaacugccacccuccccugcccagggagugccugcagggcaccauccgaaacagccaggaggcggagguggcuugccccuucauugacagcaccuacucaugccccggcaagcugcuggagagagagauccgggcgguaaggcuguagguggaaaagcauucugagcccugggaacuggccuggagcuugcaacaggcacugcucaagugcaucagcucuuugccuccccagcagacaucacccaagaguucauugggagggccuggggccuacgcagggcagcugggggugacggugggggcggguuaggugaaaccucagcuacuuuagcuucgucaccagugcagcaagggcugcggguuacaguggguguuggguaggugaaaccucagcugcuuuagcuucaucaccagugcagcaagggcugcaguuacagugggugggagcugugccuggggcuuggcugugugaccuuauggcagacacucagccucugcccuuuguccgcuaucagaaccacagauggcaucugcuagugugugcaggcgugugcagcugcugugucaacugcuuuugcuuuguagccacucacuccaggccuggugucccaagacucuguaguuuguaaagggcgaggcuguacuuccacucgguggagcuggggagucuuucagaguuggauccuggauugucugcucagugguaugagcuggucccugauggccuucacuagaagagccgucuacugcaguccccuccacauguaggcuguacaggccuaucgcaugcuagugguuagugagguuucaguguuucagacacaacaguaagugugcaaagacugcucagcuguaacccuguuaaucagugcggacagacuacaugcucaggccgauucccuguaggggucaacaugaaccauucgggugacauccuguggugauauggccauucaaggguugguaugacaguacacccugucaucucagcauugccgaagcaucaggugaaaagcuugaggccagcuugaaucagauagcucggguguuuuacaaagcuaagggcuaguagguagaauacagcacucgcagcaccugaguucuaccguaggcuuaaaaaaggauggcaguggccaggguccagauggcagacuccaggcaugcacagacuccccuuccuucccaucacucccgucuccucugacuucugaagucucccaaaauauuaugaaacgauucucuagcccaaggggcccuucugaggugggaaggggaucugagagaguagaacuuggggaguuucaauucuauauuccaagcagcuguguuuuaaccuugucuaggggcuucugaguggaucaguucugggcauugcugagguauccuuacaggucuggagagaccuauaacuagcuagcccuugucacuggcucagagguuuccugagaaggccauauuuauauauaaggaaugcaugcaggacacccuagauguccucaggcccugacucaagccucagguguggcagcaagaggaaacaggugucaguagaguggucuggugguggugcuuuuaauaagcggcagguaauagaaauaaaagagaaaaaaccaccuucaacucugugagcccuagacauccugacauccucuaguagcauuuuguccuguuucccucuuucuuggcagaugacuucuguugugguuguuuugggacaagguuucaacuaucuaacagucuugguuggcuuaacucacacagaucacuugacauugccuccugagugcaugguuaaaggcagguacuacugcccacccccauauguuucuuuuauaguugcauuuucuuguguauguaucaaguguguaacacacccagcauguauggaguucagaauuagccggaaucaauucugucuuuucaaccaugugcuucucagaguucaaguucaggucagcagguuuggcagcaagcacccuugccugccaugccauuucauugguuccaggcuguaauucugagguuuugagguaaacaucauuuauugugguucacacaagacagaauguauaccuucuagguguauagguaugugaauuuugcaauauguaacuuccauaagcaccaccauacagagcagaggccugggucucccacugacuugcuuugcuguuugccaaggauccuuuaaggagcaucucagcucucauugacacgccuucucugccucuccucucagcuuagcuuuaccugcugggaggugcagcucccuagcucugcuucuguguggaguagaagcaccagaagauggucaggucuaggauguugccacauuguuuguagaauguaguguaccuggauacugauuugccuuugagacaugucuugcuauauauauaguccaggcuggcuuugaacucuucaaugauccuucugucucagccuucaaaggacuggguuucaugacuuccagauagauaggaauugaaccucuuugucccccgucacucgugucccuuguuuuccuuauugaauuugaacuguuggcuguuuguccacaguuaaguccuuagguauguaauucugaggcacugucacuuaagcuuuauagccaccgugacugugcacugucagcuuugcccacuucuagccacagcuucccaggugcuaggaugauagguuugugccauuuggacugucuaaguggugguuuuaagugcucaaggggcucugugaagaacagagcuugaguuauguauuauagcucaccuguaaugcccgcccuugggaaguagaaacccuccaguuguuaaaggccagcauuuauuacaugaaaccuugucccugacccccaaccccccaaaaaacugcauaggugggggaagaggagcuugggacaggauugaagugcuugguuuccugggaccauuugauaggaggagggcaucugcuggguguccugaaccccagcagcaaagcuguguaugugcagcuccuguccccugaggacuaccagcguuuccuggaucuggguguguccaucgcagagaaccgaagcaccuugagcuaccacugcaagacccccgacugcagggguuggugcuucuuugaggaugaugucaacgaguucaccuguccugugugcacccgugucaacugccugcucugcaaggugagacagggaccuucuagcugggccuugcuaggacugucuguggcagcugcaggggcugccgucugagccuaguggggagcugcuuuagggguuacaauacccaucagcaucuaaaaugggauuuauauuaggcuccuacugaugguccuggcucccccuuccugaacccugcaucuucuguaaaauggguauaggcuuucuaagugagggcuuucacugauggcacccauugcugggguugggccccuucugcucaucacagcuugagccccuggggaaugucucacucaagagcuucuugcccuccaggccauccaugagcacaugaauugcagggaguaccaagacgaccuggcccugcgggcucagaaugauguggcugcccggcagacgacagagaugcuaaagguaaggcacagucuuggcaagggccuggggacauaugucguagaugcuucugaggucacauguucuuggaggccaagacuuccuccuggucaaacccccauugcagggugugacuuccguagggugucauguauggaacugaaggaagagucuggguuggggagcccucuguaacgaagugguggcuagcgcugccaggcugagggaguguacacugcagagagcaaggccagggccucaguagcuccccuccccagguaaugcugcagcagggcgaggccaugcacugcccacagugccggauuguggugcagaagaaggacggcugugacuggauccgcuguacagucugccacacugagaucugcugggucaccaagggcccacgcuggggcccaggggugagucuucgggguccuggagagcugagggggguuaguaacuggagugggacucaguacuucagccaugaacucaguccagccuaccauguacagcucaaguggaaagauugauauuuuaauauuuaauuuuuuuuuuuuuaaaagauuuauuuacuauuauauguacguacacuguagcuguccucagacacaccagaagagggagucagaucuuguuacagaugguugugagccaccaugugguugcugggauuugaacucuggaccuucggaagagcagucgggugcucuuacccacugagccaucucaccagcccuuaauauuuaauuuugagucagggucucauaauguagaacaggcuauccuccaaaucugagagccaucugcuucuaaucccccaagguacugggauuaaaggaacgugccaccguugccuggcuuuguuuuuuauuguuuaugcacccaugugugcaugcuagagagggagcgggacggagaaggagaaggggagagagagagagagagagagagagagagagagagagagagcgagagcgcaugcgcucagauuuuauuuuuauuuuuuuaagacaguguuucucuggaacagaccaggguggcuuuaaauacagagauucaccugccucugucucccaagugcugggauuacagacaugugccaccauugcuggcuuauuuauuuuuuuaauacugcuuugcacucuguagccuggguugcuuugggauuuguggcaguccuccugccucagccuuagauuauaggcuuaaggguuaagaauuguuuacaucuaaacauuguuuggagguucucaaaggcuacuguuuggaagugcagagagacacgaaaauaguucuggaacaccagcccccugcuucugccucugugcuuugcgggggcuaaggucugucaggcuuugaccuggcugugcagcaaagccugcuguccugcucgaggggagaauaagucaaggucagccuggaguuggaaggaggcuugccagucccucccucuggcacaucuuugccagggccugucucggauugucagacacaaguaguagacaagugcucuguggaugcgagucaccggcugugagugccugggugguggcagucaguacugguggaugcagaggcacuguacauuuuccuucugccugggugcugguccuccuacagcugaaucccuuucucuuucuggccuggggaagaccauggaguuuaagggugcuggagagguugggauggggguuaaaggccuucauggcuaccucacugcaccuuuagaugggcccugccuugggcugauagagugacuuuggggcauagccuguuuucaccaaccugauauccucuuuucucuauccuuuagggcccaggggacaccagugguggcugccgcugccgggucaaugggauuccaugccacccaagcugucaaaacugccacuaagucgacgaugguggcucucauacugacccagccccacauguauagcagugaacagcagggcuaggcaagggacuggccugguuuggccccauaccuuuaggcuugguaagggagaaagcccgagcuguacugcagucugauugcuguguuacaaggacccagcugagcugaugucauucgcacugccucuguugcuucuggcugaccagaccucauggcccugcacuagacacccgacccuuacuagccaccagccuuaauuaaacacggccuuggccuaaggccuggcuggcuagugcucugagugacucuauuuucccugagcuugcucccugaggacccaccacagccucauccuuugccuugcuggcuuucugggcacgucuuaaagcugaugugaauccauccagggccuagguagauugguaagucaggaaacagcccaugggguucagcucugcauccuccucuuuaagugaauuaaagugguuuucccagaagggaaaggugucaugcuugagggaacaauguccuaggcuggguaccacacaggcaggauggugagcucuggagagcuuggaacagaaccugaaggugaucuguugguucugg

SEQ ID NO: 1171 - RNA, 6646 nt, Mus musculus
auguuucacauaucaaaccacacagcucucuuuuauugggcacaugaugaaaauacacacuuaaccagaccaaagucaucaaacugacugugggccuggguacuaaaaguccccagaacagggccugagauugucuguaggcaguaggacagacccugccugguccucccccuccaacuuuggugcuucagccggaggcuaccaggguaaacagacccggauccuuauuccagacuauuccuugagucagaugccucuuuauuggagucucauccuuuuggcuugaaucccacagccaagucuucuucaaacagguucuccugccuggaggccacaaucccagcccggccugauuugugguccugaggcacauggugagugaggacuuuggucuuuggcacagagauguuuccuuuguuuaaaggcacaagacagaaggcagcuggggcacugauaaaagggacugucccaugaaccagcaccagagaagacagccccgguaggaaacgugcccaaggcaggggcuggccggagagcaugcggcacuguggcaacuuggccagcaagguauauuucucccucuuuuuccuuugcuguucacagcaccuagagcagggcguggcacucagggagcaucaccccacuaggcacaggaacgaauaaggcacgccggcuguuucuuccuccagaaaggcacuuaagguuuagcuuggcccaaaaagucaggagaaagcugagacucagguacucaacucacaccuuggagcugaggggccaguaagguggcccuagccguacagccccaccuccccuuccucagccuccuccagcuguggcccaucugggaccaccugguccaucucccuucggucagacuguggaggagagacucggccgugauccucucucaaccagggaugcaagaggauucccagggccacaagucgcucugaagguuccuugcggaggagacagcggaucagacagcgggcuggggcugauaggcccucaggcagggcaaaggucccucuacggaucuugccaaagagcaggacuggcucagagucguggaauggguaucugccagccagcauggugaagagcgccacacccaggcuccagacaucagccgcuuugccagaguaggauggccgggagcugaguaucucuggucccacguaggcagggcacgcaugcuugucccacagagagucaucugauccagucaucacgcaggcaucuuccagguucuccagcaccagcuucguccugggucacagacagaaaaaaaaaucaggucccacucagguccucuggaauagcagccuccucuccacucucugucuuguacacuguccagucugggcuaauuacuguccucaugccucugccuccugagugcugggauuacaugugugggccaccaugccgagccucaguuaguuuuuuguuuguuugguuuaguuugcuuuugguuuugaugggugagggucucacuauauagcccuggcuguccuggaacucacucuguagaccaggcugaccuugaacucagagaucagccugccucugccucuugagggcagggguccaaguccaccaccacuuggccucuuucuuuuuguauuuauuauauuuuaugcaaauggguguuuuccugcuucauguguuugggcaccaugaaggccagaagagccugucagauaccuuggacuuggacuuacaggugguuguuagcuaucacguggauggguccucucugacccacugagucaucuugccaacucccccaucccccagcacacacuuuuuuuuuucugagacaggaucucacuacauagcacugacuggccuggaacucacccuguagacccggcugaccuccaguucacagagauccacuuaucuuccccucagccaggauuuaaagguguaugcuaccacccccaaaauaagauauuccuuuuguccuuauuuaauuugaaacaggguccuucacuaaaccuguagcucaccaauugaauagacuagcuggccagugaucucuggggacccaccugucucucccccgagcccaguuguuagggcuacagauuucacggcacaggcagcggucacucagugcuggagguuucuuucccugucuucuuuugcugcugaggauggaucaugagccuugcacaugcuaagcauaagcuaugcuuaccuuagcucuuccuaaguuacucugcuccccuggaucucaguuuccccacuguggccuaccucucaagugugccucuggggucacacucaccucucacaguugcugaagacaaagcgacgcagcuugaggucgcgcaagacaagcccgugcuuguggcagugugccacggcacuagccaucugccggaagagcccggcagccucggacucugggauaccgcggcggcugcgcaccaggcugugcaaguccccaugggucuucgugaaaaagauguaaaggagccgagagcccagcaggaccucugugggacgggccacaugcugguggguaggcagccgggcauaaggugccagcaccgccugggccucgcuggcaggguacaccuggagacagagucaggaguaagcacaagggaccuagcaaaaugggacagccaacucugugagcugugagcuacacauacagaagcccuuguuuagcaagucacucacagccaaauaucaaccgaauauccgcaaagccacacaggucaggagaccccggggucacagggccagcaaguagcauauuugggacuagaacccaugcaccaaucucugcucuaagcugccacccugugugauuuaggccucagaaacuaggauguaacccacacagaaaaccacucguggaggcagaucaccaccauagccccccuucucccacacauccagcauaagaaaagccagcucaauggccugucugcagccccugcccagcugaccagacucacagccauugccccuguucucuugguguccacaguacggcacaagcaaaccccaaaccauauauuccaaagaaauaagaaagauagccgggcgugguggcgcacgccuuuaaucccagcacucgggaggcagaggcaggaggauuucugaguucgaggccggccuggucuacagagugaguuccaggacagccagggcuauacagaaaaacccuguuacgaaaaaaaaaaaaacaaaaaaaaaaaaaaaaaaaaagaaagaaagaugcuaaaauccagaguauuuuauauugcuaucuuggagaccaaacacaggaccagucuuugcuaggcaagugugggcugguauuuuagaagggagcaccuauuuuaaaaaguucgagccgugagcuggagagauggcucaguggauaagaacacugucugcucuggaagagguccugcguucaaauccuagcaacuacaugguggcucacaaccaucucuaauaggaucggaugcccucuuuuggugugucugaagauagugacagugugcuuauauauaauaaauaaauaaaucuuaaaaaaaaaugugagccugccaugguagcauauuugucuaauccccaguacucaagaagcagagccaggaggaucucugaguuugaggccauugaggccagccugaucuacaaagaaguuccaagcuagccagagcuacacagugagagucugaagugugggcccaggugacucaggaaaugugaccugaaugauccaaagauacguuuaggaaaagcucccuguguugggggcauaugcagugcaaaggcccugagguaaucaagccaucaaccugcucucaaauuacaggcaaagcuugcagguggucaggaugaggagggggggagucauaugggggcacagugaggcagcugggaagugugcucagaguuuguggauacacuggaggccuucuaggagcuaggguuucagagcugaaguguuacuuuauugcuuuugacuuuaaacucaggcauuggggguggggggugggggcugaaaguaaacaaaacaaaacaaaacaaaacaaaacaaaacaaaacgugaucuuagaagaaagagcuaggguagguagcaaggaggaaauaaauacacagacuacuuuuucauucucucccaaagcuugguccugucucagcaccguuggaucucuuuauuugggggaaagaaggggugaccuuucuuuucuuuucuuuucuuuucuuuucuuuucuuuucuuuucuuuucuuuuuuuugagacaggguuucucuguguagcucuggcuguccugauacucacucuguagaccaggcuggccuucaacucagaaaucugccugcccuacacagagaaacccugucucgaaaaaaccccccaaaaaacaaaacaaaacaaaacaaaacaaacagaaaucugccugccucugccucccaagugcugggauuaaagguguaugccaccacugccugguggggugagcuuucugaaacaaggucucuuugugucucccuggcugcccuggaacucacuauguagaccaggcuagccuugaacuuacaagauacacgugucaagcgcugcuguuaaaggugaguaucacuauggcuggcccuuuguguuuccuguacccacagcggggacacacugccuuuggacccuccucccuaagccuccuucagcuccugacaugcauggcccuuuaucaucugcaaagcccucccaggcuuccuuaaguuccccugcaucccugcaugucuccuccucucuuugcuucucccugcccucugacacuagcuucauuuccauaaugcucuucauugccugggcucuucugguaugugcacaugcguguguucuuguggcaggcagaggaaagucucuggugucauuccucagaugccacccaguuuuugucuuaggauuuauuuuuaaucgugugugugugugugugugugugugugugugugugucugucugucugucugucugucugucugugucuggguauaagcacaagugcagaugcuugaggucagaggcccuggaguuauacaguggugagcugcuucaagcagaugcugggaacagaacuugggucucugcaagaguuucacacuuucuuaaucacugagccaugucuccagccccuuuaguccuucccuuucucucuucucucuaccugagauagucucucacugaccuccgaacaaacucgcugaauaggcuagcuggcugaccaguagucuggcuccagagaucugccuaucuccacuuucccaguacagaauuacaagugugcaagcaagagcacuggaucuagacuuggguugauuuucaggcagguucucagcauguauguacucuaggcuagccugaaguucagagccaaccuccugccuuagccucucuggugcugggauuauaggcaugugccaccacaccccacuugggucugguuuuuuggcugcagcaaaugcauuauauguauaguacuccguggaggaaugucaguugaggaacccagugauaaucuacaagguuagaaagcuacaguccucuggauuccgggccuuuugcagagcccugggaugcuagaggggagagcccauagaauauaccuugcagguguacucugugccuguggggcagugcagggcucgauagcugcagcugccuugcucucguuccaaaaggauauaaggccccagucgaguugcaggggccacagcaggugacaagucugaggcgggaggugggcuggggggcagcaggcuggggagugguccgggcucaggcucaucucucacucguuuuaggacuggacacuuggcaucaauauugucaucaaacuccaacgguuucuuccugcaggaaacaucagcagaagcagccagagguguagcucgcaucuagagagcaaggaagaaagacuguuugguauccugucuucucugcuaggaccuuccgaacagagaaacaccacacuggguuuuccgaagcucucaaaugcaaggacugcuagggaaggaagggacccgcgacgaaugaaagguuuaauaacgcaauaaggagagcugagcuuagggacgcaccccugcuucgccagcacccugggggcugacuggugaauugccagucagccugggcugcauaauaagcuggggucgacagcucaggcugagggcgcccccagacggcgaaguaaaggagcgagagagugagagugagaagagugagagugaguaaaagagagcgagagcgagagggagagaacgagagagagagagaacgagagagagagagagagagagagagagagagagagagagagagagagagagagagagagaauagaaauauucaugaauacgccuggacuuccagugacccucuugccagacccggguaaaucccccuucgcagcucccuacuggguaccuuguccuggagccucagagccgccugcgcccacgcccguggaccgccgccagccuaacugagcagcucucggagucuccugcacgcuagugccagaccccagccgucacguacucggcagcagccucuuccgcugcuaaagugcugcggcaccgggacgcgggcucggauccccgcccggcugauguaaaccugagcuaaucugcug

SEQ ID NO: 1172 - RNA, 7888 nt, Mus musculus
uggugguaugcaucaacuguuuauugaaaggcgaagcaagauggaggaggugagaagcagggaccuggaaaguacaaccagagggggcacaaagguggugggaagugccugaacccucuuccucccacccaggaagccccgugggcuugcaagggguugccagagacaggauccgacgcuguccuagagcgcccucuagcguccuacaggaggacauacuuuugucuggaccacccauaggaagaaagugcugggaccuaaaggagugcacacagguuuauuaggcucaggaucaaguccagagggcauugcugucuaggggguggacuuugaggggcaaaaacauuccacuuuuccuaauccuuggaauuuauauuuuuauuaccuuucuuugugauuggggguuaggggugagggucaggggacaacuguggggagccaguucuccucuuccaccuuguaggugugagagauaaaacucagaucgucaaucacgccaggaaggcccugggccuuccugggccguuucugagcccucucugggucguuucacgagucugaaugagcaguucuugguugaguuugcuccuauccuggacaggggugagauuggagcaugggacuugauuuggggggaguggggagcuauaaggguccuagagagauuggcacuacugagaggaagaagucaaggugaugaaagcaaggagugccaggcgggaagggucugacuucuccagccugcagacuuacaagucccgcuggggcuggcuggucugcacagacugcugcccaaaagggcugggcggggucaagaacggcgacugacuacuggucucauggaaggccggggacagcuucucaggcucaucccugaauacuuccacggggcugucaguuucagugacgaggggcucugccuugauguccuggaacauccaaccagaggcgaucaagaagaggcagacagccagcaugauccccgcuacuccgcacagcgucgcuccuaccacacggcaggucaugagggcuugguuguagucggcuacuggauccuccaucgaugagaacuuacuuucauuaacaagcucuaguuuggggggcacugcauagccaguggucaaggcugccacacccagcaggagaaacagagaggccacggccacggugaccugaggagaagcagacggaucggcaaggauucaggcucaacuguggccgggggucauaagaucaugaaaugggccucacagaacaucccucugggacuuaauugauagagaugggaggagaacccaggguuuugcacauggaaggggcaaacacucuacuauggagcuacaccuucagcccuuuuugaauuuuaguuugagggcagucgugcucugcuacuggggauagccuggaacuuucuauguagcccucgauggccuugaaagcuugccuccuaaguauaggaauuacaggcaugaaucaccauacccacccuagcaaugguuuccaaagcuaaccuugaguucuguccauuguuaucuaggcucuauuauuauuauuauuauuauuauuauuauuauuauuauuauuauuauuauuauuauugaguguguauguguguguuguaugaaggggaguguauauaggacauauaguagcaaggggucaaccucugguguuucucagaaacaggaucucucaccaggacccggaacugaguggccaguaagccccagagauccuccugucucugugucucuuuucacuauuguauuuauugauuuugagacaugacuucucuacguaggucuggcuguccuggaacugcuauacagcccaggcugaccuccaacucaccaaguuccagcugccucuuaagugcugggauuaaaggcauguaccuccauauccagcucuaccuggcauuuuuauguggguacugggauugaauggagggcaagcacuuuacugacugagcuauaucccagcucuguuuggcacuccuccuuggguaccaucugaccccaugauccuuuucagccucugucucuuuccuagguugaugcucauacauccucaaaucucaucucgaaccguuccucuaaggcaccuucccggagacuugggcucgggcaggugucauuucucuuuacaaagcccagagccgagugacccuuuagugcagccaccucugaacagauuuggccauggauuuuaguuuuuaggugagugauggcugccuauuuuacuggacugaacccuaugagaacaaagacgggacauguuuugacucacugggugucuugugcucgaugcagugcuaaguacuaguugaacaaugaaguggaccauacaugagaguucuuaaagugggagguugggggauggcucagggguuaagugcuuuccauggaaacacaaguauccgaguuuugauucccagcacccauauaaaaaaaagcuagguuugggucagggcaugguagaaagaacaugacuguaaucccagaggcuggcuguuuucugugaguucuaggccagcuggggcuauuguauacagugaaaucuugccuuaaaaagccaggcaacauaugucuauaauucuagugccacaaggguggagaccuccagagcucacugacuagacgaauucagugaaagacugucucaaaagguaacgugaagaaaaauaguggaagauaucacaccuaccuccccaugugcacacacagcacacacaacaccuaccuucccaagcauguauacacauguacaaucaaacauguacacauguuucaaaaaaaaagaggacaaacaagaugucucaguaggacaaggcacuugcugagcaagcccgacagcccaaguucgagcccagucagccauguaaagguagaagcaacuccacagaguugcccucuaacccuggcacacaugcccauguacacucaucauucacacagagauacaauaauaaguaaacaaaaauuuuaaaagaggccgggaaugguggcacacacguuuagucccagcacuugggaggcagagguugguggaucucugugaguucaaggucagccuggucuacagagugaguuccaggacagcuagggcuauacagagaaacccugucuuaggaagaaaaaaaaaagauguuagcuaugucugguggcguuuguaaucucagcuaucaggagacugaaauagaauaauggccaguggaaggccaaccugggcuacagagugaguuuaagguuaucccaggcaaauguuggaagcuuauuuaggauguuucagugcaaucccucauaacauacacacauuuauccccccgccccccacacacacgaguuagcaccuugccucaccauuagagcggagccccuugaaagcagacggagggacccuuggcuucaguuucucuacaguauuuagugaagaaguauacaaagggacuacugauugacaccucaggcuguuaugagcaucaguuguguguuucucacaugucucuucugccugccaaugguacccacagugggaaaccacagugagauguaggugagaugaacuccacauccggcagcuguguuuccccuccaaagccgugauaauuagcacagcguuggcaaauggcccaaagagagucagacuucuaggaacaaaaugcuuucauuccuucucgauuuaauuucauuuauucacuuauuaacuuauuaauuaauugauguauuucaaggcggggggucucacucaguugcucaggcuggccuacaacacacuauuucuauuccaggcuggucuugaacucaugaucccuccuccucggcuuuccaaaguguagaccacaguuuuauuaugccucccggaagucaguuaauuucuggcauuuuuagguugaucuuucuuucuaaacagauguagcucaggcugccucaaauuugcuauauagccaaauacgaccuuaaaacucuggucccccugcgucuaacuuccuagggcuaggaucaaagugucaccaauacacucaaguuuaugccaugcugggauucagacccuggguugcuucauugaugaccuagaacucacaggaaguagagagagugacgugacucuguagaguugcccucugaccugggauuauccgagaagacuuccuggucagaguacuuuaggcagaacuaacucucucucucucucucuguuguauauaccuguauauacacaucuguugcauguacauacaaaugcauacacauguuggagauugcuauggugcugcuauguauucaaaugcuaaauuuuguaccccaagaucugguugcucccagaugacagaauucucacacauaccacuuuuguugcacaaaccuugcuccccaauuuaaagccguagauuaaauauaaguggcuacagccaauuacuggggagaauagaggugggugggguuucagggaccaugaggagagaaggaggagagagaaggagggagagggagaaagaagagaggaacagggggucuccauuagaugggaugggccaggaaaauguggccaagugaacacgcccccugaggacagacugcuggaacagaaauaacucuggugagacucaaacagcaguaccuagggagcauagcuggagaauuaaacagucuagcauacagaagaauagacuagggauaauuugcccaguaauugugcuacaacugauuaaauuaaguccuuaggacuuugccucaauuauugggugggugggggcuggccuggucauauuaauaacuaguaguuauuauuaaauaacauuuaaaaaccguuacacacacaugaacacacucccgugaucgugcuuuuaaaagauuuuucaguguguuuauuucauguguaugaguguuuugcuugcaguuacaacugcagcacacgcaugccuagugccuguggagaccaaggagggcauuggguucccugccacuagaguuucgacugcucgugagccaccaugugcaugcugggaguuuaauacauaaugauguuuuaaucauuuuuuuuuaaagggccaugagucagcacuguagcaccgagaagcugggcugugugaauugauaacacaaggagcucgcuugaagacuucagaagaagcugguaaacuuauuagcccuuggcuggauccaccucugccagaaggcauccaaccuccggucucuguugucggaaccuauucacaccguacuuuuggcccuugaacaugaagacuccuggccacccuagcaucucucuuauagccaugaucuggccucaguccaacgccaccuucuccccaaagccacaggugccaucccuuuguccuuaccuuccaacacagugagggccagggucgguugauauaccgaauggggauucucucuggguuauaggggagagugguggugcccagccagucauuguagaagagauuaggauagaagucaaacccauaccauguacuuuccuccacacuggugccaugacuacagacacaggggcgacugcagcucaucacggaucccugugggcacagcaacagagggaggucaguagaguugccuuucaucccugagugagguccccucuccaccucucugucaccucgcccucacaggccaccuacccuuucagcauccuuccuuaaguucgugcacgagccaggaguuuuccgcuuaacacccccccccccccccguagcugucuguccgccugaguguuuucucugaggaccaucuggcaucuggaauguggcucuggagccucacugucggacugagucccagggcccacagcgucuuugaugugacuuuagauuggguccugaccucucgggcuucccuuguuggugaaauagaacuaauaacgaccuugucugggaaauagggcuaacgaugacagcuguuucacucaaugaucuucuguaauuuuuauggcauugucuucuuccaauuuacuuacuacccgugugauguacacauaugugcgggcaaacccguguagaagugaaaggaaguguuucagagucaccucuccccuuugaccaagugaaucccccagccaucaguuuggcagcagcauguguccuuacccccaugagccaucuugacaacuccaauuacuauucuuuguuuuuguuuuuauuuccuuccucaacuuuuggggcucccauguuuacagugagagauccuuauguucccccucaaaacuucuguccuuuuagaaccauuucucgggguaacuuucauagacgauacucgugcaguugggugggagucuucacacuguauaguccuaaaagccugaggcagauuuccccuauacacaagucccaaggaauugugaguucaggauuaagggcucuugguccuuuugacuacuagauuuccaggaagaccauuuaggaacccacaaaaggagacucugagaucuuggggauggaagggaccuguguccaucgagguacuggggggaaaaacguggcucuuucugcugcuucauucccaucucccucagcgccacgugcagcuucaaccaaaauaaaaccaguggacuuguucugauggagccuucuguccuucaaucagcgagacaccagaaucccugcguagauacauacacacacacacacacacacacacacgaggcacacauaggcacgggagugcugacgggaucgugacuguccacucgccccacaauucaagggaaggaagaaaaauaggaggaauaaaacaacaacaacaacaacaacaacaaacagccuagagaaugauaaaugguagaggccaaggcacagcagugaccuaaaaugagggccagauaacaggacugcaagagaaggugggggcagcgaugcggccagagcagagaucucagaggcccuguuugggagugcgcuagugaggaaaaugaacgaggccugaagacgccacaaccagagcgucaaauagaggcccagaaggggcggggagggauacagggacaaagggccagagucagccccuccccuguaauucuugcucgcccugccuccaaaugcaaagggucuguucauccagcagaugaugaaggaaggugaccuugacugugcguccccucugccuggccccgccuccucccaucuuaggguggucugaagcaggucugggaguggaggaugggaagaggacagggagcgacaggaugcugaggagcccgcgggguugccauggaaacauccaggaguguguuccugaccugcaaagggagacguuuaaugggaaaagagcuggaagaggaagaagcugcgugguccaggaaaagagacuuuaaugcuagggacuugucucgaaggagacaaaccugugggccacaggacgcacaaaaucuguccuuaaguccgcucacuccagcgcagcaggaaggaaagcccuccuugugcgauggcuagaggagucaaaaacaucagccacacucucugaccugaccaucucugacgaaauaaacugcguacuuucccugaaaggaaacugaggcacagagaaauagaaaugaguuguuagaaaggggcgggugaacucauucugugaagccucugccuugucuauaagcccuggggugucgaggcccucagugccaagggacucuguagcacuucacuucccaaagccagagcauagggagcagaugugccagcucugacaggacacaaucauacuggggaugccagaggugggcaggggcgcuaaggguaggggagccagccgggcggggguugggccgcaggggucugagcucaccucuggaccugcgucuccggagccaacagaagcugucggagcuggagcagagcagagcagagcgaguuugcuucgcgccugcgcuacaaucc

SEQ ID NO: 1173 - RNA, 3075 nt, Mus musculus
auacgaaagauaaauauuuauucagaacaaaucuuaacaauugauuuuacauucuaagccacgaggaaauagcaaaacagcaaagagaagacaacagcugaagaaaagcaguuuaucgaauuucaagcuaacuuggugacaugucauugacccaggcccuggccuggccuggccuguuuccccaagaacgcuuucugguuuaccacucacucgugauucuggguuagaaccaccuuucuccugagggucagagguuaaacguugugggugagcuucucuaggguuccuaguggcugaggcagaggugcaaauguaaacgucugcuaaguuucuuuacugaggggaaccguuucucacuggugacagugauaguggaaagggauggcccuggaacauucaagaugugguacuccgagggcugaugcaagcagccuggagugcuccuggccccuuccuucccuagcucccaagcagcagggcgagcuuucugggcucuuucgggaugauuucuccacacugcugggguccgcacgguggagagcggacuuugggcccagcagugucgaggagauuguugugaagugugagagguagugggaugagcaccgggcuuggggucaggggacucuacugugggcuaucugaggcaccgcgcuguguacuuugucccuguaauuuaacuucucuggguucacuuuaucugcuggaaaaccaaaagguuaguuuaaaacaccguccggggaggcaaaggcaagagucgggagggagaguuacugcacguuugcagcuagccuguucucugaaugcagccgguccaagccggccuacgggagacacacugagacccugucucaaaacacaaaaccaaaagcaacccgccucccaaacucaacaaaaaccaccucuugggucuuuuccagcagggaagccuaggcucugugaucuuguagaaacucggcuucuuagccaccacauggagcugucacaauggagggacauuuuuuuuuuuuuuuuuuuuugccacgagaggcccuuggccaccauucagagcuuauucagaauacacacuucuagcaacacuguuuucacaaagucugauaccacagagaagcagcaaauaaaaagggcccagcagagaguugcaaaagguagacacuuuugacagaagccagucgauaccguuuugauucaaugaaagacuugauaagagugucuaucccgcguugggcccaguacccugggcuggaggcauaaugaccaaggcggcccaaagggcuaaaaccuuuuaaggauuaaauguaugaggagggagguaguaaaauaaaaaguagaguggggaggggaguagacgaaaguaccaaaaacaaauacaaaccgggagaaaaaaaauauaucuguaugcaaugguucugaauaguucuuacgggcaaaaauucaccauuucaaacaugccaaaaaggagcacacgcgguuuaaaaaaggcauagagagaacgucucugguagguuuuagaaauaucuccauucaaaacgauuaaaaaaaaaaagguuaaaaaaaaaguuuuggcacuuaagggagggguaagcuggcaguguauucacccuggcaggcagucgcgccuucagugccccgccacgcuggugagcugagcugucacggaauugugaacugcuuugggacacugggcaaaggcguguccucuuuugccacagagguugcacacgaugaccuuccggcaguaagggcucaggugccccucuuccccgcaccugaaacaccuguccugcgugcaggugccgcucauguggguccgggaaccacacuuaaagcacgucuugggcugccccuuguaccagcuguagccccucuccgcucccaagaagaaggccccgggcaggugccucacuccgcccucccccuggcgcagcucgaucucgcacuuguacuccccgguccagaucccgaaccugucggucacuuucacgggcacggccagcacgucgcaguggcgcuugagccaggucacgauguccuccacguccacggucucguuccggaagaggaugaagagggucuucaggcuggaccugcuccgccccaaaaccacaaaguucucccagcaguccuccagcucucgcuucuccucguagacgcggagaaacagggcuagcuuuucggcggaucggaaacucacgucgaacucgcggcugccggggaucugaaugaccgcguagaugucgucaggguccaugccgauggagcgcaggaugagcgcgcccaccacgaagucccgggucggacaggcacuuucgucucccuggaaacagaugcgcacgaggaagcggcccuuacccgggccggcagccgguggcucguccuggagcggucgcucgguggcaucuucggucgugccgggccuggcgggggucgccauggccgccgucaccucggccuucuuccuucgacucgggucucccgcgccgcucgcgcucuuuuuccuguaagcgucugacgccucacccguagggucucugcggcggcccuuuggguccccgcgagcggcgggugggaagucgccgggguucgggguggccaggcccccggggcugccgagcccgccacuugcaccgcugccaguuucgucgcgccgccgcggcucgcggaagucgcccuucuucuccgccagguucuugaccaccugggcccagcccaucuucucgcggacgcccucggguuccucgacgcgggccacgggucgcgcggggagcgggagcugaggccggccccgcugugacuccuccuccgcuccgccgccgguggccauguuaccucuuucccagcauccuccacucguucccgcgguccgaggugcccauggcgcgcucccgcucgggaugagggaugagggccgcgggcugcgugggcgacuccccgcccccgcucugaaacccgacgcuucuggcuuccgcccucuuggaagucuugcgugcgggaauucgugccggccggagacggcucgucuugaccccggcucgccuccccucugcggacgagcgcccgcccuaccgcucucga

SEQ ID NO: 1174 - RNA, 3075 nt, Mus musculus
ucgagagcgguagggcgggcgcucguccgcagaggggaggcgagccggggucaagacgagccgucuccggccggcacgaauucccgcacgcaagacuuccaagagggcggaagccagaagcgucggguuucagagcgggggcggggagucgcccacgcagcccgcggcccucaucccucaucccgagcgggagcgcgccaugggcaccucggaccgcgggaacgaguggaggaugcugggaaagagguaacauggccaccggcggcggagcggaggaggagucacagcggggccggccucagcucccgcuccccgcgcgacccguggcccgcgucgaggaacccgagggcguccgcgagaagaugggcugggcccagguggucaagaaccuggcggagaagaagggcgacuuccgcgagccgcggcggcgcgacgaaacuggcagcggugcaaguggcgggcucggcagccccgggggccuggccaccccgaaccccggcgacuucccacccgccgcucgcggggacccaaagggccgccgcagagacccuacgggugaggcgucagacgcuuacaggaaaaagagcgcgagcggcgcgggagacccgagucgaaggaagaaggccgaggugacggcggccauggcgacccccgccaggcccggcacgaccgaagaugccaccgagcgaccgcuccaggacgagccaccggcugccggcccggguaagggccgcuuccucgugcgcaucuguuuccagggagacgaaagugccuguccgacccgggacuucguggugggcgcgcucauccugcgcuccaucggcauggacccugacgacaucuacgcggucauucagauccccggcagccgcgaguucgacgugaguuuccgauccgccgaaaagcuagcccuguuucuccgcgucuacgaggagaagcgagagcuggaggacugcugggagaacuuugugguuuuggggcggagcagguccagccugaagacccucuucauccucuuccggaacgagaccguggacguggaggacaucgugaccuggcucaagcgccacugcgacgugcuggccgugcccgugaaagugaccgacagguucgggaucuggaccggggaguacaagugcgagaucgagcugcgccagggggagggcggagugaggcaccugcccggggccuucuucuugggagcggagaggggcuacagcugguacaaggggcagcccaagacgugcuuuaagugugguucccggacccacaugagcggcaccugcacgcaggacagguguuucaggugcggggaagaggggcaccugagcccuuacugccggaaggucaucgugugcaaccucuguggcaaaagaggacacgccuuugcccagugucccaaagcaguucacaauuccgugacagcucagcucaccagcguggcggggcacugaaggcgcgacugccugccagggugaauacacugccagcuuaccccucccuuaagugccaaaacuuuuuuuuuaaccuuuuuuuuuuuaaucguuuugaauggagauauuucuaaaaccuaccagagacguucucucuaugccuuuuuuaaaccgcgugugcuccuuuuuggcauguuugaaauggugaauuuuugcccguaagaacuauucagaaccauugcauacagauauauuuuuuuucucccgguuuguauuuguuuuugguacuuucgucuacuccccuccccacucuacuuuuuauuuuacuaccucccuccucauacauuuaauccuuaaaagguuuuagcccuuugggccgccuuggucauuaugccuccagcccaggguacugggcccaacgcgggauagacacucuuaucaagucuuucauugaaucaaaacgguaucgacuggcuucugucaaaagugucuaccuuuugcaacucucugcugggcccuuuuuauuugcugcuucucugugguaucagacuuugugaaaacaguguugcuagaaguguguauucugaauaagcucugaaugguggccaagggccucucguggcaaaaaaaaaaaaaaaaaaaaaugucccuccauugugacagcuccaugugguggcuaagaagccgaguuucuacaagaucacagagccuaggcuucccugcuggaaaagacccaagaggugguuuuuguugaguuugggaggcggguugcuuuugguuuuguguuuugagacagggucucagugugucucccguaggccggcuuggaccggcugcauucagagaacaggcuagcugcaaacgugcaguaacucucccucccgacucuugccuuugccuccccggacgguguuuuaaacuaaccuuuugguuuuccagcagauaaagugaacccagagaaguuaaauuacagggacaaaguacacagcgcggugccucagauagcccacaguagaguccccugaccccaagcccggugcucaucccacuaccucucacacuucacaacaaucuccucgacacugcugggcccaaaguccgcucuccaccgugcggaccccagcaguguggagaaaucaucccgaaagagcccagaaagcucgcccugcugcuugggagcuagggaaggaaggggccaggagcacuccaggcugcuugcaucagcccucggaguaccacaucuugaauguuccagggccaucccuuuccacuaucacugucaccagugagaaacgguuccccucaguaaagaaacuuagcagacguuuacauuugcaccucugccucagccacuaggaacccuagagaagcucacccacaacguuuaaccucugacccucaggagaaaggugguucuaacccagaaucacgagugagugguaaaccagaaagcguucuuggggaaacaggccaggccaggccagggccugggucaaugacaugucaccaaguuagcuugaaauucgauaaacugcuuuucuucagcuguugucuucucuuugcuguuuugcuauuuccucguggcuuagaauguaaaaucaauuguuaagauuuguucugaauaaauauuuaucuuucguau

SEQ ID NO: 1175 - RNA, 1451 nt, Mus musculus
augcagccugaauaguuuauucauagauuagaucacugaggcccggagagaugaaaugacuuuagacuaagugguggaugaguaacagcagguugauggacagcauccucuuucugggcgugguuuaccaggggggagaagauguuggagcgugccagcauggccagaggagucaagagcauggaaaaugucucuuucggccaauuuuccugaggagccguggcugaggcucagucugggaauggaaaguguucagggaggaggcgcagccguguccaguguccauccagaaagacuguuugcaaaguccugcuauaagaggcaaggggcggggacugucaggcuugcagggggaagggcagauccuggaggcaacagaucuggcaucugcccagggagaaguguccaaguuccuugcuuccucuuuggguuccugggcacugucauuucaucuggugccccgccuguuucuccaaccaucagcugucccugaaacccagaaggccaaggcuguggagaccagaaaggaagagugauuaucccucugccaaggcuggacuugagagcuaucaguuaagccagaugcaaccugaucucucuaacaucagaaagugcagugccccugaccuccaccacaacagacacaagcaaggcuuuuguuagccucgauacaagcauguggucauacuauguaggcuggaugggugugaauaaguugauagggugcucagcuaacauucaugaagcccuggguccaauucaaagcauaacauaaacuagauguagggacauauaccuggacucgggaggagaaucauaaguucaaagccagccaugucaauauaaucuaucuaaaaagaacuaucccaaagaacaauuacaugagguccugguaauuauuaauggcucuaucuggaguuccuggugccacucaccugaaacaaugaacacuccagacucuuuaagaggaccccucucccagaccuccucacagcuacagagggcacugucuggcacaugaguaucauuggggcaguaggaaccaucaguaaggguucucgggacaguuguugacuugucucauuaauuuuguaacaucccuuugguuuccaauuuguuucucaauuuacaacugaagggaccuuacacaaucuuugaaauuauccagauagggaggggcacagacaaaaacagagauuuaccguuauaccgaaggucagccuacgccaaggucuugguacacugggucccugcugccugacaucucaguugagcaucacugcaucuggccacacacacacacacacacacacacacacacacacacacacacacugaacuuuagcaguugguggcagaaggaagaggaggggaggaagaaucugccucaagguagagcugauagccaaucacuugucucuuguaccuggcagccauagucauggcaacug

SEQ ID NO: 1176 - RNA, 1960 nt, Mus musculus
cccagugcucaggaaucugcucuugugaugacugcagaggcagcucccgugagauggagcuuuggggaagggaggagugaagagcagcaauacacagccuccuccuuauccucagggcaccucaaaacuguauagcacggcacguugugagagccgugagagucuguaaugguuagcaguacgcagugugaugcgcuggaucaaggaaggcuucauguggacaguaagcaugaucuugguauucagaaugcauggcauuuaaaaccggaguuuuccauucaauauuuuugggugugggcaacugaccucacagaaggcaaggcugugcugggcaugggguaucuagguauagucuguuccauccuuaagccacuccccuuucugcuuucacuaacgacuaaggaaaucagagccuggagcugcugugaccuggccugccuccccuagacgagucuggauucccaccgacaccggcacgcccucagccuccagcccucaugcuguuccugcagcccaggccugguuuuuauacugucccaggccgagucccggcucuaggacccacucgcuggguggcaccucggcucaggcuuccucaugagcucucucagguuacagagccuggcaagugcacugugcccgucagacaagaggggaagcaaucccccugcucagccccuaauggcuuccucucuccagaccucuaagaccccacgcuguucacugugguggcucagucucugcugccuaccuuggugggaggaggcaccugggucacccaguccugcucucuguucacuuauguuagccugccugggaagccaucaucucuucuccagucucuucccccaaaccuagaauggccaugugacacacugucugcuuaggggccacauacaggcagaaaccagguagagagcucugacaagaugucugcuuuccugaugaagacagugcuuguggcagcagcugccacaccggcacaagucaaagacaauaaauaaaaaccgggauugucuuugcugccaccaccgcagggugcuaaccucuggucucuaaguucugcacugucaggaaagcgcucuggaccucgaggacgcgcugcucaccugggcgugcuugaagaugugcaugaugaagauggugagacccaggccgaagauguaggcggcgaagcugguguagaaguaggugugcguguucuucuucaagcugcagggaaggcggaaggaagagguuagacgaguaacauccuuucugcaaagacugaagcugcauauguguguggggagagucucugccaggcgccuggacagcugugcaccuuggccuucccugagcuaugucucuuuagauaaguuacccuucuuccaugcuugguuuauaccuuugcaaaaagacgggaaagccauaggccauuuauaaauaccaaauguaaaaaucuagaaauggcucuaagagguuuuuauuguuuguuuguuuguuuuucgagccaggguuucucuguauagccuggcaggcucuaagaguuuuagccagcacaaaaaucucuugggggaaaaaagguggcucuagguuauagccacagaauguaaguuugaggcgaggcucagggagucugcaagggccugagcuggguccugugcaugcucugagcuccaggccagccuuaugcuuagcuucugcgacagucugaaaagagcccgaggagggagaccucagggaacagcuagaccugaaugcaguggcucaaguccagccugacaaagacgggcugcagcuggcuuucccuaccacugaggucagccugugcucagugcucugcccgacuuggcacagcagacccgagagggaacucuuguuuaccaccauggauaugagauugagguuuacaaggucagacuggccgccaagggcacagagcuacaaauaccaaucucagauaaaaggaauuuucuuu

SEQ ID NO: 1177 - RNA, 3095 nt, Mus musculus
cuuuuuuuuuuuuuuuuuuuuuaacaggaucucacuuucaugcagccccuguuggccuggaacucucuaggcaggccucagagauuuucaguaaucguccagaaaccuccccaugcuggaugugaggccugugcucuguuugcuuugguuugguuugugcaguguucagaauggaacccaguugugcucuggcugugcucugcccccagcuacacugcagcccgcggauggugcuuugguauggacaggacugcgcaguucggaagugugcguucugcuggugguuccggugcagggaggagggugggugagucugugugauggucggguuccugggauagcugcauguucugugugaguggcugggaugaggaagaucggucugugguuugacguguccccuccacaguaucuuuuccagugugcuggcuuuguuuguguuuguguaugcacgcuaacuauguucaugugcaucuuggcagguccuuugguuguauguaugagugugccgcugucacgcuggcugugucuguugcacacucauguggugcugaauccguacauccauauucugcugugagagucacuggagauuggggggugguugggagcagcccuuuguccagcuacaggaaggccccacccccuucaucugcagggacucugggaggggcccagacugccaggcuccaaacucccucccauuguucuagggccucuuuggaaaacuggguggaaggcaaaagguggguccaggccugggccaucacacucccuagaaucaccagggaagcagccuggaacccuuacggggaggcuggcuauggguccauugugcagauggagaaguugagucuagagcagaaagggcugguuccaugaguaguaaggccagagagaucacagccuuuacacccuucgugugaccacugcccagccuccugaugaaguugggggucuagaugagucagacccuaaaaagucacagaacuguuuuguuggcucccauuucagaauacuucuuguggguuaaacauuaacccuaacucuggguuaaguucaacguuugaaugugucuuguuucucuguuacucuuguuuauuuagugcgcuugugguggagcggaggacucuugcuauagcacucauguggugggccgaggacggcugggaagaguugcuucucuccuaccauuuggguaggccacaagaauagguccucagggugucagcuuggccccaggcaccuuucccacugugccaucacacacguccaaauucaacuuuuauccucauguuguaaaugaggaaaccgaggacuuagaggaacaauucacuaguuaacuaaaauuaucuaaaaauuauucagcuccaaguauuggguggugugacuuugagcagauugcuaaccuuuucugagcucaccgauccugcuccccagccuccucaaggggguuguccuccccaauccaagaugaccucaaaccuuaagccuccagcugccucuaccugauuccugggauuacagguucagcaugcccuguaaauccuacuugcuuuccuagaacucacagccccacgggugggggaugggaauaggaaauggauaacagagcacaagacaacgaucgcuuuagauaguaaaagaaaauagccaaggguguccugaggucuccaucgaggaggugaccuuugaccugggaccucagggugacaaacuagcagagaccugguugguaagugcucuaggcugagggcacaucuagggcaagggucuugaggccggauggagcugguuagaggaagucaaggggcuggagagggaaaugggaggacaggacguggggugaagugggggggugaguaaagggggguggaguuuggguucuguucucaaggagaugggcacagauacaguguuuggccaggccagaguccugggguggaaugggggaaugcucucugguuacaaucagagguggggacagccagagcccaaggucuuuccccaaaguucccucagucccagcccagaggcgccggccuggcugcuggaagacuucacugugggcacauauggggagcagcugcggggccagggccagaguagaucacgugacacggacaggcucgcccuggagccuacagagccaagacucugagaaaaggcaguugaagaguaucuggaaaugcgcauguccacagagauaugcucugcaguguggacuuauauguaaggucuccccaccccccacacagggagagaacaccaucuccacacugugugaucugaagcuacuccuuacacagagcagacaagaagugacugcuaccucuggaggcugcugacuccucauucagagacaggcccugagaagcacccugagcuacaggcuggguagaggaccuggaugccugccuucagagcacaggcuuaggcuagugcuuagaauucugagugauacugagggagggagcacuaaguuacucugagcuauuggcaugacagacagggacaggaaccagacugaagaagcuuucccuagcaggugugacugacugcacaccugcagcccucccuaaauagugccgugccuucauucaguacauuucuccauagaggacacggaggcuucaucuugauugucaacuugacuggauuuagaauuacuuaagagacacaccucugggcauguccgccagagucauuucaaaaaccuugaagggggaagacccagggucccagacugaauacaaagaggcaaguaagagguugaacuaugcagcugccuuggcucugagcuucgugacuggauacaauguguccagccuucacauucacucugcguggccuuucccacucuuaaccuggggccacaagaaaccaguccuucccuaaauuguuugguuagauacucacucucucacgggccugggaaaaguaacgaaugcaaucaaccacccagccaggaaccuucaacccugugagccacagugaugcacacaccuauagucccagcagaggccacucugauagucucaguguagugcagucccagcuauacuccaaaagaccaacuuagaucacacuuccaa

SEQ ID NO: 1178 - RNA, 1289 nt, Mus musculus
cucucauuguacaaccuuucuucaacuucuuguucucuucccacacucuguucucagccuccuccgcuccccuccgccuguucucaggaucaugaaggucgccaguggcagugccgcagccgcugcaggcccuagcuguucgcugaaggcgggcaggacagcgggcgaggugguacuuggucugucggagcaaagcguggccaucucgcgcugcgcugggacgcgccugcccgccuugcuggacgagcagcaggugaacguccugcucuacgacaugaacggcugcuacucacgccucaaggagcuggugcccacccugccccagaaccgcaaagugagcaagguggagauccugcagcauguaaucgacuacaucagggaccugcagcuggagcugaacucggagucugaagucgggaccaccggaggccggggacugccuguccgcgccccgcucagcacccugaacggcgagaucagugccuuggcggccgaggugagguccgaggcagaguauuacauuauucuucagugggaaaccgaggccacgggaggcgggugucccccuuccuuacuuuucaggcgcauagcuauuuaggggcgacuaauaggaaaaagcucgcauuuucaucgugccuccuggaguagagaaaugggaacgccucuccccuccuuguccuuuccagugggucucaucccuuaucucgcucugguguucacaggcggcauguguuccagccgacgaucgcaucuugugucgcugaggcggcgcacugagggaccagauggacuccagcccuucaggaggcaagaggaaaaaagugcucucgguuccccaggggaucucugggaaagacacuaccgcagccaccggacucuuggcggaucgguccaguggguagaggguuugaucaacagagccucacccucuccaccuuucagccuccagagacuuuggggaggggguuaaucaaccccgcguguuucuguuuuauugaaaaagcagacauuuuuuuuuaaauggucacauuucgugcuucucggauuucugaggaaauauuuuguauuguauauuacaaugaucacuggcugaaaauauuguuuuacaauaguucuaugggggugaguuuuuuguuguuauuaaacaaacacuuuagauaacguugcugugacuucuuggaugggggaggggcgggacaggcaugaccucuggccauuuucacagcugguguugagaaucugggggauuggauggccacaucuggguugucauucuuaccgaccugaau

SEQ ID NO: 1179 - RNA, 1289 nt, Mus musculus
auucaggucgguaagaaugacaacccagauguggccauccaaucccccagauucucaacaccagcugugaaaauggccagaggucaugccugucccgccccucccccauccaagaagucacagcaacguuaucuaaaguguuuguuuaauaacaacaaaaaacucacccccauagaacuauuguaaaacaauauuuucagccagugaucauuguaauauacaauacaaaauauuuccucagaaauccgagaagcacgaaaugugaccauuuaaaaaaaaaugucugcuuuuucaauaaaacagaaacacgcgggguugauuaacccccuccccaaagucucuggaggcugaaagguggagagggugaggcucuguugaucaaacccucuacccacuggaccgauccgccaagaguccgguggcugcgguagugucuuucccagagauccccuggggaaccgagagcacuuuuuuccucuugccuccugaagggcuggaguccaucuggucccucagugcgccgccucagcgacacaagaugcgaucgucggcuggaacacaugccgccugugaacaccagagcgagauaagggaugagacccacuggaaaggacaaggaggggagaggcguucccauuucucuacuccaggaggcacgaugaaaaugcgagcuuuuuccuauuagucgccccuaaauagcuaugcgccugaaaaguaaggaagggggacacccgccucccguggccucgguuucccacugaagaauaauguaauacucugccucggaccucaccucggccgccaaggcacugaucucgccguucagggugcugagcggggcgcggacaggcaguccccggccuccgguggucccgacuucagacuccgaguucagcuccagcugcaggucccugauguagucgauuacaugcugcaggaucuccaccuugcucacuuugcgguucuggggcagggugggcaccagcuccuugaggcgugaguagcagccguucaugucguagagcaggacguucaccugcugcucguccagcaaggcgggcaggcgcgucccagcgcagcgcgagauggccacgcuuugcuccgacagaccaaguaccaccucgcccgcuguccugcccgccuucagcgaacagcuagggccugcagcggcugcggcacugccacuggcgaccuucaugauccugagaacaggcggaggggagcggaggaggcugagaacagagugugggaagagaacaagaaguugaagaaagguuguacaaugagag

SEQ ID NO: 1180 - RNA, 1730 nt, Mus musculus
auuuaaguaccagcccuagaugaggcuuccgaaacccuaaagggacuuccaagugaaucucaagguuucgcgcagggacgcggacagggggaagacagccucggaucugugaucugauuucggaaagaccacucccggguuuuuccgagaggcguaugcuggagaccccccacaaacaccgcuaguugucuuugaauuccccaaaggcccuggacacagcacugggggacggccagguccuccauuccgcgcccggacacaauggccgccggcaccccacgcacaaagacggggugagagagaggcacugagccccgccaccggccaggaagaagggucggggcucccacaguggagaccucguuuuuccugaggccgagcccaaggcggccuucuggagcccccugcagggcucgagggccggaggccgcuccgcgccggagccccgggugggugggcugaggccucgcuuacugcucgcgcuccccuaggccggguacccgccgagccaccgccccguugcuaggcaaccgcccucccucaggggcgcccccuagaccucucuggaaggaggggucucgcccccgcggcccgccccagcuuagccaauccgcgggucgagucggcacggaagcgggacggcaaaggcucccauugggcccagcgccugucaggcacaggggaggcggcgcucucaccugcgagccccagagagccguggggggccacauccccccuucauaggcccaguggcuuccagacacuagggcguuuugcggcugggaaguaugccgcggacuuaagccugccuaccuggcugacugcucgugcugaaucucccggagaagccggccucaguuuccccugaagagaccgggggaacuugcaagcgcagccacuuccggugccgcggcagcgcgcgcgagcccgagacgcaaaaggagugcgcgccagaaagggacuggcaucgagacaugggagagcagcgaccccuggcgagcgauuugaggagucucaggcgcguggaacguuuaugguucacauuccuucaaucuaguuccuucauccaucugucccuuuguauacuacagaaaaagugcuuuuuccuuucgaugucgguguccaacaucgaacagguuucucaacuuguguauuuccccccucacuuuaaaaauagacagcaauauugaccuuucauugacuguguaucagguacuacuugaaaagccugaagaauagaaagcccuuaguuugguuuguugaagacacaaggcaaggcaaugucucuguuuuuaugaagacuuauaccuuacggguggagacacccaacuaggaaaauacacaaacaauguaaucucuagugcuuuggaaaaaaaaauccugacauugugauaaugacggugaaaacgagaguugccuuagagugagugagugagugagugaucucuuuaaaaaugcaaacccugacugacugaccagugcaguagaaagacauuuauuuaacaguuuuucagcccagucuguccucaaucuauguagcauaggaugaccuacuuuuuuucucuuucuuccuuucuuccuuccuuucuuucuuucuuucuuucuuucuuucuuucuuuuuucuuuugguugugagcccaggcuuuaacgacugagccaucucuucuccuguuucacuauuauacaguuuauguguugcuggcgaccgaacccagaacuuugugcauagu

SEQ ID NO: 1181 - RNA, 47366 nt, Mus musculus
gucuuauaaacaacauuuaauuggggcuggcuuacaggcucagagguucaguccauuaucaaggugggaacagggcaguauccaggcagagcugagaguucuacaucuucauccaaaggcuacuaguggaagacugacuuccaggcaacuaggaagucaaccuacagugacacaccuacuccaaccaggccacaccuauucaaacaaggccacaccuccaaauggugccucucccugguccaagaauauacaaaccaucacacacacagaggcacuccgacauccagcagucuccggugcuacuccaacggguucguguaaguagaaaagaagucggaccugaaaucuaaccaaggcuaugugauauuccacaggugugugguccgggaucccucagguagagaaaaggaaaccuugcugacgaaaggaauccaccauuuugcaccgaccucagucuaggcuuucugguaaugucaaaagcugacauuaugagcaggguuucccaauacaaccaucuguaacuccaaucccagggcaucugacacacuccacagacauccacuggcacaggguagguaagaauuccacaugcauacaugcagguaaaaaaaaaaaauucauucaaggucaacucuggucuacaaaucacguucuaggacaacaagagcuacauagaaaccucgccucuaaaaaccaaauauauaaaaucaagaaaucucagaaagaaaauuacauuacagauucuucuuaaguugaaauacaugccuuugcacugggcaauaaccgugagccuauagcacccacagguggaaugcuaucacguagguauaaaaugcccaccauaggcuaguguuucuugguccauagccuggcacugccuugggaaguuguaggacuuuugccugcaaggcucaacuggaguauguaagccaacagggagagaggucuuugaaggugccaaucugucacacagucugaacaguaucaucucaccacccccuccaggauggacuggauuccagaaaacagugagcuuaaauaaauucuugugaccuuaaaaaaaaaguuauccaagugagguuggaaacuauaggcuguggcaucccauugucagcaccaacaauaaagaacaugcuacaacagcagcucuguaaggucuuccggagucugcgcagucuuccuuggagccauuacagagguucccuuccuaccucgcagcacaggguuccuuuauaaacgcauuuugaacagagaaggaauccaauagacuggcugcuucucacuuacacugugacugaaaccacaacccaggaauugacugccuuuauuuuaugcuuaaaauacauauauaagggguaauaaggggggauuaggugaaaaguagacuaugccaaaacgaauucuugaaauccuagccagcguuaagaccaacaggaaagggccggcuaaugucugaaggaaauaacuacaagaagucugguuaaagucuaaaugaguggaggcucauuagcuucaaaguugcuguguagagucaucuucaaaacacccggcauccauuaguuaucagguguguuuccacacauggcgggugagucugaagacgcgugcuccaugcuugugauauagaugcagcuucuacuggaaccgaguggagaacuuaggagacaccggcacagucagaggcagcucgcuagauuucaccuccacugcugcguacuuccguauuggauuugccuugugcaccuguagaauaagaaacaggguuccugagguggacugcacacaucuaugugcacaguuguucugucuguuaggggagaaggguggggacaggauuuauagaucccaacuacaaauucaggggaaggagaaguaugaagcccaagcagguggcuacuguuguucagugcaugaauguguaaacacguaaacacacacacacacacacacacacacacacacacacacaccccggcacugagaacucaaacuuauccccaguguaacuuacuagggagaaacagggucuugcuaaacuguagcagacaaaagcuacaaauuaaacauuugugacaggagcuggagagauggcucaguggcuaggggcacugacugcucuuccaggagacccauguucaauucccagcaugcacuuggcaguucauaaucaucuguaacuccagccccaaggcaucugacacccucuucugaccucugaggacacacaauaguggauaugcauauaugcuaacaaaacacccauauguauaaaauaauaacuaagggggcuggagagauggcucagcagauaagagaauugucuuccagaggucuugaguucaaauuccaagcaaccacaugguggcucuguaaugggauccaaugcccucuugugaugugucagaagacagcuacaguguauucauauacauaaaauaaauuuuaaaaaauugcuagaguugcugggcagcaguggugcacaccuucacucucagcacucaggaggcagaucucugaguuugaggccagccuggucuaccgucaguuccagggcagccaggacuacacagaaaaaucguccguguagcgggaggccaaaauugccagagugaaauuuuacacuuauuugauugacucuuaguauucaacaaaaucacaaaccaaaacaaaagacagaagagaaacaaucaaaaggggcagugcagcuggggaagcagggugccacccauccuugugaagaguagaucaaccucggagcaagccgccauaauucaguaauaagcagcauugauuaacaggguguugccucuggccugcacugagaaccgcuuuaagaaauaaacuuauauugggaacaaacucaacaggcagguacggcugcguauaugugcgugugugacugugccggagagacuauacuguuugcugucaguguggaugcugacuagucuguccaagauccaccagggagcagaacaacagcgacaagccaggcuucugagugccuauggcacccaguagauuaccaguucuuuccggagccuggcuaacuccuccuucugcugcuccucuuccugcugccugacuuccuccaacugcugcaguuuccaggccucuacuucagccauuuucuucuccagcuccugccgcucuuuggcucuccucucgguggccagcugaaaagguuccugaacuagagaaccagaaggguucucugaguacagaaacaaagacaacacugauugaugcacaugcagcacucagaacugaagccacaccccaugaccuagaacgcuaaggagucaucagugagacgagagaggugagguggcuuacucagcccugcacgcugcucucccacacagcgacuguaagaagucaaagaaucccaacuuccccccagccauguugcccaaggccuaagaaaccaagcccuguguauagaaagaaauccccacacccuuccuucaucugcuugcucccuucuuggguguggacagccugugacugucacugaaaggccaggugugucugccaaaacuccuguucuaucagucugccccaacauacuugauaauguucaaggggagccacuggcuccaacacaagcaaaaggcuggcucuaagggaguaaggcuaccgucccuucagacaaagccguucuuguugacacagcauuagucugcuacaauauucugaguccuagcaccccccugagaagugugacauuuugcccugacccccaaaagaguacauaaaaaacaaacccuaccagccagugauuuuuucuccuucuugggaacgaagggcucuuggaagaugacgguguuuggacgagccuugaagcaagcggcguccuucugcugcuucugcucuuccuccagcuguuggaaggaagccgucagacaguggcguacaguguuugcuagcuacugcagcaguaacacacgaccucaagguucuggacuuggugacuaaaaagauagagcuuucuaucccuuuauuucuuuuaaaugagcaauuagacccagaggcuccauuaaacccuuguuaguguuuguuuugaggugagacagagaacaggaauagcgacaaaaugauaagacaauucuaucacucucuaaccaaucauuugucuuuaucaccuguuaugauaaauaaaaagcaauuauaucauauaccauguugagaaaaauagccuaucuuauuaagaaccaauucucccaaccuaugucuuaccaaaagcacccacuuaaggaaauagaugagaucuuacagaaacucccaacugaggagucucacauuccccagaagacuacuaaaggagagaugagcacaauucagccugcuagucaaaugcaacuugaacuaagaauagucuuuacauguuucaaggaucaaauauacauacaggggcgagggaaggcagggagaaaauaccugacacaagucauauguaaccuauaaaaccuaaaguaaauauugccuggccuuguagagaaaacuugaugugacuccugguuuacauagaauauauuaaaauagucaaaucugacaucccagacgauuucaguacagguagugaaucuacaggcccaaucuauaggccugcaaccuauuggcuuucccacccacuacucacccaucaaccaaccaacauccaacauuucaauggcuccccauucuuaccuggugcuuccacaucucagccuuguaggcgccucucuugucugucuccagggagaaaggcucagcuugagucacguucuuuaccuuuuucucuggcagguuaauggugucaaaauggggcacaggaagugccuugaacuugggcaccuaaugguagagaagagaacagaagagcaacauaaggagcucuccucagugggggacaggaaacacuguccugcagaggaccucagaucccauugaugacuucagugcccccucaccuucgugucucugaauaaaauaggcugaucacaaaaaaauuguaaagaaugcuugccagacuuggugaugcacaccuauaauuccagaucucuaaggaucaggagcucgacacaugccuagacuacauguugagacaauguccccaagccaaacaaaaccacaaaaggccuguuagcaaguaugauggugaacaguuugucaacucgcuauaagccaggguuaucuggggagaaacaacugagaaaacauggccaaacaagcccuuucuucccaaacugcuuuugguuuuaucacagcaacagaaagcaaacugagacagagauaaaacaauauuuacuccuaaauauguguaugaaccugaaagacaagcagaggaauucaauuuuuaaagcgggauggucuagccgaaaagccauggacuguuuuagacccaaagaaaaccuagguuuuuuucccuacuaguucaaagcgcaauaaacauuucauagugggucauguaggcaucaguggaaaacagugauucaauaguaauuuuacaaagaauuuuauauacuuuuggcuucaaaguauguuuuuauauauuucuuuuuuuuuuuuuuuuuuuuuuuuuaaagauuuauuuauuauuauauguaaguacacuguagcugucuucagacacaccagaagagggagucagaucuuguuacagaugguugugagccaccaugugguugcugggauuugaacucuggaccuucggaagagcagucgggugcucuuacccacugagccaucucaccagccccuauauauuucuauauaguaauuuuauauaaacuauucucugagugaaauguauuauacaugcuuguaaucccaggaugugggaggcagagacagggaaacaaccacaguuguuuguuuauuuuccaaagccagucuggucuacacagcaaaacacugcucaaaacaaacaaacaaacaaacaaacaaacaaacaaacaagggaagguucccuuugagggaucaaagaacaguauucugcaaauuacagauaugaaacaccuaccuccccuuucugcaucucuuuuauuuuuuucuccuucugcaacuggcguucuuugucccggguaucaaaggagaacgggcacaccuccacauuucuugccucugcgauguggggcuuauaaggcaccccauaauguggcacagguugagcuuuuaucacuacugguuucuccucuuccuaagagagaaacuacagcuuagaaccaagacuccucgucuuugccaugcucaccgagcucagaaggaggucucggaaagcacacaugggauaagcuacugaugaugcaagucacuuagcaccaaugacuuuucuuucaaagucagacaaugcccacgcaucaugggucaaagcaaucugugagagcauugggugaaugacuaacacaguaacucuuuaagaaucucaaguuccucucaggaauguuggaauaacuagaugacaucagacagguaaaaugaagacuugaaggaagguucugaguaagcacacuuauauucugacucggacuccacuaaaacaugugacagaaauuaaugguugccaaacccagaauaggaccaaguaaguuguuuggguucaagcuaguaacauaagauuaccaaguauuugaguuucaacugauccuauaaaaagguuuaugcugauaucugcuauaaaauuaccccaagucuggauauuuauaaauaaaauaggagauguaauaagaagcuaucaaugacaauucacuucuuacagacccauaacccaucacccucagucaccucugugacccuuagguaucaaggacaauacgauguaauugcuugagugaauuuuaaaagucccugagcagugacaauagcucaggaaacacuugacuguguuacaaaggcugcaugaucccaaugcuacaggaugcagaggcuuaauggcagacucgaacccaugaucacugaaaguugagucacaccucagccagcuucaguguucucagaggaacaaaacgcaugcgcaaacauucacaucauucuuacagucaacuccagacaagagcugauugccuucuagccccauuaaauauaaagaaugauuaagacucagacuggucaugaaaaagaaaagaagacucccucuucccagggaaucaccucaucuuugaugggcacucggauccuguucuucaaugcaaaaacuggcgacuucgggacaguagcuggaauuaccuucuuuucaggaacacccuggaagaaggguacaacucaauuagacaucaaagagcaaugcuacauaaaauacuaaaaaccaggccaggaagauagaacccuuaugaggggccacuugcugaacaagccugacuuguauuugaucccauaacccauggcagaaggauagaacuaaaucccagaguuguccucugaucuccacgugauuaugcaaggacuaacauaacacccucauauaaacaucucucucucucugucucugucucccucucucucacauacacacaaaauuaaaagaucacaugccaagagaacagaagccucugugguuggcacccucaggccccuagaagucccacucuagaaacccacacuuuaacuuaucuuuccacaugccaugcucaagacuuccaucacaccggcuuucucugccucaugcucucggcuacucaagcccaucucucacugucuuuaccaccugucaaucucaguguaaaacaaaggaaaggaaaucccuccuuuaacuucuuacuuaacaacuuuuccuuccacagaucaugaggacugauucccacugcaaacugucugcauggcuguuucuuaggggcuuugacugcuccucuuuguaccacagcaccacaccacaccacacccacuguaucuccgcacacuguaagggcacccgaggccagagcuuugccacugggcaggccaguagagagcagcagaugacugcagcaggcucccagaggcaggcccuucagcuaggcuuugagauucuagggcggaaaguuaaguaacuucaucuugguucugcacacaauguuuaaaauguuuuuaugggcaagucacacacccuuuuuuaugaguuuucugaaaagugaaaauaaaaugaauacagcuaagcuaguauggcagaacacgccuucaaucacagcaugugggaagcagaggcagguggauuucugugaauucugggcagccuggucuauacaaagaguuccaggacagccaaagcuacacacacacacacacacacacacacacacacacacacacacacacacaaagaaaugaagaaaggaaggaugggagggaggagagaagaaaagaaaaagaaaaagaauauaucuauugucuguuuuauucauuccuucucuagaaacuaaaaaugaauugaaauuagugaaaccgaugaaagcuacagguagcucaugacagugaccucagacaucaacaugacuuaugggaacaaugagaugugggguggaaccaugcagugguuaaagaggugacagacucauagcccaguucccuuuauuagauacccuggugguagagucccuuguuuuuaaaacagaaauuaagaacagagacuuuuacaguuguuaugagaaauaaaauaaucuauguaaaacucaggacaaggcaggcauggcugugcacgccuuuaaucccagcacacgggaggaguggcagggaucucugagcacgaggccaaccagggcuacauagggagagccugucucaaaacaaagcccccaaacacccuaguacaacacacacacucaaagguauauagaaaguauuacuauuaucagcacaacugcuuacugugucaguaauccuaagcucuucacucucucugucuucaacucaacaaaucaaaaugccgagacugggaaucuauguaagagcccagaggauucugaaaagcagcugaucagacaacacacuccuucagcaccccacuguuuuagucacaccuucccuacaaacacacaaacacacacacacacacacacacagagagacagagagagagaaacaaagagaaagacagagagacagagacaaacagacauaaagauagacacggagagauguauaugaaaaagcuuucagggcuggagagauggcucagcgguuaagcgcccugacugcucuuccgaggguccugaguucaaaucccagcaaccacacgauggcucacaaccaucuguaaugagaucugaugcccucuuauggagugucugaagucagcuauaguguacuuaagaaauaauuaauaaaucuuaaaaaaaaaaaaagaaaaagcuuucaguuaagcgagaaaugauuauuucuaaguacaaucacaauuuuauauauguaauaaaauuuuauuauauauauauaauaaaauaaaaguuuagaaaguauaccaugagguugcuuuugguuuaaugugaggagauggaauaaacaaacuagugaucagggguaauauauuacagcuucacucauagaugacucugaaacaagcaaaggaaaagaugacaagccguaccacaagccaggcacaguggcaugaaccugcagucccaacuacuaggcuaauguaaggacagcucuggagucuugcuugacaagccuaagagacaaagcaagacccuaucucaaaggaaaacuuaacuauuuaaauagcguauggugugcugguuuauauuuuaugagacuugaacauuaugcaagguucugaaaccaaucuugcagaaacugagggaugaauccauaugaaagagggacaaaugucagccaucacagcaacacaaugacagcacaaggaugucaacucuacugcaugucaucaaagcaugccuccucuuccaggugcucaaagcuucccucuucugcagcccuuuaagcuccauguuccuaucagucuauuauuuaaccucauguugccuuucacuagacuugaaguucuaagaccaaaauccaauucugcugcaucucuuugucaccuccugugauaugcuggugccgggaucacaggaccaacauuucuggguagauauuuggucaccggcuggucaacucugccaccacccaacuccucaaguauucuuaccacgacaucuuccaagaucuuaguaggacaaggucuagaaugaaauucaaauuguucaucuucuguuuuuuucuuugacucucgcucaugaauucguuucucaauuuccaaaucaaaaccaacaggcugaguaggagguuuaacaggugcucucuugggcaagauggggccacuuucaaaaauucuaggaucaaguucccgugcuuugaauuuguaucuguaacaaacacaaaaaguaauaaacauaaaaggcuuuuuaaauuaaauaaaaaguacacaacguagaacaaaguagaagcgcuaagaugauccaccauggacagcaugaucucuccucuccauagucaucuucaccuccugagaaaagggugaacggcauggccugggguccccccggggcuccaggcucuaugagugcaugcgccuauaauccucgcacuguggcagagacaggaggaccagaaauucaaguucccaaacuuugggggccuggaaagauggcucagggguuuauaaagcacuggcugcuacuccccaaaaauccccagcacacccacaugauagcgaacaaccacguaucuguaacuccauuucuagaggcuccaaaguccucuucugccuuccaugagcacaggcaugccaguggugcaugcaagcaaaacuuccacaaauagaauuuaaaagcaagcaaacaaaaaaccaaagcaaagucauccuuucagaugacucaucagauucugcuccagggcaccuacauagucccauuuucagucacagagacaggagcacagccuacgcagccacuaaauggcuugcauuuucaugaaagggaaaacaguuaccaccgcccaacaggacugaaagcaggcaggcaggaguggccagccuuucucagacacugccagugggaccuacuguugcaguuucucaagcuccucggccuccugcucugcaguacuuuugcaagucacagcccuuguacgauauuuggucugcaguaugggggucugggggucucgugcaaucuuguucacagauuuggaggguaacaagccuguaaaacaaaaccacaaacgcuugcuuaguuccccaccauccaggucaccuuuaagugcuaacccaacuagaaaccgacaaagcagacaaccuguuuuucuaugcucaacucaguugauagcacucaaccugacagauguucccucccuuccucuuaucauccuuauugaaggauaguauguaggugaauucuucugccaucucugcacuuaaaaucuagccaugucugaugggguccuugccacugcauaggccuuucuauggagaacaccaacuauuucgcuuguuguugacaauguuuuucuuacaauuuuacgacaccagaccuuugcaaaccagugaguaaugaauuucacaaaaacaucucuaucaaaacauccaggccaccccucauagcaagucaaauggugcagucaggcauggugguacagaucuguaacccugaauuuaagaagcugaggcagaaggaucaguaguuuauggcuacugcauuucaacuuuuuuuguuguuuuguuuuguuuuguuuuuugagacaggguuucucuguauagcccuggcuguccuggaacucacucuguagaccaggcuggccucgaacucagaaauccgcuugccucugccucccaagugcugggauuaaaggcaugcaccaccacgccugguguguuucaacuuucaaaccaaccucacaagguagcuacaccaaacagugugugugugugggggggggggggggguucagauagucaacaggaaauaguuacagagaauuagaggcaaagagagggagaacaacucugccaacacagcguuauucagagcaguggcuaucaacauuccuaaugcugugaccuuuuaauacaguuccuaaugucauugugaccccacccucauaacuguaauuuuucuauuguuaugaacuauaauguaaauaucuguguuuucugaugggcucaacucauaggcugagaaccacugauuaaggacauuaugaacacugacaaaagguauuuacugauuuaccuggucaguaagaagccuaucgauuuucauaauuaccuagaaggaauucuccuaucuagaccuuauauaacagagugagaaaaauuaauuaucuaauucauuuacugguuuuucuuuugaaaaagagucuaugaagccuuggcuagauagacacaaauucuaugggaauaaaaaaguucacuuuuucauaguauaaaauauuagaauguauuaacaauacugggaaauacuauaucuaggguugagaguguagcacaucgguacagugcuugcuagcugaaucuccagcacugcccaaagaaaagagaaauacugcauuuaaagcaauucauguggccaccuaaagcaaagagcuaaacaauaugaaaaagagauguguagauaucucaaagcgaauccugguuuacccaaaauacuagucccauuuguuuuugucuugagaccaguucugugcagcccagaaacccucgaaucaccauuuggaccaagcccaaaccuugagccccuaccucccaaaugcuggaauuauaggcaugcaucaccaaccuagcuuuuuuauauuuuccugauaaccuauuuuacauuauuuuccaucucuaguccuucuuaaucuucuuguagaaauuacuuucauaaugacagaaacaauuaaaauccuuucaucuguucaccaccagaucuauacaaacuuaucagcaucugcacccguucuccucccucuccacucugcugcgccagccacuggagaagagggucuggccagcaaggucuggaaggaaacuuacucucguccuucuuguuccucagaugguaucuauuggggguucguuuguggaaggcuucaaccugcugugcaaugggcacauacguagaagcugcuucaucaaauguucuuuucuucccuuuggacagguugaaaggcuuaaugauagugcauccucugguuccucgggccugugaagagaagaguuguucagcaaagggcgggaaccuccugcagggcccauccucggcaccggcacucagccagaguccuuccuuaaaccaguucagcggcccuuuaucauuugucuucuucuagagaaccuggugcuuagaagacugcuuugcaacaguguagauacaugcauuuucccaaguauauaaauguuuugaaccaaucuggagaaaguuuuauuaaaauucaaagggaguggggaaggaaagaaaaaaggcaaacauacaaaacuggcccaggcugcugggccugcaucaggucagacaggagccucacuuacaucucuccacauaaaccucaaacugacugucgcaagcccacccacugcgcaucauucauuuuuuaucuauuuuuggugaguuuuuuuagaugggucucucugcauagcccuggcuaagccggaacuccaggcacauauaguccauggcaacguaguccaggcauacuucaacucaaacccucuaacuccacuugugugugugugugugggggggggggggguccuacucacucuuccagccuccaccaucaccaacauggcacauacucacaagacacacagguauaaaaauaaacaguaaaaggaaaauaagccagugugugaagucagcacugagugcugggauuaaaggcaugcgccaccacgcccggcuauaccuacuacucuuugacauuaagggaacuaaugauaaagccugauggugguggugaaugccuuugagauuuggucauacuugcaugaccacaccugacucuaccccgagccugaggggugggagaaggccucuacaaauuugccacacauaauuuuauaugcuucgugucccauccaaguuuuacaccgacuugguaacaugcuuucccaggggagugaucuguuggcagccacagaguucacaggaauucguaucccauuauaaauaaugaccaaaacgucacagcugcgaccgacugaaucaguaauaagaacgaacgcucacuuacaggcguggaagaaugcuuccgaaguucagacaugaaguucacuuccuuauacucuuccugguucuugggauguugcuugauucgcucaucugugaggaagugaaagucaacugucuugguaaccuggcucguggacuucuucacagguugcccugaggaacaggaaaacacggcgacauuaagaagagaucauuagugagccccuguacaacucuaauccuuccuguguuucuguuauugcggcucuaguuguaucugaguugugaguuugaaguccuuuguucagaugcaaacuagguaaggagaggagcccacugcuaggauguagucauagcuuugauaaagucaugaccucacacccuuuuuuuaaaaaaauaguguuggagauggaacccagggcauuacaaauucuaaucaaacacugaaaauccaaccccuagagagugacuuuaaaagcaaaauuuaacugggaaucucuaagaggggagccuguaaaauccaguaagcaggacuggugccaccaauaccacuaugccagagcaaagccagcuaagagcucuucauucagucacguuuuuccuucaaacugcaagugaauuugacaguccucuuucucauccucugccauuuguaugaagaaagaaaugacaaacuggccagacugacugucaucugucucaauccuuuugcuaacacauaagagaagaauagugcacucugagaaagugcuaguuugggugguacaacuagagaguaaccccugaggugcaggugacuuacagccaccauuuuaaguaaacacacuguuguauguggaccacucaaacugguuguuuuuuauuuuguucuugcuguaaaaaccucaaaggaaaaaaaaaaaaaaaaagcuaccaaaauucaaagaagcaccguugucguuaagacucagugaggcuacugaccuggcccugcgagcgcgagcuucuugaacucuucguuuuuccugcgcagcuccaccaccuccugcugcauccgcagccuuuucucuaucuccugcuccucaguacucuuuagaaccuucucccuagaaacaagaaucaguagagaggccaaaggaaggaaggguucagugcucaaaggacucgaagcugcugaauagacuauguucauaaccuaugauaucuaucaaaguccaaaaaguuuauccaccagaaacaguuauuggcuuaauuagguaacaugaaaagaaagaaggguauuuuacacuaagauauuauaaaauuuucagacgacaauugcuaaaauuaacuauacaaggcaguaagacacacaaaagacucacacauuuuugaccacaccagugaccaacuuuuaugccacuggaaaagcuaaauuaaaaaaucacaagagccacauuuagaauugcagcacuugggaggcuaaagcuagagaacugugagucaggggccagccuggguuaccgagcuaguuccaggcccaucgauugucaggagccaucuaggaaaggauaaaggcauacaggugacauucuacagauggcacagcguaugcaugcucugcaaugcacaauucuuaauugcaaggcuuucagaaaucucaucucaggauugauucuugcagcuaaugccuuuccugucauuauuaaacuaauauaauaaucccugggcaucagcccacccuauugagcagauauccuguagaucaaugaagauguguuguagugacgauaugcagacaaauaaaugauuucuuaauuccuaauaauuauucuauaaaacuccuaaauuuauacuaguaaaaugggcuucaaucagggcccugcaagccuucaaguauuacgaguuaauugcacuaagauaaaaagcaggcaucaaacagauuuaccauuaaggaaaauauuccucuuaggcugguuguaaaacuauuaccugcuaacaaaagaccauaaacugcaaaugaaugauuuauuauauaugauagaugcaauaacagaagauaauauugacuggguuuaccuauacaaaacuucaauacuaauaagacacuagguagauggcuugccuuuugacauucuguguuaacuuagacauaagaauuacaguuuuaacuaauuuuuuaagauucauuuuuuuuauuuuauuuuauuauuauuuuuguuuguuuuuuucgagacaggauuucucuguauagcccugacuguccuggaacucacuuuguagaccaggcuggccucgaacucagaaauccgccugccucugccucccaagugcugggauuaaaggcaugcaccacaacgcccagcaagauucauuuauuuuauguaugugaguacacuaucccugucuucagacacaccagaagagggcaauggacccauuagaugguuguaagccaccaugugguuacuaagaauugaacucaggaccucugcaagaguagucagugcucuuaacuacugagccaucucuccagccccuaguuuuuaacuuuaaugaaccuguagagcuagugacagacaaugaaugcuuaguuagauaacuagucuaaauggaaacacauguugugacuccugauucaauuuaugguuugaauuuauguuugaacuugucgugaacuuuugaaaaaagauauuuggaauaccaugugaucaauucuccuaaaaacaguacaaaacuagguacagagcugagaagagagagaggcaagaagagagagaggagcugaacagagggcagagagagcagcaggcugcugcuuacugauaaggaugggcuuuuuucuuacacacuuggguuucuuucauuuagcaauaaaagggcagaagcuuuuucuuucucuaugcaauaaaggcuggagcugauuuuuuauccagaaugaaugaguucuuucugcgcuggcgcuggggcuuuagcuccacccaccacauauauaaacacacauauauaaauacacauguaagucuagguauguguauguauguacggauacuuguagaguagaugauacaggugguuaggcccgauaaaaagaugaauaugggccuggagaaauggcucagugguuaagaauacugacugcucuucugaagguccugaguucaaaucccagcaaccacaugguggcucacgugagaucugaugcccucuucuggugugucugaagacagcuacaguguacuuacauauaacaacaaauaaaucuuaaaaaaaaaacacacacacacacaguaaaaaagaugacuguguuaaugugugagagugugaaugaauaaaaauguaaauguguguaugaauguauaugugucuggguauauuuacuuguguaaaaguauuucuuacugcgaacaugacucuuuuucugaguucaacagaaguuaauugcuccaagccucacuuucaccuggccagugagaggugaggcuucugggcaagaaagaaaggaguuguagcaauaaauccuuuauuuaacccacccccaaaccccaaccacguuguuuaauaauugaauguuaauugccagaggcccgcagcuuagagucaaaacagguaaacauuauuauuuuuuuuuuuuuaauagauagagaauuauuugucuuuuaaagauuuauuuauuuauuacauguaaguacacuguagcugucuucagacacaccagaagagggcaucagaucuuguuacggaugguugugagccaccaugugguugcugggacuugaacacuggaccuuuggaagagcagucggguacucuuacccacugagccaucucaccagccccacagguaaacauuauuaagcaacauuuacuucacucucacaaaaccauauuuaaaguuuacucuucaggcugggcagugauggugcaugccuuucagcacuugggaggcagaggcaggcagauuucugaggccagccuggucuacagagagguuccaggacaucuagggcuacacagagaaacccugucucaggaaaaaacaaaaaccugugacacacaccagcuguggugcugcauagccacauucucagcaccggggaggcaaaagagcagaauuguucaaggcuauccucggcuuugcaaggucagccuguucuacaaaaacaaccaagaagugguagcacugcaaaucuuuuugauuuuuaauuucagaaauaaaauuggcaauaaauaaaucaacacucagacaaccauuauccaugaaagcaugaacaagauuuuccagaaaaaguugaaaugaucucuggcaagggaauaacacuaaaccccaaaguugaucacugacuaaaaucccauacguuuacuaaguggugagaguguguacugaucuuguccugugugccucuuaagccagcaucuugugcugcuuacugccucagcauccuuaggucacugacagcuuuuaaggguuucuucccugaagggcagguaugccaauuacugucuuccucuaaaguuuacucugggaaagaaaguaccuugcagguggcacaccuggcacagugugcuugcccuuggcuuucuccaggguuucucuuucauucuuucuugaaguagcuggagcacugccuuccuccucuuccuccaguuucuuuuuaugagaacuugauuuaaaaugaaugaaaaauaaguaaguuucaauuuccuaaaacacgcccucauuuuggggaauaacaacaugauugaaccacaagguccuucaaccacaucaucagauuaacacagcagcagcuccaacaggucagccaugggaaagcccucagaggucaggugaggcagccaacaguguuucaggauacaaggacucuaugucaucaagucaacaaccagaagaccguggccauuguuccugauaccuacaaucugcuucuuaggcaauccgaaggcagcagcagugaacccagccauaacuaaguguuggucuugccucuacagcaacuugggagauccaagugacaauguuuagaaguaagauaaaauguaagcuauaaucucugaggaaagccucacuuuccugaaugaaugcugggcugcuuccuuuacaauauacucucuugaacagggauacagcuaaagauauaguaguuaccuucugauaaugaagcucaagcaaaaugaaaagaaaaaacaaaacaaaaacuaagaagcaauagauaguaauugaccgaagccaguggcaaucuaguuugacuucugugaaguacauaaguuauuuagacacuuuuggaguguuccuacagugaaacacauuccuaguuaaaaaaauaagaagaagcaugaacaccauaucuucuggucagcuccugccacaggugaacacugaaggcaaaccuuaccuucuggaugggacacggguaacagcuccccugaccauggcauagcuuuggaguuucccagucuaaagggacaccaagcagccugcagauggagccauugguaauuuuacuuuguaacucacaacucucagcccaggcaggugccucaugguggguacucacacuuucauucuuuucugggggggacaaucaguggccggagcaacacaucucuuggcuuucauuucaacagaggcaacaugguuuuucucuuucugcuccaaauccuucugagcagagagucuaauagaucuucuacgguagaaaugacacaauuucucuuaugaugaauacaauuauuacagauaugcaaauguucuuccuaaagucaaagucugucaacuaaggggccaauaaaaccuuuauuauccauucucuaguaaucuaauguuucugaaaacuuguuguuuccaaacauaaaauccugcuauuuaaauaugcuggugguuuguaaguuaaaacuaaccaaacagacuaaauagggucauucuauuauaaucucagcucuuaggaaucuaacaaacccuggugugggauggaugguaugugccuuuaauccuaguguuuaaggccagccuggucuagagaacgaguuccaagaaaaccauggcuacacaaagaaaccuggucucaaaaaacaaacaagcaagccggggaguaguggcgcaugccuuuaaucccagcacuugggaggcagaggcagguggauuucugaguucgaggccaaccuggucuacagagugaguuccaggacagccagggcuauauagagaaacccugucucaaaaaaaaacaaaaacaaaaacaaaacaaaacaacaacaacaaaaaacaagcaaaaagauguaaaaaggguacaaggcuugagguuaggcuaaucuauaccuugaguuccaggccagucauagcuauagagagaaccugucucaaauuuuaaaacaguuaaaauaaaauacuagauauaucugaaugaguauugggauguagauuggugguagaagacucaccuagaaggacuaggagcaaagagcuguguuuacuuccccgggggagauggggcaaaacacagagaaagugggaggguuaagaacaaaacgcaggaaaaaagaaguagaauaaaaagaaaagacacaugaccaggaaccaaagcagugacagaucuaaccaaauuagcaguuauaauauaguaauauaaauacagccaacauuucaaguaaagcaaaaauuaaucagaccaguuuuuucuuuaaagcaagaucccacuaagcaccauguacuuucugugauuguuugguuacuuuaaaagcuguccauuaacaugaaaggcaaggaugggguugggagucagaaaaaggcucaggagacagaaaagcuuauguccaggccugagacaugaccugacuucuguccucaggaaccacaaguaagggagagaacuggcuacucuguggggggaugugaagauaacccugggagcaagugggauggagagugaggcaccacaggcuccugugacuccugaggaguccugguccgcugucaguguaugaucugacacggcuccuggcauacacuaacgagccaaggccagggcuucccuagucuucauggaaaucuccacaggggagugaacccuccucuacaggccccauggacaggauccgagacacugagucagauucugcaaaacaacaccuguugcagcccaauuugcccuugaauacauaaacauacccuacuugacuaaaaagcuaaauauaagcuuguguaauaaacgauaaaguuagaucugcacucugacgcuggucuccagagucugaauccuggacaucaucauggacucuguuuccauuuaacccccaccccaacgcuccagucccuauucccacacuucuccaacuacugucuguguacaaugucauacacacacaaaauaaauauauauauauauauauauauauauguaauuuuagaauuuuaaacaagagcugguauauaauuccauaguagaaagugugcuuugcuuuuagcauaccugagauugguuuaaacucuugcaccacaaaauauuaagcaugaauaauaaaagacaaaaauaaacauaaccacaagaaagcuucuauauguaauacaaagacaaagaaaggcauuugagggcuggagcgaugacucccagcauccaugagggcucacaacuauuugcaacuccaguuucaggaagucuaacacccuuucgaccuccacaggcaccaggagugcacauaacacacauaauuaaaugcaagcaaaauacccauacacauaaaauaaaaaugaaaauuuaaaaagagauagaaagagaacugacaucagaaaaacaauuguauccauacacaccuuuuaaagucagaccgacaaguuugaaucuuggcuuugaaaugaaugugccuuaaccaagcaacuaagugucuauaagcacuuaccuauaaauuaaacccgcaagcuacaauccauaaacacugaaguaacauaaggaaucuguggaguuacuauauugauugagcagaaccaguaauauccacuuuugugccccacucuuaccucugaggcuggacaggaguauuuccugauacagcucucuuagcauccagggaagaacaaucauuugaugggauagacuguuucugaagauuuuccuuuucugucucuuugugguaaguguugucaacuacaagagaccaaaaaccuagucagacuacugcagaaguauccuaaaauagccacuuauucagccuaccauuacucccagcacuugggaagcagaaccaggaggaucucugagucuauaugguaccugaguuccaggacagccagggcuacauacugaacccugucucaaaaaccaucaacaacaaaaaaguuuaaaugguagcuauuuaacugcugagacagcucagcagcucucucuuccagaggaccggagcuuauauccccagcacccacauaauggcucacaacugucuguaacuucaggaaucucacaucuucuucuggccuuuggaagcaagauguacagacauauaugcaaggaaaacacccauaaacauacaacuuuaaaauuggaaaguuuaaauggaguuacccuguaagagggggcaauaccucucccagacaccauaagcuaccaaauuaaaagcacagagccauacacacauuacuucuuuucaaguuuuugucaguggauucccccauagacaacugccuacaccauaguccaggcuauuaccauuguucuuagccucccuccagaacuugacacuaagacaccacacacuugagucauagaacauggagaaaaucaaguuguuaucaaccuaaaagccccaggccuauaguugacuuuucauagugcugaaaguguauguauacuacugaagaacuaaucaauaguuuuucugagacgugaacccugucagcuacaguaguaauugcccugucaagauauacacaccauauuucaauagugacagaaauguucugagaguaaccagccacuuuuugauuggauuuaaaguccacccagaacauggaacucacaccuggcaccauuagaacuuggggcuagggaggccaugaguucuugagagaaccuacuacuauauuacuauucugcuaaaaggacguuggauuaaauugcccucuauugaucuuuauauccauagguuacugccucaccuacaacucagagagguucuuuuugcaguaggugacaauuaacacagagaguuaaaacugaucauuguguagagcauaagagauuguagauuguucagaucuaaauggggcaucacaccacuuccucuaaggcccagggaucaucagagaauaagagggcggagagagccauggguagugaaaagacgauagugagccagcauuuauccagcuaugucagagcacaugaacuucuaguagcuaggauuuuaugcaccagagauugagacaaagaucaagccacacaaaaucccaacauggaugggaaaaugggucaugaagaaccuucccuagcuaaggaacuauuggcaaccaaugguuguugggagagugaaagucaguuuucuacagggaugcuccaguagaugguccuacacugaugcccuuaaucccagcacuugagaggcagaagcagguggaucugaguucaaggccagccuggucuacaaagagaguuccuggacagccagggcuacacagagaaacccugucuuaagacaugguaaaccacacacacacacacacacacgcacacacacacacacaauugcaauaaugaugggagggacagaggagaagucagaagggagaggauaggagauagauuugauuagaucauauauggggcugaagagauggcucagcgguuggguagguuuguuguucuuugggaggaucugaguucaauucuuggcacccacauugugguucagucaucuguaacucuagcuucagggauuccgauggccuccucugaauuccacggguacauauacacacaugcaagcaaaacauucauacauuuuuuaaaaaaaacuaauuauaaaaagaaaguaugcauguaugaauucaaccaauaaauauauuuuuaagacuuauuuuuuuauuuaaugugcauugguguucugauuguauguaugucugugugagaaggugucagauccccuggaacuggaguuacagacaguugugagcugccauguggguauugggaauugaacccuggguccucuggaagagcagccaguccucuuaaccacuaguccaucucuucagcaccccaguaaauauuuuuaauuaaaguaauagcccccuaaauggugaauagaaacuaaucaguacucaaauuucaagaaaaucagaaauuauauacauauaugcacauuuguauauauuuaggcagauaugcauagcaugugugugugacuacagaauucaaaaugaagaucauauguaucacacacauacaaauauuacuccuaugcaugguaaccuuaacucagguaaaguuauacagaaggccuguuuauaaaagcuaugugcugggauggagagauggcucagcaguugagagcacugacugcucuuucagagguccugaguucaauucuuaccaaccacacgguggcuuacaaccaccuguaaugggauuugaugcacucuucuagggugucugaagacagcuacacucauauauauauauaaauaauuauuuuaaaaaauuaaaaaaaaauaaaaguuacgugcuuauaaucacauaaaugggggcuggagugcuguccaguagggaagcauuugcugccaugcucaaagcaaaaagaaaaaaggaagacaaacaccagcagggaaaaaaaaaaucacaagaagagaaaauuauaauguaacacuauucaugaaccuuugugcaaaauucuuuuaaaaauguagugcucagggagcagcaagauggcucagcagguaagagcacugacugcucuucccaagguccagaguucaaaucccagcaaccacaugguggcucacaaccacccauaaugaggucugaugcccucuucuggggugugugaagacagcuacagugaacuuauauauaauaaauaaaccuuaaaaaaauuaaauguugugcucaggauagugcauaacucugguagagcacuuguuaagcaugaacuccuagauuuaaccccuagcauuggaaaaaaaaaaaaagcaaaugaauccuaaaggcauauucaaaagaaaaguauaguuaggcauggcgcugcccacaaucagcaugugagaggcaggggcaagaagauuacaagucugagggcaaccugagcuccacacagacccugucucgggaaaaagagcacauuuaccauggacugaauucaaacacgucgcuaacaaaccacaauuccagucucuggugauucccuaaggugacagcucuagucaccaccagcugcccucaaggcuccugucuaggcuguuucuccuuaccugccuucaacggugugacgaagcccuguugaaguuuggcuuuucucaaggaauucuuccccugaaaaggcucgccuauuccccucugucgaagaaacuuguucuccaaguuggccuucucaucugugaaauaaucaguaaggaaacaaaccagagaagagucaugcauucaaauggggagaaaaguccauuuccagcacuguuagcaacuaaaggaaagcacugugcauucacuacacaucaggacagaggcaaaauccauccccgaagccuuugccacacccagcauccuacagagaggaaggcuguagauucuguacugacuccuaccuuuguuaagauauuguuagggccacaccaaccuuaucuggccuuaucuaccauuuaaauacauugaccuugaagaagcuuuggcccccaggaacuguaagauuagaaggacaagggacaguuuauauucagagcguggggugugagagaguagagcagaaccaaguuuucugaaguuuuaucuuggauucugcugugacuaaagcugguguaaaaacagucugucccagcaacagcacacugugacaggcugcaggagcucaggagucccugaauaacuacagcaugcauggacacucugauuauaacugugugacaagauaugaaaagcagaaagaaaagaagaaauagacuacagcuaagaugauuuuuaaaguacagaauuuuuucucucucccagacucuguauuuaauuucauuaaaauugcuauguuaauaucuccuuccuguagauauugggaacauagagaaaacuuguaaaaagaaaucuucagggggcuggagagauggcucagugguuaagagcacugacugcucuuccagagguccugaguucaauucccagcaaccacaugauggcucacaaccaucuguaaugggauuugaugcccucuucuggugugucugaagacagcuacaguguacucauauacauaaaauaaauaaauaauaauaauuaaaaagaaaagaaaaaaaaagaaaucuucaggcugacuggguguuagcucugaguugcagugcuauggggcaugguacaagaccucccuaggacaacagacccucuuaacugcccuuccuucaaagggcccuguacugcaggaaccacugaauuccuucccuagagaauaccagacgccaucucauuugaucucuguauuguaaaugguaaaugcagcugcaagagucauuuuuguuccucccagacugauguuaaugccucuuaaugaggaaaagggagacaagagaaaggauuaaauaaagagccaucaucaacaacuggacucacuuaucaacuuuauaucaaaaugacaacuacaagcugagaaacagugagauggcucaaugguuaagagcacuugcugcucuugcagaaaacucaaguucaguccguagcacccaugucaggcagcccacaaguaccugggaauuaggucugugaucuuaggcuucucgccuggccuccacaggcacugcacucagucauacacagauauguauacauaaauaaaauuuagaauguuugaaaaauauuugggacaggggaagccucucaaaucagacugucuuaucuguuuguggguuggguuguuaauaccauaaugucucuauuuaaaaauuauuggggggggggggggcuggagagauggcucagcgguuaagagcagugacugcucuuccagaggucccagcaaccacaugguggcucacaaccaucuguaaugagaucuaaugcccucuucugguguugucuaaagacagcuacaguguauucauauaaauaaaauaaauaaaucuuuaaaagaaaaaaaacuaauuuuacauauaaacagacuucuguaguucaaaaguaaauugcuuuuucuauuaaaucaugggagaauguauuuacuuuaucucagacucaauuuucaauuugauugauuuuauuaauuuuuuuuuauguguaugggugucuugcccacauacacauuugugcaccaugugcacacuuggugcuguggaggccugaagaagguauugaauccucugagacuggagccauagacaccugagagcugccauaguggguuugggaagaaaagucaguccuccacugcugagcuuucucuccagcccuuuuguucuugaaauguccucagcaagcaagacacuaacccuucuaauggcagagaaacagcagguuggugucgcacaucucuaaugccuauacucaggaagaauaagcaggggauucucugaauucaaagccagccuggucuaaagaguaaaaguucuaggauggccagagguacauacacauugaaaucaggucuugaaaacaaaaacaaaacccaaaccaaaacaagcaaaacaaaaggugccacuuaccaaaccaugagucuauauuuucaguauccucuucagcauccaaagaugaaaaauugauaaagucggugggggcaucgaaagaguaaguaguagggacuugugacauugccccaacuuagugcagaaaaacaagcuuuuuccaggauucuaauacucuccucaauagacugucuucugagggaagaaaugguuacaaaaaauugguuguacaucaauaguaaauauugauuccuacaaaauacuuugguuuuuauauuuccaauuuagaaaaucauccaggggcuggcauggcaauugcaugcuuauaauccuagcacuuaguaaacagaggcagauggaucucugugaguucaagaccagcuuggucuacauaauaaauuccaggucagcuagggcuacauagugagacacugucucaaaaaucaaaacacacagaaaggagagaggagggggacgggugggaaggggagggaaggggaggggaggggaggggaggggagggggaggacaggagaggggaggacaggggaggggaggggagagggagagugagaaggagaggaaucuuguaaauauaccuuaccuuuuuaaaucaaccuaaaaauuaauugccugggagauugcucuaguuuuuggacuuagaaagaagucaguuuggggcuggugagguggcacaguggguaaaggcacuugccaccaaccaugaauaccuaguuuuauccccaaaacccacaagguagcaugagagaaaacugacuccugcaugcuguccacugacguagcaagcaagcaacccacacagacaaauaauuguacaaacuuuuuucucguuuuuccuauuguaagaaaaggccaaguuugaugcauacuucagucugccaugcacuacuggguguggcacuaauuauucauuuucccucaauuugccauuucuuauuucuaagccuucuuccaccuagguacucacucucugccccauaaccuaauuucuaaaacacauuauuagcuuuuauaccuaacaaucuuuacccaaguccaacuaaaauucuagaaaaugcuaugcaaguauccacccauuacauaggauuaucuccaaacccacaguguuagcuuuaucuccucuagaauaacgagcauccaacuuuguaucagguaaccccauaaacgauuauccuggcagucugugcauucugaagacaaaagguaaucuuaguuguguguaugagggugcuuagcagagguuuuugguuuuuuguuguuuuuuuuuuuuuuggauuuuugagacaggguuuuucuguauagcccuggcuauccuggagcucacuuuguagaccaggcuggccucgaacucagaaauccgccugcuucugccucccgagugcugggauuaaaggcgucuuaugcacagaagagugaaacauaguuuucccuuggaaauauuuuaagaaaacucuauuccccaguugaagguauagcucagugauggaaagcaaacuuagcauguauaagaaugugauuuuaaucucacacugaggggggagaaacaaaacaaagcaaaacuccccuaggcaugaagaaaaugacuuuauagucaucaagcagaguaaguaaaaggaccaagccagcacuacaggccuaugcccaauaccaacaaaacugcauccacagugugcagcaaacagcaacgcaacccucucacucuacuucuaucuagguaacagaauagcugcaguagucagaaaaauagccuaaauggcauguucacugacaaaaaauugccuacugagugagcaguuugucagggcaugucugucacacccagugcucagaaggcagaaacaggaaaacucaagauucagagcaagacccuaucucauaagagaaaaagggauucuguaucuuguaagggauguagagauggauaauauuugcauaaacguuauccucucuugggaucaugggauagucauacccgacaacccuaugugccauuucugguauccacaagaaaagagagauuugacaccugcaagcaauuuuccaaccuucauauguaugugucagggcacacauacacaaauaagguuuguuuuuugguuuugguuuugguuuuuucaagacaggguuucucuguguaggucuguccuggaacucacucuguagacccaguuggccucaaauuuauagagcuccaacugccucugccuuccaacugcugggacuaaagacaugcaccaccacuacccagcuaagaauauuuuuuaaacuuucuuuaagcuggguguggugaaacaugucuuuaaucacacaauagaagacaaaagcagguuuggaguuugaauccagcauagucuacguacugaguuccagaccaagccagagcuauauagcgaaacaugccucaaaaaugaaacacacacacacaaaaaaaaaacuuucucuaaaugccuguaaaaauucauuuuauaaaaucuauguucauuuaaaccaaaaacccuuauauaaaaacuaaaccagagccagguguaauagcauagaccagcaccacucaggagguagagucaaagggaugggaguuuaagacuagucugaguuacauuaagacccucaaaacacacacacacacacacacacacacacacacacacacacacacacacaaaacaaggucugguagcuuaugccuagaaucccaccacccaggaagcaaaggaaggaugacuuuauacaaguucaaagucagccugaucuauauauacaacaaguucuaaggcagacagagcuacauagugaguaaacgcacauuaaagucagauauagcuacagucccagcacaucuugaaucuguuucauauauucuacaaauacuccauggcaauaaauuugagcauauaccauuaccuaaugauauguagaaauuauuuauacccccuuuuuuuggaauuuuucucaauauuuccacuuuaaaaauacuucuaacugggcaguggugguacaugccuuuaaucucagcacuugggaggcucugugaauucaaagucagccugaacuacauacagagugaguuccaggacagccugagcuacauagaagaacccugucucaaaugaaaacaaaaaacaaaaacaaaaaaccaaaaaacuuuugagaagaaauucuuguagcuaauauucuguacauauugguuauuuuucucuaaaauaauucuaaugagguaaaaaugcugaguugggggaucuuaaugcauacuguggaaaugcucucagaagaacaucacaucacuggggaguaugucagcuccccaaccgcaugaccagcaauucuuucuuucuuuuuuuuuuaaagauuuauuuuauguaugugaguacacuguagcugucuucagacacuccagaauagggcgccagaucucauuucggaugguugugagccaccaugugguugcugggauuugaacucaagaccuuuggaagagcagucagugcucuuaacugcugagccaucucuccagccccccccccuuuuuuuaaagauuuauuuauucauuauauguaaguacacugucuucagacauuccagaagagggcaucagauuucauuacagaugguugugagccaccaugugguugcugggauuugaacucaggaccuuuagaagagcagucggcgcucuuaaccgcugagccaucucaccagcccaugaccagaaauucuauucguugcauauugcauacuggaugucugaacuacaccacugucaacauauucugagcucagucacccaaccuucauuucugcccagugguuuggccagcauuuccuuagcuucucagugaacgacucauguggaaaguacuucuggguuuuagagugucucagaaacaauuguuuuaacaaacaacagauuucuacaaugacgucaucacacauacuauacauaccauacaacuucuuccuuugaacucauuauagcuuuagcucuuuauggcaacauucuaguugaggacuuagaguagaaacugauacucuaaaauugugaggaacuguagguaacaucugaggguuuuuuugucuugguuuuucaagacaggguuuuuuucuguauagccuuggcuguccuggaacucacuauguaaaccagacuggccucagacucagagaucuaccugccucugcuuccugaauguugggauucagggaguaugccacuaugccuggaugguaacaucugauuuuugcagcuuauaaugauuaacaaacuaggguuuaccaaaaaccgcauaacaauacuaaaauugugguuaaaaacaaacauaggaacaaaaauaacucccagagauggcagguuguauuaaguacuaacucucuauuaacucuaauguucaucugcaaccuuguaaagcucaguuacuguccucauccuagagaagaaagcugaagaccagagauuaaauaacagcucacuauccugcguguaaagagcugucuccuagcagcacacccugacacgccucccccacucuaggacucagcaguguuaggaggaucaggucuccauuugugugcaggauggcccuugcucugcagucuccugaccuggagacggcucucuauuccaccauccuaacaaucacucuccuccauuucucuucauuauucaugggcuuuuuguuuguuuugcuuauuuguuuuaucuuuguuuuuuuguuuuucuuuuguuuuggcuuuuuuuuuuccugcugaguuauuauuuguuccguuguuuguuuuuguccuuguggguuuuuuuguuuuguuuuuuaagacagggucucacuaucucguccugugucacccuggcuugccuggaacuugaucucuacaacaagcugcccucaaaaacucagucauuuagccucugccucuagagugcugggauuaaagguacgaaacaggacacccagcuuuuuuuguuguuguugcugguggggguggggguaaagacggggacuuacauagcacaaauuggccuagaacuuguuauguccacacacacacacacacacacacacacacuauacauacaaauucauaccaaauaaauagcacaugcaaagcuuuaaaaaaaauuuaaaaaaaggggggggggacaauuagcaaaggauuucucugcuuggaaaaaaauuuuuuuuuucuucuuugaacaacuaugcuggaagacaugggaaaaucuuggauucccaugaucucaauagcuaacugaggucacugggaacacuucccagccaggacuauaaugaagacaagcagagcuggggaggaagaggcaggaacacaacacaccccaagcauacaacgcccucuaaaacacuucaacuccagcaguucucuggagaagcuggccaucacucaaggauauguacucuuuugaccuuuacuuagaucucaaauuccuuuugucuucuuuauuuauuuaugaauuuuuauuuuuauuuauguguuuggguguuuuguccacuuguaugucuggggaugaagugucuguagaggcuggaaaagguggugagauccaucuggaacugagcagccaugucaauggcugggccauuucaagccccuuuccuacccuaaugccaugcuuaaaucuguuuuaaaccccuuucuugacaaacccuaacucgagcuagguguggcacuugcaaggccaaggcagggaaaucuaaggccagucuauuccuuccugaguuccaggacagccagagcugcagugagaccuugucucaaaacaauagacaaacaaaaaagccaggcaguggggcucgcuuucaguccaucacucaguagacagaaagaggccagucucugaauuuaaggccagccugaucuacagagaaagucccaggacaccuugggcuaugcagagaaacccuaucucaaaaaacaaacaaacaaaacaaaaauaaagggggagggauuccacuaaagaauucugguaaaaaacaaaaccaaaccugacaaguguucaaaucuagcuuuucacaugcuuuauuuuuuugcugugugucuguauguguguguguugugucucuauauguguauguguguguauacaucugugucuuuguguuggagugggggucuucucuggcugaccucuguccuccugucugggccucugaauucaaagaaacaaaaaaggggaaaaagcaacauauucauuuauccauauacauggaugaagaaguagugaguguuaguagcugaguuugugaaggacuugggaguccugcaguaggagagaccacacucuaaagcuuugguguucuuuauuauuauauaaaauaaauguuuaccuuuucauugaaaaggcuagcuagcuaagcauuuauuuuccucuaaguuugcacucagaaaagauuggaacuccugcaguuuuuguuaaauauuuuugauaaucugacaauaauuucaaaucaauugcuuuuuggaaauucuacuuugcauuuuugugguucauaaauugaccacuaucuugacuuauccaaacauaacauacucuuucugguauuuauguauauuuuaaauauuuauuuaugcauuuuauguauaugagugcucugucuucaugcaugccagaagagggcaucaugaugaucccauuauagauaguugauugcugggaauuaacucaagaccucugaaagggcagccaaugcuuauaacugcuaaggcgaguccccagucuuuuuuuugaacuugcacaaguguuuuuugcuugcaugucuguaugugcacccgaugugugccuggugccugcagagguaagaagagggcaucaauggccugggacuagaguuaugggugauuaugaaguaccaugugcguguugagauuuaaaccuggauccucugugaaaacagcaaccacuguaaccacugagauaucucuucaggacaaugaccuauuuuuuaaaaugcuuccuuuaauuuuuuuuugguuuuucgagacaggguuucucuguauagcccuggcuguccgggaacucacuuuguagaccaggcuggccuugaacucagaaauccgccugccucugccucccgaguguaagauauauuuuuuaccuagaguggccaacucagaaggccgcccugacacacuaacugagcauggugucucacacuguaaucccagcacucgagaaccuacagcaagaggacugacucagaucauccugggccuauauacugagaucuaggcuagccugggcuacaaagugagacuuugucucaacaaagaaaaacauaagaaugcuaaaacacccugucucuccucaaaauggaaucaaauuaacaaauaugaaucaguuaucccuugagaacucucauccucuuguuaaagccugacaaaguauaugaagauaaccaaaaguaggguuggggucugagcuuggugagaaaauaaacaggggaagugaguugggggcagggaccaggacacagagcaaaguaacugcuaaaucaagacaguuuuagaacacugccucacuacaaacaauaaauacuaggcugucaaaacagcaaaaauuaaagucugcuggggccuaguuggauaccgcacaggucaaagcuaagggcagcuguuuaaaugagagccccacaaauggugggaacuggauccuccugcaacccuucaucaagauugaauuucugucaacaggucucacugaaggggggaaaaacgcagauacgucaaccacauucccuuaaacaaaucaagcugccaaacaagagaauuaacuucauauuucaaaauuaucugaaauugccacagugcagauuccugaaaaacuacaaauauucucaggagaaaaugggcuugauggcacuuuaauccagcacuggaaaacacacacaguggaucugaguucaaggccagccuugacuaaacaacaaauuaagaaaaugaaaauuaaauaaauaacaaagaaaaaacccagcuuuuaauaaaaauaggcuuuuuuuuccucagugaugccagaucagaccagauuagaaguagauaaaggcaauuuucuuaggaggcagcucugggguggguucaccuaaucuuacaauggaagugacuuaucuaggauaaagccagugggguuuaugcaguugaaaggaggagugaugaugugucagcuaggaguuggaaugguguccaaacaugggcaaaaacugagcccuugggcgggcacucuugggacagaaacuucucugagggcaggguugggugaaggagggcagcagggcuuuucccagcuagugcuggggaugagcagauuccagccuaacaaaaaauccuacagggaaucugagggaggaaaaggggcucagugcuuaagagaacucucugcucucucagguccggguugauucccagcauccacaugguggcucacaaucaucucuaacucuaguuccugagguucuguugccuucuucagacuuacaggcaccuagcaugcacaugauacauauacauauaugcagacaaaaauagucacacaaaauaaaauuaaguagaaauauucuuuaaagaaagucuacacaguaugcuaugcauaaaucaguugcgacauaugaacuaguucuuuauaaaauuguguauuaaacaccaccuaucauaucuuauagcccaucugauucccaaaaugaacacugaaaugauuuauaaauguggaauccuuuuccuuaaaaaacagacaauugggguggacagagguggugcauagcacaccuuuaaucccagcacugaaaaggcagaggcaggaggaucucugagucugaggccagacuggucuacagagugaguuccuggauagccccugucugagaaaacauaaaaauaaaaaugacuaacuuuuucugaggaagaaccaggugaaaagaaagaaaacugaagacaaauacacaugaggaagauggcagaagcaauguagccuuuucuacauucaucugaaauguaccucuugucaccucuugucucucuucauuccaaccagaaauaacuagcccugacaagcucuauaaaucaaaaggugcagguucagaagggguggggaagcugcacggagcacacucuaagcaggccugaaacugcaggcuagugcucuucccaaaacagccagccagugagggaagggccagcagcucagcacccaaccugugaaacagaaaggaagcacuagcuaaccgggugguaauuaagagugaacacaagucagggauucauuagaagccaucagucagacucuucucauccaggccaggccauuucccccccaacacucucucccgccuucacugcguaagugaucucacuaaauaacacauauuuucacuuacccagaaagaaaacaucuucauuuuuuuuuccuuguacauaaggaauuagaaagagugagcaaauggcaacauauccugcaucuaguuuugacuauaaaucaaacuuacaaacuagaucugaagaaaguuugauggacauuguuuccacauuugcuaacuucuauguugaaaucagaucuguuuacagaaacagaucuaugaagcuuccaaaauagggucaguuuaaaauccgaaacaaucccucaccacccaacacucacaagucagcacaggacacacuggacacuuguucuaauuugccacuguccagaaugccaaucaacauguucucauuucuuucucgagcuuagcaauucuagacaggcauggugucauuaugaauggaaucacaguacgugggcugcugaagcagcaggauagccaucaguuguuggccaaccuaggcuaccuagcaaauuugaggccagccuauaagacuuuaucucaaaaaacaagcaaggacaauggagauggcucagugaguaaaggagcuguagucagaccugaguucaaucccugucugugguaggcaggcaggcaggcaggcagacagacagacagacagacagacacacacacacacacacacacacacacacacacacacauacaccacaccauaccacaccaaaaaccuuguaagugucauacuguauugaguuugucuuuuuuuguuguuuuuuugagacaggguuucucuguguagcccuggcuguccuggaacucacucuguagaccaggcuggccucaaacucagaaauccacuggcaucuaccucccaagugcugggauuaaaggcgugcgccaccacugcccggcuugaguuuguuuggcuugagauagggucuaucuauguagcccuggcuguucuggaaaucucuaugaagaccaagcaggccuugaacuuacagagauccgccugccucugccucuuccaagugcugaaauuaaaggugugacuaccacaucugucuuguauuuguuuguuuauuuguguggucauauuaacaaacauucacuuggcuuuuugccccccuccccacaccucccuugacauaucucugaggcaggaucacacguugcccaaucuguugcugacaaugacuuucaacuccuaaugcuuuugccucugccuccuaagagcugggacuacaggaugugcccccaaacaguuuguucuuaguucuuguuuuguugugguuuuuugagauaggaucggaagaaagaaagaaagagagagagagagagagagagagagagagagagagagagagagagacagacagacagacagagggagggagggaggggcaggcaggcagauagaccagccuugaagugaauauaugggcaaagcuagccuagaacuucugauucucuugccucaaccuccuaaaucugagguuacaggucugagaugacuccacucccauaccuagcuagaguaucauuuuuuuacuugaaguauggacuuagacaaaaaccugucagucaagcuagacaugguggcacagaccuguaacuaacuguucaggggaugaaaacaugaggauuacagguucaaagucagucuagugacagugugagacccugagucaagacagaaaauauaaaaggggccaggagugguggcacucacccuuaaucccugagcucuggaggcaggcagaucucugaguucuaagucagccagggcuacauagugagacacucucucaaaacaccaaaagaaaguuccaggcuggagagauggcucagcaguuaagagcacugacugcucauccagagguccugaguucaauuccuagcaaccacaugguggcucacaaccaucuguaaugagauccugguaugucugaagacagccacaguguacucacauaaaauaaauaaauaaaucuuaaaaaaagaaaaagaaaaagaaaguuccaaacggacuugaguugagucaguaauuaagaguaugagcucucgaaaccacccccucaaaaaaaagaguaugaacauccgggcaugguggcgcacaccuuuaaucccagcacucgggaggcaaaggcagggagauuucugaguuugaggccagccuggucuacagagcgaguuccaggacagccagggcuacacagagaaacccugucucggaaaaaaaacaaaacaaaacaaaaaaaaaccauacaaacaaagcaaaacaagaguaugagcuucucuuccagaggaccuggguagggcuccccacacccacauggugguacucaacugucuguaacugcaguuucaagggaacugacaucacggacuccaugggcacccaacaggcaugagauacagacauacauacaggcaaaauacuauauacauaaaauaagauuaaaaauauguacaaaauaaaauaauaaaaauuaaaaguacaaaaagauauaagacuagucugggcaguggugguucacuccuuuaaucccagcacuugggaggcagaggcaggcagauuucugaguuagaggccaaccuggucuacagagugaguuccaggacagccagggcuaccuacacaaagaaauccugucuugaaaaaagaaaaagaaagaaagaaagaaagaaagaaagaaagaaagaaagaaagaaagaaagaaaaaaagaaagaaagaaagaaagaaagaaagaaagaaauuaagaaagaaagaaagagaauuaaaacuagcucagugguaggauuugugaaauucuggcuucaauccaacacagcagcacaaggcagccauaauuucucuuaaaaguaugacaaaguaugauaauggguagcuuuacuuuuucuuuuccaagcuuaaggaauuucuuucuaagauauguauuagcuuuaaaagacacauuuaaguucuuuaaacauuuaugaagcugguaugcuaaaauuucucuuauuccuuugagcauaacucaccauguauacacaccugacaaccucgcucaaagccacaaucaaguucucaagucucuugaauucuugcagucuggcagacacuucucaugaagaaccuggaagcaguugaaagguauuuuaaaagguuaagaauaaacuuaaaauauuuuguguauggcuaggcaguagugguacacgccuuuaaucccaggacuugggaggcagaggcaggugggucuguaggauuuuaagaccagccuuaacagagcaaauuccaggacagucagagcuacacauagauuugucuggaaaaaaacaagaaagaaaagaaacaaagaacucaaucaagcacggacucauuuguggcugcuauaucagcuauauuaucauuugagcagauuaacacaucuucugguaccugaaaugcagcuauugaucuaacaaaugccuuuuucccaguaccuauccauaaagaccaccagaaguaauuugcuuucaguugacaauuucagcaguguacuuuauaguuuuacuucaaggguauaguaagccugcagccugauaucauaacaaauaacaacugucucucuguuacacaaaauaucacauuuguccacuuuacugauaacaauaugcugauuggagugaguaagcaagaaguagcaaccacuuuagacuuguugguaacauguguacaucagaguaugggaaauaaauacaaccaaaucuaaaggccuaccccagugaaauucuuaggaguccagugguauggggcaugcagagauauuucuucuaagugaaggagaaguuauuguauuuuaaauacuuuagugguccuauuuggauucuggagauagacaauuccucacuuugguauguuauuuugcgccuaauacaaaguuuugcuagcuuugaauagguccugugacagaaggcucuucaauguguccaggcugcugugcaagcugcucuaccacuugacaauaugaccuagcaaacccaaugguacuuaagaugucaaaugggggcuggugaaauggcucagcgguuaagagcgcugacugcucuuccaaagguccagaguucaaaucccagcaaccacaugguggcucacaaccauccguaaugaaaucugaugcccucuucuggaaugucugaagacaguguacuuacauauaaugaauaaauaaaucuuuaaaaaaaaaaaagaugucaaauggagaugcuguuuggagccuuuggcagaccucuacaagaugaaucacagaagauaccuuugggauuuuggagcaagauucaaccaucaucggcaaacaacuauucucccuucgagagauagcucuuugccuguuauagggccuuaacggaaacugaaaguuugaugaugggccaucauauaaccuggucuagccaucaugagcuggguauuaucuaacucacuaaguuauaaagcaggacaugcacagcagcaucuauuaccaaauaaauauaauaaguaauauguaugugaucagauccuaaagccauaaacaaguuacauaggaaguugcuuaaaugccuaugguacaaauagcaucuguuaccaagcguuaccuauagccucgugaggagugcucuaacgagaagacuaugggcugguuacugaugguucuguauguuaugaagucacuacccagaaguggauaacuauagcauuaaaaccccuuucugaaacaacccugaaagaggaaaucuuuacaaugggaaaaacuucaggcacaucugggacucaguauuggucucugcuguuggcauaucuggcauucagcagcagcuguacccaugucagccuuggugaguagaaauccacgcuguuagccugugcauaaccucuauuucuaccaucuuggacacuuuguucaugggucuauugggcaauaacagauggcuagagaaagaggcugaucuggcucauuucagagccagacacuuguggcagugaucccacaaucauggaauucacgauccccuuaccauguuccccaccauccugaaguagcuggccugauagaaagauagaaugaccuuuugaagacaguuacagcaccaguuagguggcagcagccuggagggcugagacagauuucucuagaaugcaugauuugaaucagcauccagugugugguaguuucuuccauagccaaaauccaugggucuaggaaucaaggcauucaaaggggaaucauuccaugcacuauccaucgcuaguaacccacuaggaaaauuuuugcuuccuguucuggacccuaaguucugcuggccuagaaguuuugguuccagagcugguaacauuccugccaggagccauaacaaacauccaguugaacuagaaguucagacuucccccuggccacuugggguuucugaugcccuuaagccaacaguaaaagaaaggaauaacaguguuaggaggggugauugauccagauuagcaauggaaaauuggauugcuucuccacagaagagguaagaaagauuaggucuggaguacaagagagcuuuagggugucucuugguacuaccauguccugugauuuaagccuauggggaacuacaacagucuaauccaggcaggaugauaaagggcacagacucuucaaaaaucaagguaugggucacuccuggauggggguagagagggaccaacaguuuacugaggguggaggaaaaaauacagaauggguaguagaggaagguaguuauaaauaccugcuaagggggcuggagagauggcucagcaguuaagaacagugacugcccuuccagagguccugaguucaauucccagcaaccacaugguggcucacaaccaccuguaaagggauccaaugcccccuccuggugugucugaagauagcaacagcguacucaaauaaauaaauaaauaaauaaacaaacaaauaccagcuaagacugugaccugcugcagaaaugaggaguaacauuggugugaguguuccugucauacuuuguuaggaauauguuuauggacauucguguucuuuccuugauuuuuuuuuccaagacaggguuucucuguguagcccuggcuguccuggaacucacucuguagaccaggcuggccucgaacucagaaauccgccugcccccaccucaagugcugggauuaaaggcaugugccaccacucccuugauuucuuuaucauacaauguaacaucaaauaagagaauaucagugguuaucauauuuaaguucugagaugccaaaagaaugucccucggcugggcagugguagcacacaccucuaaccccagcacuugggagacagaggcaggcggauuucugaguuugaggccagccuggucuacagagugaguuccaggacagccagggcuacacagagaaacccugccucgaaaaaacaaaaaacaaaauaaaaaccaacccccccccccaaaaaaaaagcaugucccucaagggacacuacuaucuaggcuaacauuuauaacgcauuugcaguuguaugaaggguguaauaaugaccugguuauuguuuucauuuagaaauuaagaauggcauaaauagauauaacugugugucaaguugacaagggguaaauuugaaauggcuauucuuaguugucaacuugacuguaucuagaauuaacuaaaacccaagcacuagguacaccugugaggcuuuuuuuuuccccuuaauuaaaucauugaaguggaaagaccugcuuuuaauaggaaucucuugagauaggaaaauacaucuuuaauccagaucuuuugagguuggaagcuccaccuauuaaucugggccuauauaaaggacauggaacaaagcuugcucucuuugccugcuugcucucaaugacaaguccguuccuucaucgccauuagagccuaauugaugcauccagccacgaggccugaacaacuacuggaucaaugguuguagacaaccauuacuggacuagcuggaguguguaugugugugccugugugugugggcgggcgggcgggcgggcuugugugugauauucuguuccucuagagagcccugacuaacacuuuucuauuauacaggaucuugggcugcugauuuacauggcucugucucaaauacaaaucuaucuuacauaauaacucaagcuagucaaucacaccauucucagaucugcuuccuaccacggcaaaacaaaaacaaaaacaaaaacaaaaacaaacaagaaaaccccaccaccuuugugaaaggauacauaaauucuccucucuguucuucucccaaaaguuaaaaaauguuuguuuuuuuuuuuuaaaaaaaagaagcuggguguacaggcucauaguguagagaacagacccaagagaagcuaaaggauaaaaauauaaagggaauguaggauucagucucuccugauacaagaacaaaaaacaaaggacuuuucaacaaaacuuuucuuugaccaaacuuaacuggaccagcaagauaaucugagaauuugguucuaaugagcacauuagcauaaacuuggccaaaggaauguuuuuauuuacauacuagaaaacuuaaaauuacuaugaucuaguuucucacacuugcuauuuugcugccaacuuagacagggccuuccuagacauccaauucaacauauaugcagccugguuguucuugucccugucuagccaaacccugcuuucugagaguuuguaucccagacacuucgaaaauccaaccuucccucuuuuaaaucucauccaucuccacuucuaaauugccagaauacuuguaaacaaaaacaaugcauuuaucuacauaauaacuuacacagauucugucuuaaacauagaaacugguagaguucuugucuuaguauacaaagcccugggcucaaucucuagcacuggguaugguggugaaggaaagaggacuaggaguucaagaacagccuaugcaggcuggagagaugcccaaggaauauuggcugcucuuccaaaagauccagguucaauucacccacauggcaguucucaacggccuguaacuccaguuucagaaguuccaacaccuucaugcagacauauauguaggcaaaacacauaaaguaaauaaacuaugaaaaaaaccagccuuucuuucaggcccaugugggccacacaagacccugucucaacaguaauuaauaucauacauacacacacacacacacacacacacacacacaaaaggacaaaguaucccagccacccucucuaccaugagcaagauauuggguucaaaccccaauacccacacacacacacacacaauaacacacacacaaauaaccaaccauuuugauuucaagcauaccagaaaacccuugaauacauuaugcaucuguauacauacagaaucuaaaaucaacuaacauaagcacauaauauacucucaaaggucaauuaguuggcccaauuagcuguagaccaugauaauuuugaacuaaaaaugauaacaugaaacuacuguagagacacaaaccaagcaagagaaaacaguaugaucuggggcaacuugacagguguuaaaauacacugaggccacacacaagaauauucuuacuaacaggcacugugacacacaccuuuaauuccagaaccugggaggcagaggcaggcagaucucuguguguuugaugccagccuggucaacauagugaguuccaggacagccagggauauguaaagggauccugucucaaaacaacaacagcaaaaccaauauuuuuacuauauuaacaaauaguucuuuaauuguuuuuuaauaugagaaaaggacaaauaaagacaaaggauguggggcuggagagauggcucagugguuaaaagcacugacugcuuacucuuccagaaguccugaguucaauucccaguauccauauggugguucacaaccaucuguaaugggauccaauguccucuucuggugugucugaagccagcuacaguguacucauaaaaagacagugggaaguaguggcacacgccuuuaaucccagcauuugggaggcaggggcaggcaggucucugaguucaaggccagccugaucuacagugaguuccaggacagccagggcuacacagagaaacccugucucaaaaacaaaacaaaacaaaacaaaacagacaaaggaugugaagauacaagguaagaaugaggcagaaacacauacauacacacacacacacacacacacacacacaaagaggaaauaaguuuggugggaguccuugaugcuauugagaaaauuauaugugacuaccaaucaggaaaauuggguguaagcccaacccacaguacuauaugaucugggccacauccuuccuuccccuccaaucuauaaaaguuccaagaaaggaagauaaaagggcaggaacgccuagugacucgauacaaagagagagagcaauaaggagaaaauaaaaugaaucuuacauuccaaacagaagacaaucaaaauggaauuaaacucuaccucaauuguguuggcacaacaacaaauuuacuuugcuaucccagacaaacgcuguuggugaucacaucucuuuuccuccaccaaagcuauucaauggcagggcuauuuccgcccacugggccucgccuuccuucccuaaaauaauguuuggaacgcuuaaugaauaagcuuggugcgggaacugcagagcagugcuuacaccaacaguccuuaccgucuaguggcugacagccuggagcagccucugcuccgggguucccagaaauaccaacgccccgaaguccugucaccggcguccaaagcccgcgcgcugucuaggcuguccggacccgcccgggggacuccccugcccucucagaacccuggaaaaacggccuccggcgcaccgcugccuccccucaccuucacgcuacuuucccgguuucagcuugcaccaacccuacgaguccagcgacucacgaccgcgucaggacucaacugguacgguugaaaauuugaacucagacacccggucgaacgcaccaaucagagagccggaagccaacaaaccc

SEQ ID NO: 1182 - RNA, 842 nt, Mus musculus
uguuucauuacguuuagguucuuuuccauggaguuucugucccugggaaauagagcugagugcuuggcagacugugguugguacugcuugcucgagguagcguuucagagagaccugaauacaaauaguuguuuagcaagaugggcugugacucaccccucgcagcucaguaccgugagggcacagcauuaauuuugguuuuaauuuuucaaggguuucucuguguagcccuggcuguccuggaacucacucuguagaccaggcugccucugccucuugagugcugggaguaaaggugugcaccacagccuccagggucacugcagggucacaaguuguuuuucacaagguuuguacauggcaugcaugggguucaaagcugugaagguagaaagguguccccguccccguccccccucccccacucaguuguccuccccagagaugguaggugucaccaauuucuuguacccccuuccccugcaccuccgcacacaaguucccaccccugccuuuaucauaauauauacaaaucacaucccuuuugcuuuuuuuucaguguuuuguggcuuugaaugauggaacuccugcacuacacccgagugugaagccucgugggaacugagcgacguggcaguccugaagcccaggggcagaucagcugcuggccuuggaauggcuuugcugaggugugagaggaugcugcuauuuauuagcuagaggaccugcuuaaaccucuguuuccuguuagagaaaucuauuuacuuauacaaagcucccugcuugcacagcugguuuugaccucacuguguagcucaggcuggcuuugaacucaugauccu

SEQ ID NO: 1183 - RNA, 842 nt, Mus musculus
aggaucaugaguucaaagccagccugagcuacacagugaggucaaaaccagcugugcaagcagggagcuuuguauaaguaaauagauuucucuaacaggaaacagagguuuaagcagguccucuagcuaauaaauagcagcauccucucacaccucagcaaagccauuccaaggccagcagcugaucugccccugggcuucaggacugccacgucgcucaguucccacgaggcuucacacucggguguagugcaggaguuccaucauucaaagccacaaaacacugaaaaaaaagcaaaagggaugugauuuguauauauuaugauaaaggcaggggugggaacuugugugcggaggugcaggggaaggggguacaagaaauuggugacaccuaccaucucuggggaggacaacugagugggggaggggggacggggacggggacaccuuucuaccuucacagcuuugaaccccaugcaugccauguacaaaccuugugaaaaacaacuugugacccugcagugacccuggaggcuguggugcacaccuuuacucccagcacucaagaggcagaggcagccuggucuacagagugaguuccaggacagccagggcuacacagagaaacccuugaaaaauuaaaaccaaaauuaaugcugugcccucacgguacugagcugcgaggggugagucacagcccaucuugcuaaacaacuauuuguauucaggucucucugaaacgcuaccucgagcaagcaguaccaaccacagucugccaagcacucagcucuauuucccagggacagaaacuccauggaaaagaaccuaaacguaaugaaaca

SEQ ID NO: 1184 - RNA, 13670 nt, Mus musculus
ccgcggcaccgcccccuccacgacccgagcgcccgcucgcgcggcucccacaaugcaccgcacaauggcccgaccgccgccacuaccggggccugagcgggccuggcggagcccgagcgcggcccggcccgcagcgcggggucccgagcgcagugagugccggcgaggguccugggggaugguggggagcggggcgggaggccgucgcgcugcgcccacacgcccggcucucggagcggcggcgccccucacuucgggccgcccagcgcggucgcccacaccccugaguaggggcccccuuugcucuagccgggcccccgauaggccccguagugacgaaaacguuccccggaccucagaccugugcccaggggaccggaacaagccuuucaggcucccuccauuccuagaccuggaaacucagccugaggguccccuagucuggaccccccagacucccuggagacccagauaacacgcagcuaaccuuccucgggaucgcggucuggggggcauagauaagcugcaccuguucccacccucggacacgccuaccccgacccacauaaccuuccuuuuccugcuccaaauagucugcucuaagcucuuucguuuuccagacuuucauaaaccugcuuucaggcuuuucugcaguaccucgggccgaagaacccaaaauaaagcccuagcugaaguucccuucccagugaucauauuguggaaaguuuaggcauuuuccuucgggagggucccauuucuacacccguuugaaauucagagaacucgcucuuucgaccuuuagaaucucccuaccucuuccccccauggggucucuuagagacucaaauaacgugcucguaauucuuuaccgugcaugcuugcucuucccaccccagauccuauuagacuuuuuagacuuacuauugaauucccgucucuugucuccacucuuuacauccaccuuccaauuguggggagaauuuaacauuucacacuacaaaauaggguagucucuccgcuggccuaagggccagacuuccuacaacuucagccccaugcuucaguccagcuuggaacagaucggggucgcgggggggggggggggagggggcgguggcgcgguggcgggccgcguuccuggccguguugggaguuggggcuuucaccugcaagcauaccgacuccuggcuuguguguuuuuccaccugucagccuggggcugugauaagucuggccuuggguuucuaacccucuccucuugggggaaaggcugcuaaguugcggaggggugguaggugaaaaugaggcccgagugaguugcagccauuugcuccaggccuccccagggcugggaggcagcgggaaucugaggaaauagggaaucaaagggacuccaaagaggcccaucuacacugacagaagaacuaccagcccgagaguaaauccuaccccuguuaauccuguuugauguuucuuggaaugaugcaagucacugagacucucaggccucccuguaauuuaauucucccaccauuccgggguguugugugugugcgcgcgcgcgcuggccuugggaagugggcagcucuucccauuccuccguuccuucuuacuguuuuccagccagccagaaugcuuuuggauugguuucugauguccaggucaaggccuguuuuguuuucuuuuccccuuuaaugcuauuuauaauuucccaguugcuauuuuaaguucuuuugaggguagauuccaccuccaagaaccuuucuggguguguuuccuccuaggcagguguugaauugaguucuucagagccccaaguagcucuugggcaggagggauaaaagcuauuuuaggguagucacugaaguggagcuguuaauccucugugggucucuuuaguuaagaacacucagagauuaacccuuucuuugcugcaaagcgaaccggcuagcuuaacaguauuugaugggagaguugggaaaacuggacuguggcagcagaaggugugaacaugcaacucaguauaaagaccaagauaauagcuuucuuuugcuggguacuuagaguaggccaaacccauugcugagcuuuuugcauaccugacuaaaauaauccuuacaaccagacugugagguaaguauuuuuagcuuuacagaugaggaaacaggcuaauaauggagaaagaacgcaguuucuauagagaugauguaacaccauaaaaacuauaguuucaucagagggcaaccuacaucacagcacuacagacgacagacaggagcuuccaaaggccauacgguguauugagcaagcacuuuuacuuuggguauggagcuauaauagaagacgguguaguaaaguggccauccuggcaaaagaaaauucuggcccaggagguaaagggcuuguguuuguacugaggguuagcagugagggaaaagaggaaggcugaguucugagauguugggaagggaaggaaacugacuuugaggcaugagaaguaacacuaagagggaaaaagaaguuauacuuagcacugugaagaggggcagcagagauguggcccucauggauucugcauguucacauuuuaugucacucucaaugguaccuuuucgcuucguccucuagaaaacauuuauuuacaaguuaagagaaugaaucucguuuagaaauugagaagagugagguucagagaaaugaaguaaccugccugugguuucacagccagugagugguggcucuuuugauagcaaguccaagguucuuucccugcugccuccccucagaucagaugccagaagauuccagggcugagaauacacugaguuauaccaguaacugggagggauuguguuuguuuuauggaaacagguucugucagcuucuccauagcuacggcuagagugugagaccagaagaacagcuuugaaagagaagcaaaauucuuucacaguuuugacaagaagucugaaggaauaguucugauuguaugagucaaauccaggagguuuucuggaucaaagaaguaugcagacaaaggacacaaagugagaguagaucccugaaagguuccuagguaacaccagcaacuguggcugcucagcagccugcuggccacugauuguagguaaagaucuugcugugcuuuuucagaggccaacaggaguaggaugaaggugguggcucuuuucuuuuaaagccauagccucguuaaugcugaucaagagcacauggugcuggccuuccuccucugguucuagcuguauccucaugagcucuucuuagccacuagcagccuguuuccuagaagcccauuacucacucuuucaguagcaacaugcuaaacugcugugucuuguuugugcauguucaacagaacagaugagguggacgugugggagguggggauguaccagucucuuucugaguuugugcggaauuuccagaguuaggcuccccucucacaucagccgggguuaugugacuugauuuccucuagcugccauucccaacuuccagaggcugagaugcauuauucggauaugaaauuggagcagaauuuugcuuuuugaagguaggagaaauucucucuaaacuagaugugcauacucagagcccagucuacccaguucugagguauauaguaaucgcuauuauuauaaacagguaauuccacccuugcauaggaugggggaauuugaacaauggaagccagccaucagaggccuuugagguguauagggagcaggcauuuaacuaaaaggcucaaguaagucuaguuuucagugauuucuugcccuugugcagaucuuucuaggcaaauccccacuugugauggggaaauguuugucauauaacauugcaauguuucuucaacaaaaggaaugguuccugaacaggauguagcucauguuaugaugagcaaagcucucuggggcaugaacccgcugauacuaucaucucguucauggccagucuguuggaugaauggucucugugagcagcaggugcuaauuagcugagcaagcauuccauggccuacagcuagcuugugcaguuaaagcucuccccagauucuuguaaccaauucccagauacaccaucauugcucuuucacaugaaaacgccucauaucugaguguaugaguuguugucucugaguuauugucaggaaggaguagugucacuauugcugucuuccucuccuuaccacaccgcuuuugccaacaagaggaagggucagauuucaaguuuuggcuccuuucucuggaugaugaagaacccaguuuaaacuagaacuucuggguauaugaguuaacccccugagaaucaacucaaguuuaauuaguaguuuacucaucuaaaaggaaguugagauuccuaaucuagauguuagguuauggaaaugaaauaaaugcaguacaaucccuuagagaaugaucaucagauggaaaagacuuaaauucaaauccaagaaucagucuuuaguagaaaaagugccagugugcccucagagccuguaggaugaccacucagcacuuugaguuuuugugguuuaaaacaaaacaaacaacugugccuuugguaaagcugggccuggagaacaaaggauccagagaagugguaggaggucagaguaggaccagcacuaguuuagggaaaauucugggaggccacuguugcuuccccagaaagauucucccaaugucaguguucugcuaagaaacaugugggacagggccuggcucuuaggucugaauuucauauugaagggcucuuacucucuguugcguuuugaaugcguuauuguuccuuuagcaccucuggugaagagaauaguagaaagcagauaaagggacuaugguaaggaggaggaagaaagcuaccugagcuuugugggaaggauauagaagugaagagaaagugugguguuuugagcucuagguccucagauuagcuugucucuucuagccuagaguuagaguaauaacaccugcugaacccugggaagcaccaagcacccuuggcaucuuuauugcauggcugcauugaccuccagauaucaucauuacuuuuagaaguaguguuuguuuuguaaguaaggaagcaggucagggaagcaagugcuuguuggaaagucacaccacuucuaagugggaggagagggcuggguguaggcuugggagcuguguggaagcagagccuuuguucucuugguauagggcuuccuaacaccaggugcucugauguuucaggugaagagacuguuuucugaaggcugcguuggaggcugugaccgagcagagagcccaugugaacugauggggaggcuuucugaauaacauggccuuuugccauuagccuugccaugaccacauuuuucaccagcgucccucccuggauucaagaugcaaagcaggaggaggaagugggcuggaaacuaguucccaggccucggggccgggaggcagagagucaagugaagugccaaugugaaaucucggggacaccauuuucaaauggggagaagcuaaggccucacagccuuccccauccggagcagagaccauauagcuguccucagcugcacugcggcaaggcuuuugccuccaaguacaagcuguauagguaggugacacucccauuccucuuucaguuuccagguuccuggagcucacaaccagagacuccauugagagugaacgguaaaguuguccugugaguauacuaugaacucuaaccauuugaagucacucacuaaauaguaauaauguuuagcuggauauggaggcucaugccuagaauccuacacaaagcugaagaaucgcaugaauuuaaagcuagcuuggguuacagaaugagacuuuguuuaaaaacaaaaccaaaaacacccaggaccuaaugagcuggcuuaguggguaggggugcuugcugccaagccugacagucugaggucagucccuggauccucaugauggaaggagagaaugaacuucugcaaguugucuucuggccuuaaacacauguauguacacacaaauguaauuaaacagcaagcaaacaaaaauaguguuugucuguuuugaaacaggaguuccuuguguggcucaaguuagccuagaauucuaaagcuccugccucguucucuuaaauaaugguaauguuuuuauugaaacacuagaaucugaugaguauaguauaaagcaacuacgaacaaauuagacugaacauuuuucaguauagcuuucuccauuccugucaggcagauuaucagaaucuucuauuauugagaaguuagaaagaaaagaaguuccucugguccagucgguucauuuuaaagguggggcucuccugccuuagccagaaucacagaguuuguugguccugcagugcuacuucuguugacucagccugcuaaucagaugauugcuccugucucuguagagucccugcuguucuguggggcagcucuuucccugaaauuuguaagcccaagaacccuuacuuaaagugaaagagaaugugaaagcccuuguuaaggcagauaaaagcagcuuugcuagggaaaggaccugauccccugccuuuccuguacaggaacccacuugcccugaucaaaugagguagacuaaccuggugcaucuagccauuccucucucuuauuauuuauuaaucuccugcuauguaccaggcacagugcucauugcuagggauagaauagugaacaagaaggauggcggugcuuuuguuuuuacacacagguaaaaguauauuuucucaauaguggagacagacaguaaacauguaaauaaaaugaaaugacuacagaaagagcccuaguucuucaucuggaaaauaguugguaggaaggaaccaagauaggcaucggguuauauagaggccaggauuggccucgggacaguuguguggacuuaagaauguguugauucugugugcuucuaaguuuuagggaacccuggucagggacaucuuuuuguacuuucuuuuuuuuuaaagugggugaccagauucuuuuuuuuuuuuuuuuagauuuauuuauuuauuauauguaaguacacuguagcugucuucagacacaccagaagagggcaucagaucuuguuaccgaugguugugagccaccaugugguugcugggauuugaacuuuggaccuuugagagagcagucggguacucuuacccacugagccaucucaccagccccuuuuuguacuuucuuagugguagucugaguaccagugagaagcugccagaaaauuccuggcccaagaggcaagagcucugacagacuuuacuugugauuuuuuuuuucccccuacaaaaugaagaaaaugauggaguucuuuagcaccaccuuucacaggaagccaucuuguuggcaugucacaggagguugauaauaacccucauaaacaugaauacacacauaacacaaggugacugugcuaugaggggucaguguuuacauacaguguaugucacugacugacugauggguagggcuaccugaugcuuccugcccuuaacuagagagcaagauuuauaacagcucacccacagcuuggcaaauagugagccuuaaggucuuggugaguugauucuuaauguauauggagcuaugaagccaguuccugggcuccgagcugcuuuccaagcaaacaggagcauucacuaacaauaacuaacaauaggaacucagcaguugaaaucauacaaaugggccugcaguguccucacacccaacacugcuguuccuuucccaaagguggauucauuuuuuaugaguccuguagacauucaaauguguauucuccuuuugguuuucaaaagggauuguauuacaugcacuguugaacuuccuuuuugacuuggccuuguauaucuugggaacuuguuccagaucaggaaguuuacauacauuucguauuucacuuuucccuuuauuguaucauuaaaaaaaaauuaaauguaagcuuuugaagaggaaaucaugcacaugacucugaauucaaaggcauugaaaggcucauaaugaaaguuuccaucaaguccacuaauaagcugucccguucucccccagcccucagguuuccagugaugucagguucuuauuuguaagcacacaaaggcaaccauguuuuuauguagagaaugccauucuuuguacacuguucauuuuuccucuucauguuucuaagaagcuuacucuuugaaggcacauaugaagcucaccuuguaaacacuggagucaauuauguaaccagcuccuaguaguacauuuacaugguucauaauuuuuuugcuacuaagaccagugcugccgcuggguguggaggugcacaccuuuaaucccagcacuugggaggcagaggcagacagauuucugaguucgaggccagccuguucuacagagugaguuccaggacagccagggcuacacagagaaacccugucucgaaaaaccaaaaaaaaaaaaaaaaaaaaaacgaccagugcugcuaagaguaacgguacauguaugauuuuaaagagauauugauagaauauugcuaauacgguauucuguugcauugcuuuauugaagauuucauauguaauuuccuguuaauagacauuugguugucuaguuagcuguuuuaaacuuccccucuuucagcuuucucuccauguuacaucccuacccacaggcacauggccacccacucggcccagaaaccccaccagugcauguacugugacaagauguuucaccgaaaggaccaucugcggaaccacuugcagacccaugaccccaacaaagaggcccuccacugcucugagugugguaagaauuauaauacaaagcugggauaccgucgucaccuggccaugcaugcugccagcaguggugaucucagcugcaaggugugccugcagaccuuugagaguacccaggcccuauuggagcaccugaaggcucacucacgccggguagcaggaggugcuaaggagaagaagcaccccugugaccauugugacaggcgguucuauacucggaaggauguccgacggcaccuaguggugcacacaggucguaaggacuuccugugucaguacugugcccagagauuuggccgcaaggaucaccugacacgccaugucaagaagagccacucacaggaacugcucaagaucaagacagagccaguggauauguuaggcuugcucagcuguagcucuacagucaguguaaaggaagagcugagcccugugcuuugcauggccucucgggacgugaugggggcuaaggccuuuccuggcauguugcccauggguauguauggugcccacaucccuaccaugcccagugcgggcaugccacacucccuggugcacaacacacugcccauggguaugaguuacccucuggaaucuucuccuaucuccuccucagcucagcucccuccaaaauaccagcuuggaucuaccucauacuugcccgacaaacugcccaaaguggagguggauaguuuucuggcagagcuuccuggaagccugucucucuccucggcugaaccucagcccgccucaccucagccggcggcagcugcagcccuccuggaugaagcacugcucgccaagagucccgccaaccucuccgaggcccucugcgcugcuaauguggacuuuucccacuuacugggcuuucuuccgcucaaccuacccccauguaacccaccaggggccacaggaggcuugguuaugggcuacucccaagcugaggcacagccuuugcucaccacuuugcaggcucagccucaagauuccgcuggagcugggggaccccugaacuuugggccucugcacuccuuaccuccugucuucaccucuggccugaguaccaccacccugccucguuuccaccaagcauuccaguagcccccaugaaggucccccaacucaguuuuuugcuucugccagggagccuaaguacccaccccguccaccucccccaugaaggcagcugagcuuucagagcuggguucaaaaagaaaauucuagugucuauauggagcacuugguuuggggguucaggcuccaggaucaauuuagagggauccuugaacccagccccgugaacaaucuaucauaggacuuucagguauuuuuacuuuuauuuuuugaucugaacugggagcuauauuuagcccucugccucuccaaagcaucagaaccaccuucagucuggagaaggggaagccucuuggagacagaggguuucaccuuauaugaccucaagagaaacagccuaagaagcccgccuucuggucccaaucugcagacccuccagcaguuggcuguugagucccugcuguggaaguucucuugacuaucaccugcuuccagcuaccaggcaagaaagagggccucuguucucaaccaucccaccccaccccacccacagcuccccuucagucaguguuguccagcaacgguaccguuuacacauucaccuccgacacgccauuucaccucccucgccacacuguuagccuuagugauugcagugaacacuguuuacacaccgugaauccauucccaccaguccauuucaguugccaccagccugaaccacucgguaccugguguuaacuggagcccuguuuacaaggcggagucgggucuugcugacuucucuucacuugaggucacauuuuucccccguggggaaauaaacugacuuuggacugcuucaguuucugccaucuuccaugacugcuucuauuccugccuuccauggcaguguccacaggagauaggcaagaagauuggagcagcuuucucacaggucugcaauuuggauuuucuccaaguacaucaugacaccuucguccuccugaacuggagaggggaagaaaugaaaggcaucccauaucaaccauuuccucagucccugaccccacccuggacaucaugagcaguuauccgucuuggcaggagggguucugggguucgggcuggauagcagaggagagggaugagcccugcguuuauuucccuucugcucguccuuuuccaggacacaauggaacugucggaagaagaguuucuagaaaguuaggauugggcagauaguugaguccuaaucuaucaaaucauuguugccucucauaccaaaauguucuuacccacuguccuucccccuucucugcuuugcaguccccauggacucugggcauggugcacugucgucuuugcucuucauugaggaucuuccacccaccaugguccccucaguugcaccuagugucuagcaaugugucuugcaagaaauuccuaauucuucugcugacuuggagcucgcugccacagacagcacagcccuugcccagaagcagcugaacaauuccuaacccauuucaucucgguucuguauggguuuuucccgugcauggaagggaggcagcucagggaccaccauuguggagccuuugagaccucucugauucagaaacacacuucuaccucuuuacuguuaacuccaacagauguagccagcagccugggcacuuguguuaguggugccguuugcuggcuucuccacuaggguuucaggacagacuaccuaggaacugccucaaccucccaccaguucuucccugccccucccuucugucuagauucacuucaguuuauuguugggaacugugcagguccaagaccuggacuccugcuucagcccaggccaguacuccuugucugaggugaaagccuucaguuuagcucccuggcccuuguguggaagcaauguggagugaaugagcauauuuugauuuaagcaagguagcuuggaauaccuuuuuuaaaaacaacuggauauaaauaugucugacaggauuggaaucagacuaugugauuugcuuguaaagauuaguuucagugagucccagggacuaauuaagguuuauuuuuaaaagcgucugccuuggugcgcaaccaccuccugcaugcuaugcaugcuguugggacucguauuacagggaauggcauugagaagccaagugggacucacugcugccauucuccuugugcuuggucuucacuagaccccagcccccucuacccuucuuaccaccucccuauagccucagcuucagaagccaguagccuccagccacagaguaucguguugugggcuguuugagaagaccuguccuccugagcugcuccuucccauggugcucacaggccagcagagcaccucuuguagaucuuguuccaccucuaaucuuuccucguugucuguucuuauguauucuucaguuuucccacuucucagugucuucacucuaaggacuuuuccugucacugugaacuuugcugguuaucugccuucaauuuuuggaccacaaaccacccugcagcuucuuaaaccuuuccccaaccuaccacccaaaagaaccuuuuggccaguuguuaaaaggacaggaaugauuuuauucuguaguuggagcccaaacucauuaagguacccuuuaugaggccaagagagccagaggggcaugcgcccaggacaggagccauggcauguggcacagaccaaucagggaccagaaaagaaugaugucccuuuccuugccauguccuugagccugucaguaaugaacuggcugcaaggggacagcaccucucagccugcacagcagcuugucagagugagaacuguccuggggccagagacuaacaugcccagguggugucggcucagaggauccuagcaccaucuuaagcaggugggaggcagggaagggugcaccagcgugucuuucccugacuuuacaugguguuuuguuaaugcaaauccgggaagcaggugugauugcuuuuugcucguagauauuauccuaaguugaaauccccuaaaucucccuuaguagccuuuaaguucccccuucccuuuuugguagcuguuuucucuaccccuccuccauaauuaaaaaaacaaaaaacagaaaaacaaacaaaaaaaguuguauuauacaggaucaauauuuugcuuuuuaacaaggauauuuauguaauaagaaacuuugccuuagguagguguuggccagaaaaguccagauuucucugugaccucacccuggccucuccuggagcucugaaccugcuguggaaggaaguggcugugacuuuaaccacuggagagcggagucugugguguggagaggguguucacuguguaaucuugggcuguguggaguuguucuuaucaccuugcuucagauguuacuuuggcguccuccaccaguucuccaugcgcaccucugcauguccggcacuagaaucccugaacacuacuucacaccucccccacugccaguugguugaugcucuagagccacucuuucuuaaugccagauuauuuaaagaaaaauacaagacaaaaaccuucuagcacuuuguaaacacagugaauaaccucuuggaguauuuuuggcuuuauauaaaacaagguuuuuaauuguaaaauauaagugccauuagaaaaugcacagggcauaucuuuguuaaaguagauuuuuucaauguuuuacagaauuaauuuucaaaaaaaaguuuuuauaaugaaguuguuuauuaaaaacuucugaaugaugugcuuugca

SEQ ID NO: 1185 - RNA, 29895 nt, Mus musculus
caaaugagcccaggguccuuccugucucugccgccccugcacugugcugggauuacaggugugcacuauucuuccuggcuuuaucaucaucaucaucgcuuauugaacaagcgccugcauauaugacuguaccacaugugagccuagugcccauggagacagaagaggacuuuggauucucuagaacuggaguuauagaugguugugaguuaccuguggauccugagaacugaacccaagacuacaggaauagcagguuuacugcucuuaacugcuaagccaucucuccagucuuucagcuuuuuuguguggguucugggaggccaaaccuuagauccucauacuugcacagcaagaauuuuaccuauggacccauuucuccagccagaagaaauuuaauuguaauggcauaaagaguauacuuggugacaguaagauggcucagcagguaaggaaaggcacuugucccccaagccugaaaccugacuuuaaucccuguaacccaccuaagggccaaagaacuaugacuccacaaagcuguucucuagccuuuacacaugcuggcuaaccccaucauacacacacaaugauaauauuuuuuaaauuguccauauuaacgccgcccaaccuguuaagccugcaugugacaucacuccgcuccacccugccgggacaucaccagaacugaaauugcaguuggagccaacacacugaagauguuuagugauaacagaacacggccaguccacgaggccgcucacccucucugaagcuccuucuccaacugugagcagugggcacaggcugccagagaaauaaaggacccugucugaaaugccuggggagacuugcagggccucaguagggguugaagcaguccuaggagugggucagcccugcugggcacugccuuccagaaguuuccuugugguuuccccacacuguuugcucagggugagaccaucucucccagcuguugccagagagccaacaggaagcugagagcucagucuaguggggaggaagccccuccugccuccagaggauuaggcuucugagaguaaagcugggggggggggggcggggcuagugagagccaaagaacuuguuggugaccaagcucuguccuaaucugaaccacuaugaaggcaugcauuuuuugcaaaaccuacuuuuaauaaggguucaaucucucuucuagcccaccccccggcacggguaauggaagaguuauuaggauauaaaggaagcacuucagcaacaguuccuugcaggugagccugaucuucuuucucaacaguucagucccgcagcaaacagcaaauaaaacucagcagcagcugcagagcaguccucugggcuggcagacaccaggcacaaagcagucacugcaguccagucuucucagcaagcagacaccaggcagcuacagcccaauccugaagaauugaccaggcuugcccaucugcucaaggugaggcguggaagucgcaagcugcugcaggaaccucacgaauagucuuugggugagcuuuucuaaaagacagccuuaccacaaguugagcuaaacaacacuaugcaaggugaaccaacacaugugugucuuuagagaagaauagcaaggcacagcaaaccaaaccaaugcucagugcucaucucccacugucuguggggucagauuuauacuucuucaagcguccucucaccugugucugcuucaggaagucuuucacauuugcuuuaccaagauguccuuucaccugugugccccagcaaaacaucauuugacauaacugacuuuccaaagaacuagacauuuccacuucaccacugucuccucuucaacugugaaacggagaguccgagacuggaucaugcuuugggaaagaccccgggcuuggggucugaguuugcuuuccguugcugugguggguaccacgacuggagcaacaugggggaaaggcuuuaucucacuguagaggccaagacagggacuggaacagauuauggaggaacacugcuacugcuuugcuccagaccccagagcccuggcuggccuugaacacagagaucugccugccuagaacugggauuaaaagugacaccacacccagccucccuuauccaucccaggacuuucuguucagaggcagccuuacccacagugggcuaggcccuucaaaaugaacugucagucaagaaaaugccccaugggccugccuacaggacagucugacaggggcauuuucuccacugagguucucucuucucagaugacucuaguuugugucaaguugacaaaaaccagccagaacagaauccaaacacuugugcacaaggccccgcuuuguugucaggcuaguguggccaagacacugcauccuguguaacagggauacguuccccuguacuccugagggcuguguuauggugaccaagcauucggccaacugaacaacaccccaccuuuuucaagccuuauuauuuugagacagucuccccuaaguugcuagguagaccuagaaugcgacuguccugucucaaccuccaaacuagcugagauuacaggcuggaucuaaaagguucaacugggauuuugcauuuaagguggcuccccugggugaugccacacugcaggccuugggucuuuuacaagagcuuguaaaaagcacgguccuggggcgauucagccccagccacuuggauugcuuguccugcaggacuccauaaagaagauagccacugccucagcaccuagaaguuggaaaggaaacauggagagaagaggcccaccggggcucagccuccuccuggggcucccccugccccacccgggcacacugcagcuucaguuagcacuuuccugggcauccaugcagagucauuuaauggcucaggaggaaccaaugugagacagcucacagcugcaaucaccgcacuugugaggcugagacaggaggacuaggaauacauauaugauaagucugggcuacaucaagaguuccaggccagacuggcccacagaagacccuaccccagaguacaaaaggaagccagucuccagaccgauuaggaguggggaguaaaugaacuagcugcugaaguaaauuguuaauaccgugagcucaguuuuuuaaagucacaauuuuugagcacaguugaauuuucuuauagagguuggugaucucugagaacuagaggccagccuggucuaaagagugaguaguucuaagacagcaagggguacacaaagaaaccuuggggauaaaauccaauaguaacagcuggggauugaucucauagaaggugagucacaaacuaugaaacacuccucaguggaagcuuacauaauuaaaagcaucuauucagcuauguucacacaggaaaaauaggaugugugguuauguaguaaaaaaaaaacaaaaacaaaacccaagacauuaaauggaauauacugcacaaccauguaggcuggugccuuuaaaaaaagagacugaaauacaaaaauaacuugauauacucagaaugugauuucuucucccaccuccagcacaauggccuagccucucacccacaggcagcaccagcuccccucugggacgucaucuuggcaccucaucuccagauguucccuugcugucccuuccugccuuagugccuuggcacgugccaugcuugcugcagggagugugcagccuccucagcugagcaaguccuccuccacucccuaaggugauuccuuuaaaacaguuucccugagccccuccccuuggcauucuucacagcucuucccuuccacagcaauccugggucuuaagcuuucucugcugccacccuccuuccuagcacacaguaggccaucagugaacacuuccugaaggaaaacagguacuguaacuacccagagcuuccuguuuuuuaugucgcuuccuaauagggcuggcagcagaagccaacagcaguaugcagaggcagucggguggcucaucauuuuccuaguguccuuuagugcacaauguguccugggaagcaacacacagaguccagugggucuggcuuaccacccacagcuaugcagcccugccugggagaaaaugucucuaaacagucacuuuuuuuuuuggucagaaagaaaaggauaaaaccaggggcaaacuaaguaagaggaugcccuucaggccccagcacagcgccuggcaguaagcaacaguuacacucggcaauggccacaugggagucuuguucuagcccagguuuacaacacucaugagcugacgugaagcuuagaacccaccagacucagcacuuacaggggagaaacggggucaaagaguacagugcuugccacagacgagagcccagcaccugcucuucagaaaugcugugcccgucaggguggucugcauggucacccacuggggcuccagccucuaaaugucccugugcaaggcagaaucuaggaccacuuggcccgucaccuagaguucacuucuuaugaaugagagcagcagcaucaggaggaccucaccacacuggcuggagggacaaagacugcucccaaccuggggcuucacauggccucugugcacggacaugucagaggcuuggugaguaguccuuaggggacagcugcagugagggcugagaccacagagcagaggcugggagggucuuagagacagcagcuuucagugcacccugccagccucacuugugcagugauacugcugaggcccggacacugccacccauggugggagcacauaccuguccucagagcacugcuaacuccugccugcuguguucacaacagaggagcccagggauggcaguggcugggccuggcaguggaaagucugagggcccuuuaggggacccccagaagagcagccaauaggcccacuugcuucuuggcuuugucugcauuucauuuauaaggucacuuuaggcuuuugugcuaauggacuccacugauuuuuaaaaacaaaggggaguuuucagguagucaugcauggcuuugcaucaaaacuacagagaucaagugaguguugugguagacacuccuaaucucagcacuuaggagguagaggcagaaggaccaggaguucaaggccagccugggcuauaugagauuagaucuuaaccuuaccccuuugcuccucccccaaacccucaaccaagggggggaaaauauauaugauauauauauauauauauauauauauauacauacacacacacauauauauauauauauaugauauauauuauguguauguauguguauauaucagggugugcccaggcuggaggugggcugcuuuguaugugcaugaucaugcagcccagagcagcccuggcuggggaccaugggagccaaugccugggauggaaugccuucucuuccaggacguccuugguacuguucuccaccucuggcagaaaagaaaagggauguguaaucccaggagcauccuuagcagccaagccugguugagggugggaggugggggcuucagaugggaucaaaauucaucccgaagcugggagggucuguccaugccaaagaaggacgacugccucccauggaggucccgcucccgcuucacgaaggcagugaacgaggagacacaguuuccaaugaaguggucagccuggccgaggauguacaggucgaucugggccaccucggguuucaggcucaccacccucaccuguagggaggaagacaagaguauuagcagguaccucaggccaaggucagcugagccgggacuaacacaccacacucucagccuuccucuccugacugaaguuucagaccaagagaagguuggagaggaugaagauuggggucaguguucugaaguguggucuccugaguccugucugccacgccaugccucagcaccgcuccugcugguuccuuccgcugccuacccuacaguguccucacaacucaucaaaggcugcccaggccugcagguauacucaugggcacaguaugaccucaggaggcacaaggucccggguucccucagcaucaauccucccaagaagccccucaagcuagcuuacgaacugccugcuuggcuucccucaagcuggacacaggggcaaggaacacagagccaucuuauccagcugccuggacgaccgccucuucccagcaacccucccaggccccauguccugucugaucuacccaccccugagaccucugucacuuccuuugagggccuaccccgcccugggccugaccaacuucaguggcuucuuugcuguccucacagcuucuccuggucuggucacuacacaaaugccaaaagaaacuucuuagaccccauguccccuccuccuacucuccagcugcagacccuuuacaggugcccuauugcuuuuuaguaaggguggcagauccgcaaugcaccugaugaggccugccaggcugguucucucaucucccaguccuuagagcuccagcuccagucugccaagcucucucccucccauuucuccucagggucuuugcauauacuguucccuuauggaguguccuggcuaguuuuaugucaacuuaacacaagcuagagucauaagagcagagacagccucaguugagaaaguauuuccaaaugccugcuugggcuggaggcaacaaugcagaacacuuccuuuuuuucuuuuuaagauuuauuuauuuuauauaugugaguauacugcugucuuuagacacaccagaagagggcaucugauuccauuacagauaaguuguaagccaccaugugguugcugggaauugaacuugggaccucuggaagaacugucagugcucuuaaccacugagccaucucucuaguccuagaccauuuucuuaauuagugauugauguguggaagguccaaccuauuauagguggugccauccuuggguuggugguccuggguucuaauaugaaagcaggcugagugccuggucuacaaaguuccaagacagccagggcuauacagagaaacccugucucgaaaaaccaaaaaaaaaaaaaaagaaaagaaagaaagcaggcugagaaagccaugaggagcaagccaguaagcagcacccuucuauggccucagcaucaucugccuccagguuccugcucuguuuugaguucuuguccugauguucuuuaaugaugaagagagaugagagauguggaagugugagucaaacccuuuccuccucgacuuacuuuuggccacagugcuuuauuacagcccuaguaagccuaacuaagacauggggguaaaccucucuuuaccuggcuaacaccgcuuaccuuucccuucuccaaucauguggcccacauuggggaagcccucccucccuguuauguaccaggucagugcccugugcucuacucuuggagcacagggcuguuuguggcucuaaccccucagugguucucuguuaacccuauguccugcuggaccugagcugaaccuuuguugcucugcuuagucucagggaacugggcuugaacaagccuucacucacccucagucuacgcugugacccugaaggcaggaccaccucucguucacugaggucccagcuuaauaaugugaggcucugcucugaacaaagguagggggcuggugaagcugcucugucagaaagaugcuuugcaagcaaaaagaccugaguuugauccccagcacuuaggaaacagagagaggcugaucuccuugaguucaaagccugccacagcugcacagugagacuuuuuuuuuuuaaaguaagcuagcuuaguggugugugcucaaaaugccagcaauggaaaaggagacaggcaguucuugggacuggcuggcuagacagccuagccuacuugcuaaguuucaggucaaugagagaucuuguucaaaacaaaagggaaacgguacccgaaguuguccucuuaccuccacacacauacgucucugacaucacacacacacacacacacacacacacacacacacacacacacacgcacgcacacacacgcaugcacacacacgcaugcacacacacgcacacacacauaguugucacacaucaagaaggggaggagaguaacauauaagccuacaggaaguggggcugaggaguggaggugggguaggguagggcaagaaccccagcauaggaacaggaaguaggccauaacaagaggcuggaggccuaacuaauaagugcaccaacccucaagcucaugaaaacccccugggacucuccacaugucucagcuccgugcaggugaggaggggugggcagaguugccuggaagagcucuguuauucaccaagcuuucugacaccaggaaccuuguuuccuggauugauaaagacacuaucuucuaaucucagccaaaagcccccaaacagucccauccacuccugaauuuaccagcucugucauuccagcugcugugggcccugggacuccucaguuaacucugcccuucugggcagccguccucauccagagcacacaggggcagauagagugagaggacauugaggacucucagcugauuuucuaucuaggaaaugggcagggcagaccagcaggcacugaccccauacuugcuugcuggcuggggcaucucucaugguuuaggugguggagcaagugaaagaacagaaagaugccccauacauaaggccaguggcucccaaugucugcugcccccuugauuuuaaauauucauauuaauaaaauacauauucaccccuuauuuauuucuaaaugucaagaguccuuagucaaacuuugaaccauuuuuacauaauuucuuuuuuuuuuuuuuuuuuuuuggagacaggguuucucuguauagccuuggcuguccuggaacucacuguguagaucaggcuggccucgaacucagaaauccaccugccucugccucccaagugcugggauuaaaggcgugcgccaccacgcccggcuugggucacucauuuuaaaaaaucaucuuucuacuguccuccucuuagggcugcuggcaucugagguccucagucaccuggucucccgaaugcucacuaacuagucccucggccaccacagaggcaugcucacuuuucaccugcugcucccucaacguaaauaucggccaagcaaauucugcugcugagcagcacuuccuaaaacacucacgaagcacaagaggucuccccuucauucauuucugguaccaacaagagcuaauuuacugagcauuauuuuauagugggaaacgucaucauuucuuuacaaaauagaucuuuacagaugccgucgucggagacaggugcuuuucggaucuacucuauugaugaggagucagcacaaaggggucagguaacuuuucgcaaggcuacagagugaguagacuuuaagucccaaaggacauuucuggagccagguguaaggaugaaagccuggaaccuggcacuuggaugaggcaagaaagaagaugaggaguccaaggucauauugcauucagcuauauauugcauuuuuuagccagucuaggcuagaugacaccugacucugucucaaaaauaaaaucaaaacaaaacagaggugugcucuuaaccucucagcuguugugugcuccauuucagaguccacuguguucuuauccaacaaagcauuugcacugugugccagacacugcccuagagcccaugaugagagacagguggcagccuccagaggucaaagcuccaggguaaaccccagagaacagaagaggagggcuacacuagccucggguggucuagaaagugcuccaagcaaagaaagggccucgggaugcuccacaggagaacucacagacauguuugagcuguggacagaaggaauguuagggaucagagaggcaaggagcuggugaggggagccugaagcagguagaggagaugugggacuagcagacucugggccagacguaccuugucuuugaagagcugcuggaucucugacacguagcucucagagucuguggcgauguagaccgaucuggcauucagugcucucacccaaagcgucacagcccgcuggauuuccuucaggucagggaggcacauggucauggugagaggggucgcugugcugcggcuauagcccacacacugaggggaagccaugaagugugacccugcaguuccauccuucagcauggcacaggcauucuucuacagggaggguuagagggcagaguuagagaagcagcugucuuggauacaggaacagauaaauagaaaagugcuacagaggagacuagcauuccagugcugcgugugugugugugugugugugugugugugugugugugugugugugcgugcguguguguauugaacccagggcuuugugcauguuaagugaauguucucccacugccuauccacuacuauauauguauuaauagcacuaagggcuaagggaaaacccaggaguggugaggcugacuuguaaucucugcacuugggaggcaagaucaugagguuuuauuuauuuuuuuaaaaagauuuauuuacuuauuuuauguauguaaguacacuguagcugucuucagacacaccagaagagggcaucugauuccauuacagaugguugugagccaccaugugguugcugggaauugaacucaggaccucaggaagaguagccaguguucuuaaccacugagccaucucuuuagucugaucaugaaguuuuaaggaaagcuuuggcuauggugagcuugaggccaaccuuggcuacaaagaacccuggggguggagccauacaaaaacacuguuuuuucugagugggguugaaaagcauuuuucugcucuguuguuaucuggggcuucaguagagcucagcauugcugauaagggaggcuuaucugauucccgcuaaagugggacugcagaucacuccccugaggcacauguuugcuguaggcuccagagagauaggcuuuaucuggcugagguggguccaggcuauuucugacuaguuaggaguuuuucucauguacuugacucuuuuuauaaagcucuuucuuacccucuagagagaugacuacauguuuuucuucuugggcuuuucuacacaaauucugggaggaugaaaacaccugcacuucugagguugaaagucccgugucuccccuccccccuccccuucucuuccccaagacaggguuucucuguuuacccuuggcuguccugaaaguugcucuguagaccaggcuggccucaaacucacagagauccacccacuucuguaucucuaugugcugggauuaaaugugugugccacucaguuuccauaguucccuuucaauagcaaucuacuggcugaccacugaacuaaggcagaggacuccucauuugggaucugacuuaauggccgaguuuacccaugugcaaacacaaggguacaaauggcagcuguuaaaugcuagcucuccagcaggagcuccauaugcauacuucugaugugugcugcaguagcaagaucaugagcuaaaauccagacuugguggaguuagcugucucugcuucaaguuaaggcaaaugccagccagagagaggaagaggaaguuacccagucggagccaaugcgcagaugaaugcccacauagggccggacgaggugggcacugaucagggccucucccguccucaccaucucaucugaccacaccauguacuucuggagcucccuguguuccuccaggacagggaacugugcuggggccccaggcagugcgagcacaggaugcucuuuugcaggaaaucuaggcauaagauggaacaaggggaagucagacaggacgcaaaaagagcccugcugccacucccacgggauaaaggauggcauugcaccaugccccagagacccuguggagaggccccuauaacaagcaagagacgaaagauugugaaaucucaacuggcugauaagaaaccuugguggagacagcaggcacaauaugcaauacuguuccagccgcacggaauuuacaaccuucuuugcuuguuuaacaauuaaaaauuuacuguagagcauuccaacauuuaauauaucacgcuggcuuccaaucuguggugugguaauucauuccaggguggggugucuggaccuagccuugcccuuuacccauacagcaggccugagacaugaagcugcuuacacagacaauguuggucccacuuguagagacugcacaugggauuagcccagucacucaauacuuagcaaauacuuauuguuuaugucaggacccaggaaaaaugagaccagcauggucucuacccucaugugauauaccaaaggucuucagauaaccccagcacacccucucaagacucuuccccaccacacagaauccuuucugcaaucuuuccacauauaucuucucuucugcuggacuagccccaguggcagugccuucucucugccuuaaccaguucuuggcgcacgugagggcucaguaauccaaagaguagcaaacccauguuuccucuucagcucaacccagacuccuguccagcaacauaaagcacuuugcugccuaugaacucagagugcauuucugauuccagacuucugcuuccaaauaucugccccacccgcugaaaucccuucuagguauuacaaacuaggaaagccacgcuggaaaaguuugcagcuaguugcuuaugaaaucagauaugcacuuauaauaggacccagugauagcacugugagcacucagccagggagauacaagccuguauucacacacagacauguacacuacuguucauagcagcuuuacuccagcugcccuaaacugguaacagcccaaauagaaccauuagcauauccacaccaugaacugccacugccauaaagagcaugggcuaccaaacaagcuauggcucuuaauggaauuacccuaagugaaaaaaaaaaacaauccccauagagcacaaaccauaugaauccaccuacauaccuuugaaagggcaaaauggaaaaaaggcuaauggcugcugggaaugguguguguuuagggaggcagggacaguaauaagcuugcaauauaaagguauguacuuugaaagaaacacucaggaucuuaacuguguuauuggcuauaugaaccuacgaaaucacauagaacuaacauacacacaguuguguauaacuuaaaaaaaaaaaaaagacaauuuaaacaggauaggaggauugcaucacugucaagauccuggccgggauacuaagucaagaguacaugaaaagaucucuuuaaacugucacaagugcaugcagaucuauuaucacauaaaaacaaaaaaauagcucaaauaaaaaucauaaaagggcuggcaaaauggcccaugggauaaaaguguguaccagccaagccauauaaccugaguucaauuccuaggacucacaagguagaacugaacagacuugaguaagcuguccucugcaugcuguccuuaagaaaugcacauaguaaagguaaaauaaaaauuaucauggacuauuguaaacccuaaaacaaauauggaaaauaauugacaugccuaugaccuacaucagcagauacuaaugcuguauugugcuucggaguuuaaaaacauacauaucuagggcugcugagaagacuuagaggauaaaggugcuugcacggaacaugaggaccucagcuggaauccacaugaaggcaggaaagaaccaacugcaguuaguuguccucuuacacacacacacacacacacacacacacacacacacacacacacaccucagagugaauaaaaaaaaaaaaccaaaauaaaagccuuagcucaccaugucuuucccuucuuuucuucucccucccuaaagacaacauguucucuugcauaaguccauccauccauccauccauccauccacuaucuacccacccacccauggcuuaguuuccuugucuguaaaagaguugaaaacagccuuaccucauaaggcuauuaaaaaacacaacuccauauuuaagguauacaagguaauguuuuguaugcagugcucagcacagucaagcuaguuaaucuauccauuuauagggcuacugaaaggauuacuuggauuaaugugaguaaaaccuucagaguagcacuuggcacgccuuacagaaugcugagcaucaucaucaugguacacauaaccuaguucaccuuuuaaaagaguuaacuuuaugccgguuugauggugcaugccauuaauaacccugguaccagggaggcagagacagguagguggaucucugaguuccaggacagccuggucuacaaagugaguuccaggacagucagagcuauacagaaaaacccugucucaaaaaacaaaacaaaccaaccccaaaacaaacaaaaaacccaaaccacaaagaaaugucacuuuauguuuggugauuggaccauacugguuuuggagaucacaggauugugauggcaucucuggcauccccaguuugcauggauaaacucuguuggccaguaggccgauucauucuccacucacaccauggagcugcaaugcaccugccacaccuucucacccugacacaaacacacuauucagcaaugccuuccacgccuccagacaggucaccacucccaggcucagcuccuuccccugcaaugcugacaagcucaacagcuuuguugccaggacuggagaacacugagggcaguggccccaguagucccucuuccaugauuucuccagacauuagucagaggccuaugccauggaugcagccuggcucuguaugaugcuugucuggcuggacucuuaaagguucuguuuauauguguauacauggcaauaauguacugaaccauauuaugugaaaagcaaugguuuuauuuguauauuaacucauuuaauucccacaagaaccuuuuaagggaauugugccuucuuuuaucuuacugauaaacaaagaagcuguauagcaugcaaagucacaggauguaaacuguuggagcaggguuuucauucaggcagugagcuucaccuuuuuuagguuuuaaaauguauaccuguuuaaauguaugcaucugcauugugugugugcaugugccuauggaagacagaagaagguguugaaucuccugaaacuagauuggauaggcaguugcaaaucgccuuauaugaaagcugggaacugagccuggguccccuguaaaagcagcagugcuuuugagagagccuuacuauguaacucuagcugcccuggaacucacuagacuggcuuugaacucacagagaucuaccugccucugccuccugagugcugggagccaccaggcccagcucagccagggcuuuuaccaguucuacuagcuguguucuugacuccuaaaucuuacucucucauuuuccugcccaguuaaggagcaucuccuaauacagaaauaugaagcuucccugagccacagcucauagcacuggcaacaggugccguaaauauuuuuagaauugaaugugagggaucaggggcccuauaaaaaucccagggcaugauggcaguggguaaaggaggaagaaacuaacguuacuucaucgccuuaccaugggccaggccugaggcuaagcucauuuuagacaucacuucaggggccucuaaccggaaaaggcuuucugaccugauggguggugaauuacuaggauaaaucaggaccuauguccuucccguucucucagaaagagccuggaacugacucuuggugaguucaguuuuggaauauuuaucccugugccagcacaaagcugucccaguaggacuacaccagcugugacuugacacaaggucaugacuccauggcucacuccccucagugaugucugagaaugggaagagggucucggcugcaaagaaaaccugaccaacacuaccagccaaccugaccagugaaugaaucuuuuuuuuuaaggcuggagcucucucuagucagcucugggcauugcugaacuggaacaagacuucaacacaugagccuuugaaagugguuucauaucuaaaccauaauacauugcuggucauucucccagauuuuagccucugcaaacauauaaaggucauaugugauuggcagagccuauagggcugagucuaugaagcccugaaggccaacccagagcuccuacacaaaaagcagagggaaaauguccuucguggcagaaaucuugagagcaggacucugccuuguuugugucucugugugcucauuuacugauucuauaaauguguggugagccuaaaagaccuuaguagccacaguguggcauugauguaccccugagguucucaggcccaacagcaggagagcuccaaccuugaaacagauucauucacugauucauaguugaauggacuacuagaagguguggcauaacuggagaaaguaggacacugagggaaugcccuuaaggguacuaucuuguugcuggucccucucccuggcucuuucugcuuccacccugugagcugacuuaauuccaauuucucccuaccauuauguugugcuccauuaaaagcggggacauagcagaaucaagugacaaugggcugaagccuuugagaccaugagccaagacaaacuuuuccuucauagguuuguuuacucagguauuuuguccaugaccggaagcacaccauauacucagacaucuacucuuuauacaugaggauaauuucaacacaacgguccacauacuuccaagaguaaauaaacagacaccuuuaucuguugaauugaaguuuguggacugagaaccagcagagcuggaaggauccucugaauccaugugguaggagacgaaacagguaaaucgcuagcuacacugugcugcuuggccuucaagggggugagacucaaacacaugcuuugauaccgacaaacccggaagacaaugguaagugaacaaguuggacauaaacaagcaaguacuacacgaagguucauccaucgccuaggucccuagaagggcgaguucauagcgaaagcagaaugccuuccccccgggcagggaggugggaguggaaauuagccuuuacugagcggaucucuagucgagaagaggaaaaagguccuggagauagaggguggcaauggcugcauacugcgacgugcugaaugugacugaguugugcacuuacagugguuuucacaaagcucauugagaugggugugguguugcacaccugaaaucccaguaaggcagaagcaggaagagcacuggaauuuaguggccugucuggucuacauaguaaguugcaggcuagacuugucuuuaaaacacaaaaacaaacaaacaaaaccccaucaacauaaauauacauaauauaaugcuagcuacucuuuccauguuugaaacugacuucauuaguauggcuguuuacaaguucaagaccagccugagcaacacagcaaguuuaguuaacgcacuugugcacgcgugcgugcgugcgugugugugagugugcaugaauauaaaaauauagaagggaagucagguggagguggcacacgcuuuuaaucuacugcuugggaggcagaggcagguggaucucugugaguucgaggccagccuggucuacagaaugaguucuaggacagcgaaugcuacauagagaaacccugucuauagaaaaaaaaaugcaggauagguaaauacauuuacuaaagggcuaauggugcucuuuauagcaguggaauuauaagcaaauuuaauuuugcuguuuucuuuuuagacagggucucauguagccuaaccuggccuuaaacuuacuauauagaucagacuggccuuguuuuagcauucugggagguacaggugcaaacugccaugucuagacauuuauuucuuuauuuaaaaaacaaacaaacccccuaaagaacaaaaaacccagaacuauuuagucugugguagauauucuagaccacucauucuaagaaauuaaauguuaaccuggauuugaacuuugaauaauugagauucuauaaagaaaacggaaaauaauaaaaauuaaaacaaaacccaaaccaccaccaccaccaccaccaagaaagcccaggccaaaagaacuauccagccaagcacaggaucaguccuguggauugccaaggacagugagcaguaacuacugcaguacugucaggcuguggccaguuaccacccaccuucuccucacucuaccccaaccacaugcucuucugucccuugcccauaccauguugugggccucugugacaucuuaccaagaguccccuuccuucuauucuaccgaggaauacuuacuucuagaucuuaguauggcugguuccuucuccuugaagccuguuccgcuaccugcagucaaacauuauguccucauguccuucagagcccuuagcguucuacaauugcuguaaguuuacucaguacuucccccauuagaugcugagcuccaucaaagcagaagccugaucugccuuacuguaccucuaggaucgagagcaaugcuugagacucagcaacugcuucuuaggcaggcuccuagagagcucugccucccuucaaacuaccucuuuauaucuucaacuuuuccccaaacuggaccauaaggcacaaguuuaaguucucacaacguauaaacuuauauucauauauaauuuauauauaugaaugcucuauuuguauguaugccugcaugucagaagggagcaucggaaggaagaggcaucagaucccaugauagauggcugugagccacugguuguaguugcagggauuugaacucaggacgucuagugcucuuaaccacugagccccucucuagccuaucacgguccuuacagcacggcaaacucaaacaagauggcugaaccaugcauaauccugaguacacccuccagaugaugcgcuggugcgcgagcacugccccaucucugucucugagggucagacacuuaguguggcauuuugugguguuuuuuuuuuuuuuaaguuuuauuuauuauauauaaguacacuauagcugucuucagacacaccagaagagggugucggaucucauuaagugugguugugagccaccacaugauuacugggauuugaacucaggaccuucagaagagcagucagcgcucuuaaccacugagccaucucuccagcccgcucuuugugauuuacuuucaguguugcuuuuaguguuggugacauauuuuucucaguggagacaaaucuuauacaccuuagccaaaaggcuaaagagcuauuuauuagggacaaaucuguauccugucuaccuuccaaugaugcaaugcugcuuaucacuuagaagugaaggaggagaacccaucaggugaucaaauaggaagugcuaucugagaucagcaaugaaggaaauuacacucucaacugaggagccuaaguggcuccuauacuaacugggaagaaaggccacacagcagcugaacacuacaccuuuaggcuagaauaguagcuuuacuuuucuaguaaucccagcccuggggaggcagagauaggaggaucagaaguucaaggacauuccuggcuacauggugauuuugagguaagcccguucuacagagcaaaaacccugucucacaaaaggaaugguuuuuggagucagacuuguccaguuucgcuacuucaagcuucaugaccuuggacgagugacuucacucuuuucugcuuucacuguucuauguguacaucuuagaugacaauuccaccucaaagacucacugauccugaguuuaaaccuaccaagacucaggaauaguguggcauacagcaggcacgaaauauguuaaagauucacaugcagauccaagcuggccuuuaaccuaccauguagccgggugugguggugcacgccuuuaauuccagcacucgggaggcaaaggcagguggauuucugaguucgaugccagcuuggucuacaagugaguuccaggacagccagggcuacacagagaaacccugugucgaaaaaaaaaaaaaaaaaaaaaacaaacaaacaaacaaacaaaaaaaaaaacaaccuaccauguaugagcaggcuuccuucuguaaaacugagaacugaaguggguaguucagugguagagugcucaccaacauguaucagguccugagauuaacccaacauucucaagaugaaauuaauaauagcuauuucaugaaauuuguuauagacauaauuaaaauaaagcaugugaaugacaccugacugguugcuuacgaugcaccaugaacuuucuaugauaggaaacaaauacuuuaguguagauuucauuaaaccaagguggaagcuggauccaaacaccuggaaggguuucugucucccaagaaagaggcaaggcagggucugaacuccggccaguguucacuccugucucuacugcagucuaccgcuagucuauaaaugucaaaugccaugaccaccuuuaacucacaugcuccucuaacccccaacaacaacaacaacaacaacaacacaaacaccaccaccaccaccaccaccaccaccaucaucaucuuuucuucuuucuucuuccucuuccuccuccaccacccuccgcccccccccaaaaaaaaaagagauaaggguuucucuguguaguccuggcuguccuguaauguucucuguagaccaggccggccucaaacucagagaucuuccugccucugccucccaagugcugcaacuuaagguaugccucaccauacuuggcuuuuuuuuuuauauauuuuuuuauuacauauuuuccucaauuacauuucuaaugcuaucccaaaagucccccauaccccccccccacuccucauacuuggcuuuuaaacugacuucuuuugugguaguggauccaggaccuuguauaugcuaggcaaggucuauagcaccccuuauucugacaucuaaacccaggcucuuuccugccacgcuagaacaucaacaacagauccccucacaaguuuauccaucugacuagacugugguucuccaaagaccaggacuggacuguccucauuuuucauauaccuuuggccucugaaaacugugucucacacaugacagacgcuccauaaauauuucacagcuuguaccuguguccugcuaaccuaauuuuuaaauagggccuauggcacacaauuaauaaagccuagcuaguaauuauaagggugacaucacuugccagucugcaccugagcuguucuccaggcacugcuuccaguuucaccuugcuaagagggagacaaaaggggaacgauucucacgccuggaggaggaaaucaacaugcaugugacugaauaauguucuuuuuaugacaucccuuaucagccgagaaacucuugcucaaccuuggggcaggcgaugagauggaaauagaucacacaggauccuaaguucaacagaaagaacacagugcuugcaccuuuggucucuuacaagggggugggguagaaggagaaaggacugggaaggacuggauggcccugaguucccaggccuccuuaaacccagcacugcuauccccaccaaguaccucuggguccauuguucuuuguaggaggcgcugaaggaaaugccugugaacaguucugacuuauugaaacucacaugaaacuggucccagaauggcccaaaaggauuuccuuccuguagaaagagagugguagaaagcuuacugagccuggagacgaggccaaaaccugcagagagaaggggccuuggaagacagaugaugugacacccggugucaaaggacggucucugggccagggccugaggagagggcuccagcuucucuuuuggcuuccaacaguguuugaaggagucucuccuggaacugugaacuagagcagucgucuucaaccguccuaaugcuggcaccccuuuaaugcaguuccucaugucguggagacccccaaccauaaaguuguuuucauugcugcuucauuaauuguaauuuugcuacuguucugaguuacaguguaaauaucuauguuuuccaaugguuuuaggugaccccugugaaaggggcauuugacacccaaaggcaucccauagguugagaaccacugaacuagcacuuuaagaggcuaagacagcauaacuacuucacaggaugggauuagauucagaagguaaggugugugcccaagguaagacagcugguaagggcaguacaggggauacaagcuaggucuuuucucaaaauuuauagcuuuucuaucauuugucccaaaagauaauugggguguaucauagucacaaaauaccagaaaugcacaaauuucuauucauuauccagggcagcuccucauuuaccugcugagaaagggaagaacacucacauuaagagaguggacaagcaagucaaguuacaccuaugucuacucuuuccuguaaggacaucagcagcaccuccuucacggucugaggagucaagguguaaauguguagccagcugcuggcaucacuguucugagcaucaguuacuauuucugacagcaccucagcucccagcugcuauuacauacagccuacucucucugagccagcuagcaacaaagcucagagaagcacaguaugucaaagguggcacugcuaacaagugucagaaacagacaaacccccaucuucucuacauuuugcuaccauguaaucucaagggccuagaagacaggacacagaagaggaucuaccuucaugggacaugucuucuuaucaggacuucgcugggcugccaccucaaagcaguaugccacucgcuucucagggggccagugggagggugccagauuuuccaugaaguccuccaggcugacaacccgaugguaggcuuggagaggcuccaguuugaaguacuuuugguaggacacauggagcuaaaggagaaaaaggaaggguccagaucuccaugguauucuuguuucuagaaacagugaauuccaagacccagacuaugaucugagagaccuguagaggcucggauagaacucagugguagaaugccuaccuagcaaagaugaggcgugaggcuucauccccauuacagcaggcacaagcagacacccaaacuggggcaaagacaaacugagagaaaccaucuuccagcucaaaaacaaacagcagaauuucugguguuccaccuauggucacuugcucuuugacaagggagcuaaaaccaucuaguggaaaaaagacagcauuuucaacaaauggugcuggcacaacuggcaguuaucauguagaagaauucgaauugguccauucuuaucuccuuguacauagcucaagucuaaguggaucaaggaacucuacauaaaaccagagacacugaaacuuauagaggagaaaguggggaaaagccucgaagauaugggcacaggggaaaaauuccugaacagaacagcaauggcuugugcuguaagauugagaauugacaaaugggaccucauaaaauugcaaagcuucuauaaggcaaaagacacugucaauaagacaaaaaggccaccaacagauugggaaaggaucuuuaccuauccuaaaucagauagaggacuaauuuccaauauauauaaauaacucaagaagauggacuccagaaaaucaaauagccuauuaaaaaauggaguacagaacuaaacaaagaauucucaacugaggaauaccgaauggcugagaaacaccuaaaaacauuuucaacauccuuaaacaucagggaaaugcaaaucaaaacaacccugagauucuaccucacaccagucagauugacuaagaucaaaaauucaggugacagcagaugcuggcgaggauguggagaaagcggaacgcuccuccauuguuggugggauugcaagcugguacaaccacucuggaaaucugucuggugguuccucagaaaauuggacauaguacuaccgaaagauccagcaauacccuuccugggcauauacccagaagauguuccaauuuguaauaaggacacaugcuccacuauguucauagaagcuuuauuuauaauagccaaaagcuggaaagaacccagaugucccucaacagaggaauggauacagaaaaugugguacauuuauacaauggaguacuacucagcuauuaaaaacaaugauuuuaugaaauucuuggacaaauuggauguaucuggaggauaucauccugagugaaguaacccuaucacaaaagaacucacaugauaugcacucacugauaaguggauauuaacccagaaacuuagauuacccaauauacaauuugcaaaacacaugaaacucaagaagaaggaagaccaaaguguggauacuucauuccuccuuagaguggggaacaaaauacucauggaaggaguuacagagaaaaaguuuggagcugagacggaagaaaggacggggauccaucccauauacaaccaccaaacccagacacuauuguauacaccagcaagguuuugcuaauaggacccugauauagcugucucuugugaggcuaugcuagugccuggcaaauacagaaguggaugcucacugucaucuauuggauggaacacagggucccuaaagaaggagcuagagaaaauacucaaggagcuaaagggaucggcaacccuauaagaggaucaacaauaugaacuaaccaguacccccuagaaccgugucucuaguugcauauguagcagaggauggccuagucagccaucaaugaggagaggcccuuggucuugcaaagaucauaugccccaguacaggggaaugccagggccagggagugggaguggguggguuguggaacagggcggggggaggguauagagcacuuuugggauagcauuggaaauguaaaugaagaaaauaucuaauuaaaaaaugaaauuaaaaaaaaaaagaaucucugguguucaaaaugccugaugcucuacagaucauuggaacaaauguagaaagcuaagccgucuguacaaggcuaauaguagaaguggcagcuuuggagcagcuacuuggggcccaaacccccaggaagacaugcuccugugcuuucuacaggagaugcagacagcaacacucagugacuuaguggaagcccagggaagaagcaggggucauaucgcacaguucauggggacuuccaggagagagagaaggguuagcacacuccucauugauuuuaccuacaaugcuuugguuuuuuuuuucccuaauagaaaagcauacuggcuccuuuacucagcaggacuucccaaggccucugcuaugcugcuguccacucucaagcuaaauguuucggagcaugggaauggagaacagcauuucugaaaccaaacaggaacuuuuuaagagacauggucacacuauacagcccuagcuagccugguacuugucuguaauuccaacuggccucacaagugcuagacuuagaggccuucauuaccacccagcaagguuugccuuuuuuuuuggggggggggagacuuuauaugcuaacagaggagagaaugcacuuauuaguuaagauuagaagagggaagggaauuauggggcuacuauaaugauccuucaaucuguucaugagugcauuauuuauucacuuagguuucuuuuaaaaaauguuuggggauauucccauguaacccagguuggacuuaagcucaaagcaaucuuccuacuugagccucccaagugccagaacuccagguggagagaggagccccuaaguaaggcacacaaauguggcuauguccuggaagccaggggagaagggaaguuuaggaagaggaaaggcuuacaggaccaugaaccauuggguggucaaguaagauacagcuugagaaaugaaccuugauuuggcuacuuuggggucccuggugaccucagugagaacaguugugacaggaaagagaagcucacuugaaacaggcuaauacacccacaggaagcaaagaaguggagacucacuaugacaacuggaugagagggcaaggauacagcaagccagcaagccagccagccagcaauaccuaaaucuaucagugaagcucaacaagucagauccaaggaucccggaagcuaaggcacuuccuguguccuggauucuauauacucaggagcucagcucauuuuaagaggaaggugugaggcacagucagggaauugacuaucaguaaccccuguucaguucucaccaugagagguagccaaucaucacagguuauuguaaagaugaggaaacugaggcacagaaagcuaaguaauuugcuaugcaauuaggaaguggcuaaguuacacugcagucuggguuucagcuucuaucaauaagcuuuuccgggucagggguacauaggauuuauaaaaccuggacccaguccauagcacugcagggagggaaaaguaucuccaaaaagaggaauacaugaaaggagaaauuaaauuuaugaaaaaagaggcauuggaguguaauacaauguuuuguucacgcuaaguacaacuuugcuaacuacuuacuuuuaaaaucaauucauuaaauauuaauuuccuacaugaggucucuggggacacagugaacaaauggaacacaaggcuauuggaagacacaaggaauaagcuaauaucagaggcugcacaucaugcccagggagccccuugaugggaguaggcaacacaggagccacgcugcuauccggguugguggccuccgauauacuauuaacuagcccaugccucagccucccuuuuaaaguugauaguagcacuugucaccuauuacugaccaauauaucuauaagguaaggugaauugggacuggaaauggaggcuuugguuucaagacacagucucuuaaaguagacagccuugggguucaauucaagaucuacugggggcuggcgagauggcucagugguuaagggggcuggcgagauggcucagugguuaagagcgccaacugcucuuccgaagguccugaguucaaaucccagcaaccacaugguggcucacaaccauccguaacaaaaucuaaugcccucuugaaguaucugaggacaaacacaguguacuuacauauaauaaauaaauaaaucuuuaaaaaaaaaaaaaaaaaagccgggcgugguggcgcacgccuuuaaucccagcacuugggaggcagaggcaggcggauuucugaguucgaggccagccuggucuacaaagugagugccaggucagccagggcuacacagagaaacccugucucgaaaaagcaaaaaaaaaaaaaaaaaaaaaaaagaucuacuacccacaggcugugcagucuuuggcaaguuaccuaaguuaccucuccucucuagaccuugguuuccucgaggauuagcuauaggaaagaugagcuaacccucaucuagcguucagacaaugcgggguacaugacagguguucgguuaaaaaaaaaaaaagcuaguuauugcuauuucuagguagagaagaggacaacagcagauuggaagaaaacccagaggccuuggagucaagcaagucugcaaguguggggaaggaugggcaagggucuaggucagcagaaauacucacguuggugaaaggaggcuugugauguugguauucaauccauggagguacagccaaggugcgguucagcagcuucgcaaaugccagggagcccaagaagugaucagccugguucccaaagcgcccuggaaaugguacauuguggguagaguggccuggggccuaauggcaugguguacgaagggcucagcaaagaugugcauucaagacuggggaaggccaaggaacagugagcuagcaacacuggcacaggagagaaaguccagacuuccagguuugacaucugagggccuguagguccugguccuucugccacugccccaccagaguccaugcuguuucucaaacauguuauaaucauccccacucuaccugccaucuuugccagcaguguccucagaccugucuccacucacuuguacaugaaggugacccugaugcuucauuugcuaagacacuuuuaaacaacuccuauccauuuccuuuacucucagcacggcauugagguuuguuuuguuuuguuuuuugagacaggaucuauauaguccuggaacuuguucuguagaccagucugucauugaacuuguaacaaucuuccugcauguuaccuccaccucuuacaugcuagaauuacagcugugaaucagauuauguauuuaugugcuggguauuuaaccuaguaucucugacaugcuggguaaaugcuuuaccauuuagcuauaaacacuucagucauuuauaugucugcuuucauuuuccagcuuuuuguauuggcugucuaugcaggcugugaaugcuuuaaacacaaaggucuaucugguuuuuguuuguuuuguuuugccagagucucacuauguagcccuggcuacucuggaauucucuaugugaucagguuggccuuaaacucacagaaauccaccugccucuggcuucuagugcugagauuaaaguuguaugcaagcacauuuggcuaucaucaauauggcagccauucauccauuccagaaacacugcaaggcugaaaugugccagguacugugcuagauguuauaauauaaaaucagaaggauaagguuucuguccucaaggcauuccauucuaauucagguuaggagacacuaaacaugaaaacaaauuccuuaugguauauuuugaugauugcaagggaaaaaaugaaaagguuuggugacagggagacucaggaaaugacaaguagagaggucaauggaguccucuuuggugacacguauguugagacuucaaggaugagaaagaguuagcagaaauuauaggaagguacuccgagaagaauagcucauagaccuuuaugucuguaagcaauagaaagccgguuacuauggcuguagccagagggccaugggagaagggguguggagaagaguggagccaaucuugcaaggucaggccaucagaugauggccauggucaggaaugcaagcuacucaaggauugagagaagggauggauuauauaaugaugauccacgacugcauuuaaguugcaucccuccgcugguucuuaggaguccuugguuaucuuuuauuaccccaguuugaaucaucuuguacaaauucugcacgcacuuaaaaacuuuuuauugucugucuuccuaaaaugaagaauccuaugagauuuaucuguuucauucaccaccagcacagacaacagcgccugggacauuaaaaaaaaggggggggggcauauaaauucuuugcugaaugaaugcaagaauugccacgagacagugcgggcaggucuuguccuacaaacuccaucuacugaucugagacugauuagaccucgagugagucacuuaacuucucccaucugucgaauggcaaguugaacaccaauggguccucuguacccaggcaaguagggcagggaagaacacaggcccugccccucucugguguucuccucuggaccugagaagucuccgggcgccucagagaaguggcuccgccuccuccgccucaguuucuccguuuaagcagaggguuccggaggccuuacccaugcagggacaguagagcagguaaccggccaggucccaggagcccgcugaccgcccgcggagcggcagcaacagcagcagaagcaggaaagacgcccgcagcagcagguguggcggugcccacgcggcggcgcccaugucgacggcagagccccagagugccacggcccggaggcggggagggggugggagggaagaagaggcgcgagug

SEQ ID NO: 1186 - RNA, 4919 nt, Mus musculus
aggaaauuucuaccagaaaacuuuauucugucaggaaaugucaugucccaaaauuuugauaaaaaccagcuuaagucucccuuugaggccacucuacagguccaccaaagugggaagaugaaucuauuauuaaagauguucuuccacuauuggcugauauuaaugaaacuuuacuuuuacaucauaauggagcacacauucuagauuuggaagaugugacagaaaaaauauauuuacuauaucacuauuauaacugccacuuuaaauguuuuauuguuuuugaaguaaaaacuuuuaaaguuaaaauaaugcaauuuuuuagcaaguauuuuuuuuaaagauuuauuuauuuuuauuauauguaaguacacuguaguugucuucagacacuccagaagagggaguuagaucucauuauggaugguugugagccaccaugugguugcugggauuugaacuucagaccuucagaagagcaguugggugcucuuacccacugagccaucucaccagcccaaugcaauuuuuuuguacagaaaaauuaccaguaaacuaacuagucuuauaaaaccuagagaacuauuguuaaacauuuuggcaauuuaaauaccuucuccagagcaugggagacuaaagaguagaauuuaaaaaacugugacuggcccaggauuuaugaguuaagucaugcauugugaggguagauuuggcaacacaacgagacugggaauguccugaagucucuacuuugcacuuguggagaccuuccuggguaaaaucuuaucuuaguuuuuucccuacaugagcgcuuuccaaaacuguuaugagaccauucaauaggggauaauuccucagagacugucuacaacaaaagaauuacugagaaugguucauacaccaacaguuugacugccuacuauaugcccaagacuauggcuggcauuugggguauacagaaaaaaaauccaaacagaugccaaauguauaguuaccaaccaaaagccaugcaaagaaaugcaaugugcaaaggggcuggagaguuccacauuagcugaucaucugcaaugcugaagcugagaaauagugaucucaucuauucuucugagauggggucuuccuguguuaucgaggcuguuuguaaacuucaggguucaagugcuucucgaacugugucauccaaguaugcaagcaugugccacuuguucagaucgcccguugacuuuugucauauucucugcuguccaaugacagugcuugguugaugaaguugcauaacuuauucaaggccacacaacuggagaacagcuacgguuucaaacucagacccacuggaguccagaaccaauuuuuuuuuuuuuucaauucuuaaaaaaaaaaguauguguaucgguguucugccccacauguaugaaauaggcaguugugagguaccauguggguucugggaauugaacucauguucucuguaagagcacuugcccugagcaucucucucuccagcccuagaacuaguguuaccagaucacagugaggaucagggauucuauguccuuuugugucucucugcuguuucuugcuuguauuauucuuaauuugugugcuuuguucauaaauuugaaaacaaugacucauccccagacugggcgggguugaacagcaguuccguuuaucuuacucagcccauggcaccccuguuaacuuucaaaggucaccuguaauaaaagcacagugauaaaaacaacguuaaaucacacuaaaagcauguauaugcuugcugcuucugacaaacuugugauucuuguuaauuaggaaaaaaaaaaaaacaccaccaaaaccucuuaaggcuuaauaaccaaaucuaauuuucaaauauuucccucuccuuucuuugguagagucucuuagauuggcuucaaaauauggagcccaggcugccuuugagcuuaaaaucuuccugcuuucaucucccaagugaugaaauuagacaugagcugucucacccauuuccaacacguaccuuauacagaccucuggaaguacuacuuucucuucaugcuuaaugaggcuauugucacuaauuugauucuccaaggguagagaucuugaaauauucaugugaucuucccacagccuguaccacuugugaaaacuaggcaacugcuugcugauacaaacugaaaaggucugacacaauguuugcauugggcuuuauuggcuguaacaaguuaaagcaauaggagcuuaaagcacacugagaaaagccuguugcuuccugggccaggaguccacauacugaguggguuucagugguucccugcucuaaucugaggcugaagucaagguauguauuuucuuuucuggaaacucuuguuucugaguucaucugcacugucagaguucagcuccacuggguugaaugacuaaggucccuaauuccucacugcuguuggcagguuuaguccugaugcugcuuacauuccuuugcuuucugcuacuucaaagccaguaacagcaaacugaauugcuucacauuuccaaaacaccuauacuuucugggacccacguggcccacucagaagucuaggaugaucuuccuaaggucuaaaauugaucugcaaagcuccuuuuuccaaugaguguaauggaguucuggguccccacccaugggucaagccaaccugcaauacuuaauaagaacuugucccaaaacauaaagggcuugaaagguaggacagugguaaagcaucuaccaugcaucuugagcccaagucccaacacaacaaaacacaaagccugcauuuuacagucuucccuauucaacccuuccaaguguguggcuuuguuggagcuauggaucaauucaaaacaucugaaccacuauccucucagaggugauugucucagcugcagauugaaaaacuauaagcaaaacuaccaaaggccaggguuaguggggcaugcauuuuaaucucacauguauuaaugggaggcagagguaagacaauagaagcccauugacgccagccuguccauauugugaguuuuuguuucaaaauaaaaaaauagugaaaugguguuaggauaugcucagggauugugggagguccucaguucaacucucuccccaccaacagaguccuaauauacaccuaauuuaaucccagcacuuggaaggcaguggcagguggaucugaguccagagcuaaccuggucuacacagugaguuccaggccagucaggugucugucucaaaaacaaaaccuaaaaugucaaaaacaauaacaauaaaauaauuuuagauguaguucuccccucgcuuuugggaugaaaugagaagaguguuucuguuuauugaauuugagucuugggugagcacuaauaaggaccgcugaguccuuuagguacaaggguuggacugcugggugauuucuucgucucagcacuggcugccuguguacuaacaccacaagaguacaggguguuuuuuuacccacauaaaccuuucaaaaacuguaaaaccuggccaucaauccaguucaagacuguagagauguuucuguacuuugggccaacaaacacagaaaaauaauguucugggugcuucaaaccuuaucauccugucacugcaaucaaggaacagaggcuccauugcccacuguguaguaauaacagcucucauuuauucuacagcagaagccaaauuacaugagccuaauaucaggaucuuccacauucucucccaucuucuagauacuucaugcuaauuuguaccccaucaagguugugggauacuaugcuaacauugaucaaacaggcucagcgggguuaggaguagucaaggagucacaacuaggauucuaaaucuagguuggcugacauuaggacuugaccucucuccgggcaacugcgucuaaauauacacucaggugcauuuagauuucuguggauggaccuucaguguuuaccuacuaucggaucaucaaauucaccuggcggcaacgcugcuggaaacugcaggugcauucucugcaaacacacagagguauuacaagaggaaauggguuaaucaccuaagucggucaaucgugcaauaaccguuuuacugauaugagugucucuuugcuuauuacuaugcgccaguugacucauuuaagggugggccaaaaagaaaaguccugcuuuuugucacccaccagaaguccagaagagaacuguguaugcggugggggauggugcaguggaagcaggguagcagacuaccaacuccagauccgaaaccgcacuggacccgccaccagaaucaaaaaaaagcuuugaacggguuaaccgcgcgcgcggccaggggggaguccagccaccgccccuucccagcaccaccucccagaaacccucaggccuccgcuaguucccgaaccucgcgagaccccgccccaucuuuuucugaccgacuucccgcccccuucuuuaccgugcuuggagcgcagcgggguacggaagaaagugggcggaaaacaggagcccggggcacuccgggaaaugugguccaagcacuugaggcagccauuuucuuccggagagggguaggccaggaagccagugaggacuacaaaucccagccacccuuucgguuuguuuuuguucaaaaaaaaaaaaaaaaaacccacacucccccuccucacucuucucucucacacacacgcgggcacacacauacacacacauacccacggcagacacgcacgcauccgagcgucgaaaggaaagccgcgucucgccauccgggcccgcccgccacuaguucgcucuuggguuucccagcagcgcgggaacgcggaggccggagccgugaccucugaccccgugguuaugcggagccgccgcauuccuuagccaucgcggggcugccgcugccgcugccaccg

SEQ ID NO: 1187 - RNA, 542 nt, Mus musculus
gauggcugggcauaaacuugcucuaaaaaccauugauuagguaucuuuuguguagcucaugccccaaaaccagaaggcaguuggaaaugcccugaaguccuggaaugagacccuccaccccagguuggcuaguuugucugagaaaccaccugcgauugacugggcuuacuacagggccaauguggccaagccuggcuugguggaugacuuugaaaagcaguauaaugcccugaagaucccugugccugaggauaaacacacagcccugguggacaagaggagacgggggaugugaagagcugugcugaguuugugucuggaccucagcucaggacccaggagugugagaagcagcuggagaaaacgaggaacauaauucccuuugaccagaugaccagugaugacucaaaugagaucuucccagaaaccaagcuggacaagaagaagaaguacccguacaggcccuaccagcccauugagaaccuaugaagcagccugggacggagccccggccgacaugaaauaaaacauuuaaauaguga

SEQ ID NO: 1188 - RNA, 542 nt, Mus musculus
ucacuauuuaaauguuuuauuucaugucggccggggcuccgucccaggcugcuucauagguucucaaugggcugguagggccuguacggguacuucuucuucuuguccagcuugguuucugggaagaucucauuugagucaucacuggucaucuggucaaagggaauuauguuccucguuuucuccagcugcuucucacacuccuggguccugagcugagguccagacacaaacucagcacagcucuucacaucccccgucuccucuuguccaccagggcuguguguuuauccucaggcacagggaucuucagggcauuauacugcuuuucaaagucauccaccaagccaggcuuggccacauuggcccuguaguaagcccagucaaucgcaggugguuucucagacaaacuagccaaccugggguggagggucucauuccaggacuucagggcauuuccaacugccuucugguuuuggggcaugagcuacacaaaagauaccuaaucaaugguuuuuagagcaaguuuaugcccagccauc

SEQ ID NO: 1189 - RNA, 1050 nt, Mus musculus
guuucuuuuuuuuuuuuuuuuuuuaaguaaacgagaaacggucucuguaagguuuuaaugcucaguuuucacaaacacaaauuucuacccaauuuuacaacauacaauaaaauguucuagucuuuagaauguguguuauucaacucuuccucagauucuuuuccaaucuuaaaaucaccacgaguuucuaccuaaguaauacucuacuguauuuacauuugaauugcaugucuuaagaacaaacggaaauccaugauauuugguuaacucaguguauuuauaaaaugaaaagcucuaucaaaauacuuuucacuggaaaaauaaauagaacagacaauggaucuaccaaaguucauauucgcuuuggcagacgucagugugggacaguucaugacagcauaauuugcccuuaaucccccagagcugaccagcuuccaagcuaacuguuaaauuauuuuacugagauuuuaucuuguugguaucuggcucauuccacaucaucuucagccaagcucugagcacuuacaauucucugacuaauggucggaagcuuggucagaagcaucuggaacacuggugguggaagagucugcuguaacacuugcagcagcugcugaggcuguccacacacagcaauggcauuugucaggugguccacacccuucucguagucaccuugugcuaguaacucuucaccaagcuguaucucuucaaggaagaauuucugaacugcuucagcaucuuuuaaaucagguaacuuggaaagcccagcucucuccuuagcaagcuucuguuucuuucuucguucucgaagccuguucuugaaguuggggucacuccgccuuuugcggucgaaguagauacaguacccgaugaagagggcaccgcacacgcccgcggcgauggcgcuguuccggcccaccaucuucgcucgacuggggcguacgccgggccgcggcagccggccuggcagcgguuagcuccgaccgaucggagcacgccggccgcucgcagccgccugccuccaguccagacggaaaagcggucaug

SEQ ID NO: 1190 - RNA, 754 nt, Mus musculus
aaagcucuaucaaaauacuuuucacuggaaaaauaaauagaacagacaauggaucuaccaaaguucauauucgcuuuggcagacgucagugugggacaguucaugacagcauaauuugcccuuaaucccccagagcugaccagcuuccaagcuaacuguuaaauuauuuuacugagauuuuaucuuguugguaucuggcucauuccacaucaucuucagccaagcucugagcacuuacaauucucugacuaauggucggaagcuuggucagaagcaucuggaacacuggugguggaagagucugcuguaacacuugcagcagcugcugaggcuguccacacacagcaauggcauuugucaggugguccacacccuucucguagucaccuugugcuaguaacucuucaccaagcuguaucucuucaaggaagaauuucugaacugcuucagcaucuuuuaaaucagguaacuuggaaagcccagcucucuccuuagcaagcuucuguuucuuucuucguucucgaagccuguucuugaaguuggggucacuccgccuuuugcggucgaaguagauacaguacccgaugaagagggcaccgcacacgcccgcggcgauggcgcuguuccggcccaccaucuucgcucgacuggggcguacgccgggccgcggcagccggccuggcagcgguuagcuccgaccgaucggagcacgccggccgcucgcagccgccugccuccaguccagacggaaaag
